United States Patent 8,067,671 (METHODS FOR GENETIC CONTROL OF PLANT PEST INFESTATION AND COMPOSITIONS THEREOF) - sequence listing, part 45

SEQ ID NO: 97487 - DNA, 528 bp, Heterodera glycines
  SCN-specific regions: Sequence locations=1-493,515-528
ctaccactagtggatcccccgggctgcaggtacaaaaacgagggtcttgtttccaaagcaggctcgctgatggctttggcaaagtgtcccccttcgacagttcaaattttgggggctgagaaagcgctcttccgagcactcaaaactaaaaaggatacgccaaaatatggaataatttatcacgcgcaattggtcactcaagccggacaaaagtcaaagggaaagatagcacgaaaattggcagcaaaagtttcacttgcgacgcgagtggacgcactttgcgacgaatcattgggcaacggacagggaattgaggcgagggtgtacatagagcaggcgataaaagaggcggacgcgcggggaggggcgaaaaagcaacgcttttctggcgtgaaacaggcaccgaagggcgcgtacactttcaaaaagggggaggtgcatcattatgacgcaaagttcgacatgacgctaaaaaagggaactgaacaggccgaagaaccgcaacaggaagaacaacagagtggaaaa

SEQ ID NO: 97488 - DNA, 479 bp, Heterodera glycines
  SCN-specific regions: Sequence locations=1-41,71-290,326-356,413-479
caagattattcaacatggccgacaacgctcccaagaagcgcactttccgcaagttcacctaccgcggtgtcgatctcgaggatcttatggacctcacctctgagcagctcgttgagctcgttcactgccgtgcccgccgtcgcttccagcgcggtctcaagcgcaagcccttgaccctcatcaagaagcttcgcaaggcccgcaaggagtgccccgagaacgagaagcccgctgttgtcaagacccacttgcgcaacatgatcattgttcccgagatgattggctccgtcgtgggtgtgtacaacggcaagaccttcaaccaagtcgaagtgcgccccgagatggttggccactatcttggtgagttctccatcacctacaagcccgtcaagcacggtcgccccggtattggtgccaccaactcgtcccgtttcgttcccctcaagtaaggatcacatctctcttgtttgtgtttcgcg

SEQ ID NO: 97489 - DNA, 706 bp, Heterodera glycines
  misc_feature (706)..(706): n is a, c, g, or t
  SCN-specific regions: Sequence locations=1-597,619-706
ctcccttttcgtcctttctatttgagcagtttttcccatggttgctttccttaattgctctgttctctataattatttggttgcgaagcaaaacaaatcgaactttgtttgtgaatcacgaaaaagggagaagactaatggccgtgcttggttctggcggacatacgaccgaaatgctcaaattgcttgctgcccaggacgaccttttccctggaaggctgtacgtaattgccaaatcagataacttgagcatagtaaaggttgaggagtttgagcgaacacatggcaataaattctgtgtcagaatcgtcccaagggcacgtgaagttgggcaaaatttgctttcttccctcgggagtactgtcgttgccttcttctactcctttaaactcgtttatcaagaacgagcggacgttgttatcagcaatggacctgcaattgggcttgggatttgcctttctgcctgtttattcgattttctccggttgtatcgttgccgtgttgtctttgtagagtcaatttgtcgtgttcaaaagctttcactaaccgggtggctaatttactatttccgaatttctcacgcgttcatcgtccaatggaagaatttgcaaaagaaatacccaagaagcgaatatatgggcaggctcatttaattttcatgcttgctgtaatttttcagctaataaattggtactcatgcaaaaan

SEQ ID NO: 97490 - DNA, 556 bp, Heterodera glycines
  SCN-specific regions: Sequence locations=1-451,473-556
accctaagcagcaattgtgcgcactttttcgtagttccattcctcttttagagcccagaatcggctgttattctgtgctcgctcaaatgtcaactgaggttgaaaaggcgcagaaagcgaagccgggcggagacacaatcttcgggaagataatccgcaaggaaatgccttcgacaattctttatgaagatgacgaggtgctcgcgtttaaagacataaaccccgaggcacccgtccattttttggtcattcctaagaagtgcatcactgctctgtccaacagcgaagagcaggaccaagcagttctgggcaaactgttgctgacagcgaataacgtggcaaaggcacagggtctctccaacggatatcgcattgtgatcaacaacggtcgccatggatgtcaaaggacttctggcacttttctacacactttgttggagaaatttggctattttaaatgattactgaaatgacattaatttattattgcatcatactatattccccagataaaaagtgcaaaaatgaataataaaatcggatgatttgtaaaaaa

SEQ ID NO: 97491 - DNA, 374 bp, Heterodera glycines
  SCN-specific regions: Sequence locations=1-374
aactcttttaaaatggcaataaaattggaatttgccggagggccttcgcaatttttaatgggaaacgcgagaccgaagctgaaaatgacaatatttcgactgttcgtcaattgttgcggtggctttcggacgggcccttgcggggcaatgatcggtcggaaatgctcatccaacgcgacaccgtcagaccgggcgttttggtgctgatcaacgacacggactgggaaattctgggcggattggacgctcagctcaacggcggagacaaagtgacattcatttcgactttacacggcggataaaacagcaaaataattgaaaaataattcattcgttttttgtccatttttgcagaagcataaattataattttt

SEQ ID NO: 97492 - DNA, 489 bp, Heterodera glycines
  SCN-specific regions: Sequence locations=1-489
ggtttcgttgcaggcggagcgcgaatacatcacacgacgggtgctgacttttgtggaactgaaggagacggtctgtgccggtggagatcaaggatttgtggtgattaatcaaaagggcattgatccgccgtcgttggatttgttggcacagcacggcattttggccctgcgacgtgccaagcgtcggaacatggaacggctgcagttggcctgcggcggcgaggcggtcaattcggtggacgacctgacgcccgatgtgctcggctgggcaggcagtgtttatgagcatgtgctgggcgaggacaaatacacttttgtggaggagtgcaccaatgcgttgaaagacggtgccgttttgcccggcgccggtgcatttgaaattgcgggatattgtgcactgaaaaagcttgccgacaatgtgaaagggcgtgccaaactcggtgttttggcttttgctgaggctttgttggttattccgaaaactttggc

SEQ ID NO: 97493 - DNA, 466 bp, Heterodera glycines
  SCN-specific regions: Sequence locations=1-22,44-152,174-343,368-466
cagcaaaatttcacactgaaaatgtcttcttcgtccaccatttttgttcttctgctgataattgccatttgcctttcattaacaattgccatgccagcagtggacaatcaaattgaaagtgttccacttcggcaaaagcgttatggctacggcggcggtggatttggcggcggatttggcggtggaatgggctttgatggctgatttggacgctgagccgtgaagaacattaatacgcattgtgaatgatcagaaatcgatcaatataaatgatgtgcgacagaactctgtttttaaagactttcaagtttataaaataaattagttagcggaaaatttttttaaaaaaaaaaaaaaaaaaaaaaaaacctcgagggggggcccggtacccaattcgccctatagcgagccgaattacaattcactggccgtcgttttacaacgtcgtgactgggaaaaccctggc

SEQ ID NO: 97494 - DNA, 569 bp, Heterodera glycines
  SCN-specific regions: Sequence locations=1-56,78-569
agtaaattgaaacccaacattttcaccaaatcagcaaatgtcaacgaatgacgttaaggaagcggctgcctccactgttcttcctccgtcttcaagtcaaagcatttcaatggcttcttccgcggatgggtcaccgcttagagaggaaaacttcgtacattcattgaaatcgcaggtggacggagaaaacatcgaggaaatcattcaaagccagaaaaaagcgttggaacgttttgagaagaccaacgaaatgctggcgacgtgttcttcgctggcagaaaagcgattggatcgggcgagaaaagactttgccattggaagggaaaagatttgccgagctaaatccgacttggactcaatcttccgacggatcgcctccttcaaacaaacattggccagcaattacccggccgaatttgtcgcagcgcaaactgactcgcctcacaatcagaatagtgactgcatcaatgaacacaaaaagcaaacggatgactaaatgacgtaatttccgatatttaactcttttagaattattttttacgaaaataaattttctttcgggtaaaaaa

SEQ ID NO: 97495 - DNA, 127 bp, Heterodera glycines
  misc_feature (9)..(9): n is a, c, g, or t
  misc_feature (12)..(12): n is a, c, g, or t
  misc_feature (26)..(26): n is a, c, g, or t
  misc_feature (46)..(46): n is a, c, g, or t
  misc_feature (72)..(72): n is a, c, g, or t
  misc_feature (76)..(76): n is a, c, g, or t
  misc_feature (79)..(80): n is a, c, g, or t
  misc_feature (85)..(85): n is a, c, g, or t
  misc_feature (102)..(102): n is a, c, g, or t
  misc_feature (110)..(110): n is a, c, g, or t
  misc_feature (114)..(114): n is a, c, g, or t
  misc_feature (120)..(120): n is a, c, g, or t
  misc_feature (122)..(122): n is a, c, g, or t
ggggggganggncggggggggggggncggggggggggaggggcggnggggggggaggggggggggggggggngganccnnggggnggggggggggggcaaanggcggggnaggnggggcngnagggg

SEQ ID NO: 97496 - DNA, 180 bp, Heterodera glycines
  SCN-specific regions: Sequence locations=1-48,70-180
atttcttgcttttggccttatggacaaatgttccatttttgcaagcttcatttgtaatatttgatcatttccaatatctcccagcatttgtctctttcacgcttttgtccatgttttaaacacagacgatgcctttcactcactcagaattaaatttttaataaatcagattctcgactt

SEQ ID NO: 97497 - DNA, 189 bp, Heterodera glycines
  SCN-specific regions: Sequence locations=1-189
gcctttaggaattggacaacaatcaggtcaaaatggaaacgatcctagaagagaaaaaaggcaccggcggaggagggaaaaacagcgcatgaattgatgatatatgttgaaatattttcttgtttatttggagatttcaaatttatatcttttatttatcaatgttccgaaaattgatacggaaacagc

SEQ ID NO: 97498 - DNA, 291 bp, Heterodera glycines
  SCN-specific regions: Sequence locations=1-175,197-248,272-291
gtcatccagcgatgccggacagcccggcgagccaggcaacccccgtggagcgggcgagcccggacaacccggagagaagggagagcacggacactgcgaccattgcccaccgccacggactgcgcctggctattgagcattgggaagccaattttggagatgacaattgggaagaggagaagaaaagtgggagaaaaagcaatgaaagacgaacaaaaacaatttgggaggaaaattcattcattgacaatttaaaaagcaattaaaaatgataatgataaaagcaattcc

SEQ ID NO: 97499 - DNA, 529 bp, Heterodera glycines
  SCN-specific regions: Sequence locations=1-381,403-529
gtttttcataagtggcgtcagggcgtgtcaacggatctcaatgcacccttacaaacatcagctggctgctgccaatgagtgctgcttcatctatccgttcccggcttatgggctgtcctcccgccaactgatgcgtgtcctctccgcttggctgatgccgtctttttccgccgacgaggagggcccgtcgatgaacgtgccctcctgcttttccgatattgactcctcgtttgaatgcgcttcattttctgtacccatggtcttctcccacgacgaatggtttgtccaatgtgtgcccgccctgggcgaacagcttgacaaacttttgctcctgtcccaacaccatttttttataggaaggaaactcatgcctccaacaacgacggaatacggacgacgacggggagtgtcatgtgcgacgggtgctgcgccatttgctcgcgttgaccacccgaattccgatgcggacacagcccagggccgaaatgcgactgttcattgcggttttcggcactttgctccgctggtc

SEQ ID NO: 97500 - DNA, 765 bp, Heterodera glycines
  SCN-specific regions: Sequence locations=1-371,393-615,637-765
caaaaccgtttaattggcaaaagaatttccttcacctgtcactttggcgacaggtggatgattgatgaccttcccgcggcgctgcgcggcgcgggaaaaaaacacccgcaacaatttgggaaatcggatttggtcaggcggcaacttcaaagtggtccaataggttttggttttgaaacacccctcccccatcgtggattttttatggggcggcaaattcaaagggctgcgccttcccataggcacgggctcgtgcgggaaacacccgcaaccaacccgcaaccttttgggactatatactactcccgccctcacattttcgtcctataaaaagggcacccttttcattatatgctcacttccacatttccattcattcatttctgctgctgcccaagcctcaacagctgcctcttccgaggcccagtgcttctgccagatttggcaggcatgcttcttcggttccgttgcgtcgtcagctcgccattcattttggcggcgacactccgccatcacttgcaacagttcgactccccactgtccagggagatttcggagtccatttatgtggacaatgtactcatcgagtgcgagacggtacaggaggccttagaaaaatacaaattttccaaggacttcctacaacaaggatgcttcaacctgagggaattcatctctaactcaaaagtgctgatgaaacaaatccctcaggaggatcagcttgataagccgaaggccaaagtccttggccttccttgggacacc

SEQ ID NO: 97501 - DNA, 494 bp, Heterodera glycines
  SCN-specific regions: Sequence locations=1-494
gtccaattaagccgtttgaatttcggcacttttcacaatgattgcggcattttgttcgacaaggacggcgggcagtcgaattgtgaagggcattgtttgctcctccgatttctcctcccattcgctgtgcggtccgccgctgatccgttcgccctttgacaatccgttgcgccgttttgaaccgcttacacccaacaaaagcgccgacggcacggccgacggtgttgcgtcattgtcagccgagcaaagtggcacgtcggcccagggcatcggtctgaaggagttcagggagacgaccacagtgcaggcgctgcgcgccttcggccaccaattggcggacgcgatgctgtacttgcggaacgccgtgcgtgccaccgcgtacatgccgttggtcagcgggcgacggaatgcagcggtgattatgacggcacaccaaagcacagcaacggagacggctgttggaagcggtggcacggcgccgccgacgacggggg

SEQ ID NO: 97502 - DNA, 489 bp, Heterodera glycines
  SCN-specific regions: Sequence locations=1-489
atttatcttttaattccgcaaaatgtcaaatttgaattttgaagacaacccttaaagcgtacaagtggaaattcaatggaagcaatgcctttataatccgatcgtcgctccgtttgccgacgtcggctcttacccaattttcactgacgaattcaaagggacgcgcaagtgcactttggatgtgtacgttcagggaaacttagagcatttggacgacaaagttgtgagttatggcagttctcatggcacttttcgtgccatcaattcatttgtctcgagaatcactcaattgagactcattgcttccatctcgtcccccacccaaaggttttcctcaccgttcatgacgttggcaagacgtatttgtcttgcgtggaccttgccaacagtccgacgctctctccgctggtcggtcagcgtgccgttttcctccacgtttctgtgccagggcaagcgcccggcgctgaaaattttgtcggagacttcccc

SEQ ID NO: 97503 - DNA, 185 bp, Heterodera glycines
  SCN-specific regions: Sequence locations=1-57,96-185
attcgctctccccataaatctgggcgcatcgcttcggggggacggctcgtataagccaaaaaaaaaaaaattattttgaaaaaaaattattaaaaggaaatgactagttactatttgaataggttatttcgcgtccgttcaatgtccctgcaaagtttggtgtgcgtgcttctgatcagtttctg

SEQ ID NO: 97504 - DNA, 671 bp, Heterodera glycines
  SCN-specific regions: Sequence locations=1-671
agccatgaagtcgggctaccagcgagagctcacttaccggcgtcctgacaattcgttttccgccttcggtgagtccgatcaacatggctccacatggctgaccgcatttgtgctccgctccttcaagcaggcacaggcgtacatttttgtggacgaccgagtgctcgaggattcaattgccttcctgatttcgcaacaactggacaatggcgcttttgttgagcgtggcgaagtgcaccacaaattgatgcagggcggcgcatcggagggcggcttcacattgactgcatatgtgctgattgcactgttggagaaccacgtgcagaataaagtgacggaattggcacgaagctatttggagtcacacctcaccgacttcaaggaggacccgtacgcgttggcgttgtgcacttacgtgctccatttggcgaacagtccgaagaagggtgacgtgctgaagatgctggaaggccttcaaatcaccggcgccacagatggcatggtccattggacgacgaaggtgtcaaacggtgccaaagatggcactggtggagcagctaaaaatggtggcggtgcggcccgggacaccaaccagtacttcttccaaccccagccggccgacgttgagatgagcgcttatgccctgctcacttacatgctgctggacaaca

SEQ ID NO: 97505 - DNA, 823 bp, Heterodera glycines
  SCN-specific regions: Sequence locations=1-823
gctaacatttattgggccgttctgttgcagctttggcccgcattgtccttggaagacaattccgagaacaaacaaagcatcatccaactcactgatttggcccgtgatctcattgtttccaacttttcatcttttcaaattgaatattttgttcgttttttctgatttttctgtatttatttatatattttagcttcccgactccgttatgcctttggctgaacaactgttgtccgattaccccggcatttgtcataaaccggcgtggccattgcccgacaaacaaaaattgggagaatttcgggaaagggaagcggagatatgcggacgaaatcgcgaaaattttcttgccttggccgagaagttgctgacaatcgcaaaagacgagaatttgcactggcggcaggtcgactttgccgaaacgcttctctcattgctgcttcggaaggactgcgacctgccggacggtgttgtactgcacttctttaagcgacttactgctgccaccataaacattcgcaaaattgcaattgacttttgtagttcatggttgaaaatacacaggcaaaaggcggttaaggaggacgtcgttattccggattgccctccgggaagggggccgggagcgcaatggccaattactttcggcatccgtagcgacaacaaattccttctcttcgacgcagcaaatgcaccctccaatgccgacaaatgggacagtgccaatttccactcgaaggtctatccgggcttttacacttggccaagcaaattccgtgtgtatgcgccaccgagtgaacaaaaatgggcaaatcgtgaattc

SEQ ID NO: 97506 - DNA, 672 bp, Heterodera glycines
  SCN-specific regions: Sequence locations=33-149,171-580,602-672
ccgggctgcagattcggcacgagggactgttccatgtcccgctgcaatgagggtcttttctcctaaggactcttgaggtggcgattgggaattctttgcacacacggtcgatgacctctatcaccgtgctgtgaagcatggtgatttcatcaatgatgatgagttgtgcctcacgaatccgtcggggaaagaagctctcaagcggaatgcttggaagcctgtccagtgacacatctctgaccaggctgaaggtggaatgggctgtcttcccatacggcagcaaaaaagctgcacacccagtggatgccttaaggataacgtccatcggaccacaagcagggctcggcttgtttccagcggaaacgctgatgcgaaagccttttttgaacacgcaaagaacgccctggtggcgttttcggcctgagaaatatctcatcgtcatgacaggagcccgccgctgggcatcttttaaccgcaactgttgaaaccgtataggaacggagccaattctccgtttttggcacacagaccattgttattgagctcaaacgtagccgaactgccctgaggagctcgtcctgggctgacctcatcagaaatgagttaaccggatcggatggcaacagagtcaggatcgtgcccgcggatcccgagcatttgagtcccgatggc

SEQ ID NO: 97507 - DNA, 767 bp, Heterodera glycines
  SCN-specific regions: Sequence locations=1-165,187-504,526-767
gcagaacctttaggaattgggtcagtctggggggcgggcgatgcagcgctttgcagtgactcgtaccctccagcgatgttcgtgcaagacccgtgcacgcggctggagacctctgccgagggcgagttggtcccgcaacgtcgcgagcgttacgtgttccgacccgtgcttctgcgcgttctcgagacgtacttccaaaaatgcccatttccggacatagcgaaacgcgttgagatcgcaaatgcctgcaacgcgcacttgcaggtggacaaaagaggtgtccaactgatgccgaaggaggtggtcactccacaagtaatcgccaattggttcgccaacaaacggaaggaaatgcgccgacgcatgggagggacggaagcgggacggagtcggctgaacagtttgtcggcgggccgctccaactcgccatcgtcgcccaactcagccgcacactctcgggagggccccttcgagttgcgccagaataaccaacagagtggcaacgtggacgaggcagtgctggcacattgtgattttctgcaggcaatgccaatgtctgtccccactgcgtccaatcagcagcaaatgcttctgatcagtgatcagcccgagtcagtgccatccgcagccgacctggcccttgtgctgcccccgctggggccccctcaccacccaaactgctgcccacccgcaactccgctgctgcccccaaatgttgtgcagttctgcccttccgtggaccagcaactgctccatctgctccaggc

SEQ ID NO: 97508 - DNA, 481 bp, Heterodera glycines
  SCN-specific regions: Sequence locations=1-22,45-131,164-481
cttgagagattgttacgtgatttttctttccaaatttctttgccttgaaaatgacaaaaaaatttctgttaataatcgaagcttaccacaacagaatgacactttccttcaaattgagcaatgcgttagggaaatgctgttggaaaaagaaagcagaagagatttgtttcattgttcccttcgtccggcacttggtcatttcgtcgctcttttgcttcattcttttggcaatgattccgacgttaatttacggttgagaagtggcgaatttctgtgtttgcttactcagttggattttgccgatgaatccgctgattttgttgcttttgttcttcccggggttttttcgggctgtcgtcagattctcttaaatgttctgcccaatttgcattcaattgacctcgtaaggtgcgcttgtgaactggtcaccaactccatttgcatttccttctcaaaaatcaatgtcaccgattgtttgagt

SEQ ID NO: 97509 - DNA, 479 bp, Heterodera glycines
  SCN-specific regions: Sequence locations=1-3,46-479
gaaattcaaaacaaaaacaataacatttaaaactctttggtgcctaaatcaccagctctaccaaaatgaccttaacgatggatgaactgagaaacaaagtccaaaatggccaaattagcaccgttgtcgttggctctgtcgatttgcacgggcgactgattgggaagcgattgacggcacggcattttgttgaaatggcgcaaaaaaaggacaaaatgtccatgtgctattatttccttgcgatgacaattgaaggccacgtggccgaagggttcgaagtcgcgcggtgggaaaacggatttggcaacggccttttgcaactcgactttggcacgctctgccgcaccccgtggatggaaaagacggcactgataatggcggatatgcatgatcaccgcgatttgcctttcttttgtgccccgaggacaattttgcgtcgtcaattgcaaaaactatccgagaagggctttcgggcgaag

SEQ ID NO: 97510 - DNA, 151 bp, Heterodera glycines
  SCN-specific regions: Sequence locations=1-151
caacactcttcaacgttgtcatgcgattttgagaggcggaaagcgggcttacaacagcgatggggtcgacgagtgttcgaactccggccggaggtctttatttgttgttatataatgcccaagcttttctcaaaattttgagaaaattaac

SEQ ID NO: 97511 - DNA, 185 bp, Heterodera glycines
  SCN-specific regions: Sequence locations=1-185
atttcctttctgtgacaacaaattggccacttggaaagaaagcgaacttcaggtaaaaagaaaagatttggccgactgatgggtcaccaattggctaacagatgatactgtgcccgaccaatgagactacggtatgcacaagtgttgatgggttcatatgatcaatgaatgattgatgattattc

SEQ ID NO: 97512 - DNA, 487 bp, Heterodera glycines
  SCN-specific regions: Sequence locations=1-487
tgagacattatcacttcactcttcttcaatttccaattccgatttttctttgacttttttctccctccttttcatcactttttcgccatccttcccctcgtttgcgtcaaataatcccatcacgcaataaattgttgagaagaccctccttttggtcacaggaaaggatttgagggacggcaaggtgggaaacggcgggaactccgacccctctccaatccgatccatcgttcggcgtcatccgcccttctcggcgcgctcgaccactcctcctcccttttctcgtcgtctcggcttttcggcgtctccgctttttgagcgtgtctcgttcggtttcctccccccccccccagtttgtcccctcccttttcccgacaaactttttggtgccacgacccgggaacacaaacccttcgccgtccgccgaccatcttaagcctccggcactcaactcaagtcgccagccgccccctcttaggctcccgac

SEQ ID NO: 97513 - DNA, 790 bp, Heterodera glycines
  SCN-specific regions: Sequence locations=1-40,121-246,271-593,615 -681,703-790
ctgttcgtttaaatgccgatttgtgcccccgcggctgtgccctcttccttctcatctctctgctcggtctcctctccctcttcttcgtcctcctcttcctcgtattgcaactcctccttcaatttcttgcgcatattcaccgccgcctttcgcaggggccgccccgtctccgtccgctcgacttccctctccactaaatgctgtcttttaatgactttggcctcctcttttgtcacctaatgtctcctcgtcttcgtcgtcttcctcttctgaagaactcgcttttggcccccattttctgtggtgcatttggcttttgggtgcctttgacttttttctgctcgaaggcccagcttcgcagtcagtgtcactcagttgcaactcattttcatcatcgctactgctcgacatttgtctaattttcatttttggccggttattaggcgggaaaagtaacctcttccgtttttttgctcgtccgattcgttttccgacaatccctttcttttttgctgaaggcgtgtaatcgctgtccgaatcgtcgttgataaattcgtcgtcacttcttcggcgtccctggaagccaatgccccttaaaaatgttttggtacttttttgtggctctttgccaaatcacctcgcagatcgcctttccgagggaagatactcgtcctccgatggttctgggtcctcttcattttcatctgcactgctcgccttccattcgtcctaatttgctatgtctccggaatggcatttctcactaaccgtgtccgactcggacgcattg

SEQ ID NO: 97514 - DNA, 714 bp, Heterodera glycines
  SCN-specific regions: Sequence locations=1-628,651-714
cccctccgtaaatttgatcaattgtccctcattgatcatttgtcccccatttcaagttgatcaattgtcccttattgatcaattgtccctcattgatcaatttcatttattttgatcaatttcaccccattttatttgaccactagtcccaattaatttgatcaggcccctccctctaatttcaattgattaaattgtgcaaatttcttttaatcagcgccacctcctcctttttgtggtcgaattgcgcttttccttttgatcaattcccacatttttttgatcttagtgcgaacatttcttttggtcaatgccattctccattttattgtttgatcaaaattgcgcgcaatccttctaattatttacatcctttcccaaatttatttttgatcagtcccactctgaggggctcacaaatggcacctttcagtcaatcagtgccatccctttttctgatcaaatgcgcacattctcttttgatcagtgccatttccccattcttctcttcatcaaattgccccaatttattttggtcaatcgtcttttggctatttcttttgatcagtgtcacccctctccatttatattgatcaattgacgcatatttcggctgatcagtcccatcgccatctttgatcaaattgtgcaaatttatttgatctgtcccattttccccatttccatttgatcatttgtaccatttttcattgt

SEQ ID NO: 97515 - DNA, 487 bp, Heterodera glycines
  SCN-specific regions: Sequence locations=1-487
ctcagcttctgggttggtttacactgctttgcttaattacctattctctacgctattgccgtctaaggaccgtttactgagtatgtgaatgccaatctcacactgtcaaatccctcgcgaaaggacgtttatttcaaggtgaaaacgactgcacctaagttttattgtgtccgtcctaactctggtgttatcaaggcgaatgataaaacccaaatcaacgttatgctgcagccggttgaatcgcctgagactctcgagagtgagcggagccggcacaaatttatgattcagactgcatttgcgcctgatgacgagcagcttcctgtggaccaattctggaaaactgttgacccaacattagtcatggattcaaagctccgagtggtgttccagcgaccttttggatttggcgatgaaaacaatcgggacgaaaccaatgcgactggtccgtttttcaatttcaacaaaacgggcgaaccgaaaaacg

SEQ ID NO: 97516 - DNA, 668 bp, Heterodera glycines
  SCN-specific regions: Sequence locations=1-42,65-260,282-668
gctgaatcttgtcggcaccgacgcattggcgtcaaaagaatagccgccgccctgcgggaagcgctttgacctctccaaattttcctctctcgtgcaaatttccatcaaatggttaagctttgcaactcgtgcctcgccaattcgttgctgatcagaaatgctgaccaaaagaggcgaattgcgggtattcatttctgaaattgttaattaaagttttcaatcagtcaaagaatgacaaaggaccttccaatgtgtgtttgaacaaaacaaacacattcagacatggtttattgtcgccttggtcgtccaatggtgtagaaaatgcctcaaggtcagtctcttcctaaaaatgccgaattaattgaaaaggatatttctgtgctttttttgcgttgaataaacacacctcaaaatggtggtgctcttccgagtcggtggtttccgatgcaagggaaaggatgtcgcccggtgctccctctgtctgatcgtccatgcttttgttggtgctcgacttccttcgcgtcctccgttcttttcgctcatttcgttcgtgctccaatgccatcagatattgcgagttctcttgaaatttgacgtttctcttttgctaagggtttcctcaatgtgctcaccttcgtccacatcgtcgtctgagtctttcaactctc

SEQ ID NO: 97517 - DNA, 340 bp, Heterodera glycines
  SCN-specific regions: Sequence locations=1-26,51-340
tctaaccctttcgtagcttcatttacaaaaaaaaaaaaaaataataatttcctctgtcgaaaaacggctttggttttaaaattttaaacttttcctttgggctatcgaatgaacagaagagcatttgattggttgtttcttggccaagttatggagcattgaggaattcaaaaatttagagtttaacattttgaaaaaaagccggatttactagacaaaaaatccaggcccaggaaaaatccatgttccctgaaaaagggcctagaccttggccaggaaaactacaggcctgagtacaggttcaaatcaaactcaaaaaatttccttttgatttaaaatt

SEQ ID NO: 97518 - DNA, 662 bp, Heterodera glycines
  SCN-specific regions: Sequence locations=1-34,57-622,654-662
atttactgtccttacattccatcctattgtttagaaaaatttaaaagctttcattgatccaatcggattaaagcatttggtcaaggaaatggaaaaatttatgctagaaagaaaagccacccaaaagaaaagtgatgatgatagtgcacaaacagactaatgatctaaaaactcttcacttcgtttcctcactctgatcaccattttgacttgtgatcagtcttttttcatctccgatcactttgctttgtcattgcgtgtaccggttttcgacttctgtttcctccattttgatcagttcgttctgtccgcctttgtcagttttggtcactccatctttttcctttttgtccaatgatttctgtacatctttcatcagtttgatcactttcagtttggcctcctcacatgggtccgttgctaccatttgtttttgagttttgtattccattaacaaaacgccaatatatctttcaagtttcagagaatttccttggtcgaattggcgcaataaaatttctttcaatgttacaaagtcttttttcaaagaataatccggttcattagtaacttttttctcgtgatcctttccaacattgcaaattgttgaccaattttcaggttttaaaatttttcaaaatttaataataaatcttagcttt

SEQ ID NO: 97519 - DNA, 156 bp, Heterodera glycines
  SCN-specific regions: Sequence locations=1-156
gtgtttccgttcaatcaaactatttttaaaacccaaataggggttcaatcttacaattttggaatttatgaaagtgtcgtcgaaaaaatgctaaaattggcacgattttgtggatcagcggtcgcaaatgtagggacaattcttaggaggacgaag

SEQ ID NO: 97520 - DNA, 511 bp, Heterodera glycines
  SCN-specific regions: Sequence locations=1-511
ccaagtttgagatgggcagtaaacgccgtttcttacttcattttagtcaggctcaccagacttttagacgtgcggagttcgatgccatttgtcagattaagggaatttctgtggtgcccaactctccttcggatgggatacacattcaatcgtttgagtttcaaaacgacgaatttgacgtctttcggctgttggaaagggctgtgttagtgaaagcggcgtacgaactgatcgccgagggggacgggcatgagcaagtgatggccaaattggcatccgatccgagttcgtcgcttgcgcgcttcgactccgccgatcagtcgtggtctctgctcgttcgtccccatcaaaagaagcgcagcggcgattacgcccgatcggttgttgagcgttacactgccattccgcttctgactctcgcgccagttgaccttgcgcatccgagcaatgtgttctcggtgatcgaaatgtacgaggcgaacggacggagggaaacgccggacaaagttta

SEQ ID NO: 97521 - DNA, 304 bp, Heterodera glycines
  SCN-specific regions: Sequence locations=1-304
cctcaccctatcttgcaaacattctgtttacatacagatacgttttttcctgctcgatgaggccgattctttgcttggtggccaaagcgactcggcccaaattgtgcacgaattgcactcgcgaattcccaaatattccgaattcggtgagcgtttccaaatgatcgtttgttccgcaacacttcacaacatggcagtacaacggctggcggtgggtcgataattcgtatattcccaaaacataaaaatgaatttttttacaatcagactcagtatatgtacttcccccaatggattgatctga

SEQ ID NO: 97522 - DNA, 235 bp, Heterodera glycines
  SCN-specific regions: Sequence locations=1-125,162-183,205-235
gtttgactccgtttcatttccattcacgggatttgccttgccattttgaatcgaaacgggcttaaatttaaacagcaaataggtaataattaacgatagcatgtccgtacattagcggacgctttggccggctgtgccttctgggccggttttttggccggcacttcgtcgtcgtctcccgaactgctcgactcggacaccgtcggaggtatggccttggtcacaggaatggtct

SEQ ID NO: 97523 - DNA, 473 bp, Heterodera glycines
  SCN-specific regions: Sequence locations=1-270,293-421,444-473
aattttcaatgataaaatgctattctaaaaaaggtcaaacttcacagctctttggtctaaaaaaaacccaaacaaattaaatatattcaaacgaaagaataagcaacaaatcaatagatcagccaatcggagggaagggccgcccctcccgttcactcccggggcccctctttataagcccgggaattccttcccaggcagttcagtcgcgacgatcagctatatcatattcaattccccatccatcgatctcgtcccccttctccagcccagggagagctcaacgcgcgggctacggcccgggatggacaagaggggatccgtgggaccggcacaactctaactggtagcaccgatggttctgaccaaatcctgggcccaaggatttggttcggagtggaattgaatgggtgctgatcaccccggggagggctttggccctgagctcaacattccggccgatgccggccaac

SEQ ID NO: 97524 - DNA, 251 bp, Heterodera glycines
  SCN-specific regions: Sequence locations=1-251
cctttctctaaaggtaaatgaccatgtcggaggtgccgaaagcagaactttattgagcagagtttggccaacgtcgtcgacaaagttcgggtcaacctgaaaccacgagtctttgagaattacggtttttagcaaccgttccattttcgacggcatcaattaacgcgtccgtgtcacgcaatcgaattgcgtcaattaaattgcgatgcgttttgtcaaaagcgggaggagcaacttaaaagaatttggat

SEQ ID NO: 97525 - DNA, 808 bp, Heterodera glycines
  SCN-specific regions: Sequence locations=1-507,529-808
gaggccgtcgaaaccgtagggacggatggccaccgtacgagcccgccttcgtggcaggagccgagcgggcatcagccgacttcgtccgcgtccggcgccgcccatgcgttgcccccgtcttcctccaaccgacccatccgctcgcaacggacgccaatgaaggaaatcatcacgctggacgacccaaccgagctggacgagtttatggcccggggcgaggagcagtgcattcacgcgatgcgcgcgttcatcacgcaattctctctgcgacagaccacggtggccaccatgacgggcgtgtcgcagccgtacatctccaaactgctgaatggaaaccacagggagctgtcgctgcgctgtcgaaagaacatctactgctggtacttgaactgccgcagacaccccgagaaattggcgatgttcgtgcaagacccgtgcacgcggctggagacctctgccgagggcgagttggtcccgcaacgtcgcgagcgttacgtgttccgacccgtgcttctgcgcgttctcgagacgtacttccaaaaatgcccatttccggacatagcgaaacgcgttgagatcgcaaatgcctgcaacgcgcacttgcaggtggacaaaagaggtgtccaactgatgccgaaggaggtggtcactccacaagtaatcgccaattggttcgccaacaaacggaaggaaatgcgccgacgcatgggagggacggaagcgggacggagtcggctgaacagtttgtcggcgggccgctccaactcgccatcgtcgcccaactcagccgcacactctcgggagggcc

SEQ ID NO: 97526 - DNA, 580 bp, Heterodera glycines
  SCN-specific regions: Sequence locations=1-212,234-255,277-580
ctcagagactagctaacaaaatcagcataggcttggacttccgtaccaattattatttttataatgggtttgttaaatgcaaaacaattcacaaaagttgttttaactccattcagagatgagatagaaaaaaaacaaaaataagtttgaagagccctcgaagagctgcaccggatgcgagtgccgccgttgctgtacgctcaacggttgctgtgcaaagacggaaaattgctaaatcagaaaaaaccaaatattatcaggaatacactctcccatctcacccgtagacaaaccgaatggtatatgttcgaacggcaagttgactaccgtacctaattaatatttttgggatgccaattgttaagtgcgtaactgttatgaaaaaagggtacgaaaaactgtgataaccccattcagagactagctaaaaaaatcagaataggattggatttgcgtaccaattattatttttataatgggtttgttaaatgcgaaacagatgacaaaagttgttataactccattcagagatgagatagaaaaaaaacaacaataggcttggagagcccttgaagagctg

SEQ ID NO: 97527 - DNA, 498 bp, Heterodera glycines
  SCN-specific regions: Sequence locations=1-259,281-365,387-498
ccaagtttgagatttattcgtttcgtttttgacctgtatttccatcacaatcaactgaaaaacggcaatggatgattcgttatcctctcgacggctcccttccgacttctccttctaaaaatttcatccaatcttctgtataattttttctatttccgtatgcttaacagctgtaaattcccaaaaatcatcctccaaggtagaacattttggccgacgaccaaatgggaaggaaactcccagccgaacttttgttcgaaattgttctctgtgttcgaagagaacatgcccacgcgagcatttgcctctcgtcccttgttttatgcaaattaatgctacctcgtgcttcattatggcggaaaatttgggtttcagtatgattttggatgtttccgctttttttttttaattttcgttgttgctgtttggacttgtctttttatttttgcactaacaccattttctgagctcgtgagctttcttcaattctattatttt

SEQ ID NO: 97528 - DNA, 287 bp, Heterodera glycines
  SCN-specific regions: Sequence locations=1-287
cttcttcttttagtcagctaattaaagtaccataaaaaaaaaccacggccttctttgaggaaaattaggagaggaattgccacgacacgagacaaatgacggaagcgaagaggtgattagagtaactgtaaaaacaatatacgaagttacggtatgccataaaataaattggcatttgctttacgtgagatttgccaagaaaagcgcggccatacaaagcaaaaaaatggtcaaaaggcaagtggactcgaccagcacagcgttggctttgtattgcaaaaactgtg

SEQ ID NO: 97529 - DNA, 745 bp, Heterodera glycines
  misc_feature (612)..(612): n is a, c, g, or t
  SCN-specific regions: Sequence locations=1-477,499-745
gtttttccctttcaggcataaagcggcgggccaagcactgtttgaggaactttgtaggtatttgaatctgttggaaagtgactatttcggcttggagttcatcgacagctatgggaacagatgttggctcgacaaggacaaaagcattttgcgtcaaattatggtcgcccaatcggacgcccgctttttctttgtggtgaaattttacacgccgaacccggccgagttggaggaggagtacacgcgctacctttttgctcttcaaatccgtcgcgatttgtcccgtggtgagctaatctgtaccaacgagaacaccgctgcactgttggtggcactgattgtgcagtcggagtgcggcgacttctctccgttggactatccggacgccggcgcctatttggccggcactcatttcgtgccgcaccaaacgcccacttttgcacaggccgtgttggagcagcaccggcgactgattggcatggagccggccgaggcggactttgttctgctggagacggcacggcgctgcgatttctacggacttcggctgcacccggcgagagatatcgaaggcactgaagtcgctttggctgtggcgcatatggggattanagtgttccaccaaatgaattgtgtcaccacattttcatgggcaaaggtgcggaaattgagcttcaaacggaaacggatgatgatcaaagttcatcccgacagcttccattctacaaagaaacaatcgaatttt

SEQ ID NO: 97530 - DNA, 171 bp, Heterodera glycines
  SCN-specific regions: Sequence locations=1-171
aaaagcgaaaatgattccaaattatgagttaaaatggcatatttggccttttaaactttgcttagtatcgatatatagattcaaatcagatcataataacaggcatgtatgttagttaaaatgacaaaaatgtgatctgaaattgttcgtttttcaaaaggcctgagaaac

SEQ ID NO: 97531 - DNA, 688 bp, Heterodera glycines
  misc_feature (42)..(42): n is a, c, g, or t
  misc_feature (552)..(552): n is a, c, g, or t
  SCN-specific regions: Sequence locations=1-2,34-156,188-188,223 -253,277-307,343-618,675-688
gtttcattgccttcttcctccagaggttgttgagcacgaacngtgaccctcagaaggcctgatcggagcgtaagcgcagcagaactcgaacagaagcagcagagaatctgtagctcatccatctcttctcatcttcatcctctacttttgtccttctccccatcgccatgtctgaagaggaatcgcaatattccgacgaagaggttgaggaggaaagcattgccgcggatgaagtgagcgtgcaggaaccggcaccgcccaaagaagaggagccggcgccggaagccgaagcggaggcaccgccggcggaagaaaaggaagaggaggaggaagaagagccggggtcatccggaggggcaggcgatgcgccgaaagaagaatttcgtcgcaccagtgttacggagtccgtcgcgccgacggagcaacttcggcgcgcgccgccccctcaggcgaagccggcagaagagtcaatgagggaggcggaagcggcgatgctggcggtgaagaggcgccgcggagagggaggggaaggcggggcgcgcgacaatgacnagcgagccccgccgggagctggctggaggtgaggagggaacccgcccctttggcggcaagcggaacgggggaggggagcggagcgcgagaggggaggggggaggatcggggggggccgggggcaagccgcgggcgc

SEQ ID NO: 97532 - DNA, 249 bp, Heterodera glycines
  SCN-specific regions: Sequence locations=1-138,162-249
tgaatcctcttaatttgtttacctccaatcaaggattggaagaaagtcgcaacattgtcttagattatcgaaaaggcattttttccccagaattaacagttgagcgtttatggaaggccaaacatctgtatggtaatttatttatgtattttttccttataggactttaggattactgaagattatcatgcattctttcagaatcagcttatcatccgatgtctgaccaaaaaatgttgccttttggtc

SEQ ID NO: 97533 - DNA, 548 bp, Heterodera glycines
  SCN-specific regions: Sequence locations=1-548
gaacggcttccgttgcgcgccttcaaaaagatcggtcgcgttggcactctgcctgccctcgcgcacacttccgccgcttcggcggccattcagtcggtgatgagcagcggagacgaagcgacgacgccggcactgaccagcggagggggcgctagcagtacacggacggcgggcggaggcagcgcattccaacgatggggaggcaatcggagaggaagtcatttggtcggttgggactccgcgcggcctcagtctgctgcgcgacagcagcagcaaatgctggagagaatgtacagcaaaagcgaactgcacgaatatcagcagctgttcaaaatgttcgacacggacggaagcggcgccatcggatgcgaagaactgaagggagcgatgctgtccattgggttgcaagcggacgacgcggaaattgaacgactgatcaaagaagtggacgacacggaaatggttcgattgatatgtgatcactctttgccttcggattgtctctttctcctcccgcccattagtgaaattgatttccccgaattctg

SEQ ID NO: 97534 - DNA, 894 bp, Heterodera glycines
  SCN-specific regions: Sequence locations=1-593,615-894
ggctgcaggtttccatgatcggattcgacccaacaaatgaacaaaattcggggcaacagcttttcatgggcgaaattggacaacgaatcaacaatctcatcaaattcaacatcggccccaaatggatgagtttgaactttgccgctttgtttttccgattttttggctttccgtcggaagctgctaattgtttggaagctgctttaacattcccccaatttttggacatttctctcactcaattggcccaacttttgctccatttgaatccaccgatggaaaatgccaaaaaggaaaatgacggaattgaaaggattttgcgtattgcgatgcaaaaaggagaaaatgagcccgtccctttccatttgatgggcattttccatttgcgccaaaatcgctccgttttggcctaccgtttcttcagagaggcgttggaccgcgacccgaacttcgaacccgcgctgaacgaattgctacggatgaaatgcactcagagagtggggaaaaagccgcgactgatccgcgacatttacgcaccaatttgctgttggcccaatgagcagaacgtcgtctgtttcgagcggagggccaaagggtcggtctggagggaatccgtccgttgtttccgcttggaatcgccgcctgtttcctccggcggggaattccccgccgttcactttgtgtatttccgctgcaacactccttatacgggtcgcagttaccccccgcctccattcgcccctttggtcgccccccttttacgcccggcaggtcggaactgcgtcaaattgaacttcgtcgattcatccaacaaatcgaggctgaggaatcattgaagaccaaacgaaatgaaaggacgtcccatcgtccgtcggtgttggcactcgattacgg

SEQ ID NO: 97535 - DNA, 155 bp, Heterodera glycines
  SCN-specific regions: Sequence locations=1-68,96-118,141-155
cccccgcctctgggggggggggggtgccaaaatatgggggcggggggaaaaaaaaaataaaaaaaactcccgccggaaaaagggggcggggaaatggccgaaaataccggccgcgtggacccggggaaagtgaaaaaaaaggggggggggggggg

SEQ ID NO: 97536 - DNA, 352 bp, Heterodera glycines
  misc_feature (10)..(10): n is a, c, g, or t
  SCN-specific regions: Sequence locations=1-352
aggttcatantaggccaagcagcgaaaggtgtacaggaatttcatgcatataaagagtttgttgtccctctcaattaatttctaatttcattcaaatggacatcgaagcaataggcccactctaccacgtcgcaatccctcgtccgacgcaaaaagcgatttgaaatgaacctaaaaagggagggacacaaaaatatgtgaaatcggagagtaaatatcgcaaaatagcgaccaaagtgcggttgcaatggcaatgccaattccgatgcaatcgatgaacacaacccaaaggaaaaaggcgcaaaacgaagaaaaggacaaattgagcgctaatgcaaacagaactttttat

SEQ ID NO: 97537 - DNA, 519 bp, Heterodera glycines
  SCN-specific regions: Sequence locations=1-519
cctgcttcgaggaacaaacgttggaggcggtggtggaaatgcctcacgttcaatcggtgaagtgatcgtcccaagaacttcagtcggaataattatcggaaaaggaggagaaacaatcaaacgtttggctgctgagacgggtgcaaagattcaattccggcccgacgatccaaacctacaagaacgttgtgcggttatccaaggaacgccggaacagattaaccgtgctacgcagatgatctctgagctggtcactcgcagttccggtgggggaggacaacaggaaaccttttacatgcatgtgccggcgaacaaaaccggattagtcattgggaaaggaggtgacaccataaaacagattagcgcggagacgggggcccatgtcgaactgtcgcgagactcgccacccaattcgactgagaaaatattcgtcataaaagtgggcgatgttgcaccgggaacaccactaccatcttttcacggcaatgctggcattaccaatgccacaacgcctttggc

SEQ ID NO: 97538 - DNA, 478 bp, Heterodera glycines
  SCN-specific regions: Sequence locations=1-478
gagacaagacagcaaaagagcttaagagggcgtttagggattggtacttacgaattggcgacggatgaagcgccaattggcaataagaagagtggaagtgaaaggtgtggtggcatttgcattatcgacccaacggatttgttacccattgagcggtacattcgccttcccagtggcgtttttcggcttgtaaaagtgccaacaaatgcaattactcctcttcttacgagtgaagttaatgataattcagcagcagttgctacacttaccgatggacgacttgctctttttacgactgaccactttgattcgattgccgatgtttcggctacatttctgcctttttccacgactttatccagtggaatgatgttagattgtgcagtgaattcggatgggcgactgctatgttctgacaaataggggaatctttttgtcctccgttttgctttggatggttttcatccacccgattttc

SEQ ID NO: 97539 - DNA, 666 bp, Heterodera glycines
  SCN-specific regions: Sequence locations=1-666
tcccattaaatgatttacaatcctttaaagaatagacctgattaatttccattttttgcattttatttttagggtacaattagttataagacaaacgtttcgcataaatatttgttcaatttcgtttttgttctcacaattagcatgacgtggaaagggatcagacggtggctgaaaatgtgctaaaacttcaccgatatcgccctcaaggcgaatcggttggtgccgttcaggttttcggaacggctatggaagtacgaacgacatttgatgccgaaaagggggacagtcatggcagaatggaagtgtacgagaatattagggaatggacggcggtggaggaagggcagaaaattttgagcacccaattcatgcgcaaatacatccacacggcccgggatgtgaagccaaaactgacggatgaagcgtccacattcatttcggaacgttacgcggaactgcgatcaaccgatttgatcaaaacggactgcgaaaggacaatgccatttacagcccgacagttggagacaatgattagactttccacagctatggccaaggcacgactttcgaaaacggtcggactcgaagacgcgaagagtgcgtacgaacttctggactttgcatgctttaaggaaaagccgagagagcgattggaatatgagg

SEQ ID NO: 97540 - DNA, 797 bp, Heterodera glycines
  SCN-specific regions: Sequence locations=1-82,104-453,476-619,641-797
gtctctgttaacaccaatggataggttcgtctcatttgttaacactcaatcgtcgctgtctcggggggaaccggcgccacatatttgttgtacacttacattatgaaaatccaagccggccacagatatgaaatcggtgaccaaaccggcaaaacgtacattgttacgggagcgacgtcgggaattggtaagacgatagcgacggaattggcaatgaaaaacgccgaagttgtgatggcatgcagaaacagaaacaaatgtttggaagtgcggcgtgacattgtgctgaatacgaggaacaaaaaggtcttttgtcgaatgtgcgatttgtcagacatggaaagtgtacacgaatttgtgcggaaaatgaccaaaggaaaatacgacttcaaaaaaattgatggagttattttgaacgcggccaccaaaagcaaaaagtacagcaccaacaaagacggagtggagacgaacttggccaccaatcatttgggctccttccttctcgttggccttttgcttcagaagcttctcgaccaggacggacaatcgcgcattgtttttgtcgggacggacatagcgacgaaaaacagtctaaaattggagcttggcaaattgaatactgccaaatacacaaataaatttctccgttccaccgaaaaattggacatcgaaaaaggcaaatacgacatgcatggagcatacaaattttcaaaactaacgcagcttgtattcgcacgtgaattggccgaacgtcttgaaggtaataataaaatccgagcggtggtggccgacccggg

SEQ ID NO: 97541 - DNA, 336 bp, Heterodera glycines
  SCN-specific regions: Sequence locations=1-336
cttccttaacctcctctgatgaactctatggaactaattaaacgattgttaatgcaaggaatctaaaccctaagaggataacatttagggaacccaaatattctaattttagatgcagatcgaatcaattaatctttaattcatctataattcgaaaccgaatctaattgttagtgtcgatgaagcttaccatcgtcgtcgcggttcgtaacacatgatcttgaaaggggaaatcaatttcaaaggcgggtcgatttggccttcaaactgcaactttcaaatctcaaattggagtttggaaatcaaattcatgaaacctttggcctggttttgggg

SEQ ID NO: 97542 - DNA, 728 bp, Heterodera glycines
  SCN-specific regions: Sequence locations=1-728
gttcctttagccccctgtaccgtatcccctcgcttttcccactgaccgttcagctaattgcccagcattggatggccttggccaaaaagcattcttattgactgagtgctaatgcgaattgccaattcccctgagcccaaatcgcccgccaatttcgactcccgcgccgacaacgcccgacgcgactcgcttatctttctcaacgattggacttctctgtcagtgatttgtttcggcgtttgtgagttggaaattcactgttcgtacgccgagaaaagccagtgaaaggcgcccgagcatagcccacggaacccccggcacagattgaaaaaagtctcttctcctccgctgcttctcctctcccgccgatgtccgcttttcctcccgcgtgcaatccctcccacgcgcgtgccatcggcgaacgcgtgctcgccagaatgggaaatatgccgcaaacggacgaaggcgcaaaaaggcacgcccaaacgacgacaaattttgagacgccgacggaggccaaagaaacgtcttcgtcttttgcgcttttccgtccctccgattgtcccccgtcggccgattgtccgtcgcttaagccatcggtcggccaattgtccgtttcatggccaccggccggtgaattatttttaccattgttttcgttttataaatttgttttctccgttgttttttaacccgtcgactaattaaatcaattacagccttaaaaa

SEQ ID NO: 97543 - DNA, 295 bp, Heterodera glycines
  SCN-specific regions: Sequence locations=1-26,50-295
gcgcttcttctttcttctgaccattgctcttctctccggtgttcttctcctttccccaagtgcactcgcaaagaaaagagcccgccgttcgatgcccgttaacgctgccatgccggaatggaaaattttgtccgctgaagtggaaaacgatggcacagcataagaaggaggaggcaagctttggatcatcggcatgatcgaagaaggaatttgccaaaatgatgaagaataaaccaatgaatgttgtggatttgtagaaattcattcaaatgccgggaataaaaatagttaaatt

SEQ ID NO: 97544 - DNA, 275 bp, Heterodera glycines
  SCN-specific regions: Sequence locations=1-88,128-147,178-275
aacattatgacgttatctttttggctgaaatgaatttgccaaaggaatgcgacggcggtggcaatgcccaacggcgggaggacgacaatgttgagcagcagcaggaggcggcggcatgcagcaacagtgaggcgcaacagcccgctaatgatgaggatgaggacgatgatgatgatggccaaaccaattttgtgtgcaaccggcaataatgccgtcgatgtaacatgatggattgtttaaatgcattaacttttgaagtaaataccgcatgaatt

SEQ ID NO: 97545 - DNA, 120 bp, Heterodera glycines
  SCN-specific regions: Sequence locations=1-120
ccgcctacttcatcagatattataatcggagaaactgcccgtaacctaatttccattttggacttacttgaggcctggataaacgaattccctcctgaagatatgggattgcaacgcttt

SEQ ID NO: 97546 - DNA, 150 bp, Heterodera glycines
  misc_feature (147)..(148): n is a, c, g, or t
  SCN-specific regions: Sequence locations=1-150
ttcttgccgaggcaaaagcctagaaagaactttagcgaggggcactactttagatgaaggatttgttttttcattaattaaatcactcatttccgtttcatttatttggcgttctgtttttattccatgataaattcctctttaccnnaa

SEQ ID NO: 97547 - DNA, 395 bp, Heterodera glycines
  SCN-specific regions: Sequence locations=1-395
gttcatcgcggttaatgaactcaattggttgcccttcctcctccaatggtccttcctccgctatgccttcttcttccgctgattgttctgctgatcgctctcttccgtcttcctcttccgttatcttccaacaattcacgatcgatcagcgacactttgtggacgaggattacttcagtctcgagagtattttcgccaccaatacgaatatttgctgcactttcgagtctaaaacgccccccggtgagtttggtttttttcggtcattcaaatgtttcagcgctttttcctctgctcggccggaaagcgcctgaggtcatttctgagaagggataccgtgccaatgtccccgcttggctcgtccccgccgtcgaccacatttgctcgtttgccgt

SEQ ID NO: 97548 - DNA, 299 bp, Heterodera glycines
  SCN-specific regions: Sequence locations=1-269,291-299
gatttcattgtaattcatcgtccgcgacggacatctcttcgaatttgcttcgctccaaaaattccctcgtgattgtgggccctccactaatgagacccttttgttcgacgccggaaatatttgccaggaactgatggatcacttgggggaaatttcgtgcagtgcgattgcgctttgtgctaaggagaactgattttgagatcgacttttgccacattggatgattttttgtgaagttatttgccaaataatggcgtttatttatttatcgtattgttcaaaatacaattttaaacatt

SEQ ID NO: 97549 - DNA, 225 bp, Heterodera glycines
  SCN-specific regions: Sequence locations=1-68,90-127,149-225
cttgcttcctctatagtagtaatctgattagctaactgccaatagagtaatgtaaaaactatcataggccataactcccccattacatagaagcataccaacgtccacttgctccacatcataaaaaaccattttaattggggataaagctggatgtactgatctataagcagcttattgggatgccaataagcttggtaagggaaaagaatcaagccaaaaaag

SEQ ID NO: 97550 - DNA, 449 bp, Heterodera glycines
  SCN-specific regions: Sequence locations=1-23,45-285,312-382,405-449
cttttcctaaaattcaatttacaaaaatggtttccaagcttcttccggtcattctctgctgcttgtttttggcttctttcgccctctgctcgcccaaggctgctgatgtgctgaaatttaaacgagaagcggcgatcagcagttgtggagctggacagtttgaatacgggggcggctgttgtacgacatgcacaagcgatgctgattgtacgggcgggaagctttgtgtgcccatcctcaacttgctcagcgtcagtctgtgctttgccccatgcggaaattaagacagaaaagaaagcagcaaatgagggtgttgatagtgtgataaattgataggattaaatggaaaatggggagttaataattacttaaatgcatttaaatagtgattgattgatcaataaatatttttcggagccgaccgattcccacgggggagaaagaaggaa

SEQ ID NO: 97551 - DNA, 154 bp, Heterodera glycines
  SCN-specific regions: Sequence locations=1-154
ggccaatctgccgattttcattcccccaaactgctcaatgcgttgtgtaataatggcgatctaatgattagcctgccttagtttacacttaattagcttattcattctcatctcattgtgccatttttgtattgcaataaaaattcatgtaatt

SEQ ID NO: 97552 - DNA, 629 bp, Heterodera glycines
  SCN-specific regions: Sequence locations=1-43,70-110,138-574,596-629
atgtggatccccgggctgcaggaattcggcacgaggcttctttgaaaattcggcacgaggaaaaacatactattgtataccttataaaatatgtgcatcttccatttctcgctttttaaataaattgttttgaaaaatttaaccgacctagacagatttatacaaatgataaatgaccttaaacagaaaagagctcgtcaacttgagacacacattgaagttttacgccgcaaaattgaattattgcgagaacagaattatcggttgttggagaaccgtcttctgagagaccagaaccaacttctgagcgatcagaaccaacttctgagagaccggaaccaacgtgtgagcgagcagatccaacttctgagagacgccgctaacgagcgccggcaggctggcggtggcatcgacgagggtgccaacgtcggtggacaggccgaaccaagtgaccgtgatgccactagtgccgaaggacagcgcgagccgaacggtggtggcaacgatcgtgatgcgggtgccaccaactgactggcatttacaagaccgagagaagcagtttcctgttgatgtaagaacataaacaaatgaaaaccatccactttttgttgcagaaaatgtattagtaa

SEQ ID NO: 97553 - DNA, 252 bp, Heterodera glycines
  SCN-specific regions: Sequence locations=1-252
atgcatgacacaacaacgtgaaaaagtggtggtgaaaccgaggcccatagcagaggctacaaggcgactggaaagatttgccgttcctttgatgttctccgctcccgcgtctgttcgcttggcttctccgcgcagacgacgcccttttcgtgctcaaatttattcaatgcgttgctctgattgcgttcgccgttttcctccagtcgcgcgactttttcctcgcctccgccctttgcatgggcatcgcctggc

SEQ ID NO: 97554 - DNA, 562 bp, Heterodera glycines
  SCN-specific regions: Sequence locations=1-356,378-562
cttcacctttccgtgcactatcttctcttgcattaagattgtccagcaatacgaacgagcggtcatttttcgactgggacgtattcgtcgtaaagcgcaaggacctggattgttcttcatccttccatgcgttgatgaatatcgctgcgtggacttgcgcaccgtgacttgtgatgtgcctcctcagcaagtgctttccaaagattcggtcactgtcaccgttgacgcggtggtcttttaccgtgtgttcaacgcaactcaggctgttatgatggggaacatttcgtcgtccaccactctgctggcacagacaactcttcgccatgtgttcggcacaaagactctgagcgaaatactcggcaacttcaacaagatcaaccgtgaaatgaagttgtccatggataagccaagcgatgtgtggggcgtggaagtggagctggtcgagctgaagaatgtgcgtttgccgcacgacatgcaacggtcgatggctgctgaagcggaggcgggacgcgaagcacgggcaaagatggtggcggctgagggcgaccacaagcggccaagg

SEQ ID NO: 97555 - DNA, 243 bp, Heterodera glycines
  SCN-specific regions: Sequence locations=1-33,55-243
ggcactgtttgctgtccgagaaaatcgctacatggttctgaacaccgactttaacaaagcatataagcaagtggtgaagaaagacagcgacgagttcgctttctacaagtgatttgtgatcgaatgacccccacccatcgtcaaccatttgctttttgttgtttttgcgcttatatatcatcatttccccgttgtgtactgtctttttcattgcgtgtcatcgaataaagggaagtgaaaagg

SEQ ID NO: 97556 - DNA, 486 bp, Heterodera glycines
  SCN-specific regions: Sequence locations=1-160,186-370,402-486
gtcgtctaagataaccaaaaatgaccaagggtacccccagtttcggtaagcgtcacaccaagtcgcacacgctctgcaagcgttgcggtcgccgcgccttccacaaccaaaagaagacgtgcgcccagtgcggctacccctcggccaagctccgctccttcaactggtccgagaaggccaagcgccgcaagaccacgggcactggccgcatgcgccacctcaagaacgtcaaccgtcgtttcggcaacggtttccgctctggcacccccaaggccgcctctgcctaaagcaaccacaactctgtgattttcaaacatgtgtatttgtgtcggtttgggttgatgcaagtttcccgcgccgtcatttcgtgaaaaaaaaaaaaaaaaaaaaaaaaaaaaaaactcgagggggggcccggtacccaattcgccctatagtgagtcgtattacaattcactggccgtcgttttacaacgtcgggactgg

SEQ ID NO: 97557 - DNA, 511 bp, Heterodera glycines
  SCN-specific regions: Sequence locations=1-389,411-511
ctagtggatccccgggctgcaggaattcggcacgaggggcacgtggaggaccaattgttcgacttttacacgcccagcgagccgaaaaagaaaaagctcctccaccatccgtcggccgccgcttcgcccgtcggtgcgcgttcctccctctccggcactcgcattggttcacttgcgctcggttcgctgactctcaacgcggcgcccgacttggaattatattctcccgctttgccaccctccgcttctttgaacgccgttgcgccatcgaaatacggtccctcgcccgcagcgaactcttcggcacggcaattgctcggaggaggggcaaggggcggagattctgttggcagtgttccgtcggcagttgcgcctgacgaatgtccgctgaagaagaaatacgcgaaggaagcgtggccagcggaaatgagaaggcgttcgggcagcattctctgagcaaataagcaaatgaactcgaataaaactgcaaagtttctgcgaaacaccccat

SEQ ID NO: 97558 - DNA, 267 bp, Heterodera glycines
  SCN-specific regions: Sequence locations=1-1,24-267
cattctttgtccaaattttgttgacttccaattcataccaaaaaacttcattgtttgtgtctgtatcgatcattgttatttaattgcccatctcaaaacagttcgtttttcaatcacttatgtcgcaattcctttaaaacctttgtcctaattgcttttttgaatcgatcctcaaagtgtgtgcctcagcaaaatgacactttctttctttacttttttaattcgactttattttaacatttttttgtctgataaaaattttattgg

SEQ ID NO: 97559 - DNA, 615 bp, Heterodera glycines
  SCN-specific regions: Sequence locations=1-409,445-615
gtcaaatctcgtcaaaatgtcgctcgttgtctccgaaaagggctcgttctcttacatcttgcgtgtgctcaacaccaacttggagggtaagcagaagatcatgtacgcccttacctccattaagggtgtgggtcgtcgctacgccaaccttgtctgcaagaaggctgaggttgacaccaacaagcgcgctggcgacatcaccgccgaggaactcgagcgcattgtgaccatcatccaaaacccgctccagttcaagatccccaagttcttcctcaacaggcaaaaggacatccgtaccggtgagtacgcccagaacgtgtccaacgctgtcgacaacaacctccgtgaggatctcgagcgcctgaagaagatccgcgtccaccgcggtctccgtcactggtggggcatccgtgtccgtggtcagcacaccaagacgactggccgtcgcggtaagactgttggtgttgccaagaagaagtaagctccattttggtgccgaaaatttttttgtcgtaccgactgctctctgcctcggatttcatgtctttttgtcgtgtgtggcgtatgggttttcacatcacaatacatccgcaaatggatcatgcctgaaaaaaa

SEQ ID NO: 97560 - DNA, 960 bp, Heterodera glycines
  SCN-specific regions: Sequence locations=1-960
ctccttctcaagcttatccaggcgggcattgtcgatgattgggatgatcctcgtctgttcacgctgactgcccttagacgtcgcggagttccgtccgagacagtgaacaagttcattgcccacctcgggctcaccgtggcccagtccagcattgacccggctatgttcgacgcctttttacgcgatcatttgaacgttactgcaccgagaacaatggcagttctcgagccgcttagacttcgcattaccaattatcgagagttgggttttataccagcgaaaagcaccttacgggtcaaacaattcccatcctcaattaatgaaagtacggacgaatgggaaattgcatttgacgagtttgtctacattgagcaggctgcttttagagaggttgccgaaaaaagttatcgtcgactgacattggaacagccggtgggactgcgtcatgtcaatttggcagtcaaaattgacaaactggagcgggatgagcacggaaatcccatcgaattggtggtaactgcgaatccggtgagtagtgagtgtaagccgaaagcattcattcattgggtggcgagaccggtgctttgtgaggtgcgtctctacgacaaactatttgtacacaaaaatcctgaggaccctgccgaagtccctgggggttttttgactgacataaacccgaactcgctccatgttctttcaaatgcaatggttgacggaagtattattcgcactattcgtccgttggatcgctttcaatttgaacggaacggctttttctgtttggatccgaatgattcgtggtcgagtgagaaaaaattcgtcttcaatcgcatcgtttctctgcgtgaggatgcaggaaaagacatttaaacttttccctgcttttttctgtttatttttatttattagtgcattttcattgttttgttgttgatagataaattgttgactctctaaaaa

SEQ ID NO: 97561 - DNA, 386 bp, Heterodera glycines
  misc_feature (386)..(386): n is a, c, g, or t
  SCN-specific regions: Sequence locations=1-4,34-386
attcttttaaattttttaatttttaattattttggctctgtcaccttcaatttgggaatgccttctcatacacttctaattctttgcttgctcttttgctttgccttaaccaatggaaatgccaacagtgacaacgacgccgaagacactgacattgaatcatttgtccgcgaaaggtgcgactcggcttgtgaggaccccggcgaaacatcggaggagtgcgcattcgtttgtctgaactgtgtccaaacagaatgccaacactgcaccaatggcaccgaatcgaatggtggcacaaaggaaaaatgccaaaaatgttttgaagaaaacaaagcaaagtgtgtacagtaatattgactaatcttaaaaataaatgaccaatggcn

SEQ ID NO: 97562 - DNA, 485 bp, Heterodera glycines
  SCN-specific regions: Sequence locations=1-65,87-124,165-485
atttctcaaagcgtatcagccgctacaaatattttaaaaggccttcgacaagcaagcaacaaattcttcacccaacacacaccaccaacgatgagaagcgtcaacacaacaccgttccgtcgccgacctcttccgcttcgcattgtgtcgtccgtgctggtgctgctgctctgtacgttcgatgtgtcactggcagcggagaagaacggcgccagcccgcctatatataatacgctcaccttcattttgctcgttccgctagtcatcgtcatctgcgcgttcatctacctcctgttcatgaagccaaagaatgcggaaggcgacgaagaagacgaagaaggcaaaggaggagctgacggcgatgtcgagaagggagcggacgacgataaaaaggagactccaccttctgctgctggtgacgtcgtggcggtgccatcggaacgcgtggttgatgagcagcaaaaggaggacgagggtggcgacaa

SEQ ID NO: 97563 - DNA, 804 bp, Heterodera glycines
  SCN-specific regions: Sequence locations=1-69,91-804
gccccttcgacctccctcggcgcgtggctgcaaactttcaatttgctctcttccctcgtccaaaggatcaaagtgccccagaagcaaaagagcgtggcggaagaccgcgccatgtccgaccaaatcttcaccatgctccaacacccggcacggctcgacttcctccgggtggaccaccccgagttggcagctgcttatgagaaaaacccaacggacaaagatcttttttacatcgccttcatgaagaacaaagaagaacagacgcgacgagttcggctgatgtacgaccatagcagtgaggagggacagcgatacatcgcccaggaaatcgaacgggagcgaatcactcgaatgcaggagttggccatggagcacatgccggaggcgttcatcccggtgcatatgctgtacattcggatgaagattaacaaccaccttgtgatcgcttttgtggactcgggtgcccaggcatccattctgtccgagagttgtgctcgacgctgtgacattttgaaatacgtggaccgccgttaccgagtgcaggcccatgggattggcgggtcgcaaaagatggtagggagaatcttcgcctgccaagtgcaggtcgatgacaatgtttttgcgtgtccctttgaagtgatgagcgacagagacgtcgacattttgttcggcctgaacgcaatgcttcgccaccggtgcaacatcgacctcaagaaaatggtccttcgctttggggacggcacggagacgccttttctcagtgagcaggaagtcaagcgggagaaagaagcgattgcaatggcc

SEQ ID NO: 97564 - DNA, 570 bp, Heterodera glycines
  SCN-specific regions: Sequence locations=1-570
atctcttttatctccgactcatctgctgaatgaaaccagcctgaaccttagatgcccatattgcccaaagaaattcctaaagaatactgaagccatttctcacatggatccgtgtctgaagagtcggccttacccttgtacgaactgttctaggcggtttaaatctgcgcaaaatttgagccaacatgagaggattcacacaaatgttcgaccttataattgccagtattgtgagaagaattttactcagaagtcacatttacaacagcacgaacgcatacacacaggtgaaccggccttctcatgccgttactgtggcgagacgttcaatatttattcatccaaaatacagcacgaaaaaagtatttgtggccttcacgaggccttggacaaacagaaagaaaattcgagtgaaaagaacggtttcgcaaagattgtaagggaacggtcgcctataggcagtgccaacagtcatttgaaaaaatggccctatgacaaagtaggcaccacttcctcaaccgagcaaaacgacgccgaccgaacaatcatcgtcacggggaccagcagtaa

SEQ ID NO: 97565 - DNA, 245 bp, Heterodera glycines
  SCN-specific regions: Sequence locations=1-81,103-245
gtttatttacaaaaaaaaaaaaagacgcggcgaactccctgtgtgggtcgtgagaatgatactttgccttatggatggacaaagtattagaaaaaccaaaaatggggggggggaaagacgggaaatcggagattgagtgatcactgatcaacccgatttggttggtataaactcactcgctgcggtggccaacaaaggcggcaatgaggcggagaaacaatagccgaggcctgggatagacattt

SEQ ID NO: 97566 - DNA, 596 bp, Heterodera glycines
  SCN-specific regions: Sequence locations=1-596
tacagtttgaagatgaattagaattgatggaaaacaccgggacggcggatgaatccgccgatggtccgttgggtgctttttgggaatggcatcggatggtcgctggggctgacaaattcggctccatctcgcagcgaatgcttcatctgcgtccttctttgaaagtgccttccgtctccaagcgaattgccttcccttcgaccgccttcccaaatccaaatccgaacaatgccatccctccgccgaatgtcgtccgtcgccgtgcccataacattccaagggacaaacccccgtgccttcgaccgatggacagaccattccgagaacatcggacgtacccgcgcagttgggaaatgcccggctttgaggcgaccattccccgccagtgggactggcgaaatgtgtccggaaccaacttttgttcgcccaaccgtaaccagcacatcccggtctactgtggaggctgttgggtgtttggcactttgggctctctccaggaccggtttaacgtggcacggaaaaatcgttggccaatgactatgctttcaccgcaggaaattattgcgtgtaatggccgtggaagttgcaacggaggg

SEQ ID NO: 97567 - DNA, 646 bp, Heterodera glycines
  SCN-specific regions: Sequence locations=1-110,137-156,180-488,512 -535,557-646
gaaaattgcaaagatatataaaatgccaaattttctcattctgtcctgccactatggcacccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtgggctggacattttgtgggtcagcggccactatgggtcaagcccagtgttagacaaaattgctcataacgccaaatagcgtaattggcgtaaatttttgcgcgctaattcaaacacactgatcactgccatttctgattgtttattttgatcagccatagctttgttcctctccaactaaattgacctaaattggtatctaaaataagaatttgaaaaggagaatctttttctagttaaaataactctacagttggccttatttttgtattaaatttccttattaatcgattcagaatttttttctctatcgtgtgcaaaatttggtggggttttaacaagcagaaaaaaagttaaacagcatgaagta

SEQ ID NO: 97568 - DNA, 157 bp, Heterodera glycines
  SCN-specific regions: Sequence locations=1-104,128-157
cggcgatagtaccagatgggttggcaccgaaagcggtgaatgaacgaaggagcttttggggcctgaaaagcctatggcataagagggagtgccgagttagaaagtgatagaaaagcattaaaaaatgagaaaagactttgagcaggaccatttgagg

SEQ ID NO: 97569 - DNA, 507 bp, Heterodera glycines
  SCN-specific regions: Sequence locations=1-174,196-507
tgccatttttactacgtattattttatttgttgatgaataatgtcttctcgaagaaatgaatatctcgatgcgaagatttatgttggtggtttacctgaggatgcaacttctgaagagttggacgatgcgtttcatcgctttggacgcatacgaaaaatctgggttgctcgtcgtcctcctggctttgcttttgtcgagtttgaggatgcacgagacgctgaagatgctgtgcttgcactcgacggaacgaggatttgtggcgtcaaggcccgcgtagagctttctcatgggaacggaagagggggcggacgcggttttcgaggcggagggggacgttatgacgaccgttatggtcgtgatcgttatgaccgtgatcgcgaccgtcgttatcgttcaaggtattaatgaaattaattcgttgaagcttttttcgaaacttgaacattgcgcggatgagtggtcgaagtttataaacttcaatttgtcaaatttagcttttcttcatc

SEQ ID NO: 97570 - DNA, 564 bp, Heterodera glycines
  SCN-specific regions: Sequence locations=1-6,31-564
caccattattataaaatgggcaattttaaggctgcacgtggcacgggtgcaaaaagtgctacccaaacgacaacatgctgctccccagtgggaagactgcggggcaagtgcgcgaacgggattccaagcggatggaatttctgagagagaaggtcaaccgagtggacgtctactgggaatgcgaaatccatcggatgctggagaggagcaaggaaatgcgcaaggcatttgaagactatgtcgatgatggcccgctggtgatccgcgacgcgtttatgggagggcgaactggaccgctgaagctgctgcgcaaggctggaccgggagagaaaatctcctattatgacttcacatcactctacccgtatataaagtgagcactgttaaatttgtaacaacttttaacattgttttcttcacagcttcacaacccgttaccccattggcactcccaaagtgcatgttggaaagcggctttgcttccccctgtgcatcacttgcgccaaagagcacccgacaggaggagtggacaacgactaccactgcgagcacaatgacagacag

SEQ ID NO: 97571 - DNA, 300 bp, Heterodera glycines
  SCN-specific regions: Sequence locations=1-61,113-300
actttccaagctccactaaatttgtttttttgtgaataacagtcagcaaaaacaaagcaaaaatggacgccatcaagaagaagatgcaggcgatgaagatcgagaaggacaatgccatcgaccgggcggacgccgcggaggaaaagtgccgtcaaacgcaggaacggttggagcgtgttgaggaggaattgcgggacacgcagaagaaaatgatggcgacggagaacgaattggacaatgcgcacgaggaccctgacggctgccaacaatttgttggaggagaacgagaacacagtgcag

SEQ ID NO: 97572 - DNA, 610 bp, Heterodera glycines
  SCN-specific regions: Sequence locations=1-56,78-165,189-610
gcgtaccaaaacgagatgtctcgtttagcgcgaattattcaatctcaacaatggacgatttcctctcaacagaggaccatcgaaatgttggtctcccgactgcctcggaatgatggagcggcggctccgctcaatggcggcgaacgacgggacatgggaggagcgcccaacgaacagcagcttggccaaccgcccattcttcaaattgatggaggcggacatgggcaacgcccaaacggaaatgccaacatcgttcgtggccaaaatgtcgtaccagtggctcctcccccatttgtggctcaacgacaacaagagcaaggacaaaacgaaggcggaaatggacgacgcccacacggaaatgccaacatcgttcgtggccaaaatgtcgtaccagtggctcctcccccatttgtggctcaacgacaacaagagcaaggacaaaacgaaggcggaaatggacgacgcccacacggaaatgccaacatcgttcgtggccaaaatgtcgtaccagtggctcctcccccatttgtggctcaacgacaacaagagcaaggacaaaacgaaggcggaaatggacgacgcccaaacggaaatgccaacatcgttcgtg

SEQ ID NO: 97573 - DNA, 281 bp, Heterodera glycines
  SCN-specific regions: Sequence locations=1-86,108-281
ccccccccccaccttcgatatctctcgccgggtgcagccgaagtccgtagaaatcgcagcgccgtgccgtctccagcagaacaaagtccgcctcggccggctccatgccaatcagtcgccggtgctgctccaacacggcctaagaagaagggcaaatgaactgaggaaaaatcctcggattatgtaagttcacatggtattatttcaaaaagtgaatgaagggcaccgggctatcaagtttaacggagtgatcagttggaaattgatgatcgataagcctg

SEQ ID NO: 97574 - DNA, 255 bp, Heterodera glycines
  SCN-specific regions: Sequence locations=1-255
caccaagcttatggaaatccaatgagttttggttcccgggaaatagcgaattccatgaaaatccgtgacgaggaaaatcacgacgaaatcccgggctaaaatcttgtcaagaacccggaccaaatcatggtaaaagtatgacagcaaatggtaggaaaataatgaaatgaacttaaactgaaaacgatggatgaaaattaaaaattcacatgtgtcaggcgtccaaacacgtgcgcgaaaatcactccttaaatt

SEQ ID NO: 97575 - DNA, 607 bp, Heterodera glycines
  SCN-specific regions: Sequence locations=1-386,408-607
attttggccctctgtcagcacattacgaggaagacgatgaactgcttacaccgacaaagcgacttcgcgaattgcggctgaattctgacgaaaaatgtgcgatgtccgattcaatcccacgggctgttgagctgtttatggagaagaaacgagcaaggatttcaaaattcctgtacacgtacaacggcaacttgcaattgaatttgccacaattgcacgcatttgcatgctcaacgggcggactgattgatgacgaatttagagaaagaatttggccaattctcgtaaaaaatcttccacaagcaaaacgatgtaaagatacgcaatgggacgccctccgctcggaggaatacaatgaccaaacaaatcattcgagcgacgaattgcaacaacaacagcaaacccttttcctatcagattccgactttgaatctgcattttccacgttcaccccgtccatttcgggctgtgatgatcaattgatggatgcggaggacgacgccgagggggacgacgcccaaagaatggccccccaaaacgcaacgaaccgatgacattcgagtgagtcaaggtcttcgacttctctcctgaccagctgcgtgcccac

SEQ ID NO: 97576 - DNA, 548 bp, Heterodera glycines
  SCN-specific regions: Sequence locations=1-190,212-301,323-407,429-548
atttattcgtttcgtttttgacctgtatttccatcacaatcaactgaaaaacggcaatggatgattcgttatcctctcgacggctcccttccgacttctccttctaaaaatttcatccaatcttctgtataattttttctatttccgtatgcttaacagctgtaaattcccaaaaatcatcctccaagtttgtgggaggggaattcaaaaattgatatggatgttgaaactgaaacacagggtagaacattttggccgacgaccaaatgggaaggaaactcccagccgaacttttgttcgaaattgttctctgtgttcgaagagaacatgcccacgcgagcatttgcctctcgtcccttgttttatgcaaattaatgctacctcgtgcttcattatggcggaaaatttgggtttcagtatgattttggatgtttccgcttttttttttttaattttcgttgttgctgtttggacttgtctttttatttttgcactaacaccattttctgagctcgtgagctttcttcaattctattattttatttttg

SEQ ID NO: 97577 - DNA, 565 bp, Heterodera glycines
  SCN-specific regions: Sequence locations=1-183,205-256,278-347,369-565
taattaaatccattccttcgggggaccgtgccgggtgccgcggggtaagcagtgctggttcgtttcatcacggcaccgaaccttttggctagtcagcaatcgttgcttaacttgccagatcggacgggtgcgcatgattccactgttccaagcaccccaccaaaagcaaaacgatataaccaaaatataaggaaaaattttttctccatcttcctttttgatactaaagcatcagagtgctaaaattaagttgtaaataaaattttggtgcactttagagcactttctgaaaaaaatatttatgaaacaaaaaaatcgattttttcaagtgtccgtttggggtactcaaacatttatggggagcaaaaatccaacgcagaattaaagtacaggctatagggaagctattcccgagggattcggtcttcccataaatctgggcgcatcggttcggggggaatgccccgaaaacaaaaaatcgattttttcaagtgtccgtttggggtactcaaacaattatggggagcaaaaatccaacgcagaattaaagtacaggctataggga

SEQ ID NO: 97578 - DNA, 361 bp, Heterodera glycines
  SCN-specific regions: Sequence locations=1-241,264-361
gctctaccaaatgaaatgggctcacaatatgccgcatcttgggcaagtttggacaggggtaatgcaaagtgctggtgcgtctcggaaagcggtctaatacaacgacagaaaaccggacatcgacacgaagggtatatcgtctcccgacaacctggacggacgaatcgaattccaaaatgtgcatcttgacaattgtacactgtcggacaatcccattcttctgggcccctcattcaccgtggaaccaggcaaaggggaggcattgctcacagcaaccggaagaggaaacactccgcgcattgcgcgttgagaacacttttactcgcctgatggaagcaaagatgtggcggaccgagtggcc

SEQ ID NO: 97579 - DNA, 624 bp, Heterodera glycines
  misc_feature (563)..(563): n is a, c, g, or t
  SCN-specific regions: Sequence locations=1-624
ctcaatggccgtgccggctttctcgcctctttgcttgaacttcgtttactttttggtcaacaattactttccgacgatgaaattcgttctgttttggatgctatggtttcttccggcagaaaatactccaaaaagcacaaatctccggcccaactgatgttcgaatggtacaacactgaataccttggcgcggcgcacggcgtcagcggaatttaccaaatgatgttaagcttttgggacttgttggatgcttctgcaaagtcggatttgaagcaaagcgtcgattggctgttgagcacccaattttcggatggcaattttccctcgtcgtccgatcgaatcggattgtctgaggaactcgtccattggtgccacggcgcctccggcgttttgcatttgctcatcgtcgcctctttggtgtttaaggaggacaaatatttggagtcggctgaacgatgtgtcaatctcatctgggcccgaggaattctgcgaaaaggacccggcatttgtcacggagtggccggcaatggctacgcttttcttctcctcttccgactcaccanaaatgacaaattcctgcaaatggcccattggttcgccttcgtaatgatggccccctctttt

SEQ ID NO: 97580 - DNA, 298 bp, Heterodera glycines
  SCN-specific regions: Sequence locations=1-298
atttccacggttccattcggtgagcctccgtccgccttcgttttgctctgtcaaactttgctcggcgctcgttttgtccaaacggcacacttttgcagaacgtgcgcagtgccatcggccaaaaagcgttgcaaagattacattttactgttccgtcgaatgccaacgatttgattggggcgttcacaaaaagtgttgtgaggcaataaaacaaagaaattttgaccaaaattgtacagcaacaaattttgaggaattaaatatttcatgagtttgtgcagatacactctttattatt

SEQ ID NO: 97581 - DNA, 439 bp, Heterodera glycines
  SCN-specific regions: Sequence locations=1-412,434-439
cattgagcctgatgttgggtgccgtcttcatttatccggtctaaattgggaatggcacacattggacactttgcgttctcattttggccaatttggcacgatcgaacagctggaaatggtggcttacccccgtggctgtggttcgttggtgttcgattcgcttaatgctgcccaactttgtttggctgccggtgaaaaacattcggtcaacggacattcaatcgaagtcaaaatggttcccgccggcttttccccgctcttttccccggctcggcccaattcctccgattcggcactttccgccgcttcctccgcacctccgccgccgaatgcccctctgaacttactctgatctgtccaccttctaatcattcgttgtttcccaacttttttctcggttttttttgccatttccgttgtataaaacaaatgtccattt

SEQ ID NO: 97582 - DNA, 195 bp, Heterodera glycines
  misc_feature (194)..(195): n is a, c, g, or t
  SCN-specific regions: Sequence locations=1-195
ggaatctatgaaatatgcgccggtgacttcttgtgacgttgaatgcagtttttcaatttacaaatcaattttggccgataatcgaatgagttttacccccgaacacctcgaatgtatccgatttgcaattgttttcgcgaaattgatagactgttaaaaatttgtattttttcgcataaacacacttgatttcnn

SEQ ID NO: 97583 - DNA, 485 bp, Heterodera glycines
  SCN-specific regions: Sequence locations=1-3,25-485
gagaaattaatttcttacaaattttcgcttcaaatgactttcgcttttgctgtgctccttttgcttttcattcctccgctgacattggcaaaaaatgcgcgagcggagggacccgtgccggttgttctttggcatggcatgggcgattcgtgctgcaacccgtacagcatgggcttcatccgcaaattgattctcaccaatatgccccatgcttatgtgctttcgctgcagttgggctcctcagttgccgaggacattggccgcggctatttcgccaatatgaacgacgaagtggcggccgtgtgccaacagttggccgaggacgcgcgacttgcgaacggttacaatgccatcggattttcacaaggcgcactttttgtgtaagcaaagcgcgagaaagaaaagataaagtgatcgaagcgtcggggttgtgactctgatcagttgaatgttgtgactctgatcagttaaatgttgtgactctg

SEQ ID NO: 97584 - DNA, 274 bp, Heterodera glycines
  SCN-specific regions: Sequence locations=1-27,50-133,158-274
gtcagggcaaaattcaagaatgatgatggggaaaagcccataaaatggcgattttggcgtgatcagaaaaaacttaaattgatttgtctgattttgcatttagactccgtccgatcgatcgctcctcggcatatccttcccctcccctcccccaccaaataatccccttaattcatactcattcgcatttaaatattattttgtatgctaaggttaccaaattacgtaattaaaatatttagtttcgctagaacatcggaagaaaaaacaaagg

SEQ ID NO: 97585 - DNA, 481 bp, Heterodera glycines
  SCN-specific regions: Sequence locations=1-481
gttatgctcaatgacaccaaattagagtcaactttgagcacgacgattaaatcaatcgaccttcagattgaattgcctaaatgtttggattgcctggctgacggattgaatgtcacggaagaggccattacagagaatggcggcggcacaattcgtttcctgcgttcttccccgccagtctccgtccccatcttgcctccttacattttgctgttgcacgaccaaacaaatgatgccaatgtttggcggaaaactcttcagattctgtcggcctccggcttttgctgtgttgcgcctcacctctcaaattttgtttttgacgaggaggaaaatgtaaattttttgctgaacttaacttcacatatcggagcacgtgaagttgtgcttgtggccagttcgatgtccggcatttacctcattccgttcctttctcgtggaattaagaaaaaggacattcatttccacgttaaagcattcattg

SEQ ID NO: 97586 - DNA, 971 bp, Heterodera glycines
  SCN-specific regions: Sequence locations=1-971
ggagctccccgcggtggcggccgctctacaactagtggatcccccgggctgcaggtattcggcacgaggggccgaacactggacgaagtgatcagcgaaatggacttggccaaagcatacggagcaccgtacgatttggtcgaacaaacgcttaacaaacggcggaaaatgctgcgaaaaacggcgaagggaacgagcagaaacattgggcccaaaaatgcgaaggatgccgcgtacgaccacaaaatgatacggcacaaaatatttccgatggcagccgcttcttatggggacacggaaaatgtgaagaattgcattcggaacacttttcgaaatgccacgttgtaccgtaattcggtggtacagtgtaacggtaaggcttatgaattgtgttcggcatttacggcagtgtcccatgaggacaaagcgatcattttgtcatttcgtgggacggacacgggatatcaattaattgaagaaacgattcaaattgcacttttcaaacgatcccaatcacctgacgaagaatgggggaaagttggaagttatttcctgaagattttcaatcagctcgtcgaagagggaaaaatcatcgattatttggccaaattagtgaacacgtacaacaactacgagctttgggtgaccggacattctttgggtggcgcaatggctgccattgccagtgccaccattgttgacgcgaaactgatcagtgcgcagcgactaaaactggtcacatttggacagccgaggacgggcaatggcgaatgggcgacagcgatggaccaaaaagtcggccccttcaattaccgcgtcgtgaacaaccgcgacttggtgccgcatatgccgcccctttggttcgaagggtaccgccaccatatgactgaagttttctataacaacgcaaagaacaaaaccgaggaatttgtcatctgcgcggatgaagccgaatcggaggaatgtgcggg

SEQ ID NO: 97587 - DNA, 386 bp, Heterodera glycines
  SCN-specific regions: Sequence locations=1-386
ggcaattgatgatgaattcgaccctgacattgatctttcacagaggtccagctccgacggtttatgcgatgttcaacaacagcgtttggacttttatgcttgtttacggcgtgacaggccgatttatttccgcaagtgttgtaagtttactcacgatgccagccactgctgctctgtgggtttgggaggctgatcgcgactacgaacgctgggaagggtcgcgggtgttacgtgagcgccgagttccaaaatttgtgctcccgcgaacgattttcgattggtctgactttgattatgctcaacagatgagaaaggctcctaccggttaaggaaaaagactatttacctaatacatatttgaataaagagcattgtttcaaaaaaaa

SEQ ID NO: 97588 - DNA, 314 bp, Heterodera glycines
  misc_feature (164)..(164): n is a, c, g, or t
  misc_feature (166)..(167): n is a, c, g, or t
  misc_feature (180)..(180): n is a, c, g, or t
  misc_feature (182)..(183): n is a, c, g, or t
  SCN-specific regions: Sequence locations=1-258,280-314
ctaattatctgtcctgcagttttagcagaatgggcattttaactgcttcgaaagtgtgcactttgccacggctttcttccgctcgctctatgacttggtggtggggcccggagaaaaacaatgggcgcgaagttgttggccccactttccacggggatgaattntnntaccaagaatcgntnncttgaccggttgggtatcccggtcccatttcgatttcgcaaaatgacgaagtgatcacgccattcgcacaaggaattgggaaatgggaaaaattgggccttgggaagaaaaattttttttctcggttctct

SEQ ID NO: 97589 - DNA, 408 bp, Heterodera glycines
  misc_feature (407)..(408): n is a, c, g, or t
  SCN-specific regions: Sequence locations=1-408
caaagacttcgttatctcttccagcagcgactcggagcaggaggacgccccaacgaaaagaagacggcatcggtgccgggaaatatcgcttctgctccattggaagagccctccgaggggaagatttacatggtggagaagggtagcacagtggacactgtgctcggtgtaaggcgcgatcgtccagccgttgttgcattggtccgctacatggacgagcagtacgaattggtgccaacgcctctgttggtgaagcataacccggcaaagttgatcgaatactatgagaagcatttgcgctttttctgatgggggcgaacttcggcggtgatccaacgacttgtgttatggcacttttctgtttgttttttttgacggcatttgttggataaaatgccaatgaatann

SEQ ID NO: 97590 - DNA, 552 bp, Heterodera glycines
  SCN-specific regions: Sequence locations=1-431,453-552
ccaagtttgaggtcatcgatgttgatccgttccaggcagcaattgtgcgcactttttcgtagttccattcgtcttttaaagcccagaatcggctgttattctgtgctcgctcaaatgtcaactgaggttgaaaaggcgcagaaagcgaagccgggcggagacacaatcttcgggaagataatccgcaaggaaatgccttcgacaattctttatgaagatgacgaggtgctcgcgtttaaagacataaaccccgaggcacccgtccattttttggtcattcctaagaagtgcatcactgctctgtccaacagcgaagagcaggaccaagcagttctgggcaaactgttgctgacagcgaataacgtggcaaaggcacagggtctctccaacggatatcgcattgtgatcaacaacggtcgccatggatgtcaaagtgtgtaccatttgcatttgcacgtgcttggcgggcgtcagttgggctggccaccgggttaaacacttggaaatgtcaatcttatcgattgattttttgaagggacttctggcactttt

SEQ ID NO: 97591 - DNA, 544 bp, Heterodera glycines
  SCN-specific regions: Sequence locations=1-24,46-171,196-544
caggacacggcggtgacacacgaattgcccatcagtttggaggacctgtgcaaagggtgcacaaaaaaaatgaagatcaccaagaaaattgtgaatcctgacggcacgtcgcggacggaggacaaagttttgacgataaatgtgaagccgggctggaagagcggcacccgcatcactttccccaaagagggcgacgtgttccccaaccgtatgccagcagacatcacttttgtcatcaaagacaaaccgcaccccaaattcagaagggacggctcagacattcggtataaacaagtggttccattgcgagacgcactttgcggcatgtccataaaagtgccaactttggagggtgacatcatcccgttgaacatcaagcacgtgaccaaacctggcagcacacaacgaatccacgatcgtggcattccgaaccctaagacgggcaaacgcggcgacttggtggtggagtttgacgtgcgcttccccgattcgatagcgcctgccgcgcgggaactaatcgccaatgcattgccaccaaactgat

SEQ ID NO: 97592 - DNA, 654 bp, Heterodera glycines
  misc_feature (645)..(645): n is a, c, g, or t
  SCN-specific regions: Sequence locations=1-50,79-654
atttcgcttcgcattttctgtttcccccagttttcgctgcccgaaacagcaaaaggaaagaaaaaagaggaaagggagggagagcaacgaccaaacgcttcgacaattcctccgacaatccctccaccctcccaattccctcatttgtcagcccctgtccaacatcagaccatccattccatccgtcgcgcataacgcagaaggacaggcgagccgatcgcagcgatgacgacgataacgccccaacaaaaaccaattcttaaagcggtgattttagtcggcggcgcccaaaaaggcactcgttttcggcccctctctctccaacttccgaagccattgttccccgttgccggtgtcccactgattgagcatcacatttcgcagctttgcgaacagttggaaaacctccacgaaatttttattgttggattttacccggccgaacaatttgcgaactttatttctgattgtgagaaaaagtatcgacgcgtgccaatccgatacattcaagagaactgtccgttgggcactgccggtggccttttgcagtacaaagacattctaatcgacagaaaacctccggatgcactctttgttctgaatgcggatgcttgcggagaattccctttccttgaaatggtgcangagttgaac

SEQ ID NO: 97593 - DNA, 507 bp, Heterodera glycines
  SCN-specific regions: Sequence locations=1-507
caattaagtaatctgttcgactcattcaccgcttttgcggataattatgcgcaagtgttgcgcgaacgatggcatttgggcgaatgtggcgaagacattctgattttgattgtccaaacaccgccacaaatgcagcccaccgatgggcctcagtcgtccgcgcactcgcagcccaacggcccatttccgatgcttttcctctcgcttggcccactgatcactagtcggcttcaccccgactttgccggccacgcgcttcggcacattttgtttgatgctaatgcgcaactccaacacgacgcacgccctctcttcaaagtgctcaacgaaatgttgctgcgcatggacgccgaagtgtttggagcgttggcaccggcagaattttcagcgggcgttggcacggcaccgtcctcctttgtgtccacaccgcacgcgcggcaccggcacagttatgccgatgggccgacggtgccgtcacgcagtcacataccgccatgggcatgggcg

SEQ ID NO: 97594 - DNA, 383 bp, Heterodera glycines
  SCN-specific regions: Sequence locations=1-224,246-383
gaaaactgaaaagtcaatttttcgataccgttaaaccgttttggacttgaaaactcctggagcaaaaatgggcttcctgacttatgcggttgtttcggtagttggcggtgcggtcgccatgactggagtgggcttacccattgcgggtttactaggattttcagcggctggacccgttgctgggtccttagcggcaggggcccaggcgtacgtgggaaacgtcgcagctggctcagtctttgcagcagttcaagcattagccatggccgctccaacgccttgaaacggtattgcttgctgtctgactggaaaagggagtatatttttaatttcagcagattttagtcatgtacctgccatcttcataaaaattctacctatct

SEQ ID NO: 97595 - DNA, 409 bp, Heterodera glycines
  SCN-specific regions: Sequence locations=1-18,40-409
caaatttgttgattttcaaaaacgtttttcaaaaaattattcaaccatcgaagaaaagctgacgcgattttcaatttttgttgccaatttcgaacaattggaaaagatccgaagggaaggcgaagtgtacggaattacgacatttttcgattgcagcgatgaagaattgaaagaattgataatgccacatgaatactttgaaagcgttcccttttcttgggctaagccaatccgcgaatttcgtccgatggatgcgaattttaagcggccgagcgaattcgattggcgcaaaaacggagtggtcaatcgcgtgaagaatcagaggcgtggctgcgcgtgttgggcttgtgccaccgcaagattgggccaagtcacagcacccaattcacagcggaacacggggtcactc

SEQ ID NO: 97596 - DNA, 256 bp, Heterodera glycines
  SCN-specific regions: Sequence locations=1-153,203-256
gacagaaagatggcacagagagcggagttcggcaattgctctttcacggcattggcgatggttgcgagcgatgcgtttcgtgtgttgaagtgctcaaaagtcgtttggccagtcagggaaaaaatgttttccaatggaatgcattgagcaacaagaaaacatcatcaacaacaacagaaaacagttcaaaatgtgatgaaatggaggccttgaaaatttcggaaaactcgccaaagttgtaaaatgtcaaccaaac

SEQ ID NO: 97597 - DNA, 265 bp, Heterodera glycines
  SCN-specific regions: Sequence locations=1-238,260-265
gtcaattggtctttcgactcgctcagagggaattggcgccgctcgccactcaaattgaccgtcatgaccaattcacaaagctccgcgagttttggcgcttactcgtccaaaacggacttttggggatcacagttccggcggagtttggcgggtcggaacgcaattattttgaccattgcattgtgatggaggtgcttttaccaattgggcccaaaagcggcggcatattcaattcggctcatttttgccataaattaaactcaat

SEQ ID NO: 97598 - DNA, 605 bp, Heterodera glycines
  SCN-specific regions: Sequence locations=1-108,130-570,592-605
cggacattgggccggtgatttcacaaaaagcgaaggagcgcatttgcgagttggtcgaatcggcgctggaagaaggagccgatgtgccattggatggcaccaatgtgacagtgaaaggctttgagaagggaaactttgtcggaccgacggtgatcactggagtaaagcccgaaatgctctgttataaggaagaaatctttgggcccgttttgtgtgtgctcgaaacggaaacacttgacgaagcgatggatttgataaacaaaaatccctacggaaatggcactgcccttttcactcggtcgggaattgccgcgcaccgtttcgtctcggagattgatgtgggccaagtgggcataaatgtgccaatccctgtgccacttccgatgttctctttcaccggttcgcgtggaagttttcttggcgatgcaaatttctatggaaaggctggtcttaatttctacacccaaattcgaactgtgacccagttgtggcgttctgaggatgcctcgacagaagccaaaccacaactatcttttccacaattcaaatagtgccattttatgcattttaagacagacactgttttatcctctttaattccttaa

SEQ ID NO: 97599 - DNA, 334 bp, Heterodera glycines
  misc_feature (334)..(334): n is a, c, g, or t
  SCN-specific regions: Sequence locations=23-78,103-199,221-334
ccttcttgtcctgcctggcatatggaaagcacggaatgacggcagtgacgcggcaagctgaagcaattttacatgcactgatcatgatcaacagctccatcagcttcaccttttatgttcggcattcggacgttaacaagagacccagacgcagtggaatgctcgccttcgctgagaagcaaacttccggtagggctagacgttttggaaggatgataaaaagaaaaatgcactgaagaaatatcaacgagggcactacgagtcgaagacaaagatttcgacaaatacctcaacattgtcctaaatgcaattgaacttagaattaacgctagcn

SEQ ID NO: 97600 - DNA, 479 bp, Heterodera glycines
  SCN-specific regions: Sequence locations=1-136,158-168,193-209,231-479
tatgatgatgaactccgacaattcgagtgctatcaacagcaaatccttcgatcaaatttcggagattggatcaatggccacggacggactgcttcaggacgacggagtgccggattatgcaaaaatcataatcaaacagcagcaggcactcattgccacgcttatgaacatgcaacagcagcagcaggagtctcggtacgcgtcgaccatctcactttttcaacagcatcagccgcactttctctccaacaacgattcgtcctttccccctcctggcatccccacccatccgtctcctccgcccggcatccgtccacccgtctctcccgcgccagtgtcggcacctccgccgcctccaccgggctttcgtgcacccccaggcttcaacgtaagcgtcagttcccgcaagttcgaactcgactccaccaaatccgacaccggcggctcccacaaattcgacatcagagaggagctgaaga

SEQ ID NO: 97601 - DNA, 347 bp, Heterodera glycines
  SCN-specific regions: Sequence locations=1-136,158-347
tttgaattcaatgccaatgacaaattaatcagcaattttctgatggacactgtgattaattttgtgaaaacagctaatccgtcatccgaccacagtaccgtccaatggcttccaatggctccgaaggacccatcagaaagttttatgcatttgttgatcgaaatgccaatgccgaaaatgaacccgaaaatggaggaggaaattggcagggcccaattttggacgcaaatgcgaacaaaacacccgaagattgacttaatcaggggccaattttgaccaagccaacgcattttcactattcaatttttactctctttccctatttagaacataaagggtaatatttt

SEQ ID NO: 97602 - DNA, 299 bp, Heterodera glycines
  SCN-specific regions: Sequence locations=1-149,184-255
accagctgaagatcccgagcccggaaacgctgaaccggcaaatcccacctttgctgcatggcatacgcctcccaatgccggcgggggcttcgtcttcgtctaatgccttccaagaaacactgcgagaggaggaggaagcggccgcggcactcgcatctttgaaatgatttaaaacacaacttcgacggcattcactttgatagtctcacaataagtcgattcattaccatcccatttacattctcaaattatcctcatgtttgccattttaaaaaatatttagtaaatctatttgtttg

SEQ ID NO: 97603 - DNA, 361 bp, Heterodera glycines
  misc_feature (361)..(361): n is a, c, g, or t
  SCN-specific regions: Sequence locations=1-361
ctcgttcaatttgagtgattcttcaacaaatacatattaattaaccaattgtccaattctgtgcttatgggaacggatgtcctccagcggcagacatttgttcacattgtccatcgccatcatttttttgtgtttcgcggttactgtcgtccaaacccgctaccgtttccgggaggaaccgatgccggacgaggggcttcaccaagactgggacatccgattcaggcgcttttctgaacacatcgctcaccgcattcaaagcactctgagatgagacggtgaagtgactgacgacttttttgacatcgatttgtcccgtgaccgttttgattatgatctcgctattaaacgcaaaagaccn

SEQ ID NO: 97604 - DNA, 478 bp, Heterodera glycines
  SCN-specific regions: Sequence locations=1-478
ccaagtttgagcacattttcaaaataagttttcaattatttgtgccgatgaccttcttcaaggaggtggactatttgtcgttgcgtctcgacgacccggtgtccgcgttggccgattatctgcccaattccatcatttacaccattaattattcgttggcccttccgcccaatttggtgctgctttacatgggcctgaggccaagtctgatcacttcccgagtcaaattccccactttgggaatgacttgtgccaatctgttcggattgttcggctttcttcttctcaacattgtctatttatacacagtcttttccgacgtcagactgtccttgttcatgtgcagtttattgcgcaccgttttctacaacaccacttacgtgtgctatttcctcttccccgtccttgccgttgaccaatacctttacgtgtgccaaaacgtcgagttgagcattcgctctctgaaggcggtgattgg

SEQ ID NO: 97605 - DNA, 614 bp, Heterodera glycines
  misc_feature (428)..(428): n is a, c, g, or t
  SCN-specific regions: Sequence locations=1-518,541-614
caatttcaaatcgtccagcaaccacgaacgtcttttcttttcagaatatgccgatcttcggcgatccttcctccccttatgacgaagccgtagagaaagcgactgcggagacgatgacaaatgagaactggacattgatgtttgacatttgcgaccgcgtagcctccgaaggtccccgcgcctgcaagcagtgtttgttgtcggtgcgcaagcgtctcaaccaccgcgacccccacgtcgttctgctggtcttgtctctgttggactgtctttggaacaattgcggaacgcactttcgacgcgaagtgtcctctaaagactttgtcggggagctcaattacaaatgcacaaatagtaatcgcgttgttgcggaaagggcccgttcgctggtgaagaaatgggcggagaacgaatgctcaaaggacagntctctttcgctggttgaaagtctttacagagatcttcgagaccaaggactgagctttgagctcgattcgacaaccaacaatcattgtcagaagaagaaggcgattgtcagcaacgatccgaatgtcgtgtcgagtgagcaggaagaagcggacattgcgaaggccattgctttgtcattgcaagag

SEQ ID NO: 97606 - DNA, 513 bp, Heterodera glycines
  SCN-specific regions: Sequence locations=1-298,320-513
gtccaattaagcatccattagcattagcaaatgtgcgacgtcctcctcatcctttccctctccatttaactttagagagaagcttgttttcattaacataaaagaagatgtcaagcatcagcccggccaatcccaaaaaattctccataccttcagagaccaattgtgtggtctgtgtagacattgccacgggaaatcattattcagtcgcatcatgcaacggttgcaaaacatttttccgtcgtgccattgttaacaatcggtcgttcatttgcatggggaatggcaattgtccaattgacaaaggggttcgctgtgcgtgccgtgcctgtcgtttggagaaatgtttgcaggtcggaatggacccgaatgcgatacaatccgagagagaccgaatcggttacacgaagagaacacggcgagaaaaacttgtgggatttgacgaaggcattggccacgagaggggcgacctttgcgcggagtcttttgcttcgaacgatgccgatttggagg

SEQ ID NO: 97607 - DNA, 346 bp, Heterodera glycines
  SCN-specific regions: Sequence locations=1-2,28-346
gcgtcaaaataatgtttttaaaatttttgattctggccttctgttttcaattggcaatggctaacctatttggtcaaaaacaatctgtagctgttgttggaatgctcaaatgtaaagggaagccaagtgctggtacaaaggttaagctctacgacaatgaccattttacgactgatgatttgatggcacaatccaaaaccgacaattatggacgtttcaaattgagtgggattttttaaagaaattacgaaaattgacccaaaattgaatctgtaccatgattgcaacggcgatttcccatttacaccatgcaaatggaaaattacaattaaagccttggatggga

SEQ ID NO: 97608 - DNA, 597 bp, Heterodera glycines
  SCN-specific regions: Sequence locations=1-597
aacaatttgtcgtcaaaatttttgaaaaacggaccgttcacaaaagtcgcacttccattttttagttgcttttgtttttcaaccgaagcatttgagaaggcgcaaaaggacatgaaacagctgaaggacgagccggacaacgacaccaaattggagctgtacgctttgttcaaacaggcaaatgaaggcgacgttcggggcgatcgtccaaaaatgctcgaatttgtggcgcgtgccaaattcgacgcctgggaaaaagtcaaagggatgccgaaggcagatgctcagcacaaatatgcggagattgtcaattcgttgttgaaaaatgcggggattaacaacgcgaacacttcggaaacagaatcggacggaatccgacggacgaaggagggcaaagtgtacaaaattgagctgaaccgttccgacaaatacaatgccatcacttgggagatgtatgagggtctgatcagcgcacttggcgatgcaagcgccgacagagaaacgagtgtgacagtgatcacaggcgttggttcctatttctgggccggcaatggttggggcaatttaacgcgcggcggcaaaacgagggacgatttg

SEQ ID NO: 97609 - DNA, 348 bp, Heterodera glycines
  SCN-specific regions: Sequence locations=1-348
ttcttcttttcccttcctttaaccaggccaacaatgccgatgagtccaccgccgcctgttgccacaaatgctacgtcgcgttcagagattgtttccgcgagtgtttggacaatcggtcggagaatttggtgtgcgtgccgaactgcaaaattgccttgggaaattgctcgaccgacaaatgcggattgaaaaatataatttgaatgataaatgggatatgtggttgtttatgtggagcaagcagtctatcttcaattaattacggaaaagcaattatatgtataccaatcaacttttaacaatttgcaaatacaataaatcgcaatagaatagtaacaggaagccacg

SEQ ID NO: 97610 - DNA, 541 bp, Heterodera glycines
  SCN-specific regions: Sequence locations=1-198,220-541
agctccccgcggtggcggccgctcttcaactagtggatcccccgggctgcaggtttcggcacgaggcttttcgacatttttgaacacataaacactaacgaagacgttcagtttctgcgtagttctggaaatgctggtgccttggcaccacagccgttggtccccaacactgtctattcattgtccgatctgtgttcggcattcagctctgccgcttctctttctgcccctcctatgggcatggcttctaactccgatgcttttgggctgcgttcgacaattctccccgcggctcctctctctgcccctcccgtgggcatcagtacgaactccgatgactttgggctgcgttcgacaattgtccccgcggctcctctctctgcccctcctatgggcatcagttcgaacatcgataacactggcgcaactcgcgaacgcaaccaccaatacttttttggccatgactttacgacggaatctttctcgagcaattccgggacgacgcgcataagaaaaccgcagccgctgaacttctcgttga

SEQ ID NO: 97611 - DNA, 398 bp, Heterodera glycines
  SCN-specific regions: Sequence locations=1-398
ctggtcactatccaaggcactgcctacacagtggccgacatggccaacttattggcattggccaatgtgccaaatttggcaaccatttaccaaaactcggcatcacaaattaacgcacagcaatacacacccatgtattgcgtgcatgggaattccgcggacagcacaccgcagcaatacgcatatcctaacggaattaactcaaccggcacagtgacaaaaggggcgggggacggcactgtgaacatcgactcgttgagagtgtgccaacaatggaaggaccagggcaaattggtgaatcaagtggtcgaaattgcaaatgtttcgcacgaaagaattttgcacacccggcaattttacgatgtgatcgactcaattcttattgcctgagtaaatga

SEQ ID NO: 97612 - DNA, 491 bp, Heterodera glycines
  SCN-specific regions: Sequence locations=1-266,290-491
gtccaattaagttttgttttcatttctttcggcaaaatgtctctgtcagcgctcaaaaaacagttcaacaaggccaaccagtacctgaacgaatcaattggcactgctgaggcgacgaaacttgacgaagaatttacggagatggaaagaaaggtggacatgacaaacgaactgatcacgcaggtcatcgcgggtaccaacgaatatttacagcctaaccctgcggttcgtgccaaaatcgccgcattgggcgcaatgtccaaagtgcgcggttccaccaaaaatcaatcgtatccccaaacggagggaatgttggcggacacaatgcaaaagtacggccgttcgcttggcattcaatcggactttggaaaggccctttgtgacgcggccgatgccttccgtcaaatggccgacgtaaaataccaattggaggacaacgtaaagcacaactttctcgacccgatcagcgattttcaaaacaatgaactcaa

SEQ ID NO: 97613 - DNA, 253 bp, Heterodera glycines
  SCN-specific regions: Sequence locations=1-137,159-202,226-227,249-253
cttccaccaccgcttcatctccgcacattcattcggcgagtaacggcggaaactgtggaaaatgtggtagtcattggctccaagaactccaagtactcggacccaaatttgaacattcggtcccgcaaagtgggctccagcagcagcagaagcgattagaagagattaaattgaaatttttgcctgaatcgccgaatcattcattcattttaaattcatttaaataaatttgttgaacacttaaaaaatattt

SEQ ID NO: 97614 - DNA, 481 bp, Heterodera glycines
  SCN-specific regions: Sequence locations=1-410,434-481
atggaattacgacttttatttgcttccctatttgccctctgggcagtgacagcggcgatgcgcaagcagggggttgccatcagcggaaaattcgtgtgcggccacgcgccggccatgagcaattcgaccaaagttcgcattgtcgacattgacacagggcccgacccggacgacactttggacgaaaagtttgtggacgctgccggtgcatttaaactcaatggctacacacgggaactcactgacattgatccggtgctgtacgtgtggacagactgtaacgacgggcatacgccatgccatcggaaaatcaaatttttgatcccaaaaacaaagatcattggtgaagacccgaaagccaatgattggcttgacatcggagtggtcaatctccaatccacctttgaagaagagaaaagagaatgcattttttgatcgagtcgctcatttaacagcagaaggaaagagaatgaatgaattg

SEQ ID NO: 97615 - DNA, 474 bp, Heterodera glycines
  misc_feature (84)..(84): n is a, c, g, or t
  SCN-specific regions: Sequence locations=1-411,464-474
gggacaaagcaaaacaatcgccgcattctttgctttccatttaattccaatttatttcaacaaaatttgaatggataccgctgngaaagacaatcaaatgccgagcagcggtcgcttgggagccgaaaaagccattggttatcgaacaaatcgaagtggcgccgccaaaagagggcgaagttcggattaagataatgttcacggccatctgtcacaccgatgtttttcaagtcagtggcattaatccaaacgtcaaatttccaacgattgtcggccacgagggtgccggcgtggtcgaatcggttgggccgggcgttgaaagtgttcgggccggcgatcatgtcattccaatgccgttgtgccagtgccggaagtgcgaggagtgcgctgacccgaggacaaatctttgccaaaaatttttatatttgtaaaaatagtattttttaaattaattaatttaattgtcataaaaaa

SEQ ID NO: 97616 - DNA, 287 bp, Heterodera glycines
  SCN-specific regions: Sequence locations=1-122,144-158,180-184,206-287
agcagcagttgtcctccgctttgaacttgcaggcgttggttggggctggagcagtgcaccaaccgccgactcccatcacttccgccgcggcatccaataatattcccggcatttcgcaagaacttttattccaagcgactcttcttgcggcagcaaatttgaacaatcccggactaattacgtcgaacacaacaccacaacagcaacagagaccaaaatgataagaaggagagacaattaacaaatgttgtcgtcacaatttttagaaaaaactaaaatctaattat

SEQ ID NO: 97617 - DNA, 342 bp, Heterodera glycines
  SCN-specific regions: Sequence locations=1-342
ctgtttatatgcaccgctaatgtaactgactccccacagagagggttaaaagaccgaatggagatgattgaagttgcgggttatgtggctgaagaaaagctggagattgctcgcaaatatttggtcccaaaatgccgtgagaaatgtgctttgcccgacgaaaaattggttataaaagacgatgcaatcgattcgttgataaaatcttattgccgtgaatcgggagtacgatttttgtttatagccattgaaaaaatttgcagaaagagcgcttatcaattagtaaggggagagggcgcgggaacacaagtactgccaattggggtggagaacagcgaccat

SEQ ID NO: 97618 - DNA, 306 bp, Heterodera glycines
  SCN-specific regions: Sequence locations=1-306
atgcttaaagtgataggcaacaaaaatcaattcgaagcattcgtttcgtccaccgaaggggaaagcaaaagatcgctttttgtgcacttttccgccccttgggcctcctcttgcgcgcagttggacgatttgctgatggaacttcagagggaatacggacagaatgctttcgatatagccaaagtcgacgcggagtcattgcccgaagtttcaatggcacaaaaagtctgtgccgttccgtctgtcatcattttcaagggcggaaaagtcgccggccgcgtggagggatttcagcccgccgaattg

SEQ ID NO: 97619 - DNA, 597 bp, Heterodera glycines
  SCN-specific regions: Sequence locations=1-192,214-314,336-345,368-597
gaaaaaacaaaataaaatattcgttttgaatggattacgccaatcgtcacacatgttgttggggaccgttccgcaccagaattgaaacgggaaccactgtgatggcattgttcggatttgggctcggaattctttctgcaatttccagctatgttggctttcacaacatctatgccggaatggtgtacctggcttcgtctcttttctatctgtcggttattattgccatgaaaaagaaggagccgtcactgttcctgccttatctgattttcgagggtatcggcttgttatgcgcagcggtgatctcattgactatgtttatctttggaatttggtctccacagcaagccttctctactaaggaacaggaaatgaattttcgttccctcatgcttttctttgccgccaccgtgggcattgacgtcgctttgaacgcctggttctactccatcatttaccgcacctacaatttgctcaaaaagacaacaaagttggtggcatcggcttccgccgtcgcttcggcacgcgtgccgccgcccgtgtgatttatggcgagagattgatttgatgagtaataacaatggatggatgtgatcg

SEQ ID NO: 97620 - DNA, 498 bp, Heterodera glycines
  SCN-specific regions: Sequence locations=1-414,448-452,474-498
ggaagttggagccatcctttctttttgaactttgtgttgagtctgttctgccgacaaagaaccaacaacagattttgtcttctctcagtttacgccaactttgtcttctcagttgcttggtaaagttggaatcatcggagtataaacagcgcatcgatttcacttaccaagaaatcgcaaaagggtatattaaattcacaaatgactatgagaaatcgatgcgagtgtgcagttttgtgctgtatagagacttggacgaattggccgctagtggcgcactgagtttggcgaagggatcggattttggacaaatccaattcaaaaaagccacatcaaatgtcgaattggatgccatcattaagacaattgggagagggaaaattccaacgaaagtcgaaaattggattttatcaccagaattataattgtatttcttttatatatttgaacgcaattttattttttattatttagatttccatttttgtgttttgggat

SEQ ID NO: 97621 - DNA, 925 bp, Heterodera glycines
  SCN-specific regions: Sequence locations=1-26,48-104,130-925
ttcctaaattgttgttgcatctaagttctgttttataataatagtaatgtcgctgctgcccatcagtcgctgctcctcccttttccatgccgcccgttctttggcgtgccgtcgtcctcctcccctggcgtcgtgtcattgtttgctctcagtgccatccacggcaccgttttcgtcccatttgtcgtcgtcgtcgccagtcgtcctccacagcctcacaactccggtgacctccactcactggtgccatcgtcgtgcatttgcctctcaatcgacgccatccgcaccggtgccaaattcgacaaacaatactccggctgctgctggcggtggtggcattgggttgtatcagcgctacgagcaatggttgcagaactatccggccctgtacaaattgcatcgactcactgttgacggctccaaatggtgttactccgatctcaaaacgttcttttggttggcctacggactgcgcaaagggcgcatcacactgaacgatctcaacgcgcgcgaactgttcatctacatccaggccgggtcccaattggtcaaactgagtttgctcgccgcgttggctgtgctgcctgccggatttccgctgataatcatttcgatgcttgtgtcgcccaaattggtactgacccggcacttttggaccgattggcaaagccaacagttccaaatggacgacctgcggcgcaacgagcgcaaactgttcccccgcattgttgacgcgttgcggcagcacaacccatcgtcagcggccgcattggcagcgcttgagcagcaattgccactgactgttgaccaattggttacgctgcaaaagtcggcgaacattgtgcccgcctcgttggacgcgtacacgcagcagcaccggttcttcctgaaaagggtgcacaatttgccgttttggaccaccgac

SEQ ID NO: 97622 - DNA, 171 bp, Heterodera glycines
  SCN-specific regions: Sequence locations=1-31,54-149
ctgaaggcggtggaaaggttaccaagtcggcgcagaaggctgctgcccctggtgggaagaagaaatgagaaacgctgataattggaatggattcgatttttggatttgttgttttttttggccgtgaaataggcccgttaactttgggttttgttggataaaatttgtttt

SEQ ID NO: 97623 - DNA, 350 bp, Heterodera glycines
  SCN-specific regions: Sequence locations=1-103,125-350
tccaatccttccaggcggcttctgtccatttcgggcctcaatttacctgggggcttggcctcgcttttggtgtttatatttcggcacaaatttcgggtggtcatttaaacccggccatttctttggttcagatggccaacgggtccatctctctggtccgatttgccctgtatatttttgcccaattgtttgccgcttttctgggcagtgctgtggcatttcttggccatttcgagaattgcatgcaaattcaaacacgaaatggcaatcaagaattctcacaacttttcgccacttttccaagtcctaatttaagcatttggggcagtgttgctgatcagctgatcggt

SEQ ID NO: 97624 - DNA, 473 bp, Heterodera glycines
  SCN-specific regions: Sequence locations=1-473
ccaagtttgagtaaaataaaaccaaaaaaatgcgaatttggccttcccctttcgttcctccgtcccttcccttcgcacttttgctccccttttgcttctgtgtcgctctgttgttgcgctttggcgccggacgcgacgacgccgcggtcggcgaattgcaacacaaccgactgcacccgccggacaccaaagagattcagcagtgtttgtcgcccgacttggaggccgaggaaagcacttcgggccgtttcttcgccgctgtgatcgacgccggctccaccggcacgcggcttcacctcttcgagttcagccacgagttagagcaggagccgagcgcgttcaagctggaggccgagatttacaaggagattaaacctggcgtttcgtgcttcgccaaaacgcccgaattggcggcggagaatgtgcgcgaattgttgctgaccgccaaacggcaaattccggccgaactttgg

SEQ ID NO: 97625 - DNA, 431 bp, Heterodera glycines
  SCN-specific regions: Sequence locations=1-431
gtaaaaacctattttcgcggtttccatcttttcatagcttttacatataacagaaaggcacaagttgccatttttactacgtattattttatttgttgatgaataatgtcttctcgaagaaatgaatatctcgatgcgaaggttttaggtttttctacaataatttttcgaaaaacagttaagatttatgttggtggtttacctgaggatgcaacttctgaagaggtttttactcattccaattacgcatccaatgtcttttaggcgtccaatccgctagtaaagtttatttattgactgaaactgtatatatcaaactaaaacaaaaataggctgtaattccgattgagtcgtattggacgcacaagctagatattgtttttataattggattttaattttatagttggacgatgcgtttcatcgctttg

SEQ ID NO: 97626 - DNA, 341 bp, Heterodera glycines
  SCN-specific regions: Sequence locations=1-341
aacgatcgaatcggacataatattcgacaatttggaagaacaaatgctctttcagcattcttccgactttcctttcttccaataccccgtcgaatcagaaatcgaaaaatcttcgaaattccattctttgcgccgcgacggtcgaatatttcgccctttccgtcgcgtttgccttctctccgtcgaccaattcctccaattcgcttcgtccgtcgttcgttcgttctccgtttgaccgccattcattgcgtaattacacaaaaggtggaaagagaaaaacaaacgtcaattgttatttgcatttctattataatttttttttggttaaaatttaacagtcc

SEQ ID NO: 97627 - DNA, 276 bp, Heterodera glycines
  SCN-specific regions: Sequence locations=22-88,133-197,221-276
ttaagccatgcatgtgtaagtttaacctgccatacagggaaactgcgtacggctcattacaccagctataatttacttgaccttgacttcttacttggataactgtggtaattctagagctaatacatgcaccaaagctccaatctccccagagcggagcgcatttgttcgccacaaaaccaagcgcctaaacactagacattaaaattcaaatatttaatttgtggtattcaccatcgtataaaattttagagccaaatatgaagagagaaagaa

SEQ ID NO: 97628 - DNA, 180 bp, Heterodera glycines
  SCN-specific regions: Sequence locations=1-63,89-180
tgagcttgtaaaatccgagctcggattcgtgatctgcgcattttttcagcccagaaaatgtgctatataaatttttaaatttaattttcgaagaaaccacaaaactttaccattgccccataatatcttattttgcaattggaaaatctattttttaaaatatcataaaaaaactattcg

SEQ ID NO: 97629 - DNA, 493 bp, Heterodera glycines
  SCN-specific regions: Sequence locations=1-493
gcgatgtcaacccgacggacgacccgaaaaatcgtgctaaaatactcaccgagaaattcgaaatggacgcgaccgactcgcgcaaaatttggtgcttcggaccagagggcactggtgccaatttgctgattgacgtgacaaagggtgttcagtacttgaacgaaattaaggattcggtggtggccggtttccaatgggcaaccaaggagggtgtgctctgcgatgagaacatgcgcggcgtccgttttgacatccacgacgtcacgctgcacgccgatgccattcaccgtggcggtggccaaatcattccgacggcgcgtcgtgttttctacgcttcggtgttgacggcaaaacctcgtctgcttgagcctgtctatctcgtggagattcaatgtcccgaagcggctgttggtggcatttacggagtgctgaaccgtcgccgtggtgtcgtctttgaggagagtcaaattgctggcacaccgatgtttatcgt

SEQ ID NO: 97630 - DNA, 292 bp, Heterodera glycines
  SCN-specific regions: Sequence locations=1-75,97-292
ggctgcagcgcgtggcaaagcagacccagacaacgacaacaacaaaccgcctccgccaaaagagaaaaaacaatcaaacaagccagcaccaccggaagcagaacggaaaacacgccgcaaaaaaccaactaatgtgttggctgttccatccgccgtcgaacaagaagaaggcggcgcattcctcgaaatggttgattctctttcgacggctgtcaattcgctttcggaggcttctcactcgctttcgcaagcttctcactcgctttcaaactcggcggcgcaggaaatgcac

SEQ ID NO: 97631 - DNA, 388 bp, Heterodera glycines
  SCN-specific regions: Sequence locations=1-156,179-199,222-388
caagcggaaataatgcgcgcgggccccgtcaccgccgccttccgcgtctacgaggactttggccactacgcaagcggcgtttatcagcacgtggcgggcaaataccgcgggggccacgcggtgcgcgttatcggctggggatacgacacggacagcaaattgccatattggctggtggccaattcgtggaataccgcgtggggcgatggcggcttcttcaaaattcggatgggcactgacgagtgcggcttcgaaacatcgggcatttgctttgccgacccggaccaatccaactgaaatgcgccctctaaatgaacgctttaattatggagaaaattaagattaattgttataatctaatggatggaataaaccacataattagtta

SEQ ID NO: 97632 - DNA, 374 bp, Heterodera glycines
  SCN-specific regions: Sequence locations=1-167,189-374
agaattcgagccttactttactattatattatccaccatcacatagcaaatgctacaatttgcacttctgctgctctttatggtgtcatcatttgatccctccgctgaatttatggccaatgaccaaattagtgcggtgcaacagcagcaagctgtaaaaccaattgttggctggcatttttggtgggacggacgaaatcgaaattggatagcaaaaaatgcggaaaatgttgaaaaataaaagaaagcaaatgaacaatcgaaaatggacagaaaataaatggcgaaacattttataaaaatggcagagataagtgaatttttgtggctttcttggaaaacgacgaaagattggataaatacatatatttgtt

SEQ ID NO: 97633 - DNA, 346 bp, Heterodera glycines
  SCN-specific regions: Sequence locations=1-82,259-312
agaaaaatttattcggagataaacgttcctgagaaatatctaccagataatgctcagtcattacaaaaaaaacaacagatagtaaaattaaaagaaaaaaaaataaaaactaaaagctttaaaatttttatttttacagaataatattttaatatttaaaataaaaacttaagaaataaaaatattcaattttttttacctattaatatgaaattaaaaattctaaaattaaaataaaaaatttttttttttatttaagttctcacaaatctaccttactacaacttatcccaaaatataaataaggaactgatggacaattagtactaaaaataataaaaattac

SEQ ID NO: 97634 - DNA, 230 bp, Heterodera glycines
  SCN-specific regions: Sequence locations=1-126,148-230
gctagaatcaactttattgggcatgaatcccgattttctatttcatttcgtatacactgcgactcacaattttgggctcccgatcgaatcgccgaaaagctgactgaattgggcgcggccggaacggaaggaaagtgagggatggaacttttcatcttggaaaagcagttcctcaagaaattcaaaaatttatttaattactcattttaaaaacaatcgaaataattggc

SEQ ID NO: 97635 - DNA, 176 bp, Heterodera glycines
  SCN-specific regions: Sequence locations=1-176
gttttcctcaaaactcggcggatggaacaaagcgcaaacggtgttcgattttgtgaatgaagaaaaaatgtcgcccaatatttcttctatgcttcttcagatgcctaattcttctgattgactgatctcacaaatcaatgcatttttaaaagcaatttcataaacttttttttgac

SEQ ID NO: 97636 - DNA, 638 bp, Heterodera glycines
  SCN-specific regions: Sequence locations=1-23,78-115,137-638
ctaattcgaaattgtcccaaatgagcaaaagcagcacaagcaacacaagttatagcagtagcagcagcagcagcggctttttggaagcaatcagcggagaagaaaatgagcaaaagctgaagaagggggaggaggagacattagcaacagcagcaaagccaattgataaggtttcgaggcttttgcccccttcgccgacggcagtgccaatggcggggctgggagagcacccgcaattggacaacatggtcaaggcgtacgagagcatcatcagccatgtgggcgaagacgtacagaggcagggtctgctcaaaacgccagtgcgtgccgcgaaagcaatgctttattttacaaagggatacgacgaaaactttgatgatgtgctgaacgaggcggtttttgatgaagacaccgatgaaatggtgattgtccgtgacattgaaatgttttctttgtgtgaacatcatcttgtcccttttcttggcaaagtccacattggataccttccaaacaaaaaagtgttggggctcagcaaattggcacgcattgtcgaaatgttcagtcgacgtcttccggtgcaagaacgactgaccaagcaaattgcttcagcaattctccaagctgtgcacccgacgggg

SEQ ID NO: 97637 - DNA, 178 bp, Heterodera glycines
  SCN-specific regions: Sequence locations=1-1,24-178
aaaatctataaaaaatttaaaaatgagaattcatgcgagattttctggaaataagcttaatagggcctagttaagctgtaaaaaaaatttggggcgatttgaatgagaatagaaagagccaggttcgatgaagttttggtaagccaaaaaatccaaacatttaaaaatctataaaaaa

SEQ ID NO: 97638 - DNA, 262 bp, Heterodera glycines
  SCN-specific regions: Sequence locations=1-262
attttaaaatgcgatttttccttttctttttgctcatccttgcctttttggccccagcagcacttggcaaaagttttaagaggcgaagtgtgtctcttgacactgtgcaaaattggaaaattgaatgggcagcaaatgcaaatgacgggccaatggcatgagagaaaatggcacactgactgaccaatgtgatcgatgatcattatgagcaaagccaaaattgtgaatggatggatattcgtgataaaatttatctaacctg

SEQ ID NO: 97639 - DNA, 396 bp, Heterodera glycines
  SCN-specific regions: Sequence locations=1-396
ctcgttatggcttggctgaagatgcgaacttttctcgtcaagcattaattctttctcagaaagttcccatctcagcatccaataaaaacttggagccgcgacaacgttcgttgtccgattattggctgacgaattcaattgcaagagcctctccgaccatggcccaatgcgtcaaagcttcgcgcgactacgccgttcagcctcacacggacccgctgagactggcgaacccccacgcctaaggaagggagcgaagaaggaattcgatttaattaggtcgcttgtaaatgtcttatttaaattcgttttgattctgttttccatgcgaatcaaaagttgtaaattgaaaataattctctattcgtgtcaaaatgacaataaatatttgttgtgctt

SEQ ID NO: 97640 - DNA, 273 bp, Heterodera glycines
  SCN-specific regions: Sequence locations=1-159,192-273
aaatttttaaaaattttccagcaaataatggaaatttttttcgaattcccccccccccaaacgaaaattaaaaagtttaataggcaaatttcgtaacaggtagcactcaaattgccaaaaatttttcccggcggcgcctatcggcaccgccggacctacattttccactatttttacaagttttttgccttaaaacggccaaaatttggtcatttttagtgaaaaagtgcagttgttacccagcagtggaaaaaaagttattggttaaatagc

SEQ ID NO: 97641 - DNA, 587 bp, Heterodera glycines
  SCN-specific regions: Sequence locations=1-235,265-587
ctcgtccatgtcgacagtcgatttcttcgtcaaactcaaataaacaggcggaaaacaatactttcagccgaagcgacggaggacgcttttccatgagagggactcacaatcagtcgaccaaaggacaaccgaaggcgagcgcagcgaaagccgtcgttcagcagcaaagccctgaaatggtggcatggctcagacggaaagagtacgacccgcggaaggcggcggcagaccaaagccaaagggaagcgcagcagagacagcagcagaactctttcatggcttgtcggtttttctccacctcggccaatgccaaaacgcccttcgcccgatggcgtcaaaatcgcaagagtcagcagacgatggccgaccaacgaagcaaccgttcccacgacgacttgagccgtctaggggaaagtatggacgacgagtcgcttcatggcgtggctgtcgatccctgctcgaattcgctccaacggacggtggacgaattgacgcaaaagtgccacaagtcgattgaacttttgaaattgtgcaaccaatccggcctttcttcgtccgtagagcaactgctcgaaaaggtcgtcgaa

SEQ ID NO: 97642 - DNA, 209 bp, Heterodera glycines
  SCN-specific regions: Sequence locations=1-143,171-209
agacgacgacgttgaagaatgcgcttgttcgcatgatcaaaggcaacaaataagcatgatcagaaaaaaacaaatgatcactttgacactttcgaagagagaaattccataatagttatgttggaagataattaagccttcgctaattgcttttttaaaaatttaatttgcttatttttttgtaatgttgataaatttggcttgctttt

SEQ ID NO: 97643 - DNA, 385 bp, Heterodera glycines
  SCN-specific regions: Sequence locations=1-385
attctgctatatatttgtgtgactcgaaattcaacagcaaattgtgctaattgccaaaaaatgaacagacgttggatttgcaacgacgtttggatggacattttcccctcttttgaccgtcctcaactcggcctcaaattggcacttctttcgccacgtttcaatgcgttggggacaaacatttcgatggcaaaagcgaattgactatttggagaacgatcgaaattcgcaaggacaaaggaccagaaccgaagctgtctgtacaaatggatgacaaatgtgtgccatttccattgcccgaccgtccgttgcccagcaaaatttgctttaaatggcttcggattgagtaattaaaaaacagttttatggaaataaaagcggctct

SEQ ID NO: 97644 - DNA, 627 bp, Heterodera glycines
  SCN-specific regions: Sequence locations=1-6,31-559,581-627
cgcttcgaataggggatcccccgggctgcatgacctcggcacgaggtgcccttgttgtgctcggcgacaagtgccgcaaccagcttgcccgcgagtaccgcgacgccatcaagctcacctactcgcagctcggcaagacggtcccctcgttcctcgaggcgtccatcattgccgacgagattctcgccatcaaggacttgcccgccaaccccaagatcaacgtcgtctacaacaagttcttgtcggtgattgcctacgagcccacccacatgcacaccatctcgtacgccgacttgaaggccgcgcccaagctcgccacctacgagatggaaggcgacattttgtccaacttgcaccagttcatgtttgccacgtcggtccactgggccatgaacgagggccacgctgccgagtttgccgcccgtcggtccgccatggataacgccaccaagaacgccggcgagatggtcgatcggttgaccctcttgtacaaccgtcagcgtcaggcttccattaccaacgatctcgtggatatcattaccggtgcttcggccttgtaagttgttgtgtgtgctgtttggcgagtttgcgtgcgcgagttggcggggcgagtgtgagttggaaatg

SEQ ID NO: 97645 - DNA, 267 bp, Heterodera glycines
  SCN-specific regions: Sequence locations=1-90,117-267
aacgtatgagattgtcgagaatgaggacggcacaaagacaacaattcacaagagcatagaacggaattttcccataaatgacggaccaacagcggaggatgaggaggaggacaagacggatcagcaacaacagttgctgcacaatcaacagatggacgcatcaatgagtggataaacaagacatatttaatgatcattttctattaaaaaacccattctattgataagtttttggtgactttccgagcatcactttttcggcacgac

SEQ ID NO: 97646 - DNA, 481 bp, Heterodera glycines
  SCN-specific regions: Sequence locations=1-374,396-481
cttcgtcctcctcccccttccccaactgtcgctgcttcctaattttgttttccgtctgctgctgttgctctttgttctgtcccttctccaatggcgaaaatgtttactgcacatactaccgggattccaacgagatcacttgcggtacggtgacttgtgagacgcattcgccgttcactcccgacaattccgagcttgacggtctcgacacgaaattgccgaggggatggtaccgtattgggacactgtcaatcagacacgacagggcgtagttcaacctgtacaggcgacgggccactggactcggctattgggacttttacacacagattccggagcggaattgcatcggtcaattcggcttgcacgcgggtgaaaacattgccggatctgtggcagtgaaagacaaacgatgttttgatcgcctcgtcgtgcaaattgagcgcaaatcgaccaccgaaaagttcgatgttctccaatg

SEQ ID NO: 97647 - DNA, 493 bp, Heterodera glycines
  SCN-specific regions: Sequence locations=1-493
gtcgtcttgcaattttggtggtacaatgtcaaagggcaacaaaaatgtgaaggccgtggccgttttgggattggatgacacggacacggatgccacgatcgacttggaataccacgaccgacttgtggaggcatcgaaggacttcaaaagcgaaaatcaatacaaagaattgctccgtctccgtttcaaattggtcgccactggcgtgctgaagctggagcgttcgttggacggtctgcaaatcccgcctccaatactcgaaaaaattggcgaactgtttgactgtttggactgggctttgtctgccgacgacgaatgaaacaaattgagggatcaaaggccaagccgaaactttggacggatctttcacccacccgtgtcctcccaaaaaaagccatttttaccccgtaatcgaatttttgtattatttttttgaccgaatgatatcacgcgacattcatttatttttgcccaatttatcatcctcccaaat

SEQ ID NO: 97648 - DNA, 391 bp, Heterodera glycines
  SCN-specific regions: Sequence locations=1-391
cgaggaggaggacccgacaatggtggcagccaaatacggactgggggagcgtaacgacgacgaagcggttgaggaggagccactaaactcgggagacgaccaaagtgacgacgaggacttggacacgttgttcgacgcggagaatgtcgttgtttgtcaattcgaaaaggtacaccgagcgcgtaacaaatggcgattcacgctcaaagacggggtgatgcacatccgagggaaggactactgcttccaaaagtgcactggcgaagccgagtggtgagggacaaatgcgactgactttaatgggaggaagctgatctccaaatattcatttaatttattctaattttacacatgtttttgttttttaattgcaacaataaaatctctgaac

SEQ ID NO: 97649 - DNA, 299 bp, Heterodera glycines
  SCN-specific regions: Sequence locations=1-122,144-299
cttcaaaagtgcaaaaaaaaacaacctaattttataatttgaagatttttcaaaaagttttttgttccttttttaaattaaattttaagtgttccacttcggcaaaagcgttatggctacggcggcggtggatttggcggcggatttggcggtggaatgggctttgatggctgatttggacgctgagccgtgaagaacattaatatgcattgtgaatgatcagaaatcgatcaatataaatgatgtgcgacagaactcttttaaagactttcaagtttataaaataaattagttagcgg

SEQ ID NO: 97650 - DNA, 498 bp, Heterodera glycines
  SCN-specific regions: Sequence locations=1-219,248-390,412-498
ttcctatcaaaatcataggacaatggcaagtattgcgatcacacaaattgaccgtttgacggatctcaaccatttgccggttcatcgattgaatccgaacaacaccgaaatatgggataagctgaaagagggaaagttcgctgaggtcaatttgtgggaagagccaatgccgaaaagtggtgaaaaaagtttcgtcacttcgcaagacaacgcgcagacgacgcaacaacagcagcagcagagacacctcaggggaaaaacgccgcaaccgatcaaacggagtatgccggtgcccgtgacgaatgtgttcatgagactgaacgacgatgcatcggtgaaacgacagcaacagaacgggacgggcaaacaacagccaaaagtgaatgtggtggaagtgaagtgagtgatgaacgatggatgctttagtcactgagaacagagctttatttcgatgtctcaccgtgtaatttatttacaaaatatatttatttgacggtg

SEQ ID NO: 97651 - DNA, 310 bp, Heterodera glycines
  SCN-specific regions: Sequence locations=1-134,156-286
atttaatctctttttttaataatgtgtataaaaattcgactattttcgcaattaatcccttttccattcaatgattgacaagtcaatccaaggacaatccctgcgcaaaacggataatgtcctcgcccaattctttggggcattcgaatgccgcgaaatgacctccgtcttcaaaaagggtcatttgggtgaggttgtactgacgagagaccatttcacggggcaaaacaccgcccaaatcgtagggaaaggcggcgtacgccgtgggcacagcgacgtattttctgaaaataatgaaaaaataaaattc

SEQ ID NO: 97652 - DNA, 292 bp, Heterodera glycines
  SCN-specific regions: Sequence locations=1-133,155-292
ggaagaagcaaaccaattagcctagaagccgagaacgaaacaaatcaacagaaaaaaggcttgaagcagggacgcaggatgatgtttgccttaattttaacttattacatagagaaaacggcaattttaataaatttcacctctacatttgaaactttttcgcccctatttcgcgaattttttgcccctatttaagtccctaaattggaatttttcgcccctaaaaatccgcaccctaatgatcaatttcatattcaatgtaaaaagctcgttgaattaaacaaaatcattt

SEQ ID NO: 97653 - DNA, 580 bp, Heterodera glycines
  SCN-specific regions: Sequence locations=1-580
gtccttgtgattgccaaatccactctctgttttattaagacaatactcccgccgacaacgatgcaagcttaaagacatggcgccggctaaattcgccctctcattatgttcatctaccaatggaattgaccgaccacatttatgcgactgggatgccgagacatcgcactacatccgagacaatacccgcatatggttgtgccgacgtcgaataacggtcgctggtgggaacacaaccgtcgcttccaaggcgcagccggtcgaaattctcagagagcgcccaactcttctccaaccttccgacaatgaaaacaatgtcatgaatggcattccggaaatgcttacagcaaacgaattgacgcacgaggacagcacaaacaatgcgagtgaaataatggcagcgcaaggcaacgaaacgacatcgatagttgttgacaaggacccgctgaaggagttgaagatgatgcggcggcgattgattcagctgacgaaacgcgtttccgaattggaaacgcaaaatgcgcagaatgccaatgaaaggactttgctgctgggtattgtgagtgcgtctactttgcta

SEQ ID NO: 97654 - DNA, 618 bp, Heterodera glycines
  SCN-specific regions: Sequence locations=1-1,23-41,63-80,105-133,155 -294,316-618
cggcacgagggttatcaccaggttcttatacaaaccaaatgttgctcccttatttttcataacacttccatttgtaagtcaaattttatcttaaatacttagatttgattcgttaattacctaattcatattttctccatgacaaaaacttgttaaatgcttgagacaccacgaacaattcccgggtttcattcggcggggccgcgtcgactcagtttggccacgtctcactacagacagtttggaattgtcagttctccgttggcgacttcgtctccttctccgatgcttttctcgtctgctgctgctgccactctcccggatcgcttgccgttacgccgtccaaaaaagccaccgcaaaagttgcctcttttaatgccgcaattgcacctgcagtttccttcgagtcgaacgaacacaattcgcagcaccgatttgtcttccatttacacggtgcagccggaggaggcagcgttggacgagcgaaatgcacatttgcttcaatgtatccaaatgcaacaagaactcatcaatcaggccaccgctgcaattgcgctttgtcataaaaagttcaggttcagtgggactcttcaagagctcagcgcacagcgacttctt

SEQ ID NO: 97655 - DNA, 614 bp, Heterodera glycines
  SCN-specific regions: Sequence locations=1-45,69-138,162-614
tgagctttttcattcgttttgctaatgggtcctgctgctttgctgcttctcctcccctccctccttctgctttttctgctcatccgtgctcttcttgagcttatccccgtctcgcggttggataagcgttctgtgctaatcaccggctgcgattcgggctttggcttcgacttggcattgcgatgtttgggtgccgggatgcgcgtttttgccggctgtttgactcagacaggaattcagtctctaaagaaaagtgcccaagaaaagggaattgccgtggaacttttggaaccaattgaattggacgtcacaagtgacgaatctgtggcaaaggcattggaattcgtggaacgaaaattaggaccgggaaaaggtaaccaaaaatggagaaaagcatttgaatgtttcgaaagggcttcacgctttggtcaacaacgcgggaatcagtggcaacgaggcaaatgccgaagtcggaagtgaattttgcataatttgttcaatttcagagttgggacgattggctgattccaaaggactacgaagatgttttccaggtgaacactctcggcacaattcgcgtcactcacgcattcaaacgactcgtaaagcgcgag

SEQ ID NO: 97656 - DNA, 286 bp, Heterodera glycines
  SCN-specific regions: Sequence locations=1-215,237-286
aaaaatggctcaaatgacacattgttgtgatgccatcccaatgttcgttgagtgaatggggcaatgtgtcattcattggcacgtcacatcacatcaaaaacaaaatggcacggcatcacttgtggccaagaccaaacatcatcaggccaatttggccattgtgtattaaggcttaagtctctaccaaacaaaattactgatggtctgctattgttgaaagaaataaggaagtgaatattcaattcacatgattttgagaagcacttaattagtatgaggtggacgc

SEQ ID NO: 97657 - DNA, 579 bp, Heterodera glycines
  SCN-specific regions: Sequence locations=1-161,183-186,208-556
ctccgttaataatttttggctaaaaatggtgaatattttggccgatttggtcgccttgggcgacgttgaaaagcgcgctttggactttttgccaagggcagcgcgcggctattacgaaagcggagccgacgatgagcagacgcttcgggaaaaccgcgaggcattcagaaattttctgatccgtccctttgccctgagagatgtgtcccaattggacccttccgtcaccgttcgcctttccccctcaacggccaacccgaagtgtcgtccgttcgctcgcacttttgcctgcccaattggcatcgcgccatcggcattccaccgaatggcgcacgacgagggcgaaatagcgacagtcaaggctgctggcgagacgggcactctgatgatttgcagcactttgtccaccgttccgttggagaaagtggcagaagcggcgcccgaggggagcactttgtggtttcaggtggccaattggcatttggagaagcaatctgcgactgactcaatgaatgaatattttcagctgtacatttacaaagacaggacattgactgagaaaatcgtccgaagggccga

SEQ ID NO: 97658 - DNA, 380 bp, Heterodera glycines
  misc_feature (116)..(116): n is a, c, g, or t
  SCN-specific regions: Sequence locations=1-161,184-380
ttactaataaattattcataatgaaaaggccttcttcggttgtcgcttttggtagtcatttatttgtcggctttattctgttgtcgcttttcattggcactttgggcactgagaanaaagagacgaaacctgccgctgctcattctcccgccgatgccaaacatccgccgccagtcgccgcccacgcggccgctgggcgcggccacgccttcgatccgaaacccgcttctccttccccgctggggttgctggtgcttgttcccaggcttattcgcccaatgggggggccgcccacgggggcggaaccaaaaatgggggggggctcccgctttaaaaaatatcggagagggccccacaaggtttttcttggggtggtgggg

SEQ ID NO: 97659 - DNA, 476 bp, Heterodera glycines
  SCN-specific regions: Sequence locations=1-476
gtcactaattggccctcgggcgttaaacgacgactgacagagtaattaaatttttccgacgccaaaacaatggcagaactcatcaccaaattgtgtacgacaaaactggccattttgaaatggcttcaaatgctttgtgccgtcatcaccgtcctttttctgattgacggtcagcgccagtcgtggttctacactttggtttttgtcgtttccattgtgttcggcctcatctcgttgctcactctgatcgccaactttttcctccactcgcgcaatcagtcggtccctctgcccgcctttgaaattggcttcaatgcgttggctgcctttgtctgtttggcatttgccgttttgctcaccatcgattcagtccgaatgttcggcgacgacttcagccaccaccgctttttgccaccagcgaacattggcaaggacgggtggcgcaatcggactttggtggtggcgattgtccaaat

SEQ ID NO: 97660 - DNA, 451 bp, Heterodera glycines
  SCN-specific regions: Sequence locations=1-5,27-90,148-451
acaaatgatttatttgctgtttttttgcataattaaaaagcatttttcggtaaaaaaaatctgacaaagacaaaagtaaaaagcctattgtaataataacaataatttataatcactttcattaaatgttattttattattattattggcatgtcaaattcactgggcaattgaggcgacggacgccgcgccgctggggaaatggtggggcaggcaaattctgtcaagcacatcccgcggaatgtgttctcggagaatggcattttccgcctccaatcgaatcaccgtcgcctccaaatggacaattcgcgcacgtaacagttcaatctcatcacgaactgcgtagatgagatggcttttcacaaggtccattgcctgctcaatttttgagtctatggccaccactccgtcgcccttttgagccgtcggaacagcgccagtcgaggcggaa

SEQ ID NO: 97661 - DNA, 570 bp, Heterodera glycines
  SCN-specific regions: Sequence locations=1-291,313-570
cagcaaatagtgttgtcagcggtttccgtctccaacttacggtcatcggtaacggagtgtctacggacaatcgcctttcattcccggcaagcaaacgcctgacattgccagtgcttacttacttcttcaacgatttgatgtctcaacattcgggacggtttccagtggcggttccgccttcgccattgcatttggctcgctgcgagttggcggcggagacggtccccattccgaaacggtgcacactgcaaatagtgctcttacgtccgtgcggttcggtcgttaagctgttcatggtcgcggtgaatgtgctcgacatgccttccaattcgaggacgtttattcgtcaaagggttttcagtggtgacagtgccaaaggaacgggtgaaaaggaaaggagcggaaatgaaaacaaaacgggtgggtctaccaatgttccgaatgcaaagccttgctccaattcgttgcgctttctaatccatctgaggctggcttccgattcatcgggaaaagtctatttgcatagcgacatccgaatattattttcaaataaatcaaaagatttggaag

SEQ ID NO: 97662 - DNA, 411 bp, Heterodera glycines
  SCN-specific regions: Sequence locations=1-6,28-49,126-127,159 -298,320-330,362-384,407-411
gcaagagactcacattgttctcgggattgcctcggtgtgctctctgttggctatcatcgccacagtcgtcactctgccatctctgtactcggagatgagccaaatgaacagcaaagtgcgcgacggagttgaggccttccgcgtcaacaccgactcgggctggactgactggatggaagtgcaaggggtcgtgaacccgccgttcaagcccccgggaaacccctttcaatccattttttcgtggcaacgtaaatgggccggaaactgccaggggcttgggctcccaaagccaaattgtccctttgggccccccgggccttcgggaaccctgggaaaccccggaaaccccggggggagagaaaaccccgaaaacctggaaaagttggggaaacccctttttctggggcccgc

SEQ ID NO: 97663 - DNA, 485 bp, Heterodera glycines
  SCN-specific regions: Sequence locations=1-1,23-485
gcttcttcttcttcttcatgtatgtggaacggcaattcgttcgaattgtcgcggtcattacaatgggaggcagttccctgcgttccatccgtcgcattagctctttttatccatccctttccgtcaaccgaccacaacgcttttcatacgttgtacaaatgtcgtccgactcgaacaatgttcggcatggcgttgcgctcctttgttggcattgtggcggagattcaatgacaccgtccgacgacaacgccggcactgtccttttgtgctcgcgttgcggccgcctgcagccgttgcccgcgcgcatcgactttttctcctattttggcttggatgaccccgcaggcgcaacaattggcgaggcggagctgaagcgacgtttccggcgcatgcagtcgctggtccatcccgacaaatttgccggacgggacgaaaacgagcgcgctttggctgaacaacactccgctttcctcaacaacgcttac

SEQ ID NO: 97664 - DNA, 345 bp, Heterodera glycines
  SCN-specific regions: Sequence locations=1-3,102-240,263-345
tgcccttccccctttccctcttcgtccctctctctctccccctctccctctcaccctttcacccccttccctcacgcccctccttcctctcgccttctccccttctccggaacctcccccaaatcccttctcatctctcttcctcttctttgcacgctcactcaaataagctgggtggattgatatgcaacatgtaaacactcgaattattgggcacccaacaatcggtccctttgtcctatcatttatttcctttacttttaatcatttttaatattctttcgtaatgttctggggataacatccccactaatcctcatttttcgcttttttggccttccaatg

SEQ ID NO: 97665 - DNA, 252 bp, Heterodera glycines
  misc_feature (162)..(162): n is a, c, g, or t
  misc_feature (166)..(167): n is a, c, g, or t
  SCN-specific regions: Sequence locations=75-252
aaaaaaatttaattttaatttatttcaattgaaaataatacaaaattaaattttgattttttatttaataaaatccaaaagttagagctaaattaaattaatgaaaattttcaaacaaattttcttcaatcgggatcgacccatttccatatccataggtgnccanntgtaatcccgacactgggtaatttcgacactgacaaaggaaggtccccaggtgtccgtgggatttcaaatgaaatttggtgggtg

SEQ ID NO: 97666 - DNA, 557 bp, Heterodera glycines
  SCN-specific regions: Sequence locations=1-557
catcagttgaataaagaacagtggtcagagtcgttttcgtacggccttttccgtatggaatttgttcggaccgggacaaatggcgatatggatcaaggtcacagattaggacgacctgctcattgtcagttaccgtgtacaaaaatagcattcaacgtgaaatgctaattaaaaatggcaaataccggtcagtctccaaactcaaaattatttaatgcggactaaatcgatgaaaatagaatttggggcgcgcttgcccttttttaggctgaaaaagtgccgggactgaagtgtccaaatccagccgttacggtaggggtcaactccgtctggccaactccgtctcagcaatgttcaaaaagctataacttttttctttgttggccaaacttcacaatcatgatgattgcacgtaattgccgaaaaaattcgagaccaatttccgaatgttgaccgactaattgcaaaacgaaagccgtctttgtcaaagcgccttaccgagtcaaaaaatttggaaatgtatctcatatgcaatttaaaccaatgaatttgaagaa

SEQ ID NO: 97667 - DNA, 640 bp, Heterodera glycines
  SCN-specific regions: Sequence locations=1-640
aagcgattgaaccaaaagcgattggttggagcacaacaaaaattgggccattgcccgcatcaatcggaaagcggtgcccgaaaatgcatgtgatccgaagacgcaacgtgaacggttggaggaagcaaaacatacggccgagctgaacattgcgtcgttgaagcgttttgaggacatggaattggagcggcggaagcgccatcagaaaccgacaaagcgactcgcgttggacgggccgcgtgtgcgcgagctgtggacacgggacggaaagcatttcatcacatttgtgcccgaaccaccgccagccgagcaatgctttccaaagctgaagccaagggagttccgcgtgtgcgcaatcagtggacagcgcgcgcgttacattgacccggtgacgcggctgccgtacgcggacatggacgcgttccgtgtgttgcgcgagaagtaccgccaattcttggagacggaccatgaccatattcaacagagacagcagcaacaacagcggaagaagtcggcggcaaatgattaaattggtcattatttgatttttttatttaaagaaatgtaccatctttttttattcgattgtcttcgtcgtccattcatttcatttgtttgaattattaaaacattcaatttg

SEQ ID NO: 97668 - DNA, 628 bp, Heterodera glycines
  SCN-specific regions: Sequence locations=1-124,149-356,381-628
gtttgaccaactccttcgtggaggcactgcggctggccggttcattcatcccgtcatctccatgggcgcccaggccgcgtgtcgtccagtgtaccagggccaagaaccgtcgctgaattgccaaaatcttttcttgaacaacatcatcttacggtggcgttcaaagttctaaaggttcaccgctcggccattcatttggccatctgttccaacccgatcaagccaattaagctgtactggcagtggaatgagcgcgttatgggggtgtactggcgacagggtaaccggaaaaaaaggctatgcctgagatcagtcaaatgtgcgaccggggcaatgtgacggtggagaaatcgcagcttttatttgttctatttgttgccttcaacctttgcctatggcttcaacatcgactgtcaatgaaaagcgagcaagatggaaacaggattataaatgccgaaaaatgggccgtctccattgtgagatgcgttcattggtccgtacgcgcaataattttgaggttgaacgcatcaaactcacttgtgagcaaccacttgcccaatcagtcgccgatgcagtggaagaaagcgaggagcttgtcaatgtggaacagaagccgaaaaaaattcca

SEQ ID NO: 97669 - DNA, 506 bp, Heterodera glycines
  SCN-specific regions: Sequence locations=1-158,183-506
cagcgagtagggggcgaaggcgggcggggggcgggcgtgcgccgattgggtgtcgcgaccaagggccgcgtcgacaggggcggcccgggggagcccgggctgtgccggtcgcacaatgaggagagcaacggctcaggcccgcgtctcctggccgccccgggccccagggacctcctggacccgatggacagcccggcaaccccggagagtctggccaacccgttcttttcggcaaactcacccagggcccgcccgtcgttggaccgcctggcccatcaggaccccctggccagcccggacagcccggcgagaacggacagcccggccagcctggaaaccccggcccgcaaggataccctggcgacggcggaagccccggccaacccggcaaccccggaggcagcggcgagcccggacagcccggagcacagggatccagcggccaatgctaccattgcccaccgccccgcaccgcccccggctactgagtgtgatcagtcgaccat

SEQ ID NO: 97670 - DNA, 585 bp, Heterodera glycines
  SCN-specific regions: Sequence locations=1-71,93-585
cggacagtgtggacgggtcaatttttaaaaatcaaaccgaataacggaatacgctccccctgacaagccgaatttaaatatttaagccaaatcttccagaattgctcacgaactcgtcaccgccgaactcatagatggccatgatctcgtcgtagtcgcggccaaccttcagaaactgatcgacttggcccagaaaaaggcggaaagaaggacgatcactttcgctctcaattccggcgttgcatccaatgaaattcccgacgaacgttctttgaccggttttgctcagctttcactgttagattaattggttcttccatcttctacaaccatccttttttcacaacaaatccatccgttaaaccaaccgatttcgcttgacttaaggaaaattaatcaccggcggaaaagtgcgattcgtttcgctttattttgctttctttttgctgatgccttacgaattccatttatttatgataacagtgattatttcgagttcgatgtttctggcccaattgttggttatcggaaaagtcactttttgggatttagcaaccgttagctgacaaataatcgcatccaaat

SEQ ID NO: 97671 - DNA, 633 bp, Heterodera glycines
  SCN-specific regions: Sequence locations=1-360,383-633
gcggaattcccaatccccgccaacaaaaacggcgactgcttcagtctcccgcagagtccccaaatatacaaacaattgctaatgtgtggctccatcgaccgttattaccaagttgctatttgttatcgtgatgaagatgcaaagcccgacagacaacccgaattcactcagctcgacttggaactttcattcacctcacaagagatggttttgtcactgattgagcaaatgatcgtgaattcatggcctgatgaaattactcccaaaccgaccatcccttttccgagaatgtctcatcgtgaagccatggataaattcggcactgataaaccatgatttttaaggacatcggctcagatgcctcttttcctcgtttcgattttgtgtgggttctcaaattcccgcttttcactcgaaacgactccaccaattgcttggaaagttcgcaccacccattcactgcgccaattcccgaacattttgaaaaactttgtcaggggaaggatctcgaccaaatcgaagctcaacattatgacctcgtcctgaatggcgtcgaaattggcggaggctcgattagaattcataattcaaaagtgcagcgatatgtgatggaacaaatactcaaattgaaga

SEQ ID NO: 97672 - DNA, 609 bp, Heterodera glycines
  SCN-specific regions: Sequence locations=1-47,69-316,338-566,608-609
gtttgagcgaagatcactcaaaaggggacgcccatggagagcagcgacgccaacaataacatcaacaacagcgagggggaggccgaaaataccaccaaaaacggcggagaggagggcgtcgagaagaagatcttgagcaaaggcgtcagcggggtggtcaaatggtttaacgtcatgaatggatacggcttcatttgccgtgatgacaccaacgacgacatttttgtgcacaattcggcaattacagcaaataatccatccaaaattcagcgatcattgggcgatggtgaaaaggttatgttcgacattgttgatggtgctaaagggccagaggcggccaacgtgactggtccggacggagtgcccgtgcaggggtccaaatatgctgcagatttgagccagcgtcgacgttttgcgggtccacgacggaattatttcttccgcggaaatcgaaaccgccgtccccggcatagcgaagaagcggcaggtggcgaagtgccggtgggcgaaaagaaagaaggcgcagaagaaaacaatcgtcgaaacgtcgcgggctcaacatctggtggcacagaaaatgaaggcgaacagaaaaaagaacaaacgcag

SEQ ID NO: 97673 - DNA, 479 bp, Heterodera glycines
  SCN-specific regions: Sequence locations=1-374,396-479
cgcagcgaaaaatttgtttgattcccatctccgcccatggcacaaatcccgccactgcgcacatgtccaatttccgagtggtcccagtggagtcggacaaacacgggaacatcaattacaaggacctctcagcaaagtgtgaaaagcacggggcggagttggcatgtgcgatgatcacttatccgtcaactcatggagtgttcgagtccaacattttggatgtgtgccagaaagtgcatgagtttggaggtcaaatttacttggacggtgccaatttcaatgcccaagtcggcctttgtcggcctggcgattacggaagcgatgtgtcgcacttcaacctccacaaaactttctgcattccccaggggggaggtgggcccggcatgggccccatcggagtaaaagctcacttggccccctttctgcccggccacccaattgtgccgatcaaaggcaatcgttccggcgctgtggccgct

SEQ ID NO: 97674 - DNA, 335 bp, Heterodera glycines
  SCN-specific regions: Sequence locations=1-36,59-137,159-335
cttaccacaaaatgttgggccacttttccaaacttagtgttcgttgctacgcttctgccactaggtttcgtccggtcttcgaccgggtgctcatcgagcgttttctgcccgaacaaaagacgaagggcgggattatgattcccgagaaggctcaggggaaggttctcaagggtactgttgtcgccattgggcccggttatcgcaatgacgaggggaagacaattccgatgcaacttcaaattgttttccgtgtcttgttgccagagtatggcggcgctaagatcttggtccgccacaaggagggcgggggtgtccgcggagcggacgtcatcggg

SEQ ID NO: 97675 - DNA, 474 bp, Heterodera glycines
  SCN-specific regions: Sequence locations=1-474
aatactcacttttcaaacgggtctcagcgccgccggcagagcacaaattctgaacagcgactcttctcttccttcgactttttcttccgtcctttcaattgcattgagcgatttgcacgtccgaatgcaaaatgtgcaagaagaccaagtccgagccttgctgcaagaaacaagtggtggagctgcgcaatgacattgccaccaacggatgcatcgccgggggcatcgaatgctgcgatttgacggcgcacactgtgcagcgaagaccccaaacgactggccaactgtttctggaggagctgtacttcgtcaagcacgtcgacaacaattcactcgctgattctccccgcgagcgtgaaattctggccgaatatcgcaatttgctgtactccatcattctgaatggacttcgccaatggagcaagtcgggcgtactggcacaaatcacgaacggagaacagttcgaacacgcgc

SEQ ID NO: 97676 - DNA, 528 bp, Heterodera glycines
  SCN-specific regions: Sequence locations=1-528
gctcgccgcggtggcggccgcttaccaatagtggatcccccgggctgcagtaactaagaacgaggatagagtgtttgcacctatgcttgcaggcaacgtagcgtgaaaagaagcacgtcgcttgatgttcgcacccacatttgtgacgtgaggctgactcgccctcgattcaagttgggacgaaagcctatgaaccgagtctaagctcggcagagaccactagtgcaatgtagccattcactgataacaggatacatttgaagcacaaaggccgactggaccatcatcaccattgcatcggcagcatcttgtcactttggacccgcacatccgtcattgtgattctcgtgacatccctcccgctctctggctacctgttggttgtgtcatgcattcacttgtacaagtctggctcgcgatactttgcaagcagcggaggcacatccaccccggcatcgtcgctcgctggcggctcgtcgactggcgacgccttgattcccatggtcgtagcaggcgcgcaagtcttgg

SEQ ID NO: 97677 - DNA, 526 bp, Heterodera glycines
  SCN-specific regions: Sequence locations=1-249,307-429,451-455,487-526
gcctttaaacataatttccaaatgaccaacgaaattacgcccaataccacctttggagacataacatcggaccgagtgttttatcgtcctacttttgtgaccggtgatcagatggatttgtccctggccgcgttggcactgcgcgaggggagcaaatcgccaacggaaagtgtgtgcagtttcgacttgatgtccgctgttggggaggacggagagcaaaacatcgccgacgaattggcttccaatggaactgctggagaagtggaggagcagcagcagcacactaagcagaacaacaagcagaataatgaaaagaagtgtttcgccattctcaaagttcgaccgattagcgtcaattcgaccgcggcgcattgtccgaatttgaaattcgaattcgtctcgaaaaacactgctgacaatggcacaacgcagcagcagcaactttccactgccgcttcttcgtcttcctcctcagctgctgcttcttccgctgacgaagtgccaccgattgcgccttccgttggcc

SEQ ID NO: 97678 - DNA, 158 bp, Heterodera glycines
  SCN-specific regions: Sequence locations=1-158
gcaagcaaagcgcgggagcggaggggaagctgacctgcgctggagagccgttggcggatgtgaaggtgaaactgtatgatgacgaccgcggggtggacacggatgatctgatgggtgagacgagaacggactcggagggttttttttttattggaggg

SEQ ID NO: 97679 - DNA, 272 bp, Heterodera glycines
  SCN-specific regions: Sequence locations=1-22,44-65,142-143,202-272
gtttgagcgctaaaatgcaagagactcacattgttctcgggattgcctcggtgtgctctctgttggctatcatcgccacagtcgtcactctgccatctctgtactcggagatgagccaaatgaacagcaaagtgcgcgacggagttgaggccttccgcgtcaacaccgactcggcctggactgacttgatggacgtgcaagtggtcgtgacgccgccgtcgaagccccgtgataaccccttcatcctttcttccgtgccaaacgtcaactgc

SEQ ID NO: 97680 - DNA, 251 bp, Heterodera glycines
  SCN-specific regions: Sequence locations=1-251
cgatgtgaaaaaggaaaagccgaggagaaggcaaagggaaacggcgaagaaaacgatgggaaatgaccaaaagaaaatgcgcagttcaatgatgaaaatggacaattcaaacattagaatgcttttttaaaggttttaacggaatatccttccctttcttttggctcttctgttgttaaacaatttcaaaaatatttatttccgaagaattgtttgtatttgcgcagacaaagcaagaaaattacaaaaaa

SEQ ID NO: 97681 - DNA, 205 bp, Heterodera glycines
  SCN-specific regions: Sequence locations=1-205
actttatttcagtgcccattggtgtccgccgtgccgcaatttcacgccggtgctcaagaaattttatgacgagttgaaaaagtcgccggagacggcgccctttgaaattgtttttgtgacctttgatcgctccgccgatgatctgagcaacctatttcgccaatctttttttttttggctgggaattcctcttggaaaggccaca

SEQ ID NO: 97682 - DNA, 184 bp, Heterodera glycines
  SCN-specific regions: Sequence locations=1-184
taagatcagagatggcagcggttgatcaacaccagcaacaactcgttgaacgcattaaacagcttgacaccctttcaacaacggcggatgaacaatttgacaattctttaaatgtgccaattggcgatttgtgtcgtttgctgttggccgcgctggcgggcgacgaattggccgcgggggaggc

SEQ ID NO: 97683 - DNA, 476 bp, Heterodera glycines
  SCN-specific regions: Sequence locations=1-201,223-476
cgctaatttgtgggactcgcgcgcggacaactgtttttacgcggcccgctaccatggcaatgtgtccgaccaattccatgaaaaagtcaaatattgggagattgaggatgtgcaaaatgtgagcgaccgtcggatctccaaggattgttcgggctcattctatgggtgccagacccacgcgtgcattgatgcaaaagggaaccccgtttttgtgttcaacttatgtgcttcttcggctgctgcttccggagagaacaacactggtcactgctctcaccctgaattggaagaactttgcgccatggaggggggcaaatcgaaatgtgccatttgcgagaatggcatgtgcaatgaggcgaacattgagctgcaaaatgtgatggggctggacatcaacggcaccattggcacggcggttggtggagaatggcacgaaaagtgccaaaacgggcgagaccggcggagacacgacggac

SEQ ID NO: 97684 - DNA, 525 bp, Heterodera glycines
  SCN-specific regions: Sequence locations=1-163,187-217,245-430,452-525
ctacaacagtggatcccccgggctgcaggtatctggcacgaggtccttctccccagttcaaatctttaacgacgaggccagcgaggagcgtgccgagaatgcgcgtctttcgtccttcattggcgccattgccgtgggcgatctcgtcaagtcgacgctcggacccaagggcatggacaagatcctgcaatccatgtcgacgggcgaaatcatggtgaccaacgacggagccaccatcctcaagtcaatttggttggataaccctgcggccaaggttctcgtcaacctgtccaaggtccaagacgacgaagtcggcgacggcaccacgtccgtgtgcgtgttcggctccgaactgctgcgcgaagccgaaaagctcgtcaaccaaaagatccacccgcaagtcatcattgagggctaccgcattgcgtctgccgcggcgctcaaggccctcgaggcggccgccgtcgacaatggcagcaatcccgaaaagttccgtcaggacttgatcaacattgccaagaccac

SEQ ID NO: 97685 - DNA, 478 bp, Heterodera glycines
  SCN-specific regions: Sequence locations=1-478
acttatcaattcggggcgttatccagcagagaatttgatggcgagttgtccaaagacagatgagtcactattggagcaatgcaaaaaattggggattggaacgacgagtgacaacacgagaatcgctcgagagaatgacgtcatcattttggcggtcaaaccgatgaatattagcaaagtgacgtccgaaattgcacccaatttccgaagggagcatttgctaatttcaattgccttagggattacacttcgctacatcgaacaacttttgccttcaaagtcccgcgttgttcgcgtgatgccgaatacccccgccgttgtcggggccggtgcctcggcttattccatgggctcggcgtgcccagatggcgactccaaagggggcccagagttgggctgcccccggggatatgccgcgcggggggccgacggtgcgttggagcccactcaggcggatttagcgggtccgggcccgggt

SEQ ID NO: 97686 - DNA, 382 bp, Heterodera glycines
  SCN-specific regions: Sequence locations=1-280,302-382
cgggacggttgtgatcacacgcggcaaaacgttcgaagagttcaagcaggagtatgagcgtgagtcggtttcgaggcgtgcggcatttactcgcggcaccattttcactgttcttttttatccgggcatttttgttggcattttggcggtcatcagtgtcatgtctcatcgctggtacacttatgtaaattttttgtacgagtaacgtttagagaaatccccaactgatttcagggatggtcccagtctctcctccccccccaagacccctggacacccaaaattatatttttgctcaaaactttatgattttttttttgctgggacctcctgcaagacctgggaccgtccctgcctgatgattgtcccctgccccatttta

SEQ ID NO: 97687 - DNA, 249 bp, Heterodera glycines
  SCN-specific regions: Sequence locations=1-249
ccgacgacaacgaaagggcagaaacgattaacgcatttggacgactgatcagattcatcgtagaagcaatgatcgaagggtatggccaaagagtgactgagttgagaacggagcgaaggggcagcggagagacgacggaggaaaagggcaaatcggacgacgaattgaaaagtgatcgaaacgaactacaaaacataccatagattattcatacaaaacaaaaacatacacatataaatatgtagcctt

SEQ ID NO: 97688 - DNA, 260 bp, Heterodera glycines
  misc_feature (29)..(29): n is a, c, g, or t
  misc_feature (54)..(54): n is a, c, g, or t
  misc_feature (67)..(67): n is a, c, g, or t
  misc_feature (108)..(108): n is a, c, g, or t
  misc_feature (126)..(127): n is a, c, g, or t
  misc_feature (138)..(138): n is a, c, g, or t
  misc_feature (145)..(145): n is a, c, g, or t
  misc_feature (164)..(166): n is a, c, g, or t
  misc_feature (168)..(171): n is a, c, g, or t
  misc_feature (174)..(174): n is a, c, g, or t
  misc_feature (176)..(188): n is a, c, g, or t
  misc_feature (214)..(215): n is a, c, g, or t
  misc_feature (220)..(220): n is a, c, g, or t
  misc_feature (224)..(226): n is a, c, g, or t
  misc_feature (229)..(235): n is a, c, g, or t
  misc_feature (237)..(238): n is a, c, g, or t
  misc_feature (240)..(243): n is a, c, g, or t
  misc_feature (249)..(249): n is a, c, g, or t
  misc_feature (254)..(255): n is a, c, g, or t
  SCN-specific regions: Sequence locations=1-86,108-117,164-196,228-260
atggtcgtggcgttaataatcctcgtccncactttggctaggcatcactttgcncgttgtttacccnacatttaactataattcaaattttgtttggttttttccccntactttcccttttttttnntttcccttttnttttccnttttctttttttttttttnnnannnnccncnnnnnnnnnnnnnctttttttcccccccccccccccccnnccccntccnnnctnnnnnnncnntnnnncccttntcccnnttttt

SEQ ID NO: 97689 - DNA, 172 bp, Heterodera glycines
  SCN-specific regions: Sequence locations=1-96,119-172
gggcgacccaatgaaattggagggttcactccgtggccacaacggatgggtcacgcaaattgccaccaacccattgtataagaatatgttggtgtcggcctcaagagacaacaccatcatcgtttggatgcttgatgatagtgggtcggcgttacccgcaaaccgataccac

SEQ ID NO: 97690 - DNA, 630 bp, Heterodera glycines
  SCN-specific regions: Sequence locations=1-564,591-630
taatggtcgagaggcgcaaggaatcgcctaagcgtcgccgccgttcgtcaagttcttcgagttctggaagctcttccagtactggttctagctcatcaggttcatcttcgtcctcttccaccactgcttctcgttcaccttccccaaagaaacaaagagcagctgctcgtccttctgctcgtgacgatcgtactacacgtcgttctccaagaaggtcgcgttctccccatcgtgtccaaccgaaaacagagaaaagcactgtcagctctcgccgttcaccgtctccccgtcgtcgtcgtccgtcgcctcccagccgcggcccgcgtcgccgttcgcgctcgcctcgtcatgaacgcgcggctccatcgccaccaccagtgaaaagggaacgtactccggaaccaccgccacgccgactttgtgttcgaaatctaagcagaaatatcacaaaagcgccacatggaggaaatcttcgctctgtttggggctctaaagtcctgtggagtgccaatggaccgtgtgcatgtgcatttgccccggggatacggcgagggtgatatgagagaggggaggaggccgaggaggctgctgaacataaggaacggaggccagagtgagagcctggaaatt

SEQ ID NO: 97691 - DNA, 542 bp, Heterodera glycines
  SCN-specific regions: Sequence locations=1-542
gtccaattaagattcttttaaatttgaataaatttgaaatgacgacaatagcggcgaacggtggcggcgaaacattttcacgaaaagtttttgtaggtggactgcctctggacatagcgcagcagacggagctggaactttctcgcgcttttcgacagttcggcgaacttcaaatagaatggcccaccaaacgggtgaaccagggcaaaacgacattggacggcaaaccggcagggcccggctacgcgttcattgttttcgctgacccgcgttcggtgggtcttttgttgagcaaatgtcgccgtgaggtgacagcgcccggggagaagacgcgtcgttacttcctgacactgtccagccgaacggtgcacaacaaacccgtacaggtccgtccttggcgtcactcggacgccgtgttcacccctcgttcggggttgcccgttaacatccgatggactgtgtttatcgggggccttccccgtcccaccagagcgatcgacctttgccgagtgctgatgccccccatccgtggaggcgtttgc

SEQ ID NO: 97692 - DNA, 488 bp, Heterodera glycines
  SCN-specific regions: Sequence locations=1-488
gaaaacatggtctacgaggtctcctttttcagtgacgaaacaggcataagaaactacgagttagtaaagccgggcccaacagttcaaattcagcttgaagaaataatcaaacgtgagctatgcaaatgcgagacacgtgttttcaatttgcttagcgcaaaaaaggaaatggtaaaaaaattggccaagtgtttggccgagaaggacaacaacaggatgggcgaagctgaaatttccgatttcttctaacaatacaacgcggacaaagtcgcaaccggtcaaaaaaccgatggaagtgatgggaacagtaaagtgaccgatacaatggaagtgtagacccgatcgatttgcatggaatgcataacatttttaaaaaaatcttattttttgttaacaaatctcaccaattttcacattgaaaaatttttatgcgtcagaagtgttttttaaaaaaacttatgcttcataaatatgtattttggtaaaaa

SEQ ID NO: 97693 - DNA, 643 bp, Heterodera glycines
  SCN-specific regions: Sequence locations=1-450,473-643
cttacaattttcgcttcaaatgactttcgcttttgctgtgctccttttgcttttcattcctccgctgacattggcaaaaaatgcgcgagcggagggacccgtgccggttgttctttggcatggcatgggcgattcgtgctgcaacccgtacagcatgggcttcatccgcaaattgattctcaccaatatgccccatgcttatgtgctttcgctgcagttgggctcctcagttgccgaggacattggccgcggctatttcgccaatatgaacgacgaagtggcggccgtgtgccaacagttggccgaggacgcgcgacttgcgaacggttacaatgccatcggattttcacaaggcgcactttttgttcgtgcgctcgcccaacggtgtccgtacccgcccattcgaaatttgatttccatcggagggcctcagcagggcatttttgggctccccttttgccccggttccttttacatttgctcgttcatccgtcgtctgcttgacaatggcgcgtacaccgaatttgcacaacacaacctcgtccaagcgcaatattggcatgacccaaatttggccgagggctattgccgcgcaaacattttcctggcccacgggaactgtgaacggagctgccaccagccc

SEQ ID NO: 97694 - DNA, 647 bp, Heterodera glycines
  SCN-specific regions: Sequence locations=1-647
gtctatgcgtcgtccaaatggtcgactgcccccagcaaaacggacaccgccagcaattgcctctgttcaatgcttccgagcattttttcgaaggggctgagaaactatttgaaatttggttcgataatgaccagcagaagcgagaaaatggccacaaaagcacactgagaaccattcccgagaacgaactgcggcaacttctgaacacggccgggtgccacattctccaggtgcttagaacagctgaaatcgatgcgtatttgctaagcgagagcagcatgttcatctcggatcgacgtctcattttgaagacgtgcggacagacgcggccgttgcttgtgatcggaaagttgttggagttggcacggaaacattgccaaatggacacagtgaccaatgtgtattattcgcgtaagaatttcttccggcctcatttacagccccaactccacgccactttcgacgaggaagtggattaccttgatggcttcttccagggtggaagcgctttttgcatgggtcctctgaagcacgaccgatggtatttatacactttgactacgccccgtgctccgctggactgttccgaccacactttggagcttgcaaatgacggaattcctgtggagttactcagtgcctacagt

SEQ ID NO: 97695 - DNA, 339 bp, Heterodera glycines
  SCN-specific regions: Sequence locations=1-313,335-339
catttcccacttttcctatttcctcattccgcttcccccatttcccacttttcctattgcccatttccgcttcccccatattgctccccactcgcccaaccacctgtactgattgtgctcgctctcctgcgactcgccgccgtctcctccgcccgactctttcagtgccttccttttgcgtctcttcgccgctctcagctcaatttgacgttttgtgcgcggaattcgaatgcgcacaaaacatttttttatgacaatcatcaccaatagaacggaggagaccaggtctattaccatccacagacgaagggccggcgcgacgaactgatcgagcaaatg

SEQ ID NO: 97696 - DNA, 582 bp, Heterodera glycines
  SCN-specific regions: Sequence locations=1-27,59-582
cttaagtgtcggtcaataatgaaattatttttgttattttctttgtttttaatacaattttcttccgccatcgataacatggaacatcttatgccagaaaatgacgcagacagtttgatttcgtatttagaatttcagcgttggcataaagcggtgatgggagcagagccacgggaaagctcaatcctttttggcaaaaatgataaagacgcagatggcatgctaacggtggccgagtttgttccattggcatttgagcttagccgaaagcctccggaacgtcagacggacaaaatttttaagaaatttgatgtcaattcggacgaacaattggaccgtcaggagcttttgaaaggcgattccatctccgaggaaattgttgatggtctttttcaggtcgccgatgtgaacaacgatggtcgcatttcatttgacgaattttcaaccgtggccaacactttggaaagtcgcttgtccaaggatgagaaaagcgcgggcatggccatgtcattgttggcccaattggacacggacaaagatgaacgaattaatggcactgaactgtttgaatatgctcacaaa

SEQ ID NO: 97697 - DNA, 422 bp, Heterodera glycines
  SCN-specific regions: Sequence locations=1-387,418-422
ggaatgctaccgtaactttctgttaagcgttaccgttacccaccaaacattcaccaaacgacggcgactgcgtccgctttcccaactccgcccgtcagtggcgcagcaatgcctgtgccgggctccggactgagtctacaggtgtccgtgctggccggacaacactcagccgcacatttgcacaatctgagcaccaacgaatggggcggcacttcgacggtggaccatccaagtcagtattggccccaatgaccgaacgaagggacaaatagcgaacggagaaagcgaaccgaccgatccatggacaaatcacaaatcaacagttgtttaccaaagattttcaaaaggtcatcgattcattcacaagcgtattgtgcttttcatatcaataaaatttgaaaatatattaatttaaatgtgtt

SEQ ID NO: 97698 - DNA, 552 bp, Heterodera glycines
  misc_feature (525)..(525): n is a, c, g, or t
  SCN-specific regions: Sequence locations=1-104,130-239,261-552
gtccaattaagcaattttcaataaactccgtgttggccatcaacgagtcgttcacgcgttttccgctggagaacagcgagagaaaacggaacgcgaatctgcgtgagcaaacgaagaaagacagaggcattggggagagtgaagcagctgagattgagaacaaagaggataaacggcagaagcgctcgcgcggcacgcaatgattcaaggcaaatggagcgtgaccgtattctcttccaacgccaacgctttcccaccgtcgcctcaattcaccatcagccggcgacttcgtccgcctccggcgttttggtgccaattccgacgacggacggcgccgccgctgtgcccggcagtgccggagggtatcagaggcggtattcgacacatcgagaacagcagctgcagcagaggaacagaagggacagcaaattcagcaggcgtttggccgtttacacttcaccgccagaagacagtgccgccggggccatttcacttcggccgctgaatactacaataatcagcagntcgcccagaacggggagcagcagtgac

SEQ ID NO: 97699 - DNA, 475 bp, Heterodera glycines
  SCN-specific regions: Sequence locations=1-5,27-475
tggacaatttccttttttggacccttgcgccttccaaacggctttcaccgccgcttctgacggaaggcgcgtcttttcaacagcagcaggatgagagacaaatgcataccgttgacctgtctcaacggttcatcgactcacttccctcttctttttttctgggtgaacatgcaacttacaaagaccatgccgccatttcactgcttaatttggctcacaaccattttgtcactgtccccccgttggtggcacagttcatcaatctgatcagcctcgatataagcaacaatcacttggcattgttgccaaaagagatctcttcgttgaaaaaccttcgcgaactttcacttagaaacaatttgctagagaatttgcctaaagaatttcaacgactgcaatgtctacgggaattgaacatttccggcaatttgttggagcatttcccgcgagaactgctccaaatcaaatctctccg

SEQ ID NO: 97700 - DNA, 389 bp, Heterodera glycines
  SCN-specific regions: Sequence locations=1-31,62-202,226-389
gaattcattccgccatttgagcaagagggccatgacagagaggaggaggaggagaacagcaaacggaggagggcactgaaaatctgtttcgatttgccgtccggcgcctacgccactgtggctctgcgcgagttgatgcgcaccgactttggcaaaaaggcgcaaaagcaattggaggaagaaatgatgaggaagagaaggcggaggacggaggaagcagaaggcgaatagggaagaagcgaaaacgagcaaaagaaagacgacaaaacggaaatgtgccaaattaaaacttaaaacatttttttgttgttttgattgtttcctttttcaccacttttacttgttaattttatgttggtattcccgatatgtgtgattgaaagaataag

SEQ ID NO: 97701 - DNA, 473 bp, Heterodera glycines
  SCN-specific regions: Sequence locations=1-102,124-340,362-473
tgagaaatgaattgaggagcgggggaacaaactccaatattaccgtttttctgcgcttatgtcttatggaggtcggaattgaacggatggaaagcgatgagaatttggaaaatttaccaaaagtggattggacgataacaccagaaccaattgtcatccgtggagttggacacctaaccctgtttggccttaactcgcattttccaacggaatttccgagcgctctgataggaaaattggcaccttaagagtttgacgacacattgcgacgtgtgaattacgttcttcataggaatgttagcagaaacttgcgctggttgatctgcggattgcttttttgctgctgcagcttcagcatttcgctatggccggcggcctgactgaacagaaggactatttccgctctccgcaaaacgctggaccgtggaaatcccaatcgtttccccaacccggcatcgcaatggcagttagcc

SEQ ID NO: 97702 - DNA, 449 bp, Heterodera glycines
  misc_feature (440)..(441): n is a, c, g, or t
  misc_feature (444)..(444): n is a, c, g, or t
  SCN-specific regions: Sequence locations=1-449
taagttttttatccttcctttgaaaattatgttttgcaatttctacagaatttaattgtgtcctcatttggcgtacaatgacaacaggtggcgcaaatgaaccgagattccatgtgctggcccaattggaacatcttcagtcaaaatacacaggcacgggccatgccgacagttctcgctgggattggatcaccaaccagcatcgtgacactttcgcttcaatcattggccatcccgaccatttgagtatgatggccatttgtgagaatgagacgcgtgctcgaacgaagtacaacatgctctgtcggatggttcagccgtgtggtccgcccccggaaaaatcagctttagacgatctttgacagctcacaatcggtcgcgaaaggatcatcatcttttatttgttcaactataaaatgttttcatcgactctttcaaannaanaaaag

SEQ ID NO: 97703 - DNA, 392 bp, Heterodera glycines
  SCN-specific regions: Sequence locations=1-209,231-392
gcaacagcaacaacagcaggatcgctgaagcggacaatggcagcagtttcgacatggacaccgacggggcgcgccaatgggacgaaaatgaggacgacgacatggacgacgatgagctgatccggaggcaggacatgctgctggacaccgagcccgtcaaccaccacgaggtccattgtccctactttccgggcgacaaattcgagtggtggtacttgtttttgttggagcgcaaaacacgccgactggtcaccatggtgcaaccgtgcaagacgcttgaccaggagaagacgcacctccgttgagacctcagcacactgaacacaactgcgcaccatttcttcagccttggtcatcacatattccggctgaaaaaagcgcaaatttcaatc

SEQ ID NO: 97704 - DNA, 356 bp, Heterodera glycines
  SCN-specific regions: Sequence locations=1-149,171-356
gcgtggtgaacatcggttcgtcgctcggttgtattggacaggcggccgtttcgcctcggctgagtccgtatcagaacgtggcttatggcatgagcaaagtccgtccccttctccgtccgcccctttctttgatcagtgcttaggctgctcttcatcacttctccaaaatgatggctttggacgagtcggacattgtcaccgtttttattcatcccggttgggttaaaacggaaatgggcggtgctaacgctatgatgagtgtttccgactccgttgcaaaaataatggcgcggatttgcgcactcacaaaaagcgactcgggaaaattgctataccgagaaaaggaattgttgccc

SEQ ID NO: 97705 - DNA, 614 bp, Heterodera glycines
  SCN-specific regions: Sequence locations=1-614
accaaacgatgttaagcgaaaccgtgaaaatcggatttatcggagccgggaaaatggcacaggcattggcgagaggacttatcaattcggggcgttatcctgcagagaatttgatggcgagttgtccaaagacagatgagtcactattggagcaatgcaaaaaattggggattggaacgacgagtgacaacacgagaatcgctcgagagaatgacgtcatcattttggcggtcaaaccgatgaatattatcaaagtgacgtccgaaattgcacccaatttccgaagggagcatttgctaatttcaattgccttagggattacacttcgctacatcgaacaacttttgccttcaaagtcccgcgttgttcgcgtgatgccgaatacccccgccgttgtcggggccggtgcctcggcttattccatgggctcggcgtgccgagatggcgactcaaaagggggccaagatttgttctccaccgctggatattctgttgaggtgccccaagttcgcgtggagccaaccgcggagtaagcgggcgcgggacccgctgatggctgttcggtgatcgaggcggtcgcggacggacggacatcatccggcctcgcccaagag

SEQ ID NO: 97706 - DNA, 284 bp, Heterodera glycines
  SCN-specific regions: Sequence locations=1-284
ggacaattgcctggacaaacgggctgatccggataatcgccactactgccgggttgatccggatacgctactggacagccgggctgaatgcgggagaagcgccaagacaaccgagctagatcgcgagaagcgccaagacaaccgagcaataatgtattaagccattacggatgacattagattttccgacaagaaacgtctactatgaaaatgtttcaataatacaccgaaccttattatgtaaaatattcttataaaattttacgaaaaagaagaacaaaaaa

SEQ ID NO: 97707 - DNA, 200 bp, Heterodera glycines
  SCN-specific regions: Sequence locations=1-200
ttgaaccaattatcagaaactcgcctgcatttaaaagcaactaagacaagggttacacgcgaagatggctcagtgatcgaagaagagaaaactgaaaatggcgagtttgttgtaatttttgagcgagccaatggaaatggaaatccgagtggatttaaacaatccaagcgaatgcaaaagggtcgtggctatgtcattga

SEQ ID NO: 97708 - DNA, 396 bp, Heterodera glycines
  SCN-specific regions: Sequence locations=1-29,51-396
gctgaaggttttaaaaataacacatggtgccacaaaatttttttggcccggagcaaaaaaaaaactcttcgggtgccctcccgaaatttttttctgtatacgggcctgaactcactcgaccacccagaaaagtgtgttcattgtcagatggatgttgcgttgcttttggcacgttccggggccagcatcgaaaagaagaatcgccagaacaaaacgccgattgatttggtcgacggcaaagaacataaactgaaactgatcaaagcgagtgaatcggtgaagccaactgccggaacatagccgaattcctttgttaaatcaattctattgtttttcaatgtaattgtaatgaatcttttgatttcacttgaccaattaaaaattctgaattattag

SEQ ID NO: 97709 - DNA, 590 bp, Heterodera glycines
  misc_feature (420)..(420): n is a, c, g, or t
  SCN-specific regions: Sequence locations=1-590
atgatatatttattctgaagaatgcctgtcgtaaaaccacgaacggacacgccgaatttacgaaatttcttttaaacgttgggactgctccgtgtattgttgatttttttgctacttggtgccaaccatgcagtgcgatcgctccgggttttgacgaattatccaacaattatcttaatttgaaatttgttaaagtggatgtcgacaaatgcgaagaaacgaagaacacatacggcgtcagtgcaatgttttcattcattgttctcattaatggtcagcgcgtggaccttttgcgtggtgccgacaaaactgcacttcagaatttggcccacaaatggtccaaaaattgtccaactcaaatggtctcaccgattcctggccaatgcgaattgtcaccgcttttcaacaaaatccaatgcnaatgtttgaacgaggacgattccaacaatttgaacaatttgctgaacggagttggtcccctgatcactgattgtgacgagcaactgctgatcagcggggcggtacaccaacccgggcaaggggactccggcctttttaacggccccagaagaaaaggcgccgaaaaactg

SEQ ID NO: 97710 - DNA, 163 bp, Heterodera glycines
  SCN-specific regions: Sequence locations=1-128,151-163
gttcgaaacaattctggcaataatttggcttctccgccaaacggaaccgcaacagcctctaagaatttgttggcataaacactgatgcattttgatgaaatgatttgataataatgattttattccattaaaaagaaattgcagataaaaagcaaaattatgt

SEQ ID NO: 97711 - DNA, 258 bp, Heterodera glycines
  SCN-specific regions: Sequence locations=1-258
aaattgttcggttatcgacgcaaaaaagtgacaaaaaaggactccctcaccggacggaacaattcatttccagtgccgtatttgtccaaattggaaggcaatcagttgcaaccggggcaatccctaattgtacgtggcattatcatttcttccgatgagtttgtcatcaatttaaccaatggtccgcgtgtcgaattggacgacgaagtgcggacactcgacgatcggccgccgcgcctgtttttttttatggggcaa

SEQ ID NO: 97712 - DNA, 273 bp, Heterodera glycines
  misc_feature (237)..(239): n is a, c, g, or t
  SCN-specific regions: Sequence locations=1-273
gaaaatatttttttaaaacctatttctattttatactcacgatattctcatcaatgagtactaaccgaggacgaggacgtgtgtctttaccgagtggagaccattctcaaacttctgaatatgggggtcgtggacgtgggatgtattctttcgccaccagacagggacgtgtaaagcatagttccgcgtggccagtgggacggtggaaactttctttttgccgggaggagagagaannnaagagataagagacccgctcggcggagggagggg

SEQ ID NO: 97713 - DNA, 379 bp, Heterodera glycines
  SCN-specific regions: Sequence locations=1-379
cacaccggcgccaaattcaacaaacaatactccggctgctgctggcagagggggcattgggttgtatcaccgctacaatcaatggttgcagaactatccggccctgtacaaattgcatcgactcactgttgacggctccaaatggtgttactccgatctcaaaacgttcttttggttggcctacggactgcgcaaagggcgcatcacactgaacgatctcaacgcgcgcgaactgttcatctacatccagtgcgcccctgaagtggtccacattacgaccatcttcattttgctcgcaattcctgtcagcggagagctcgtcactttgttggcgcttgtgtcgcccaaattggtactgacccagcacttttggaccgaa

SEQ ID NO: 97714 - DNA, 384 bp, Heterodera glycines
  misc_feature (384)..(384): n is a, c, g, or t
  SCN-specific regions: Sequence locations=1-384
tcctcggcgaagcgatcatttcgctgcatccgttgacaaatgctctgatcactctgttccttcttcggccttatcgcgaggcgttgaaacgaatccgtccgccgttcgcccagcgaattccgctgctgctctgttccaactcccagcggagtacgacaacggccaaccgaagcgtatacgacagcacaggaccaacgaccatcgacgacttggctatttttggaggagtggccaattgcgacgacactccgccagtttcattgtgacaaggaaacgctatgccttgccagaaatacgaacaaaagtgccatcatttgttcacatcatttcattaatttgtaaatatgtatattcctttcatcgaaaaaaacaagtttattttan

SEQ ID NO: 97715 - DNA, 232 bp, Heterodera glycines
  misc_feature (232)..(232): n is a, c, g, or t
  SCN-specific regions: Sequence locations=1-197,223-232
cggatacggtggaagggacggatatgagcagagcggatacggcggatatgcgcaacgcggatacggtgaaaaggacggatacgagaagagtggatacggtggaaaggatggataccagaacgagtaccatgattattacaaaaacaatcgctgatcaatgacttatttatcttccgatctttgcagtgattaaagtgtatttttaaataattaataaataatctttatctcn

SEQ ID NO: 97716 - DNA, 553 bp, Heterodera glycines
  SCN-specific regions: Sequence locations=1-377,399-553
gtccttaagctttaaaaatcttctattggatggagctgttgcccgagttcgacatgctcctcgccatttgtggttccgcccgccaattggccgtcatccatctccaacaaatccaccgcgcattcaaagttgcacaacagccgacggtgtcctgcacaaacattgccaacatcgaacaatgccatattgcggttgtcagcaactcggaacatcaccgcgacaaacgcaccattactgatgaccgcattctgttcaaatgtcgcgcggcgcatcgcacgggcaacggactgaacgccggcgaattactcttcaccgtttccagcgaagaccgagtggaactgcacatttttggccacgccgacgcggcacatctccaacagccgcagcagcatcagcagagtgtcaagtcaattctcaaacggaaaatcttgatccatgcctttcgacaacttttatttattctttcgaacttaatttttgtttaacttttgggattgccacttggcgcttgccttttatgatctgattttgtgcgcataaatctgcttgctat

SEQ ID NO: 97717 - DNA, 344 bp, Heterodera glycines
  SCN-specific regions: Sequence locations=1-166,190-214,237-317,339-344
ctgacctgacccaccattcaccatcattgatcacggatgattttgagaccaaatttggcattttgatcatcattgacctttttttatttatgtttttgtccgttccatgagccagcaattgttgatcatggatttagcccaatgtatgtgactagtatgactgcttgcatttacataaaatttaaagttatgcagctaattatttactctcacttcccccattaatgaaatgatgtaattaaactataccaggcttgatcaacctgctgatttaaattggtatggatttgaaactttgcattaaacgtcactctgacacatttacattttaggaaaacaagaag

SEQ ID NO: 97718 - DNA, 311 bp, Heterodera glycines
  SCN-specific regions: Sequence locations=1-311
aattaaacaaaattattcaatgcaatccaacggggctgcgaccggcacggcatcggcggcggacgccgggcgggcgaacacggcacaaatggcgcaggcgaatggtggcattgaacgtgagcggaagccgttggagagtcgtcaaattgttgcacaatacatcaaatatgcagtgaaattggaacggatcatttgagcgaaggcacacggctggagaaaatcggacgagtaaacgaaatgttataacgaaaattttgtataacaaatgttgtgttgcttcgttttactttgacaattcaattcaatgcaat

SEQ ID NO: 97719 - DNA, 474 bp, Heterodera glycines
  SCN-specific regions: Sequence locations=1-474
caatattttgcgcaggagagaaccgatgtccagactaagcaaatattcctcgcaatttgcaggtcatttgtttcgcccgctgttccgctgaccgttccgctaagcgaagatcgtcaggggaatatttacgtcagttgggatgttttgtccttcgacggcattcgccgctccttcgctggtgctttggcctggcagaaaagccaattcgaggcatttctgaccatcatttgtttgattgcttcttctacgctttctcaggccgtcctccaaacggcgtcggaattacgtcgcaaattgcgcttaattgacgaatttttcgccgatccgttttcctatgcccaagagaggcaaaaacgatgactggcaaaatgttggagacggaaagcaaattttcgggtgaagcgataattctggcaaatttaccgttgtgtatttcaggaattcattgctttggcgaatttttacaaatgttga

SEQ ID NO: 97720 - DNA, 365 bp, Heterodera glycines
  SCN-specific regions: Sequence locations=1-146,168-272,316-365
catcagccggtgaaatggaacgcgagaatcggcgagtgcgatcaaccagactcagccagcaaagataccgcgagaagggtaatgaagcacgcaatttgttgcctcagctgtacagtcgaattgctgagttggaacgggaaaacaatttgttgaaggatttgttgtggagagaacgcgaccccaacagtttcgcggtggcacaacagcagaaaatggtggaaaagaaattacgaaaatgaaaatgttttaatcgaattctcaaaatgcaattgtaatttttaacaattttttttactcattttttatttaattattcgtattttctcgattatttgaatgtttccaaaaataggaatggaatcgtg

SEQ ID NO: 97721 - DNA, 593 bp, Heterodera glycines
  SCN-specific regions: Sequence locations=1-593
aaatgtgctacaaaaatgttttattatttattgtaactacagtagcaatttttgagacgtcatttggagctgaaaacaatgcaacacaaccacaaaaaaagcaggaattgacttttgaaaagacgatggaggaaatgatcatctcggcaaaaacgggcaaatttgtgcggcaatgttcttgcgatgaacaggagccatgtctgaaggacattttgacggattttcaagcctgtttcgagacatgctgggaacagaaaaactcgggaaaaattgcccctaagccagaggtgttaaagcaatgctttgagagccgtttgggcctggtcaaccagttcatctcgtgcattaacactaccgcaaaaacctgtttcccgaccaaatcaggcccgcaaattgagtacgtgtctgtacaacgaattgttgccgctggggaacaacgcatggcggcacaagcaagcggctttgagcgcgcaatgggcccagcaaataaaccggtggttcaggctgccgaagaactcgccagctgtatgaaggattgtttcttagacaaggacgctggccaaaaatgtttcggcaaatctgggtgtcaacca

SEQ ID NO: 97722 - DNA, 547 bp, Heterodera glycines
  SCN-specific regions: Sequence locations=1-32,56-547
cacgacttggaaggactgtttgcaaggctgaaggagcttggcatcaaaattgccatttgcacagcggacagtcgggcgggaacgacgcgagttttgaagactctaaaagtcgaacaattcgtggatttgatcgtttgtggtgacgacaaaggatcagtgccgaaaccccagccggacaatgctctgttcatctgccgtcaattgggagtggaccctaagaatgccatggtaatcggcgacactcctgccgatttgggaatgggacggtctgccaaactcggctcaatcgttggtgttctgtcggggattggagaacacaaagaactgaacgaagctgaccatttggttgaacatgttggagaacttcttcctctgattggctgagatttccacgttgtcgtgggactgcgcataacccaaagtcggattgaatcaatcctttgttctgtcgatacgtcgtgcttttccctccccccccccaaatttccccctttttttttgtttcccctcccatttttgccaacacattccgaatgaatgagcttac

SEQ ID NO: 97723 - DNA, 584 bp, Heterodera glycines
  SCN-specific regions: Sequence locations=1-176,199-477,560-584
aaatggccgattgttgggacgatgaagactacgacccatccgcgcaaatggcggacaaaatcgccagcctcggcttggacgacgtcattcggcaacagcaaccgaaaggggaaaaagtgccgacgcaagcgacgaataacagccgaaaagagggcacagcgaaagagggggcgacggaactgagcgaaagggaaaagagagaggcgcaaatgagggcggacggaacggcggcgatggatttgttcggcttggccgtcgagcgcaaggagcccacctttgacgaccttcgcacgaaggacgactttcaggcatttgcggataaattgggcgaacaaatcggggcgaggaatgaccacgcgaattactcactgtttgtcagtgctttggttgaccatatgacaaagccaatgagcaaattgcaactgcaaatcgtcatggcaaaaatacaggcccatttagacgttcatttgaagcgcgaggaggaggagcagaaactgcaacaggaaaagaccagcaaaaaggagacgaaaaaggccaagaaaaaggagttggaggaggacgtcattgaggacgaatacgacgac

SEQ ID NO: 97724 - DNA, 569 bp, Heterodera glycines
  SCN-specific regions: Sequence locations=1-154,176-283,318-492,516-548
atttgtctgtcatccaactttgtgtcacttacggcaacaaaaatttggcttttcgcctcatggaccgactgaatgcgtacgaggagcaagtgaaggcttatctcatcctcggagaagtgaaaaaggcagcgacattggcagttgaaagggaagacttgcaaatgttacagagcatcaaatgccgactggcgccatcttctgccaattgggaggaagtgaagaaaatcacggacacattgctgaagaaggcagcacatgcctaattgcgcaatgattttcatactttatttacttatttttattatattattatttatgggtacgcgggtcggttgagccaacgattcagtccaaaacccataaagagaaaaacaaagctttagtcatataatcttaatttgaatcacttctctttaatgaagtggttggattaagcaagaaaaaccaaaaaagcattggcacttaactgacatagtcagtcaattttattgtttcccaatatttccatttttaaatactgcaatattattataatttaaatgattgtcaaaaagtgatggctgataaat

SEQ ID NO: 97725 - DNA, 561 bp, Heterodera glycines
  SCN-specific regions: Sequence locations=1-561
ctcaaattgaccgtcatgaccaattcacaaagctccgcgagttttggcgcttactcgtccaaaacggacttttggggatcacagttccggcggagtttggcgggtcggaacgcaattattttgaccattgcattgtgatggaggaattgtcacgtgctagcggttccattggcctcagttacggcgtccattccaacgtcggagaatgtgcttggcgaggaagactgcggcttgtacattctgatgtccggtcttgattcggagcgattggtttttgcggcggcacccctcggattgatgcaatctgcttgcgacatcgctttcgagtacgcccattgccttcggcaaaccgatcggcaattttcaggtaccgtttcgacttctgttccgcatttcgacgcccgctcagcttatgcaaggcaaattggccgatatgtacacgcgtttgtgcgcctcccgggcgtatttgtacgcagtagcacggaacgctgtttcggctgaatgtttaaaggcaaaagattcggcagcggcaattctttttttggccgaaaaggcattgga

SEQ ID NO: 97726 - DNA, 316 bp, Heterodera glycines
  SCN-specific regions: Sequence locations=1-316
acaataatgaaccatgaccagctgcagttggtgaacagggaaggctgggccaagctcgctttctacctcgtctcattcttcatctacctgtacggcatgatctacacaatggtgaccacttaactgtgaagagccggacgattttcgcgcccttctcaaacaattttcatttattgcccctaaaaatgtgccagattaataattaatcacaaaacatgttttgttttcgtgtgccagtattttcacctaatatgcatttttttcattaacttttgctgtaatatgacaaaatattggcattaaaaaatttttgatt

SEQ ID NO: 97727 - DNA, 373 bp, Heterodera glycines
  SCN-specific regions: Sequence locations=1-215,238-346,368-373
agggtccccaaaactcacacagccataattgacttaattaccttttaataccctcgcactaattgctctcaagatgtcgcctctccgttttatcattgcctttcttttggtcgttttgtgcgctttttccgcactgataaccgcgcaagaagagagagttgacaatgaacctgctgctctgcgcgccagacgcggaatgtacggttcgccgtattgtggcggaatgggcggcggcggaccatggggaggaaatttcggaaagaaatgagaagggagcaaaatgtggtgatcaagacgaacagaacaagccatttgattgaatatttgtgaaaatagtcaatgtaacaattagaaagaaataaaattacaattt

SEQ ID NO: 97728 - DNA, 361 bp, Heterodera glycines
  SCN-specific regions: Sequence locations=1-361
tgtctgttcctttgacttttttcatgctaattgtcccttaaattggtccattctttgctcattttccctcttaaaaagactttgtgccgtacaccactgatcgcaatttggtggacgaatggatcaaaacgaatgatgcgaatgcctttctttttcgcggcgactgatcagcggggagggattgctgtgcgggggttcttccggcgccaatgtttgggcggcgatggaagtggcaaaacggatgggcagagggaaacgcgtggtcacaattctgccggacggaattcgaaattacatgagcaaattcatcgacgacgaatggatgagagttaagggatttgaaggaatttgaaaaagggga

SEQ ID NO: 97729 - DNA, 272 bp, Heterodera glycines
  SCN-specific regions: Sequence locations=1-272
gacaatgtccatcgttggagggcactcgcttcgtgccgaagtgattcaactttacaagacgctgtaccacttgggcaaggactatccgcaaggctcgcgttggttccatgaacggctaaaaaacgcattcgcacgcaacgccaatgtgcaggaagaggccaaagtgcgcgagctgatcaaacggggcgagtacgtggtcaaggagttggaggcgctttatcggctgcgcaaatacagggcaatgaagaacagatattacaatgattaaatgt

SEQ ID NO: 97730 - DNA, 195 bp, Heterodera glycines
  Promoter: Source sequence=SeqID_9660; Location=3637..3831; Strand=-; Gene=SeqID_72243
gcttaaacgggaatgattatcgataggatgggaaacgatggagaagccaaaggaaaaggaaatgcaaaaagacgggggacaattggccaaccgaaaggacacccaaaacggcacctgtaccgcacaaagtcatttctcatcagaagggccaaacgtttgtaatgattgttgaagaaagcgcgtctaaaaacaatg

SEQ ID NO: 97731 - DNA, 870 bp, Heterodera glycines
  Promoter: Source sequence=SeqID_21473; Location=238..1107; Strand=+; Gene=SeqID_52084
ttcatttttccaacctaacctagattttatttaatttcctaatatcagtggacctgccaaaatagtcaaagattgaatccgcgttgttttggaattgtaacaggttcattcttgctctcaaaaggttgaaagcaggttgaacctgttcaacccttaaaaatgagagtgcagtaagactgcgaactgcttgcaaaaacgcgtttctggcacctattattgcataaaacaaatacatttgattacattaccaatttcgaaatccaacatgagggtttgtggtgcaatttgaatgtgattgtttaaagcctatttatgagttttttttgcaaaatttgttctacaccaaaacctgaaaagctctgaagtaagtattttgggccttattttgcattaaaatgtaagcgcttgcaaaactagctgtttcaattaaaacatttatggtataaagttgcaatagctgattcggtacaactaaagcagaattttgtattattattcattattgttattattatttttattatttttttgattttatttttttgattttatttttttgattttattcattattgttattattatttttattattattatttttattattattatttttatttttattattcattattgttgttgtgagcaattgccacccaattgctaccctttaccaagccgccaaaacactaaaaactctaaagagtgcgcatattttaacaagcgcgacaatcggtgccctcggtggagcaataactgcacaattaatcgaggacttaatcgagatgctagtcgaaaaatttgaaaataacggtattataatcataaataaacaacattaggttaggtattgtttcagacgacatg

SEQ ID NO: 97732 - DNA, 344 bp, Heterodera glycines
  Promoter: Source sequence=SeqID_5243; Location=2043..2386; Strand=+; Gene=SeqID_57415
agtccaatcaattggcttagttgctatggcccattatctgtaggaatctttgacctaatcgatgttaatccggataaatattatagagagggaaaggaaaagagacataaatcatacatttttgtttttaccaatgatcatatatttcctttgtaaatttcaagctaaaatagttttcaagtaatcacagcttaacctcgatgaaaagtgggccgtccaccggatcgaccattcaatcatcatcgtcaagagcgagcgataagcacatcacgacgactgcggcctcatccactgatttcattaccaaacggcgaaggtgcaatagttgggacttcaagacaatg

SEQ ID NO: 97733 - DNA, 126 bp, Heterodera glycines
  Promoter: Source sequence=SeqID_10979; Location=1472..1597; Strand=+; Gene=SeqID_74289
ggttttgtttcttttaatttgtttacaaaaaaactgctattggattttttggcgaattatttattttcccatggtctgtctgatgctttaaaactgtaaattttagacccattgaatccacaaatg

SEQ ID NO: 97734 - DNA, 511 bp, Heterodera glycines
  Promoter: Source sequence=SeqID_25919; Location=1..511; Strand=+; Gene=SeqID_56685
ggagttgggggttggcgcgacagaattggccgcctcgcttctccccgccccgccccctccaaataccaacgcggcattttctcacaaggcataacgcccacttccttctcgtattatttggaaaatgattgcttcagggatcacgccggtgtttttaaatttgcgaatttaaaaaccaaaaaattccataaaataatttttatcataaatctctttaaaatttatttccctgtttttcgaaattttgaaaaggtcatttaaatttttctctttttattttttaaaattggccattcattggcaaaaatttcgtagttaagaaaaatgacagctaataagcaattcaacaacagcttccttttccccattacaaaacggcggattggtgccacggcggaaagggcacaaaaatggcactttaaaatgcggagaaacatttcgcggaagcgtttgttgaagattgtgtagatgatcgggttcaccttgagagggaagaaagtgtggtcaaatg

SEQ ID NO: 97735 - DNA, 605 bp, Heterodera glycines
  Promoter: Source sequence=SeqID_2506; Location=1722..2326; Strand=+; Gene=SeqID_80121
acaatttaattattcattaattagccaaaaagtacaacatcgttggcctggttgtcccatctttgcaaattccaatttcaaaactgcacaatgttttctttgcctatgcccaggctcagctctttgaattagaggtgggatgacagagcactcaaaagcatcactctttcaatagattaaattgtttataaaatttttatattgaacaaattcagaaaaggcaaaaattatgcatcaattattttgaaatataaaaatttaaaaattcagtattgggtattgcgagtttcggaattttaaggaggtcggattatggcgattttttcatgcgaaaatatcgaaatattaattatttagttttttgagttaagaactttgcctatcattgtttgttttatattgatgagaatgcggacactttgctcaattcggtggcatttttgcaaattgaccaaaaaacgttgtgtgaaattttgagtcgtgacgaattgcaaatcagtggagaaatttcaatttggaacgcagtatgatattaatttatctaagaaaattacgttgatattttttggctatccgttgggctgacggaaagtgccgtgaaaatg

SEQ ID NO: 97736 - DNA, 137 bp, Heterodera glycines
  Promoter: Source sequence=SeqID_15407; Location=3903..4039; Strand=+; Gene=SeqID_79672
aattgtttgtcacttataaaataggtcaatttgtgaatatttaaggtttccaaaatggaattcattgtaattgctacatttgttccatacttttcttccaaaaattttccatcccattctattgttgatagaaaatg

SEQ ID NO: 97737 - DNA, 1003 bp, Heterodera glycines
  Promoter: Source sequence=SeqID_6754; Location=1050..2052; Strand=-; Gene=SeqID_62749
tttaatcttgaactattttaaatgcaattttcattttacaccgaaataaaggaggcttttacttttggcctaagcctttagctttggttcgagataccatttaacatgtatttgtttctttttggtttaagcctgttctcttggttagaatttaaacttcccaccatacttaaagttttacaaaaaatatacgttctgtaaattttattttggcctaagcgtttttgtaccagtttgaatttaatcgtcactcatagagtatcatgcgaaactgacgttatgtaaatttacttttggcgcaagcatgttgactcggtttaaatttaagattccgccatttttggctttccataaaaaatggcgttctgtaaatttatttgtctaacttttttgtaccagtttgaatttaatcgccactcatggaatatcattgcgaaactaattttatatgagtttttggctctgtttaaaatttagcgcaaaactcgaattgaattttagcgccaaaaaccctgttattgaaacgaaattggcgttgtgtatagcgtattgtaagacaatttatagtaatttgaatttaattttggcaccaaaataagctggcgttgcgtgttaaacaaattattgttcggctatggtcttaatttgaatttaatttttagcgccaaaagtatgtattgaaacgaaagtttgtcacaattaatataaatagccgtcatttcttcacctagtaaaattagccattcatttgataaattaaaaaaaaataatttatttaaaaccacatcaataattacactgattattatttaattactctcgcatatttaccccacaattatctctaatttatgcactattttctttcttcttttcagtttctctgactattattgtgtttttaacgaaaatttctattgctccccatatattttcattataaaaatatataaatccatccatcacaccatagcaaattttaaaatataattcgatatcaatg

SEQ ID NO: 97738 - DNA, 126 bp, Heterodera glycines
  Promoter: Source sequence=SeqID_27800; Location=295..420; Strand=+; Gene=SeqID_58462
tttgattgaatcttttttccttatttatatactttccgacagatttgattgtattattttctttaattatatctatttttaataattttgttattattaaattatttttagctcttctaagaaatg

SEQ ID NO: 97739 - DNA, 314 bp, Heterodera glycines
  Promoter: Source sequence=SeqID_22813; Location=696..1009; Strand=-; Gene=SeqID_53518
aaatagctttggtactaattaattttgtatcccattttggtcattttttatcattttaaaatattcttttaactggattaagaattataatgctcgatttttgtttttaataaatatggcaatttaaacaagattaactaaattaaaaaatggacacataattaggaattaagcaatgggatttaatggaattaaatgtcgagttttataaaaatttttgttgattttttaatttgcaaaaaacaatgccaggttcttcttgagagcactgaagaaatgaaaaagggaccagattataaattctttcaccaatg

SEQ ID NO: 97740 - DNA, 129 bp, Heterodera glycines
  Promoter: Source sequence=SeqID_33498; Location=1..129; Strand=+; Gene=SeqID_63544
aaatattttgaattttttttatttacaataatttataaatatattttttcttttttttaaataaatattttagttatttttcggtcggatgaggaaaaaattgaaattgtgagaaattttctgaaaatg

SEQ ID NO: 97741 - DNA, 484 bp, Heterodera glycines
  Promoter: Source sequence=SeqID_927; Location=1..484; Strand=+; Gene =SeqID_64221
tcgcgtccttgcgctcagaagcacatattttttaattcgtaatatcactagatgtttttctattagcttacatagtttacaaaaaacttttgacaaaaaatgttagataaacaaggttttttggtttatcttggtcacaatttttttgaatcaacaaaaatttctgaattttgaaggagaaagttttggtagaaataaatggaaatggaatcaaaattattaaagttaaaaaatttaaaaaaatattattttgaatatttcacaatataattttcccagatgaatgcactttaaaattctgataaattgtacaatcatagagaattattttgcttcggaattttctctgatgagtaagcatccagtaggccctgtcagctgcctttcatcgaacacactaagagaaatttgatttcatttttaattcagttaacagttaccaatgtattcgtaatatttaataaataatttttagttaaaaatg

SEQ ID NO: 97742 - DNA, 188 bp, Heterodera glycines
  Promoter: Source sequence=SeqID_29353; Location=451..638; Strand=+; Gene=SeqID_59861
cctaaacaattgaaattttggccaattctgtctaaccccaaccaaacaataagtcaaaacaacttagtttttcaattttgaagaccagcgacctcaaaaccccatatttttatcatccacccaactgggagcagttcgtttcccaccccacccctctccggacagttttttaaggggggaccgcgatg

SEQ ID NO: 97743 - DNA, 846 bp, Heterodera glycines
  Promoter: Source sequence=SeqID_11609; Location=2708..3553; Strand=-; Gene=SeqID_75058
attcttatataatatttaattaattaatataaataaaaagtctgaattaatattagagatcagcgcgagggatcggtgcacggtgccgggtcgcgttactcaaaacccatcaaaatgggcgttactcaaaaaaccatcaaataaaaatttttgacagaaaattcttcacaaatgcgcataaaatgaatcaaattttaaaatcttgatattattagagatagcttaagtgttttatgttatactccaaaatttcaaaaaattcgtcgtttaaaaaagtcatgacttgagaaactcaatgaaagcaagttttcttgaacatttttgatcataactttcttcaaacttaacgaaacttttgaaattttgcatgctaataaaaaacaggtagggctatcgaatgacataaaactttaaaatatggttgtttttgagcaaagttttagcaaaaaattttttattttgatggttttttgactaacggcctttttccaaatttattttcatggaggctgcgacggtgccgatttccagtcgtaaaatttaaatttaaggaaaaattttttgacttcgagataagtcccggtttttcaacctgaaaaggtcccgcccggtcccggttttgcccaaaattcccggtcccgctcaactctagtttaaagctatatttttcattcatttgcttttttaagcaataacagcaatgcgacacacctcaattgtgtgcagtatttgctttatcaccatatacaaaaactcatgtggcgtcttgaaagcaaatttggcgtgaattttggcgaaaatgaggagaaaaattcattcttgaaaacttatactgacaaaaaaatg

SEQ ID NO: 97744 - DNA, 218 bp, Heterodera glycines
  Promoter: Source sequence=SeqID_25184; Location=300..517; Strand=+; Gene=SeqID_55911
tttcaaaaaacaaataggcgctctcttgtttttttcatcattcatttttgcgattgttgcgaaaaaagagtatcgttttctttccctttacccgtaggtttgaatttacagatttaaacagtctagcaattgctttacattgatcttaatcttttttttatgcatctgttccttgttcagcgatcccttgataatattcaactgttaatttgaaaatg

SEQ ID NO: 97745 - DNA, 374 bp, Heterodera glycines
  Promoter: Source sequence=SeqID_12099; Location=919..1292; Strand=-; Gene=SeqID_75659
tgtatgtcgttttcggttgccgtttttatctgacccaaaaattttaaattgataaattttttgattttttataccaaaaaaacaaatgctttcaaggtttgcgattgaccaacgcttttggggatataaatgccaagggcgtagccataccattggaagtggctcaaaaacgcaaaatttggtcattttgtggactatccaccataaaagcatatatacgtcacatcacatgtctttcaatttgccttataaaaaatatttcttaatgcatattgccattcattgaattgatttgattggctttattaagatttaatgcttttatgtatttgctaatttttaaagattttcagaaaaaaaatatttttaagatg

SEQ ID NO: 97746 - DNA, 86 bp, Heterodera glycines
  Promoter: Source sequence=SeqID_7089; Location=773..858; Strand=-; Gene=SeqID_63813
tttttggccaatcggagtcactccgtaccgtaagacttgacgtttttgtacggtatttggacagagcgaaaaatgtgcgcaaaatg

SEQ ID NO: 97747 - DNA, 233 bp, Heterodera glycines
  Promoter: Source sequence=SeqID_20725; Location=198..430; Strand=-; Gene=SeqID_51287
gaacaacaccactacacattaccacactaatcactcattaaacataattatattatgcactttggccgagtcccttcccaaattcccattgctcattgtcttgtcgtcttaaattgtgataaatgacttaatgattttcttttttgttttcatcttctgtcatagtttttatggacttatttatttttgaaaatggaaaatgtcatttttaatgcaagtaaaacacagaaatg

SEQ ID NO: 97748 - DNA, 972 bp, Heterodera glycines
  Promoter: Source sequence=SeqID_7981; Location=1..972; Strand=+; Gene= SeqID_66579
caaatggtgaacttcagctaagtcttgcttaaaattggctaaccattttttgtcattagcattagtctgaacagaaaatatgaaattgaaaatttcaattttaatttatatatttgtgaaaacaaaaaatgttgattaaaatggacggcggttagttaaaaaattaaagcattaacaattatttaatgagaaaacgagctctgttcgcccccccccccaccctaatcgttcgtcgtaaatcactttcggtgtgtgaccggaaatgggccggtggaaaatgcggagttaatcagaatttcttgaaaaaaacgagatacggtaatggaacaaggttacacgaatctaattacagtatgtattgtttatgcattttggtaaatgcttattttttaaaaaaccgaatcaccaatccaaaaatgaaaactcttattcaattttgagtttttgtattaatgtgttaaccacgacgccaggcgcccagctctcgatccccatatattttgggccttctctttaattttcaaagaaaatttagaattttttctaggaaaaaatcaaaatattattagaaaaatttaaaaaaaattttaaggttgattttacaattatttttcaaataatctttttgaagaaaaaatcaagaatatttgtttttctagcagcaaaactaagtctgttgttagagaaacaccatggttaatttgaaagaataaaaaatttcaccggctcccaaaaagataaataaataattggaatttacatttttgtggataacattttttcgctaaaattggttccaatttttggaattttcctaaagcattagtgtggcagtgttaacactaagtgaatgggcgggaaaggttaattaattaatacaaattaccgattttctgatgcgattaagtcgtacgcattcctttggttctttaaatgagccatcatcattgagaacggcgcaaccacccaatg

SEQ ID NO: 97749 - DNA, 231 bp, Heterodera glycines
  Promoter: Source sequence=SeqID_4141; Location=2102..2332; Strand=-; Gene=SeqID_53348
aaagatcagaacctttatttttggattttcctgcagaagcattttgatttgattaatgcattttcaatgtattaatcgccgagtaaaatggggaccggtaaattggacaccaagcggaaaactggacaccaaattaaaaaaaataaacccaggaattaggttgaaaaataattggtgtggataaatggattaaggcatttagagtggatcaaacattaaataggcacgatg

SEQ ID NO: 97750 - DNA, 211 bp, Heterodera glycines
  Promoter: Source sequence=SeqID_20467; Location=1..211; Strand=+; Gene=SeqID_51002
aattgctaaattaaaataccagatttaaattaaattatagataaataaataaaaacaaaaaaaaattttttaagacatttgattttataaaaaaatataaatttaattcattttaataataaataaaataatttatgtaataacaactttaaaatttttttaaatatgtacaaattaaatgtaaaataaattttgcttttttcaggtaatg

SEQ ID NO: 97751 - DNA, 193 bp, Heterodera glycines
  Promoter: Source sequence=SeqID_13585; Location=511..703; Strand=+; Gene=SeqID_77483
cctgattaagcaaataaaaattaatcacagcaaaaaaatgggaaaaaacccgaaaaattttagttttcgtctcaatttttgcattacacccgaatcggatgtttccacgtgtttaatcagtgtaacccattcattttcgagaatatagcaagaatcaagcaaaaaaggtgtgaaaaccgtttgagcgaagatg

SEQ ID NO: 97752 - DNA, 497 bp, Heterodera glycines
  misc_feature (23)..(23): n is a, c, g, or t
  Promoter: Source sequence=SeqID_2717; Location=1..497; Strand=+; Gene= SeqID_81235
atttgttgatccagcaacattantgatggttgttcttctggcaaagaaaaggacagcaaattatgcataaaagttgaaaatagatcaaaacgggtagagggggggggggaggggattgggatcacttccatttattttgccacatgcagtggtttcccttcatctgcagtgaatgtgaaccggggttggtatgctaccatcccggtaactaccgtaaacccatcctctgtttacattccagtattaacaacctaaccgagtttttgagggagggcaagactgaaacgacatgtccaaccgagactacagaaacgaccagcagcacaatcatctgtcctccgcctccaccaacgacaattcacagcattctactgttgttcatcacttctctgcttcttttggtctttttcgcgcaggtccaccccccccccccctcccccgtctaatcattaattattttttaaattttttttttcaatttacaggctttcaaaatg

SEQ ID NO: 97753 - DNA, 335 bp, Heterodera glycines
  Promoter: Source sequence=SeqID_4198; Location=2074..2408; Strand=-; Gene=SeqID_53558
attcgtgagcctaaacagcgacttaccattggggaaatgttggcgcattcgtcactgaatccgcctaatttgaaccgcagttttattgatggaaacaatttgcagcaattgtttgtttggggttttgctttgttttccctcaatattttacattaattgtagctcaagaagtgcttcttgtcaacaatttacaacattagcgaagactgtggtactttctatttaaaaaatatttataaatgttctgattgttaattttttatcctcaacaaccgacagtctccaaaaatagtcctccgcctaagcagcccccgtccgcccacgactcgggcatg

SEQ ID NO: 97754 - DNA, 328 bp, Heterodera glycines
  Promoter: Source sequence=SeqID_442; Location=1230..1557; Strand=+; Gene=SeqID_52870
agtatttttttgtagataatcagagctaactgattgtgagaaccggtagtcaaaaaaccaccaaatgaaaaatttttgacagaaaattattcataactttgcccaaaatgaaccaaattttaagctcttggtatcattcgatagccctaaaacttgtatgaaaataagtacaatttctgccataacttattttaaatttgatagttttatttgaaattttgcaagctaatagagaaaaagcttggctattgaatggtgccaagaatgtaaaatatgtttgcttttaagcaaaattatgccatgttttgtctaaaaaatcgctaaaatg

SEQ ID NO: 97755 - DNA, 1003 bp, Heterodera glycines
  Promoter: Source sequence=SeqID_1359; Location=88..1090; Strand=+; Gene=SeqID_73012
ttttggaacatttgtgttaccttttgtctttatcttattatgtacgttgctcttctattatagtactataagctcattatacacgaacgtgcaaaatgaccttattaattcgcgcaaatattatattctgaactacattatttagaaatgaaattttttttgttattacaaaaaccaattgaatttttccgatttgaaacttatttatttaaaattttctcgttattcaatttacaatatttagttagaattcattcatttatgttaaatttcatgtataacaattttagaatgttttttaatgatacattttcattagcttgtctcgatacaaatttttgtcactatttctacacttttgccatttttcattactattttagttaactatttcgagatttttcattaatattaaaattaaggtaaaaatagatatttttagagagtgggtcaatttttgttataagcattgttttattattttctatttattccactcatttttatttaaatatccatcggatggtccaacttttgttcttttttcgtcattttgtaacaaatttgagggtttttagttttgcatattttatatctttattaattcggatttcaatggcatttgtcattttaattttagtacaatattgcatccattactggtgaatattcttatgcatagtataaaattattctgcttaatccttacgatgcccttttcgtctttaattaaatcgtgcacaaattgcttatttatcactcctttgaacaatgagcgaggattaatcgggaacaaaatttgcatgttccatcatgcaggtcactcgctgactaagccatctgatcagctccatctcttcccggattatgccacaaatggtgaccatctgctgctgctcacaaagaatgagaagaagactatgaaggaggggtcggagatgccatttgcagaaattcctccgttttggcacccaaaaagaacaaactcatcaaaaaggccatg

SEQ ID NO: 97756 - DNA, 240 bp, Heterodera glycines
  Promoter: Source sequence=SeqID_3222; Location=1304..1543; Strand=-; Gene=SeqID_83756
tccgtcgagcacatcccaatgccaatgtatgggtcaaactgattttgaataagcacaacataacaataattagtttcatagagatatattatcccattaatgcgaggggggggggaagaagcgacgaaagactgtgtgaaaacaagaggatgtacagttagagaaatgatgagagagtgctttgcgccctccccccgctaatgggacaagtgctaccgcttcatctcttaaatttaaatg

SEQ ID NO: 97757 - DNA, 593 bp, Heterodera glycines
  Promoter: Source sequence=SeqID_38576; Location=655..1247; Strand=-; Gene=SeqID_67352
acaaacacttattaattgagaaatcctgaaatatattcatctcaattattcaaaaaaaaatcaaaaatttaatacaaaaattacggcccatacatattaattggaaataaaattaattaatttaattcgggctatcaaataaatgtacatatcattagggttgacaggcaaaattctttttggaaaagcaaaattttgggattaatactgaatttttcattatttgatattattgtagttgtttagagaaaaactgcaaaaaaaaacaaattaaaaatttttaattaggcaatttgtttaatttaaaaaaatttgtgaccgaaatatttgtttttatttgtttttatttttttgaagaattatcaaatgccgatcacttggaattgttggccaaaggatgtgaattgttggggaaaatcaacgaggaaaagcatggcttaattggtcggcttgcagaaaaagtcaacaatgaagcatgcttaaatcgcgcggcaagcttcacagaccaattgattcacactttccaagagagtggcccacaaactttggcgcagattaaagcgaaggaaattgggcaacaaaatgccaaaatg

SEQ ID NO: 97758 - DNA, 378 bp, Heterodera glycines
  misc_feature (18)..(18): n is a, c, g, or t
  misc_feature (26)..(29): n is a, c, g, or t
  misc_feature (34)..(36): n is a, c, g, or t
  Promoter: Source sequence=SeqID_23326; Location=73..450; Strand=+; Gene=SeqID_54037
ggggacttgccgcgacgnaggaaaannnnaaaannngaataaatttttaaacaaaattcattaaaaattccaaaatttctccccggcgtcgccttcgtcaccccccccccctgttgcctaaaaattttctggaaaaaatgagccgcaaaaaaatggtttgaaaaataaaaaagaaggacaccgatttacatggccggacctcttctcaaaactcccgctcgacctccctcccacctgagactccaaaaatttcggtagcccccccctcccccgttttttcacatatgtcatccatataaattgcatccatactctctaattatataaaattttaatttttacacattttgccttttcagcatcaccttcctggacatg

SEQ ID NO: 97759 - DNA, 201 bp, Heterodera glycines
  Promoter: Source sequence=SeqID_8236; Location=2155..2355; Strand=+; Gene=SeqID_67402
cctgaaagtggggaaaaagcgattggaaattgcgccaaatttgggatttgaccgaaaaattgggttgatcggatcaggaggagctcatattcactgatcagacaactgggactgaaatgagtatgaccaaaaatgggactgagctggccgggatcagcaaggcaaaattaattcctcgtcgtgatcagctaacaaataatg

SEQ ID NO: 97760 - DNA, 1003 bp, Heterodera glycines
  Promoter: Source sequence=SeqID_21383; Location=864..1866; Strand=-; Gene=SeqID_51995
acaaaattcggcaaaaaatcaaaataaatatatatttatttaatttatttaaataaataaaacaaaaaagtaatttgcatcggatttcagcattttttcttcttcttcataaaccgggaactaagcctgaaaaaggaaatgtcacaaaaaatttgtgtcttcctattcgtctttaaattcaatttatggtagcatcaccaccactaatggcaccgacatccagccgatgtgttctgtcaaaaattagtgtccattttttcggcatttcatcatacatttcactttatttgtgtggggagttggcacaaattttgtttaaaatatgccattttgggacctttttgaaatttaacaatgtgcccaattctgactatgccaccctgtgtcatggccaaatttatcacaaggacaaaactttatgcgtcataaattctatataaaaagattgacttttattcatttttatctatgtgggtatttaggttacgtttttttttttttttgcttttttcaaaatttaattaaatttcgaatttcgttaattttttttaaactttctaaataaaaatattcataaattgtaataggcagtgtatcttttttttctttattcacccaaccattttgatgaattgtgggggttgttaattttttctaattttggacacattttccttctttggcatgttgaagtaggttggacatttgttgttctcggcacttttccatgccattaatggtttttggctttgaagcaaatgagaaaatttgtgcctttcatttttgtctttcgtaattttcactaaattggaaatttggaaaatatttatattccaatttaaccaaaagcaaattagaaaaaaacatgttagcaaaagcaaagaaagttgcttttttttaatattgatataaataatcttaatttagccaacataattgaaaataatttaatatctttttcttaattttagccagcgattttttaatttacattttgccaatg

SEQ ID NO: 97761 - DNA, 223 bp, Heterodera glycines
  Promoter: Source sequence=SeqID_15787; Location=254..476; Strand=+; Gene=SeqID_80111
tgcttctcttcccccagtttatccagcgaaaaagtcctttcatccaaacagatggacaacccttccaacgcattccatacgttcattcattcaccaatccttcccacctcccttcttttgtgtcccaacattttttcacttttccccattttgacaaatcgtttcccatccttttcatattgttcaattagaatgggcgctaaagcgaataataagcgcaatg

SEQ ID NO: 97762 - DNA, 81 bp, Heterodera glycines
  Promoter: Source sequence=SeqID_4545; Location=1..81; Strand=+; Gene =SeqID_54841
cattgtttgattcactaacatttaattgaattttaatcaccaggtgaccaattgcgcgtgcttttcccaccgtcaccaatg

SEQ ID NO: 97763 - DNA, 1003 bp, Heterodera glycines
  Promoter: Source sequence=SeqID_14474; Location=865..1867; Strand=-; Gene=SeqID_78518
aaacacaccctttggatttcatttgtcattatggtacattagccaaccgtattatacctattaaaataatgtgcatgaaaaacgatacctttatcttttttagtcgcttcttgcatgaaatttttgttgctttttttatgcgtgaattcattaatttttctacaaaatatcaaatgaatcgcaaagtcggttctaaatggggaaaatatttttttaaatgaaaattttgaaaatatgccataaaattgttgagaagatagtgatcgattaacaacaaaaaaacagccgatcaatgggatttacgcgcaattgatcagacaacttgagcggaatgagcatattttgtgccatgttggaaatttaaaaaagaaatattttcttttttaatgggttttattatttattgacctaaatttttccaaataattgtatccgaaggttttaaatgatacctaatacccattcagccatttctagcgatcggaatttgagtcaaatgaccgtaaaataagttaaaagcgttctttgcaaatagcattttatttgacttctttgcacttttatgacgtttttacctttttaagcaaaaatatttaatttgtctatataaaaaaaaaattttcagagtcccaatttggtttgtaagaataggtgaaagacaaatcaattaataataactttacctcaataatgaatttcttaaaagggccagccaaccatcgacagtatcaacagcgggggtggcacggaattccgattacggcatttttggggtcagaattccgatttttggctgttgttttagaataaataaattttctaagttgtagaacaaaatttcaaattgaaaattttatatacgcaaatcttttttaaacgcttccacgaatatattgttggaaaatgtataagttaagcaaaaaatagaaaagtgagctttttcgtaagttatggatgatgtgagagatggacgtaatgcacaaagaaaacggtagaaaaaatg

SEQ ID NO: 97764 - DNA, 143 bp, Heterodera glycines
  Promoter: Source sequence=SeqID_3925; Location=1214..1356; Strand=-; Gene=SeqID_52469
ttggggcggaccataatctagaagaataaatttggttttaaacaattaattaattcaaatatttttaagaagtggtcaacagaacggaactaataataaagaaaagcggggaattagagagaagaaaaaacttgcaaatgatg

SEQ ID NO: 97765 - DNA, 208 bp, Heterodera glycines
  Promoter: Source sequence=SeqID_21851; Location=1448..1655; Strand=-; Gene=SeqID_52484
ttctctcgctctctccccacattttgtcattaagataaaattattattattatttctttgaaattaaacaggatttccttattttattaagtaaataatgatttattcagttttttaatcagaaaaaaaatcatttaaatgcctcaaaaaatgaattgcatttaattgaagaaaaataaaataaaataatttccagacgacaaaaatg

SEQ ID NO: 97766 - DNA, 194 bp, Heterodera glycines
  Promoter: Source sequence=SeqID_39543; Location=1..194; Strand=+; Gene=SeqID_68097
tcacagaaatgttaaagcgctagaacagagttgaaaaattttcattaatttaaaatgttctgctgcctaatttacaaatttttcataggctaactttgaggcctcctatttcgttcaatttttcaattttttttttataaaaatttttttgtaaatttattaaaatagcggcgaatgctttttagttgagcatg

SEQ ID NO: 97767 - DNA, 830 bp, Heterodera glycines
  Promoter: Source sequence=SeqID_5050; Location=690..1519; Strand=+; Gene=SeqID_56721
ttctttataattctttggtaaaaacttttaaattagcaattttgtaaattaatttattcaatttaatgattgaatttaggtaattatgctgctttatgaattatttatgaatgtatttaaacgttacaaatgagaatttattgctttgtattgattataaatatggattaatttaaaagtcaggaaattattcggctaattcagattatctaatgcaaattattttcaaaattattattcatagtttttcagatattttttaaggaaaatttcttcaatttttcttaaaatccctcattaaaccctccaaaatctcttttccaaattgttttttccattttgaaatgctctttctatcaattttcatcattttgcaattcccctttgattctttttttggattttctctttttatttgccattatttttacattttttccattttcggctatttcattaccacgaaatgccaaattctttctttaatcttttaattacatcataatttactccaatttcttacaaaaagcggatttggcaaattttatagaaatttataaatttcatcaataaaaaaaatggcataatcccgatcctgtgctggcacaggattcgaggcagtaggtgcattaatttgcaccccgctgactaattatgagtattactgttaggacatttttgtaggagggcttgtaaaaaaaaattttttttaatagaaaaatataatataataattcagatttcaaactcactcattcgtttgttcgttcattcattcattctattaatggccccaagtaaaaaaactccccccccccccccccaaaatg

SEQ ID NO: 97768 - DNA, 212 bp, Heterodera glycines
  Promoter: Source sequence=SeqID_8715; Location=1..212; Strand=+; Gene= SeqID_68935
gtcattagtttatgggtgagttcaaaaaattataaatttcgtttataacctaattttaggacgacgagtatggcgaggttctattattggaattcatgagagaagcggagagccatggcggggagattttgtacacggacacggacagtatttttgttaggcacgatcgggatgtggagccgatcacgacggggaaatatttgggagaaatg

SEQ ID NO: 97769 - DNA, 372 bp, Heterodera glycines
  misc_feature (168)..(168): n is a, c, g, or t
  Promoter: Source sequence=SeqID_31808; Location=1..372; Strand=+; Gene=SeqID_62094
tgtcaagtcctcttcttttttctcttccgccattctcttaaaaaattattgagtcaaaatcaaaaaatttgagctttttgtcattttcaaaagaaaaacttgcgaatattttttgagggcgcagattttctcgaaagccgagagaaaatagaaaatcacccccccccntgaaaaatttttttctagggtaattttatgagttgagcacgaaaaatgttattgtaagccatcacgcattttacgtgagttacgtgaaaatttagatgaaaaatttacgtaaaaatttaaaattacatgtaaaacttgaaatttcaaaaaataagacactgagagggatataaatgagaaaaatgagctgggagatcaagaatg

SEQ ID NO: 97770 - DNA, 315 bp, Heterodera glycines
  misc_feature (8)..(9): n is a, c, g, or t
  Promoter: Source sequence=SeqID_11705; Location=1976..2290; Strand=-; Gene=SeqID_75194
aatataannagttgctcattttgtacaaaaaaacttatattaggaaatgaataaattctatggttgaatgaatttttgatgatgagttttatgaaaatttttgccgtttttatatgcaacttttccattaaatatttttgccggaaatacgtggaaattttaaattttgtaaacaggaagtccgttgaaggaaaaaaacgttttcacattagaaagccataaatgacaaatgcataattaaaaatatgaaatcaatcaaaaccaatttctaaaaaaaaaactgatcggaattaaaaaaagtttctagcatgaatg

SEQ ID NO: 97771 - DNA, 442 bp, Heterodera glycines
  Promoter: Source sequence=SeqID_12471; Location=465..906; Strand=-; Gene=SeqID_76098
ggcttacaattagaccaaatctaattccatgttccgttaagaaagggtgacttcgttgacctcgtctcattggatgccacggcgatggaaaagggccgtctgtcgtggctatttaaacaaaaaattgtgcaaagttgcatcgccgccggtctcacttttgagctttgttatggcaacgcacttatcagttcggagcatcgacgacaggtgcctttttaatgccatattctgccaaaagatttattcatctcttgaccagattaaaaattttactcacttgtttattagtttgagatcttttttgttttatagttgaaagacggataaattttctaaatggtttagttccctaaattataatttagaattagacctggacctaaattccaggttgaacctggacctgggttttatggactaaaacccaggttgccgaaaaatg

SEQ ID NO: 97772 - DNA, 67 bp, Heterodera glycines
  Promoter: Source sequence=SeqID_4434; Location=514..580; Strand=+; Gene=SeqID_54433
tcttaaacatgtaattattgtcattaaaaaataattaaatttatttatttattttagaaatggaatg

SEQ ID NO: 97773 - DNA, 238 bp, Heterodera glycines
  Promoter: Source sequence=SeqID_14643; Location=1..238; Strand=+; Gene=SeqID_78737
tcaagtatttcaagactgacgaactaataaagtaatcactttttattgtggcctacaaagaattcaattttccaaaataaagaagtcatcaaattttatgaaaaatcaaaataataaaaaagccgaataaaaagtttacaaaaaaattaaaatatattattttaaaataggcaaaatttatacctttcgccaatttaaatgaataccttaacaaaatgacaaatctcggaccaaaatg

SEQ ID NO: 97774 - DNA, 444 bp, Heterodera glycines
  Promoter: Source sequence=SeqID_13585; Location=1498..1941; Strand=-; Gene=SeqID_77484
ttctatttaggtaacatcaaaaggcaattaattagaggaaaatttcgtatgaaaaaccgcatatcttgcgcatttttaggagaattttttaaaaagtgtggcattttgtttctttgggaaacaaaaatttgatgagaatgagttattttcttctcattcccaattaataaagtccgaagcgaaactttgagttttcccccattttgaatgaaatattagggaaaaattactgaaattaatctcttccgaacccccgacctaaattcgaacaaaaattaaaatttttttcctacaaaatacgtaaattttgactttttccttcattgcttacctattttctttatttttgttgctctttttcagcatattgaagccccttataataaatattacttccttctcttctgaattctctattaaaatttgattgccgtgcaaaaaatg

SEQ ID NO: 97775 - DNA, 514 bp, Heterodera glycines
  Promoter: Source sequence=SeqID_10819; Location=1..514; Strand=+; Gene=SeqID_46905
cggtcagaagagttcaaaaaaccaaatctttccaactttcttcggccataaattcgttcaaaatcgaccaatttttttgaatttcgcagtctaatagagcacgttaagagctttcgaacgataccaacaacgttgaatttggttgacaaagaaaaaagttatgccaaaaagccgctggggccgaactgagccggtccgatctacccactatgggtcaagcccagtgttagacaaaattgctcataacgtcaaatagcgtaattggcgtaaattattgcgcgctaattcaaaatgtacactggaaaatgccttttttgtattttttattttgatctgccataactcgcttcattcccaactaaactgaacaaatttggtatctaaaaaaagtttttgaaaaggagaatctttttctaagcgaatgctaagcaatttgacatctcagaaaaaaacccgtactcaaacaaaaccgtttttcaataaattcatactttatacttcagctcaattaatg

SEQ ID NO: 97776 - DNA, 569 bp, Heterodera glycines
  Promoter: Source sequence=SeqID_34884; Location=1..569; Strand=+; Gene=SeqID_64578
aagcaaaatatgttcgccaagataacacataaagagcaattgtcgaacagttcaacgaacgcgagccacttgcttatcttcgcgcaatttcatatcactttcacttttaaataataggactttgaaaatggaacagagaaaaattatattaaagaccgaattacatttttttaaattttgattattctattttttaaaaattctctatagtgtcgaaattactcaatgtcgaaatggtccagtgtcgaaaatgcaggaaaacagtgaaagttttagaaataattcagtgtcgaaattacttagtgacgaaaatgtagtgtcgaaattacttagtgtcgaaaatacttagtgtcgaatttactcagtgtcgaatttacccagtgtcgaaattaccagccgcgcttttttgtgccaaaagtttttgaatttctggttgtctacccaaactaaaaaaaataagattctcatagaaatgcctactgttcgcgaaatatttgggtgcctgcaaaacccccaaaaaaaaggcgtcgccattccaacaaaacgaagccagcgtattcaatgaaatg

SEQ ID NO: 97777 - DNA, 128 bp, Heterodera glycines
  Promoter: Source sequence=SeqID_5535; Location=1636..1763; Strand=+; Gene=SeqID_58373
gagagagagggatggagagagagagagagagtgaaagacaggatggagagaagaagtgaaggaaggaagagaaggaaaaagataggaggagagttgacaagaaggaagagagtaagagataggaaatg

SEQ ID NO: 97778 - DNA, 104 bp, Heterodera glycines
  Promoter: Source sequence=SeqID_8572; Location=1..104; Strand=+; Gene= SeqID_68566
cggtaaagcgaccgaatgaatttacgagaaaaaaaaatgcaaaaacacttttttgttcagcagtttttttcgaggaaggaaaatacgacgaatgcatcgaaatg

SEQ ID NO: 97779 - DNA, 90 bp, Heterodera glycines
  Promoter: Source sequence=SeqID_12433; Location=1257..1346; Strand=-; Gene=SeqID_76043
atgtacagtacagcggtgccagaaagacctgtaaatcacaaaaattcagagagaatctgatcacatctccgccctctgctgttgccgatg

SEQ ID NO: 97780 - DNA, 95 bp, Heterodera glycines
  Promoter: Source sequence=SeqID_22014; Location=1270..1364; Strand=-; Gene=SeqID_52648
attgcagaatatccatgaaattatcgaaagtcacgggacttttagacatgttttttgtgtcaattttgaattgtttacaggtccaaggcaaaatg

SEQ ID NO: 97781 - DNA, 282 bp, Heterodera glycines
  Promoter: Source sequence=SeqID_32775; Location=1..282; Strand=+; Gene=SeqID_63023
tgacttataaggaatacatcggaaaagcgcattcgctattaatcattcttttgccgggctgccgacattttgttatttttaatttgatttgttttaaaatgctgacaattgccattcatctaaacgcatttggttataattagtcattaaggcttaattggaactgtagaacaagcactaaaattttggtcataaaagcacagcgagaaatgcttggatttaacttacctcatcaaaaaataaaaataattttaagtttttttaatataaggtgaaaggatg

SEQ ID NO: 97782 - DNA, 119 bp, Heterodera glycines
  Promoter: Source sequence=SeqID_9009; Location=1079..1197; Strand=-; Gene=SeqID_69985
ccaaataaaaatattttttcacaaataataagaattaaaattcatcattttgtttgattcttatactgacgattttcatttcacattaatttgttttttttggcgcttttgcaaaaatg

SEQ ID NO: 97783 - DNA, 307 bp, Heterodera glycines
  Promoter: Source sequence=SeqID_31912; Location=1..307; Strand=+; Gene=SeqID_62225
tgcaggtccaaaaatctgagaattcactacctgactgtccatttttaatgacttcctcacatttttataaaatttccataaataaaatgatttttcatcatacattaacaaggggtgcgccggcgcaccccccccccccccccccccccccaattgctgccatatgggatcgttagccgaggaatttacgttttatttaggatgttgaataaaattaaataaaatacaactcccaacagcaaaccagtgataaagtgcttacaacaacaattgatggtaaataattttagaaattttagagggaatg

SEQ ID NO: 97784 - DNA, 983 bp, Heterodera glycines
  Promoter: Source sequence=SeqID_6997; Location=1..983; Strand=+; Gene= SeqID_63533
ataaagcgagtaaagcccataaaaattggggcgaaaatccgacacttagccccaaaatcgggcaaatgcccggttgctagggtaaaatgtcacgctaaatttaaacgagcaattatcgagaatgaaatctcggggagaaaatgtattatttatgggtcaataatcattataaccttttaagtaatttatggccattaattcaacaaattgtgcgacaaaacagcataaggggaaaacggaaaaagcattaactgatgataacatttgttctgctgattgagagattaacatggaaatgattaggaaaatttcccgcgaaaaggtcaaatatttataaattatttacccatttcctttgatattattaattaatgggtgggggggggggagttaatttgaggcaaacattttttacacttattattataaatattatataattaattaccaccaatcaataaagagagaaataatttggtttaaaatttaatgaatatagtaatcctgtcaatattttgacaaaattgttcatcaaattcaatcgctcaaaaaacaataccctcatcttttcaacaaatagttctaccagacctccaacaatttcttcaaataaaaatatccctcaaaatttctctaaaaattttacccaaaaaaaaaaaaaattttttttttcctcttttacaacccctaaaaaaacaacaacaattttccctttgttggaggtctgacttttctaatttctgcttcttcattcaaaatttcaattatcttttatcactacctttcatttcacctcatttccgccaaaagtataagtggcacatgcccttcttttggttatttttatttttgaataaataaacttttaaacgtgtagaatttataagagaaaaatatgaaattcattttcgagaattatattattatattatatatttacatataaaaatataaatttgaatttttagaaaagcttagcaatg

SEQ ID NO: 97785 - DNA, 127 bp, Heterodera glycines
  Promoter: Source sequence=SeqID_41617; Location=298..424; Strand=+; Gene=SeqID_69698
tttcgggccattccaagcagacatggacagttttgaagcatcggtcaataatttaaaaaatgaataattaaaattataaatttaattagcttgtgctagaatatattttctatcattttgtcagatg

SEQ ID NO: 97786 - DNA, 257 bp, Heterodera glycines
  Promoter: Source sequence=SeqID_12654; Location=712..968; Strand=+; Gene=SeqID_76329
ggtaaaatggattaattaaccattttcaaatgtaaacgagtccattaattgattttcacagatatatcgactgcaataccatcgcttttctccaccgttttcgtccacttttcgccgcctgtccaatcaatttgtccatcgatacgacgaatgatcgcatttcggagttcattttgcacaacatttggccaatgctcgggaaaaacatccatggcattgaaatgtccgcctcgtttttcaatcttttgcgacaaatg

SEQ ID NO: 97787 - DNA, 260 bp, Heterodera glycines
  Promoter: Source sequence=SeqID_7946; Location=364..623; Strand=+; Gene=SeqID_66465
ttacgattaagaaatagtttatgattataattgttaaaagcataaaatgaacctgcgaaaaaacacgtaattattgattgatagtgagaggggtgttagcgcgcagcgacctccagacgggctgtcccttttaatcgataggtcacgcccatccacaaacacatagacgagagagtagtggttagagaaagatacaaaagggcgccaattcaaatacacagtgaaacccaagccaatttattgattttttacagattatg

SEQ ID NO: 97788 - DNA, 74 bp, Heterodera glycines
  Promoter: Source sequence=SeqID_14126; Location=1529..1602; Strand=-; Gene=SeqID_78119
tttctgaacggtttattattctttcactgtacttatttgaatagttaattcgtgtcgttcgttattcagtgatg

SEQ ID NO: 97789 - DNA, 844 bp, Heterodera glycines
  Promoter: Source sequence=SeqID_29329; Location=232..1075; Strand=-; Gene=SeqID_59836
tttcttttcgtccgtccaccaaattttgcgaccgatggcttttaaaaatattttaaaattattgaaaataaaaaataaataaacttttgtcaatttaaagattaatggatgggggaaatgggcgaatgctttaaaaaaagaaatgttgaagaaaagttgagaaattggaattcccggaaaaaaatagaagaaaataaaatattaggacgaaaaatgaaatgaatgggcggacgaaatggaaaataattggacagaaccgtttaaattttgacaattattgagtttttatggttatgaaaatgataattaatttttttttaaagaaaggatttaattgtattatttttttaatattaaatgtttaattattaaattaaattatcatttaaaattttcaaatttttgttaaatgtttttgcgtcatgttcatataatcttccaaaaaacttctgtgcttccatgtatttttgtatagtttatttgtctcatttattcactgtacaatttttttctttttaattccccgggggtttttgcccaatttccccccccccccctaaaatccgtcgccgattgtttcgtccggttgtgttgcgttgcgttgcgcaattccccccccccccttttccttcatatttggggattcgctgctctcgatgattattcatttgttatttgtctctctctgtataacactttatttttgtgatgtgttaattcaaatttgcccttccctttcccataaatttgttttttcattttttaaattccaatttttgtcaattaaattccgccgtttcctttcctttggctttgttccgctgctttttctcctcccattatg

SEQ ID NO: 97790 - DNA, 1003 bp, Heterodera glycines
  Promoter: Source sequence=SeqID_13769; Location=829..1831; Strand=-; Gene=SeqID_77694
gctattttttttttttttgcttaaaaatcccagcccaagtaattaacttataaggtagggcagcaagcactttttaaatttaatatggctcatttgactacaaaaaatgaccaattttactaatagcaaaagttggtcgagaaccatggcactatttattcgagtatgcggagaaatttgatcaaacaccaaaaattccaacttttcaattacattttctaatcaaaacctattttcgactttgtagccatggaaacaaagaaattctccatattaacttgtttataccacctaatttatttaagcagcaaaatattttcataaatatatttaaaaatatataataatgaaataatttaaatttttaaatatttaagaatgatagttaaataatttaaatttttaaaattttcttgaaaatgaagactcttttgaccagccagcagctgttgctcccatttttgttcttcatacacattaattttcgacagctgtgtaagcaatggagtattcttgttcactaaaatttaaaaaatcatctccttattttataccggttttctaaaattggttttttttaatttttctatccatgttacaccaataaattaattttttgttaattcttgagatcccgaatttatttacctttaattaaatcgaattattgaaaattgtttcgcacacacatgattcattaaaaatttaataattcaaaaacagattaatttctctttggtttaacttgagatcttccgttttacttttataatattttttttttgtatttcttctaatttaacatttaataatttcttcaaacttcatcaaactttcatgtttaaaatccgtgcccaatttctcacataaaacaacaaaaattccataaaaattgtttatattatgtcgagatcccgactttgtggtggggatgtcctcatcccatcgatcgatttttccaataaagcaaagaacattttaagcacacaaaaaaaaaaagatg

SEQ ID NO: 97791 - DNA, 898 bp, Heterodera glycines
  Promoter: Source sequence=SeqID_9295; Location=1891..2788; Strand=-; Gene=SeqID_70894
ttaacggataaaaatttattcgatttcagttaatcatttttgttgtgttacttttttaattttccttttttataaagcattttttactcaatcgatttttctcacttttattaatgacatcagagagtatcgagagtgatcttcatcttcttgaggcttatttttggttccggaaagtaaatgagaaaaattttctgaaaatccttatattacattttaatttttaaagtttggtttattaggaaagttagttttaataaattgttgtaagaattttgataattattaaattatgtctcttttaattattaacaatttaacaaattgccaagtgtattgattggcttttgtattaactcaaaagagtggagggattagtcaaagctttcttcgctgcatgacaaattggaaaagcattccaacaattgcttttcctcgctgctaccaatatttgtcgaaaaagactctatggattttccgaaaagggcaaaataaagaattttttaggaattaatatttagactttatatttgaaatattattcgtaataaagcattcatttacattttaaatggaaacaaaaatataaatgtggattaatttaagaatttacgcttttttaggagtttttatcgcttttaaacatgtaaaatattttaaagcctaattttatttatttttacttcattgttaaaaaaataattagatttgaactgaagtaattctgaaataataattttttttcagtcaatcgttaatttgattggcacttacaaatttataatttttatcagttgctcttcctcattcggctttataaacaaattgagggagtttcataaccaaatccatcttaccaattagaatattctttacttgttctgtttagttggcaatg

SEQ ID NO: 97792 - DNA, 364 bp, Heterodera glycines
  Promoter: Source sequence=SeqID_12304; Location=1482..1845; Strand=+; Gene=SeqID_75892
cctaaaacagctcaaagatgggcctgcgccagcatcgctgtctgccaaattgtgcattaattcgtcgggttttcctctgttcccaacttggccgtgccgtccgtttgggccgcggcggcacttccggcggaacgaccgaagagagcgaaggaaagggacggatttccaattcatttggcggttcgggaaaatcaaaggctatgttttgagagcacaaatcagtgcaaattggagttggaggctaaaagtgatgggaaaatgatggaaaattcaacgaaataaaaatgcaatttgtcccagggggaagcccttttgaaaaaaacagtaataattttgcttttgaaaattattgcggccaaatatg

SEQ ID NO: 97793 - DNA, 341 bp, Heterodera glycines
  Promoter: Source sequence=SeqID_7360; Location=1..341; Strand=+; Gene= SeqID_64592
agggggaaatttaaaatttacacaatttccttagtgaaatcaatataaaattcaaaaaattttcccggcggcgcctatcagcaccgccggaccgcccgccacccccttccccaaaagccgagacaccccccatgtcccaatcgtccgtcgtatggccattgggctgagtttttaattgatatcaagcaaattaattattgaatttttcatgaattcactactttgctttatcacctttctccaaagttccttccggcgttctgacatttgaagaagtgcttgtcatttatcagtaccattcccatccggatatctatggagtgcccgaattgtacccaatg

SEQ ID NO: 97794 - DNA, 330 bp, Heterodera glycines
  Promoter: Source sequence=SeqID_3084; Location=3293..3622; Strand=-; Gene=SeqID_47521
tttttttctcaatatttttggacttttctaagcaataatgatatgaattcaaccgaatttttatggcatgacaaagaaacgacacatgttgtgggctcacacatgcttcgaagctttcaagtaaaaatatggcatatagattttagagaatccagtcgatgaatttcatatgattcaaatattcttaaactttttggatttttaaataagggagctcagccatttcaaagtttccacttttatagatggagctcaactgagcactcaccggcccagaaaaggctcatttttttctcaatatttttggactttctaagcaattatgatatg

SEQ ID NO: 97795 - DNA, 346 bp, Heterodera glycines
  Promoter: Source sequence=SeqID_5711; Location=1607..1952; Strand=-; Gene=SeqID_58991
aattcttaagaatacaatgcttttttaattttcaatttagctaaattaacaattttatacataaatgcgaaaaatcgaaatttttgaagttttttcttaagaaatttttttggcttggaaacctattgatttttgtttgattaagagcattttacaaaacaccaatttggataattaaagtcataaaacctaattcaataaataacaaataaattttactcttcaaattatttacataaaagtcactctgaatactgctgttccggctgctgcttctgtccatggcttttcgccacatttgctgctttcaaaaggctattttgaaatcagtctgtcccgtgccatg

SEQ ID NO: 97796 - DNA, 109 bp, Heterodera glycines
  Promoter: Source sequence=SeqID_31231; Location=558..666; Strand=+; Gene=SeqID_61602
ggtgaactccctcctctaaagaagcccaaatatcgtgccgccgatgcgagaattcttcgacttttgcagggatacaataccatcaacaataacccggctaaccaaaatg

SEQ ID NO: 97797 - DNA, 377 bp, Heterodera glycines
  Promoter: Source sequence=SeqID_11586; Location=1925..2301; Strand=-; Gene=SeqID_75032
cttttcacccggtcaattcctcccagtcgagggtcggtcgcttcattcccccgagtctcgagagcaccttgagccaataaatgtgccaattagtggcccatagtttgttgaatagaaaagcccaggggagaggaccgatgatatttggcactgttttgttgtgggattatggaaaatatcaatggaaagaaaccctttcatatggcacaaataaaacatttttattttgattcaattatttttattttggtgattataaaattgaaaaattaaattgtttataaaaatgcataataattcgcatgagatgacacctattccgtgctaaaattgcttcacaatcggctgctgatgaccatccatgaacgaagcaaatg

SEQ ID NO: 97798 - DNA, 185 bp, Heterodera glycines
  Promoter: Source sequence=SeqID_22362; Location=1..185; Strand=+; Gene=SeqID_53031
ccccccccccccctcccatcagacaatgtttttttttttgaaatttcttgagacacccacaaatactcgaatttagtcattaacataatcagattttgttggctcggagtagcagcagtagcagcgtaagcaccgaaggagccgacaaattgcacaaaattggtccgccaacggcgcatgaaatg

SEQ ID NO: 97799 - DNA, 99 bp, Heterodera glycines
  Promoter: Source sequence=SeqID_771; Location=2024..2122; Strand=-; Gene=SeqID_46218
ggttgattgtgttcacgcctgatcagatcatccgtcgaatttcccgcaggcattttcatcgtcaagggcaaggaggacgcgctgtgcacgctgaacatg

SEQ ID NO: 97800 - DNA, 571 bp, Heterodera glycines
  Promoter: Source sequence=SeqID_1017; Location=2286..2856; Strand=-; Gene=SeqID_66121
ttctgatcaccgcaatttgctgtgagcacataaaaccaaaatcatttaattccactggaaatcatcataaatcgagagtcttggggttaagcatttcttccgttctttgttttaactttcattcttcaaatttcgttttgatcatctctttggctatcatttcattgttttttttggccgtgaactttctcactttttcgtttttttttggtgtcatgacaactcgtacaatggcttaggctaggcctaagctttagcataggtttggtcctaagcattagactaagcttagacttgcttgggcctaggcttaggctttatttaaaaaattttattgtacgagttgcctttgtactcgggtcaatttctctctgactgtttcgaccccggccatttcagtcctgaaaatggctgccaaaattaattcttcatttggctattgtccataggtgtgatcatcgtcgcattggctttggactcctcgccaacacatcgctggtcctcccggcactcatccgcagcagtggcctcccgttcgtccgacctttttctgtcctcgtggccccacatg

SEQ ID NO: 97801 - DNA, 174 bp, Heterodera glycines
  Promoter: Source sequence=SeqID_11774; Location=2350..2523; Strand=+; Gene=SeqID_75271
gctgtacaaccgaattgttggtgtgctattgcggtttcaccccaagtgctttcccttgagataagtccacttggatacagcactcctttcgttttgaacaaaaattcccctctcccctcaagctcagagcactacagtatattttacagtatctttccactacttacaggaatg

SEQ ID NO: 97802 - DNA, 955 bp, Heterodera glycines
  Promoter: Source sequence=SeqID_19897; Location=1..955; Strand=+; Gene=SeqID_84658
gattagttgttgttttttctgccaaacaagcgccatggggaacgaatcggctgaacaaatacggagcgatttataaaaaaaaaaaattaaattttattaaataattcgaaatatccggcaatttttgtcccagcggtcaagcgattataaataaacccgatttaaaaaacaaagacatgaatttttcattttcaaaaattcatacaaaatttaatatagttttttaaaggaaggaagtatttttcaaatttaaagaaaattttttttattcatatgacactcttttcttttccttcttattatgaatttgtttttaaaaattatttccataatttcatttttaaaaattaaatttgggttggagtgaagttttttgcgggagttccgtgcgtgttttttctgcaaatttttgatgtttgtcccagtggcacttcagcaagcaacggaaaagagagaagcggacgaaacggcagcggagagcgaattcttttttttggcattttaccgcaatggcatttcgtccatttgccctctaattgggttcattaacactctttaatcgttcctcttttacactttcaattttattctctttttgttcatttcatttagtacattttctattaatgaatattatttttgttcgtttatttttataaaattaatttattcattcgctttttttatctctttttccatcagtggaatttgcacagtttttacaatttgtcatcgctaacacttttccgcttctatcaaaaaagcatccggcaaaaatgggctctgattttgctaatgagtcatttttcgtccattataatgaataaaataatggatgcaaaaaaataattatgttaattcaatactaaattatcgaaaataatgataaataaataaataatattggaattgaaaaatgaagaatttaaaaaatatacagtaatcacgataaatg

SEQ ID NO: 97803 - DNA, 667 bp, Heterodera glycines
  Promoter: Source sequence=SeqID_4941; Location=4176..4842; Strand=-; Gene=SeqID_45943
agagtctagacttaatgtcccatattttcgagaaatttattttcacatatttgataaaatttaagtaatttataaaaagtagtaataaaaaaagtgagagcatcattatcaaaggtcgaacagcatatcgttttcatttattatttgttttattataacatacataatgccaaatttaaatttaaaaggggaaaaaatgcctaccgctgccgagtaacgactaacacgctggaaccaaaaagacggcggcattaattggacggaagttttttaggctcactacctaattagtaattactaaataaaaagaaacccaaagaagtataaaagcataagtgagtctttcataaatctacaaaaattattttcgttttttgctccatgttctattttgtgtaactttttgttatttttatgaaaatatgttttattagacacctatcccttctattttttacaggccttattttgacttgacttctctgttaaatttctatttaaatggataatgaaaaaaaaagacggacagttattcgacgtgtcaacgaaaccgcgcgtgaaaatgaaaaatggggtacttccgggtttagccagcccctgaaattttttttctacgctaattttttgatgctgatcacgaatctaacgtttatttttagctacaatg

SEQ ID NO: 97804 - DNA, 203 bp, Heterodera glycines
  Promoter: Source sequence=SeqID_11636; Location=997..1199; Strand=+; Gene=SeqID_75083
atatgattgccattgccgatttcgacacacttgtttttatttttaatgaatttttttacccatttctttctcctctttttgaaaattactgaaagttttaaattcacaattataaatgttttttcttgtttattgttcttctgtaaaattgttttttgctttgttttgtcgcgtcagaccacatcagttgcttatccgaaatg

SEQ ID NO: 97805 - DNA, 488 bp, Heterodera glycines
  Promoter: Source sequence=SeqID_4277; Location=1..488; Strand=+; Gene= SeqID_53859
ccgatgatgaagattcgatcatttgtctgtcggacggttccccaaaagcgtgcacaatttaatggtgttgttgatcttttacgctgatattccacactttccgccctccctccccccggccaacaaaaaccacacaatttcctgagctctctctctgtacctgtaatttttatgtgcgattgattcgcttttgacctcctctcattgtcagccttttttctgcccccccccccgtttttttgtcttccaatcagtccgcagaatattatactatttttctcatcagatatgtcacacagccaagctttttttgtcactaattcactgaattttatttgagtttctataaaaaaaaataccgaggaatgctgtctaaattattcatttggacattgattaattaattgttatttaatttaattaataaaattttgtgttttcatcatttcatttggtttcacttttgacgccttgccaaaaagcagatg

SEQ ID NO: 97806 - DNA, 88 bp, Heterodera glycines
  Promoter: Source sequence=SeqID_41623; Location=493..580; Strand=+; Gene=SeqID_69710
atagttagtccttttgttgaatttttagaaattctatccgtccaatcggcttttggaattttaatgagtaaatcaggaaccgtaaatg

SEQ ID NO: 97807 - DNA, 452 bp, Heterodera glycines
  Promoter: Source sequence=SeqID_10426; Location=1030..1481; Strand=-; Gene=SeqID_73624
tgaaaatatgttaacacattgcactgaattttcaaaaaaaatttccggcggcgcctagcggcaccacctgacccccccccaaaaaaaattttttttttgaaaaaagcgcaccgcgaaaaaaacggtattaaaaagcaacaaaaaaaggtcgtaaatttcatggctgaaccatttcgcaaaaaatttggttgacccccccccccgccccctttttcatttgagtgtgcaaatttttcttcaaaaatcatcaaaatttgaaaaaaaatttaaattccattttacatttttcgggagggaaaagaacaataaatatgtttcattttaatagacattgatttttattggttctgtatgaaaatttgaaatttttttaatgggtaaaaaaattaaatatcaaatttacaccgttttacgcaccattttcacataccaccaaccaatccttgcagatg

SEQ ID NO: 97808 - DNA, 1003 bp, Heterodera glycines
  Promoter: Source sequence=SeqID_3645; Location=290..1292; Strand=+; Gene=SeqID_51263
cgataaatgtatttagaaattaaaaatggaaattttaatccttcaaatatttttctattatgtcatttttattttttctatttgtttttttactttagtttttctagaataaaaataataatccttcaactattttttttatttaatttaaataaatttttttatttatgagaaatttttcattaaaataaaaatggacaaaaataatttgtttataaaaattttttactttagctttttctataataaaaaagaataacaaaagcttttcgtcgaagctgccaattttaaaatgaaaatctcttgagataattggatgccattcttataattggggctgctgttgttacatttttggcacaaagtattataacgtgttcaaattccccagcgaggtttcattttcggcacaacggcaaacatttggttgcagtaaattatttaaacaatgcccttattattttgaattattacaattattattagaatagtagtagccacaaagataaataaaaaaatgacatcataatatttttaatatatttcttaatcgaattttgctgctagataatttcaaaatttaaattcatccattcttcttttaagtaaaaattttatatttaactcaatttcattttaattacttaatgtttttaattttacatatcattattttattttttaaaataatttttatttcaacaattcaaagtataaagatgataaacttaaaataaaaattgctaaagctgtcaaaaacagattctctttgcactaaaatatgcaaattgcctaaaaatgcctccagacacgcataaattttctaatggaaggcatttgacaaagcaaaaaattgaatttatgtgttaacaagctttttttatactaaaattgctagaataaattaatataaatatgttttttgctttatatttttaataatttaaaaatattttattttgaaaaataaatttgtaaatattaaaacaattttttagcaatg

SEQ ID NO: 97809 - DNA, 306 bp, Heterodera glycines
  Promoter: Source sequence=SeqID_41040; Location=1..306; Strand=+; Gene=SeqID_69259
aggggaagatcaaagattaagatcgacccatgtgtgctctagaggcaattgcgttgtcgccgatttcctcacaaaggggccgtggtggcagaccatccaaaaaaataggcggtcatgatggctcaggcaggagcaaatataatgattccatgagggagagctagttaatggatcataggtgtgaatctatcacagatgtggttgtttttccatctgtcattgataaaataatcttcaccccagtgcaaatcaattttgcaatcacgtgaaattttacctgtagaattaggaagtgggcagcaaatg

SEQ ID NO: 97810 - DNA, 140 bp, Heterodera glycines
  Promoter: Source sequence=SeqID_9985; Location=1..140; Strand=+; Gene= SeqID_73027
cctgttctgtgtgcgcatcccagcataaacaacattacggactttttgagcactgggcagcttggtgaagttgcaacgacaacaacaacaacaaccgcacttccgacaactgcggaggtgtcggcggcggcggcagaatg

SEQ ID NO: 97811 - DNA, 434 bp, Heterodera glycines
  Promoter: Source sequence=SeqID_14887; Location=824..1257; Strand=-; Gene=SeqID_47244
aaaatgcaaaaaagacgaaaattgatccttgtaaatgcatttcttttgcctatattcagaaaaatgaagaattaagtccccattgagtttgaaactttttttagcaatttatcaaagtttaaaaaaattaaaatgaaaattttttttctgtttttttctttgtgtaaattaaatgaatttttagcgcttcaaaatattggcgtggcatattgttgctcttaaattcaaagaagaaaaaatgttgaaaaaaatattttggaaaaaaattttaggttagggctggtgctaccttttgcaacctgctggaaaattgtaaaattaaaaattgattttcaaatttttaatgtgtaataatgaattgaattttttttcgttatattggattctattattgtatattaattggttggtcgatcatctgcatttttccaatg

SEQ ID NO: 97812 - DNA, 94 bp, Heterodera glycines
  Promoter: Source sequence=SeqID_7448; Location=917..1010; Strand=+; Gene=SeqID_64853
atatttattccaattaatcacaataaatatgaaaatgctaatttataaataaattttatgcaacaaatcaacagaatcagtcactggaacaatg

SEQ ID NO: 97813 - DNA, 1003 bp, Heterodera glycines
  Promoter: Source sequence=SeqID_20065; Location=368..1370; Strand=+; Gene=SeqID_84849
tattacttttgttaatgaaaaagtgaaaaaaaggaagcggcaaaaagcgacaaggcaacaagattttaaaataaaactgtattaaattatttaaagaataatgctgggcaaatggttgacctgggagggaatcgaaccctcgacctacgccggtgcagaatcggttaccccacatttgcgcctcagacattcgcgcctatgtccaaaaccgagttcaaaaatcatcaattattcaaaaagcagaattaatgctccaaataactagaagacttggatttcttctttctgtctatacatataaaaaaggaatactaatcacttgggtgaggattaatttacaacaaaatcccaaatatttaagaaaaagtgccaaaatacttaagaataaaaatatatcgacaaaaaaattcaaaatctcttctaaaatgcaaaaaaaaaaaaaaatttaaaatttatccgctgttgcagttgctacttaagtattttccgaggtaaaatttatacggttttcgacatgaatatttttgttaaaagaaaatgctcgtcaaaaataagcacattttaaagcgccattaaagcctaaatttgcatgttactgaacaaaaacaaatgttattaaaagaatgttcttcatatttttcaataatttaattatttcaatatttttgggtgaaaacattttacagatttagtccaaaaattggtcattttcgagatgtaacaacctaaataaaaaaaaattggtcaggcggtgccgacaggcgtagccgaggaaatttcgtgggttttagcctgttttgagaacagattttgcacccaaaaataagtaaaaaaaattcaaaatgccaaaatatttaccaaaatattataaaatgccaaatatttaacaaaatattttatttacgaaagccttaaaaatatattttttatatttactagcggggtcagcgccttcggcgcatcccccgctaggcagtacgattgtgttatagaattatgaatg

SEQ ID NO: 97814 - DNA, 170 bp, Heterodera glycines
  Promoter: Source sequence=SeqID_2798; Location=1..170; Strand=+; Gene= SeqID_81650
ggaatggaccggggaagaaaagcttattcaacaattttcttccagtgatgttgatgaaaaggtcaatgatcagaagcagaagaatgccattccaaattcaaaagacaaaagtaaaacacaacaaatatttgaacagaaggcggtgatcaatttgatatttggacaaaatg

SEQ ID NO: 97815 - DNA, 223 bp, Heterodera glycines
  Promoter: Source sequence=SeqID_23622; Location=1..223; Strand=+; Gene=SeqID_54319
gggcagttgaaaggtatggattaattgttgactttatgatgaaaattccgttaagatttattaatcgataattttatttgacccccccccccaaaaaaaaggcaaaacctattgtaaggactgtacacaaataatcaataaacccaagcctattgcatatatcatatccgaagctttaagtaaattagcaaaaaactccaattcattaaattgtaaaaaaatg

SEQ ID NO: 97816 - DNA, 212 bp, Heterodera glycines
  Promoter: Source sequence=SeqID_13835; Location=3395..3606; Strand=-; Gene=SeqID_47159
agttagtttcattcgaaatattcgaataattgagttatcaatccagaaaaagggtgtaccttattatagctctgcgcttataatccgattaaaaccgaactaagaattactattaatggatatgttacttttcagggcaaatcaatttttttctgcatttttccataaaattgttaagatcaacaaaactcttccctatttggtctcaaatg

SEQ ID NO: 97817 - DNA, 489 bp, Heterodera glycines
  Promoter: Source sequence=SeqID_15872; Location=1..489; Strand=+; Gene=SeqID_80202
gaaaaattttttgaaatttgagtgctatttcatagcagattttcaattaaaatcggtaaaaacatgattaaaaaatcggtaaaataaagtgcggtcatgcgggatcgaacattaatgcacagaacaaaacaaacctgctgttttcaccactaaactaaaatacttaaataataaaacttattatttctttccaaaaaagtcattcttaagggtgtaaatattttagtcttttttgtaaaatattgctctgacgaaaccgaaaacgaaacgaaaaaactttagtggacgaaaacgaaacacgaaaacgaaactcaaaaagtaccgaaaatttaggacgaaacgaaaacgacacgaaatttcgtccagccctgattccaacccacaacattttcaattgatttcgaagccgccgtttccaatgccatacaaaatgttttcaatgggaattgcgccataaacttttgtttttttcattttgtgcgtaacatg

SEQ ID NO: 97818 - DNA, 416 bp, Heterodera glycines
  Promoter: Source sequence=SeqID_11843; Location=3747..4162; Strand=+; Gene=SeqID_75346
atttaaaatattttattttaattataatatgtttatttttaataatttttaattaaaaattatttaaattatttttattgaaattgataagttaaaaaattctatttgataaaatcaattttaaagatttttattacaataaaagaaatttttcgtttaaactttaataatactttattgaaattgtatgttaaaataaatataattaatattttaaacaaatttaaaaaattttatttaaaaaaacactcgaaaaaatataatgcaaataaaaatttatatttttctatatatacaaaaattagtaattaaattaaattatttttttttacaaataatatttaatttaattacctttttaaaagtaaaaaataaatttttccatcataaaaattaatttcttaatccaccaaatg

SEQ ID NO: 97819 - DNA, 1003 bp, Heterodera glycines
  Promoter: Source sequence=SeqID_15155; Location=460..1462; Strand=-; Gene=SeqID_79348
cgcccttttgtacgtcattaaatgaggaggaatggcgtaaaatcagtgctttggcaggcggcgaagtgtaaaaaatgcacaaaattacaccgaagcggcaaattaagcttcacaccaattcgaggaaatggtggcaaaaacggtggagggatggacggcaccgcggtgaaggtcgaaaatagaaaaaggcacagaggccgaatgaccgagttcttgagtttgaccttttcaatttaaattttggtacggtctcgagaccaattagcacacggaatgaggaagaagagaacgcggaataaagtgtaattcatacagtcataccacaattgtacctttaaacataatgcgagtgaagtcaagcagtaacgaaaaaattcatttgtcagcgaaattggttgtgcttttttgttaataccgtaattagaaaagaacactttaaacatagaataatttatacaggctaacaagttcaaggaaacttttcgccattttttttctaattgaaatcatttagtctgcataaaaccattgacggtccaaggatttaggctgttcgtggctttgggcggggtaccagctggaaaaatgtcattcagccaattttccgcttttagtcattttcttaatagattttaccccgataaatatactgccactatagatggaagcgctttaatagatatcataagatagatttgatcttttctcgctgcgcctactaatcaaatcatatcacgctatagtgatatactgtatgatttaaaattggctaattataaacgccaatctatgtttttttcactgttttaaaccctttgaattttattaaaaaccaaagagaaaccaaaagaggggagcttcttgttcgagtttagtttagggattaggaatttgtctcatttcatgtcagatccatgatctaatttgtcccattgtataaatccaatgtagtcaattttctaaatccataattatttttgtcactttttgaggtttgaaaatg

SEQ ID NO: 97820 - DNA, 321 bp, Heterodera glycines
  Promoter: Source sequence=SeqID_999; Location=9168..9488; Strand=-; Gene=SeqID_65665
cgaattttctcactgtacaaactaaagcactaattgcttcctttactttctcacatttcgctttcattttaaaaatttctttcacaacgcatttttaacaaatctcgccaaattcttatgtttcacattattaattatcatttctcattcacttaattcatcatctaatttcacatgtgccgtatttataataaaattgtgtttactttttgctttttctagtttatgttgcatagagaaatgcgtaaaaacggtttacttttccccgtaaattattttaatttcttttttattgtatttatttattattttttataaatg

SEQ ID NO: 97821 - DNA, 666 bp, Heterodera glycines
  Promoter: Source sequence=SeqID_21173; Location=446..1111; Strand=-; Gene=SeqID_51763
aaaatttaaaaaaaataaatttattttatttttcaaatttcaagttaaggggattttcctttttccaaggcttttgtcccaatttattttccctttcgtcgtagtaattgtcgttaccatttcataattatcaaactccgctcgcgttatgtgataatcggtgggcagaagcaaattttgaaaaataaacagacaaaaaataaaaatgcaaatttgtaagtgtaaatggacttgaaaacttatcttaaacacattttaatgacatagaaattattgtaagttaccggaaaaataagtcaataatacagtatttctaaattaaagtactgtagcatttataaaaggtcgaaattgtttaaaaacttcgttctgaattttttcaattaagtttctttaaagtctaaagaaatttgaaatttacccaatccctaaaaaaattatactgtaaataggttgttgtaagcttgtttacataccaatcaagatataagtattatactaccgggtctcgttttttccaagatattctgattcactgacccattttccagtgacgcactgtgaaaacgctaattgatacatttagtaaacaaattaactaaaaattccaattttcaaattttaattacaacaaaactttaaggcgagacgggccccggcgaaatg

SEQ ID NO: 97822 - DNA, 1003 bp, Heterodera glycines
  Promoter: Source sequence=SeqID_18317; Location=339..1341; Strand=+; Gene=SeqID_82913
gaaatcggaattctgacactaaaaatgtcggaaatcggaattccggccccaaaagaaatcggaattccgacccaaaaatgtcggaaatcggaagtcggaattccgttccatccctggcacaggtccaagcaaatggcacaatttaaatgtaaatttaatcaattaagggattttagttaaattcaacacaaaaaattatgcagcagccagcatttggagtgatttgcataaatttttgtttttcttctaagaaatgctcccccataacctataaaaatgtccgtccgattttggggctcgcacttttgcgcatcagccgaagcaaatttaagaaaacgcgttcaattggcggtgcttttgaacgagtgatgagcaatgcaaagaaatgggaaatttgagtaaatggcgaaatttggtaaaacgcgcggcggtgaaacggacgaaattttggggaggggaggaaaaagggggacagctgagagcggatgtttgcgcaagagaattattataggaaagaacagagaaccaatttagcagaaaaacaaatttaattaaatttttaaaaatatgcaaaaaaacaaagaaaaaatttagtcgaatttgcaaaatctttagcatgttttaaaaattcattaataaaagttttaattttgttcttcgttttaaagcagccaaaaaccaaaaaattagagactattttttacaaaatttttaataatgcattttgaaagttttaaattcggcatcacaaaatataaatttttcttttttttttggggggtggggactgtgccatatttttttttctttgccaatttcacactaatttgaatagtcacactgttggacattggtggggcattaaaattcaatttcaaaatttaaattctatttcgaaagtcggctaatttaataaatgcgcactgctttattatccgcaccaattttgagtgtatggataaataaataaacgaataaattgcgaattttgggcagcaaaatg

SEQ ID NO: 97823 - DNA, 233 bp, Heterodera glycines
  Promoter: Source sequence=SeqID_5121; Location=1..233; Strand=+; Gene= SeqID_56987
atttttgggtatgttagccttagcgctgtttggcccctttccgtcatcagaggtcggacggaggatgacgatagataaaatgtgaatgggaaaaatgcatttatttgtccactgttgtgagacgacgccggcggggagaaagggcgaagaattaaagaaaagcaaaaacggagacagatcgatttggcttggattttccatcggaaaattcaaaattttttcagcaaaaaatg

SEQ ID NO: 97824 - DNA, 441 bp, Heterodera glycines
  misc_feature (118)..(118): n is a, c, g, or t
  Promoter: Source sequence=SeqID_7299; Location=1537..1977; Strand=-; Gene=SeqID_64395
tttgtattgccaatctgatcgcgccctcctctccccgtcttcctctgccgcttccttttccttcatttccttatccgttcttcccacccttcccttttctcttcctttcctctccttncacctccccttcttcttcctcttgttcttccttctcttcttcttcctcctcttccttcctgtcttttcctcttttccttttcgtcccattcgatgtccgtctgtctcttttccttttccaaagggaataactcccgggggaacttaactttctttgttcgaccccagtgaatgaatgttagcgaagtgaaaggaaaggcgacaaaaaaagatattaaaggcaaaaaaacaatgaaaagcaaagggcaaaaaagaaaagattaaaaaagaaataaattaggaggaaaaaaattaggaataaacgggaaaaagcgaattgaaatg

SEQ ID NO: 97825 - DNA, 650 bp, Heterodera glycines
  Promoter: Source sequence=SeqID_24621; Location=1121..1770; Strand=-; Gene=SeqID_55359
aggctcgccaagagggtgcgcattgggtcgcactgtatattccgcgtttgaacaccatatggtattttgatagtttggcccttcctgttccttttaacgtacagaaatttctgtcccacttccctcatgtcagtaaaaacaaaatggcatttcaatctcccacctcagacgtttgtgggcactattgcatattttttatttatttggcttcaaccggaatgttatatgatgaaattttgaaacaactgaaattgtattgtgtggattataattgtgacattgcaattaaaaactacgtgaataaaattttgttttatcttcttgggggagccttcaattagtaaaggtggatgattccgaatcatgatttaaaaatataccagctagtgccagtctctgggcattggggtcaaaaggcgtcagctgacacatttctcctgtgtctatctcattttgatgcgtcagctgtctagcattttagtccttaatttattagagaaaaagaggcattgagtatcgtaaaaagagaggtattgagtatcgaaacgattcattcataattttatggaaattactgctagtacggggtataaattaagtgaaaaattcaatacaacctcatttattggccaatcccaaaaatcatcatg

SEQ ID NO: 97826 - DNA, 218 bp, Heterodera glycines
  Promoter: Source sequence=SeqID_4003; Location=1..218; Strand=+; Gene= SeqID_52771
tatataataaattttaaaaataatttttatcgtcgcaaatgtcgttttgactgggcgccgtaaatgtcgaccaacagttaatttatgcggtgagaatgtgaactttgcgcgccttggttttttaaatatttatagaaactaaaaaataaaatgtattttttctcgccttattgatcacgaatcaaaaaaattttgtcattaaaattaattccaaaatg

SEQ ID NO: 97827 - DNA, 521 bp, Heterodera glycines
  Promoter: Source sequence=SeqID_22826; Location=1..521; Strand=+; Gene=SeqID_53535
ggaggggaccggcggaaaggaggggacggggcagcacttggaggaagaggcacaacttcggcaaattggcccaacaaccgacacaacgccaagagatgccgaacagacggagatgagttttgttggcaaagtggacacattggactagaagattgggccggaggcgaagcggctgcaaattctgttggaactcacgcacaaccggcacaacagggcgaatctgaacgcaaaacagctgcacgtggtcaatgaaatgttcaacttgttcatgtacaatcacgcatttgttgtttgcctttcattcattcgttattattctttggcaggtcgcggtgtcttaaagttgtggccacaaacagccaattgctgaacacgctggccaacccggaaccgttgctgccaaagaggaaggccaaccaacagggcacggaaaaggggggcagcattgctagaatggcccaacaattgtccgtttggctcagagtgtctgccaaatacgtcgacgaattgccccctcaatg

SEQ ID NO: 97828 - DNA, 410 bp, Heterodera glycines
  Promoter: Source sequence=SeqID_26706; Location=926..1335; Strand=+; Gene=SeqID_57468
tctttaattataaattaattattttaaaactgaattagcattcccgttatattttattatctttttgttaataatttgcagaagaaatttctctctgtgcagaattatggcaaagatgggacgcttaaaattcattgtgtattgaatgcgattaaaaagaaaattaaattactcatctaatttataaaacaaataaaattggcttttgcacaaatcaacaaattttttgacttttcgtccgctccattccctatcaaatttgttcgataaaaaatgtgaaacacaggccaaattggcgagtgatgtgttgctgctatataattggaggaagagccaaattccctcacataattaattcgctaattaattgctcatttgtcagcccatcccaaaaactgataaaaaaaatg

SEQ ID NO: 97829 - DNA, 298 bp, Heterodera glycines
  Promoter: Source sequence=SeqID_963; Location=1..298; Strand=+; Gene =SeqID_65062
aaaacagagtcatgggtcattatttaagaaatacgcattgatattatgctgcagattatgtgttaatgttttgtttctagaattatatgtatatttttgctttaaaatgcgacaaaaataaaacgcagaaattagtaatggtcgatttgacattctttctgctttatctcataatgcaaatgatttattggaacactgagacaggtgcccttttcattagatttttttgattatttattattttttttaagttgagaccaaagcattcttctgttcgacgtaaagggatgtgagaatg

SEQ ID NO: 97830 - DNA, 150 bp, Heterodera glycines
  Promoter: Source sequence=SeqID_3817; Location=4811..4960; Strand=-; Gene=SeqID_45647
ttaccgttagctaaacattaataatgataattcatattaagacttatggatctttcaaagacattttaaaatttaacctaaaacatttacacttttactaatttgtttagctactgtattaacatcaaagtgtaaagcgtattcaaaatg

SEQ ID NO: 97831 - DNA, 646 bp, Heterodera glycines
  Promoter: Source sequence=SeqID_45008; Location=1..646; Strand=+; Gene=SeqID_72399
tgtgaaataaaatggcgattgtgcacagccctccgtttttacgcaagcgcttttgtgaggtataaaatttctcaaaaaaagagatagccatttttctgggatagagtataaatttaaaaattccctcaaaaataaaaggtaaattgcgcaccgccctccctatcatgctcgagagcatttgtatgtgtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatg

SEQ ID NO: 97832 - DNA, 353 bp, Heterodera glycines
  Promoter: Source sequence=SeqID_43146; Location=1..353; Strand=+; Gene=SeqID_70888
cttgaattggctctaaatatttaaaatttcaccagtttttcttttttcatttttttgacttctctaaacattatttttttttttttggcctatttaatcccttgcactttttggcacaatcgtcgcttggccaaaataaaaaaatggtcttttttggtggtctcccctttgggccagaaataacaagttgcccccgggggaatctgtttattccaccagcgccttctgaacttttcccgatgcttttgacatcggtcgctgacacccccgcataaaaaagtgaaaaatgggggggggggagggaagggacggcgaacaccgaattttggcactttttgaggaacggaaaaatg

SEQ ID NO: 97833 - DNA, 156 bp, Heterodera glycines
  Promoter: Source sequence=SeqID_1440; Location=4217..4372; Strand=-; Gene=SeqID_73552
tttcgattttcccctatacttaggcacaatttcgaacgccgcttcccgccacctccgcccgtgttcaacggttcggtgcccattgaggagacagtcaccctcagctgcgtctcacccaccagtgccgacgttgccgtcgtttttcaatccggcatg

SEQ ID NO: 97834 - DNA, 746 bp, Heterodera glycines
  Promoter: Source sequence=SeqID_32370; Location=1..746; Strand=+; Gene=SeqID_62686
cgcgaagcggccgaatgtcccccaaaaatttaaaaaaacgggcgcgaagcgcccgtcctgaggccgcgaagcgtccgaatgttcccacaaaattaaaaaacgggcgcgaagcgcccgtcctgaggacgcgaagcggccgaatgttcccaaaaaattaaaaaacagggcgcgaagcgcccgtcctgaggccgcgaagcggccgaatgttcttaacaaaattaaaaaacgggcgagaagcgcccgtcctgaggcagcgaagcggccgaatgtcaccaaaaaattaaaaaacgggcgcgaagcgcccgtcctgaggccgcgaagcggccgaatgtcccccaaaaaattaaaaaacgggcgcgaagcgcctgtcctgaggccgcgaagcggccgaatgtcccccaaaaattaaaaaacgggcgcgaagcgcccgtcctgaggccgcgaagcggccgaatgtcccccaaaaaattaaaaaacgggcgcgaagcggccgaatgttatcaacaaaattaaaaaacgggcgcgaagcgcccgtcctgaggccgcaaagcggccgaatgttcccacaaaattaaaaacgtgcgcgaagcgcccgtcctgaggccgcgaagcggccgaacgttcccacaaaattaaaaaacgtgcgcgaagcgcccgtcctgaggccgcgaagcggcccaatgtcctcaaaaaaattaaaaaacgggcgcgaagcgcccgtcctgaggccgcgaagcggcccaatg

SEQ ID NO: 97835 - DNA, 227 bp, Heterodera glycines
  Promoter: Source sequence=SeqID_23881; Location=1424..1650; Strand=-; Gene=SeqID_54570
atgtctgggactcaaatctccggcattccagacactgtggactcaacccaccaactttcaatggcattccaatctctgggactcaacccaccagcagcatttcaatctctgagactcaacccaccagcatttcaatctctgggactcaacacaccagcatttcaatctctgggactcaaatctccggcattccagacactgggactcaacccaccagcatttcaatg

SEQ ID NO: 97836 - DNA, 325 bp, Heterodera glycines
  Promoter: Source sequence=SeqID_27915; Location=1671..1995; Strand=-; Gene=SeqID_58577
tttcttttaccttcttctttttcaaactatttcttttcatctctttttcttttcaatctctcctcacagcaaatacaaaacgccacattcaaaccatgttacatagccacaaacaatcaactttattatataagattaggtagcagctacggctctaatgcagtttacgcgtccaatcgacttttacgcgtagcactaccacttaaaaaaagatatttaaaaaaatctttccttcgttgagtcaatagcaacccgtaaaaaagcaactcttacaataaaataagcctaagtaataattaccaaattaacttaagagtattaaatg

SEQ ID NO: 97837 - DNA, 94 bp, Heterodera glycines
  Promoter: Source sequence=SeqID_25539; Location=394..487; Strand=+; Gene=SeqID_56279
tctccgcctactgggaccagttcccgtcgctggcacggcaaatacaaatttggcatcatgtccgagtcggttatcaaaacaaaatgacacaatg

SEQ ID NO: 97838 - DNA, 1003 bp, Heterodera glycines
  Promoter: Source sequence=SeqID_4177; Location=2289..3291; Strand=+; Gene=SeqID_53480
agaaagaattctacataaattgaacaattatttataaatgacataaagaataattattcaccatataaaaaagcacaaattattatatttattaaaaaattaaagatgtacgaaaaagagtagggttaagccccgacccccgacccgagacgttatttggacctattccccgacccgacaacgaaattagccaaaattgtacgaaattgaagtttgtccccttccgtttagttgagaaataatttgttttatggggcagaataacggtgaaagaaaaaaggaaaatctttgcttggttattcttaaaaataaaattttttaaaattcacagcatcctaataaaagcttaatcgttacattaataagataattgaatttcctgggttttttacattgtcacattactttttttccaaaatcctaaattttataatttattttactaattaattgtcattttgctttttacaatatttaaagccaatatttgctgttaatcatcccaaccgttctgtttcctaaaccctttaattcacaaatgtcacattaacaatccctccatttaaaatggattacgcatttatcggttggcaatctttgaaataaacaaaatgttaaaacattcatgaaatttgctataaaaatgagcaatgtgtcacaatgaaagagcaaaatttaacattcaataaaagataaattaaataaattttattataaaataattttcaaattaatttttcccctttttacccaatgaaaattaatacaataaagtaattgggttgtccgtttggttttcggggcgactgtaataatttcgggagggtttcgggattcgcatattcgaaagtaaggaaattttaaatttgaatttagatgctatttttgacgattcttctatttctttttttcttctccaatgctgaacaattaacgtttgttggcggacattcattcaatggtttgtttctcaaatgaatcgtttaatttatttttagaaatg

SEQ ID NO: 97839 - DNA, 1003 bp, Heterodera glycines
  Promoter: Source sequence=SeqID_25780; Location=1096..2098; Strand=-; Gene=SeqID_56518
aactctcggcatgtcctcaccacacaaggacgtgcgtacgcaaagacagagaaagagagagactgggagcaaatgagggaaaaagggagcgaatatttcttttctggggattgcgattggaatggggtgagaaatgaacttaacaaatgaagagcaaagaaaatttcataaaaagtgcaacgaaagtggggagggaaagttcagttataaatcatttgtttgaaaaggaacatgaatggacagggagaagcggctcatccgaaaaactggaaggaatttgctttacaattttaggtagattcacaaaagtgattgagtaaagaaaaaatttggatttataaactacaaaaaaagaacactgtgggtacactgcactgagaaaagaaaaatccagaacttttctttttggcattatgttcatgaatttaaagtggattctgcggggtccactgcgtttcggcgctcccgtttcggcgccagcatgtttttggctataacttttttctttgtaaaccaaatccaacattgttggtgtcgttcgaaagcttaatctatttagaagctttttctaagctattgctttgcgattagacaattatcaaaacagttatgcatgaaaattgcgaaaagtcgaaatttttgaagttttttcttaataaaatttttacaggcttgaaaaacttttcgtttttgataaggctaatagagcatgttaagagctttcgaatgataccaaaattgttggatttggatgccaaagaaaaaagcttaagtggaaaaacgagctggcgccgaaacgcgtgggtccctcacttaccacaccatcccgaaaaagagctcctgtaaaggtttttagcaactggcaaaaaatttgaaatcttggtatcattcgaaagctattgatgagaagaagctttttcggcgctagttacaagaaggacctttttgaatttttcttgtaactagcgccgctttttctaagcaactgctaaccgatttgatg

SEQ ID NO: 97840 - DNA, 1003 bp, Heterodera glycines
  Promoter: Source sequence=SeqID_10363; Location=4060..5062; Strand=-; Gene=SeqID_73540
tgcatttgcctaaaaaatccctatttatcacatatatggtagggggtagggatagcacgtaattccgtttcgaaaaaattttgggcttcggaactccaattttcaaaaatttttgtggtctcggaatcccttctctagtagggagggaaacggggactggcgcccagttgattggcgcccagtcggcggcgcccagttgatctggcgcccagttggcgtcgcccagtcggcgtcgcccagttggcggcgcccagtcgacccccaccgagaatagtttgaccccataaaaattttttttctgttatgaaaagactaatccggggtttttgcgtttctgatcatgaatacgatcactttgcaaaattccttggtcttatcattgatttgaaaaccatagattttcggaattcgatcaaatgttcctacctaattatttactggtaataaatatcgtaccaggtgttttcgacagtgattgatttcgacagtataaaatttttaaattatttttttaaaattatttttttatgtatatgcacatatgaattaattttaaatattattttcatatacataaaaaatttataagaaatttaatttaaataaataaataaataatattaaacacaactaaagttgtatggttattttttgtaaaaatataaaatattcttatcgcgttaactttttctgcgcaaacatctcctgctgctgtgctgttctcgacaaacaatttcctagataagattttcgagtaaagttataatatgaatgacctgtggtcattcttcgtccatattatcattctcctcaatccatagttccatttttactcaattttttcttagtcaaataatggctttattgcgttttaatgcggctaaatcatcgcgtgggaaaatcctgctaacaaatgccgggtttgagtatgcatttgaggtccaacaaactaatgtcaaaaatctgatcagtggttttaaggctttatctaaggtcaaagatg

SEQ ID NO: 97841 - DNA, 292 bp, Heterodera glycines
  Promoter: Source sequence=SeqID_1937; Location=5653..5944; Strand=-; Gene=SeqID_76910
ggtattagtctcgggcctcgggaaatttggctctattgcacagtttacacgaccataaaaaaagataataaaatatttgacaacattaatgtaccttattttttgtagatttattatcaaaaatgttcagaaaaacccaaattttttcataactttttgctaataataaataaaaaatgaaaatttattatttcaatagtcgtcgaaaataaatttttttgaaaaataattttaatgagcacaattaaataataaaaaaataaaaatctaaggtaatgttggacaaacgatg

SEQ ID NO: 97842 - DNA, 409 bp, Heterodera glycines
  Promoter: Source sequence=SeqID_27091; Location=262..670; Strand=+; Gene=SeqID_57803
atctgatcaacttggtgttgctaccttttttgatcagcatccaaagttatgcatacctgaatttttttaggcatttttattgctagaaaatatgaattttctgaagtgttcctaaacatatgaccaccccgaaatttgactatatggaagaaaacacaaatttttacaaaaaggaataaagcaaacgagaaatgtgtggtaccaatggatagcccagaaaaaatgctacaaaatgcattaaaaagattattgattatttttctttcaatccagagaagcaatattttcaaagaatttatttaaaaaaagaggtgttcctaaacatatgaccatgactgtattaatgttataaaagcacagttacctcttaaatacattagaggccgctcttagttaagattaaaaaatg

SEQ ID NO: 97843 - DNA, 1003 bp, Heterodera glycines
  Promoter: Source sequence=SeqID_5980; Location=269..1271; Strand=-; Gene=SeqID_59901
aaaatgaattagtcggcaatatcttaaattaattgactttaatacattttataagtagggctgggaatttacctaattcacaaaaaagtcacaaaatgcaaaattcaatcgtacgtcaatcaatttataaaaaaattaattttgtaacaatttctaaaaggtaaatttccaaatttgtcatagaaaaatgatttaaaatgggaaatgaaatgggggaaattttaaagcagcatttttgcctgaaagatccgacaaagttaggcgattgtttcaattctcggattcttctcaacaattgcaaagttttttccggattcttgaaattcagggatttcaattttggctgagggaatctgataaaattgggcgattttaattcccttgctcttcttaacacgaaaaattctgccagattaaagccatttaaggccactttaaccgtagaacaaaaaggcagttggcctccttttaagagaagcgaaaattagtatttatttcatatttcagttgattccttccttttttccaaatatttttgatttctctagcccacactatttctccattttctttctatctgctcacaactaaaattgtcaccataaaaaatcgatatattggtgggagaaaagcctgcagagatgaagacagaaaagaaataagtgatatgtctgtttacaccaggctactttaattaaattattgttttttttaattgattgaatttttgggaatgcgtaaaaatttttagtgaaaattttgtcagcgaggagttcgattaacactttcaatgccatttgttgtgcacaatattcaaattcaagcagttcaaacgaaatgccaaattaggtaattcaaaaatttatcgcgaaattgatgtgctgaagaaattcagacatccgaacattgttcgactttatcaggtgacaaattgaggacaattattactaattgattgataattaattaattgcttaattttgtaattcaattgaaggtgatg

SEQ ID NO: 97844 - DNA, 177 bp, Heterodera glycines
  Promoter: Source sequence=SeqID_24056; Location=1..177; Strand=+; Gene=SeqID_54751
agtttatgcatgggagacatgtggttcagcatgggaatgaggagaaaatgcgcttgtaatcagtcgtaaaaggaaattgagtttaatggaaatgtgggcagtgatgatgtaaggcaaaatgagaagggcaaacattcggtaatgagaaatgcaataaatatacagcagcacacaatg

SEQ ID NO: 97845 - DNA, 599 bp, Heterodera glycines
  Promoter: Source sequence=SeqID_1092; Location=403..1001; Strand=+; Gene=SeqID_67692
ttgaaaatttttacaatttggatgcaattactaacagattttgcctaacatacgacaaaattttgtgatttcagttgagagaactaagtttcgagtgaggggaactatgaaattttgaatattttttagcagatattcaccaaaaaatcctattttatgtcaaatttagaaacttttttgaatccatttttaaattaaaggacaattgcggttccgcctaatttgaaaatttagaattgaaattcgttaatgaattttatttaaaaataaccaatttacgggtttatatgaattttaaaaatggtgatttggctagtacggtgtcgatatggcaccgccgggtgaaaagaaattaagttatttttaatagaaaaaaattcattttaagttgcgaagttcatcaaccaacgggggcgagtacaccttgcagaaatagttgaacaaagcaaaaatttaatttcattggagcctttgtgaattttttttttataaattttgatttttatttaattttatttttaactgtttaattcattataattatttatgtgctcttctaaattaatttatcgcaatacaagtttttcataaaacaaatg

SEQ ID NO: 97846 - DNA, 450 bp, Heterodera glycines
  Promoter: Source sequence=SeqID_20016; Location=1..450; Strand=+; Gene=SeqID_84792
attatatttattaaaaggaatatgttttaattgattgaaaatggttgcttcatcgattgatagtgatcaatcaataattaattagtgatgtattaaacattggtgctcgataagcttgccgattcgctagcttattatcgattgatcagtaacgcgatcaataattgattgacaaactaattggattggtcggttgatcgtttttgatcaataggttaaaaaatgcttatccttttttttgtgtctgtctgtctgtctgtgtatgtctgtgcttttctctctctcacactgtttttttttcttttaccgcttttgctattttcgcactttctttttccacgcttttccgcactgtaatctctttcaatgtttaaagtttttttttaacatttcgccaagaaattatatttttaaaatttattctctcgcatcttcagggcaagcacaatg

SEQ ID NO: 97847 - DNA, 555 bp, Heterodera glycines
  misc_feature (58)..(58): n is a, c, g, or t
  misc_feature (123)..(123): n is a, c, g, or t
  misc_feature (198)..(198): n is a, c, g, or t
  Promoter: Source sequence=SeqID_26773; Location=900..1454; Strand=-; Gene=SeqID_57534
gatttaatggtatattaaaggatttaatagtatattaaagaatagttattaatactanttcctttaaataataaaacaaaaggtataaaaatggttattaaaattaaaaaattaataatcttntaataaaatgttctaattgaactattaattaatttttcatttttaaggagatgaaaatttataaaaacaactccnatattttaatatattaatatgaatataataaaattatttttaattcttcaagcaaagaaataaaattattagatcttaattaacgggtcatctaattttttaattatattaatattatctttttcattaagtttactaataatatttgtttgattgtatatcacaatttgtaaattatattcatcacaagatcttcttataattatatccattgaaataaagtcgtctgaataatatttttaatttgtttgttaataaatggaatagtttcaaaatttcaaactttaactattttattatcaataatttgatcaataaaaattatttcatgtttaggtcttaaacaaggacgaaatg

SEQ ID NO: 97848 - DNA, 315 bp, Heterodera glycines
  Promoter: Source sequence=SeqID_21674; Location=992..1306; Strand=-; Gene=SeqID_52283
tgtgccaacatcgcaaccagttgttcgctgtcaccctgctccgggtgaatctcgatcacaaccctaatgttatttataatttaaaaaaatatataatttaaaatttacgggattttgtcccaggagcttgtggcccaaatttctttgctgtcgggcgcggaagggtccaataatttgaaattgacgactttcacatggggtaaatcggtaaaaaatgcaccgcgcagcgcgtcataaatcctttttgagactctggtttaattacccaagtttgagataaaaacacattctctataaaatcgattatcgacaatg

SEQ ID NO: 97849 - DNA, 626 bp, Heterodera glycines
  Promoter: Source sequence=SeqID_15233; Location=1..626; Strand=+; Gene=SeqID_79437
ttttttctttgttatccaaatccaacaatcttcgtatcgttcgaaagctcttaacatgctttattagccttattaaaaaacaaaaaaaaaataattggtatttttccaaaaaaaacccctaacagaacggccccatcaggtaaaatggcctttttgacctctaatgaccggaaaatttttcgaaaaaggcattttttagcaaaattttatcggaaatattaattatatttaattaattttttttaaatgagttcatttttgtcaaaaaataagcaaaaaagcaaaagtttctcttttcaggtcgatttttcgctaaaatgagtaaattttactgtatcgtgttttttcttctaaattggtttctaataccatatatgcaatttttaaaactttactttgcttttagcgaatttgaagaattttgaattacatccatcaatttgggaaaatttatgtccacttttttgcatttttatgtccatatttcgcaagttttgatccacattttatggccatatttcacgatttatatccatatttttcagccctaaccatgaatatatttaatttatacaattcaaagcgatctttcactaagaaattatattttttcaggcggaccgatg

SEQ ID NO: 97850 - DNA, 167 bp, Heterodera glycines
  Promoter: Source sequence=SeqID_8261; Location=2799..2965; Strand=-; Gene=SeqID_67483
tttaattttcagaaaattttacctccacggcactgctcagctggggctgtagcgaggaagcggacaaaaatggctgcgaagaattcttcgtgaacgcgtccaacaccgcgctgcactcgacgaagcagcgctgcgagtgccaatttggggaccagggcaaagacatg

SEQ ID NO: 97851 - DNA, 601 bp, Heterodera glycines
  Promoter: Source sequence=SeqID_44285; Location=698..1298; Strand=-; Gene=SeqID_71790
cctgatcaagaatgtttaacaccgggggcacattgctgtgtcggaaatgttgtcgatcccgtggtcgccgcacatcagcagtgcaaatcagttacgtgcattcccattccaaatcgtccgcaacagccattttacgaactgctatcgacccgtgtttctatatgcatattttcggtaatggttacttttactggtcccataaaaaaggaataaatcaggcggttttttacgattgtttgtcccactcgggggttacttgggccgctgatcacgaatatgacatcagatctgtcatgtgacttcatctaatccgtgatttttcatcaagtctaataagatttttcaaaaagtaatttttcattttttaaattatagttataaaaatcttttatggacatatcggggtcgctgggaaagataaatcggaagcaaaaataaaaaaaggaaccaaaccgaaagcgctcatgaatatgacatccatttcgaccagtttctaaactcggaccagaattcgaacaaaaaatcggaacttcgcatttcaacgaatttcgaatttttcgtctaaaaaatgcttatatgatcttttattacaggaaagatg

SEQ ID NO: 97852 - DNA, 716 bp, Heterodera glycines
  Promoter: Source sequence=SeqID_5625; Location=2876..3591; Strand=-; Gene=SeqID_58691
tttgcggatcaaaaggctaatcgaaagtgatttattcaaaaccatttcaatagcatattataatatttccatttaatgatttccaccatttttcctacaaacagatgacgaaccaaagcctgaaataaagcagatgaaagagcagagtttgtggaatgtaattgcatacggcgagaacatttccgagtgtcgtcggaaactgatcatttcacattttggagaggcaaaaccgataatttaaaaattaaatatccaaaaaatattatatattctccatcattttttaagaattattgtaaagctttcttctcatcaaaacattgcatgccttcccttttttcagacttatgaccgggaaaattgcattttaacgccagccccttgcacaatttgcgcatacgccgcgacccatggccaacttccggcaaaacttttcgatttcaccaaagaagcggtcgccgtgttggagtccattcggttcatcaacaattccggcgtcgcatacttggccgaattgttcagagggcaattgggcaaaaaggcagtgaagcgaaaagtacggaagcgcaagcaatccaccgacaataaatgaccatgtctttaggtggatgacaatggacacggacgactgccaattttcgcaatgggcagagggttgagtgaacaggtggaaaattcgttttcttaccgccacaatcaaaaaaaatattcaaatg

SEQ ID NO: 97853 - DNA, 569 bp, Heterodera glycines
  Promoter: Source sequence=SeqID_17731; Location=1..569; Strand=+; Gene=SeqID_82269
ttaaattatttttaaaatccggtctctctaataataatgcaaaatttgcaacaacaacaaaatttcaaaaattaatttgtttcatttttgcctttcctcctcctttgctgttgttgcatttgaatttaaatccttccgccggtggcacggcgcactttggcattttaatgccccaccagtgccgacagcaaacattaacatgcttaaaaggcttattagtctaaggtcacttaagccttattttcctgctgttggcatcattttgccatcagaaatttagtgagaatatgattcactttcactttcgttgtttaactgctgctttggattcaataatttgccactatttaataaatattatagcattttgagaccggcacgattgggtttttcgggttcggtttttattcaatattttttaattttcattttctttataatgctaaaccccacagttattcctaattatgttattaggacaatgttgttttcgataattaactttaccgttggcacaaaatggactttctttttagagaattccattgtcgagagtctttactaaaatg

SEQ ID NO: 97854 - DNA, 129 bp, Heterodera glycines
  Promoter: Source sequence=SeqID_35615; Location=735..863; Strand=-; Gene=SeqID_65133
gttcaattggataccatttataatcaagttggttgaaataaaatttgacaatttttggatgaatttttattgaggaaaatattttagggacgaattttgaagattttttaatttcagataatttcgatg

SEQ ID NO: 97855 - DNA, 1003 bp, Heterodera glycines
  Promoter: Source sequence=SeqID_3962; Location=572..1574; Strand=-; Gene=SeqID_52593
tcataaaaaattctaattgaagcagaaattttttgaaaaaataatagaattaatatttttaatagggttaaattttaaaattttaaatcaatttaaaaagttaaatgcgaagtaaacaaatatatttgtgtgtatttggttgaaaaattattcagtgatatttaactttgacagcaatatcgtgacacatttttttcaaacttttgaaacttggggggggggggtatgggtccggtggtgccgttaggcggcttggggaaatttttttgaaaatttagttgtgaatgacaaaaaattggatttttaaacatagcggaacacatgggatgtttttgagaacgccgctctttttcagccccggtaccgttcccctgctttaaaaaaccgaaaatcggttaaattttacttaaaaatattaaatataaagaaatttaaaacagatgctaaataaatatatttaatataaattatttaaaataaagtgaaaactaaagtaagaattattattatttttcatcatttcaacctataacaaaatgaattaaaaaattaaataatttttaaaagagcaaagcaaataataaggccaacaagttagccagtcatcggattcaatttaatttgtttaatgaaaaattgttattgaaagggagctgagttaataaaaatgaaataaactaaataatgcagtaaaaagttagaagaagagaggaatattaatgcattctagaaaggctaaataaacaagaccacccaaatggtaaggattggatgcactatataagtaattactcggatagaacaaatatgataatcatttaacgccgaaatgagcgccgtcttcattttactgcttgtgtaaaaatttttattaattgataaataaaattaattaattaagtgcgttgaatttctgtgcaacggctcagcaagatgctgtgcctgctttggtggatgtatgaatgttattttaattaatgcaaaataattactaaatcagatg

SEQ ID NO: 97856 - DNA, 473 bp, Heterodera glycines
  Promoter: Source sequence=SeqID_14493; Location=1760..2232; Strand=+; Gene=SeqID_78536
atgattatttttgatttggactgtttcgctagttttgccatccctaatactcaaacataacagtgcacccgattcaggagttggggctttttttaacctattttggctaatactaattcaagaatcttttgggaaatcctttttaaatgccaatatttttgaattttctttttcagcagaatggacggagggaatagcagcacaaaacgacaacaccaacacgaattggatgacagaagaaaaaatgaaaatttcctattttaatcaatattttttgcaccttttcatttggcaaataaataaattactattttttgcaatttcctttttcattcatttgctaataaatgatgtagtccaacatttttgtgatttcctctaatttctgtttctttttgcgatcaaacaaatatatgtctccagtttttaatgaaattcaggcctaaaaggcattgttggcaacaaaagtgatg

SEQ ID NO: 97857 - DNA, 347 bp, Heterodera glycines
  Promoter: Source sequence=SeqID_2359; Location=1533..1879; Strand=+; Gene=SeqID_79315
atacaatttgtatttgtgcatatgcattttatttatacattttaaaatttgatattatgtatatgctgaaatcgttcctctcattaccgaaaaaatttaaaaaaatcttttagaatttaaaaaaaaaatttttttttgaaaatttgtctttttattagaaagttaataactttgaaagcaaaatttttctggtgagatggaggggaaggagcgaaaaacagtgtcccattttgctctaattgttgcaatttaagccttgttgtacaattgtgggatcggtttgccatgcgcgtcctctttgccttgccctgccatcattgttttaaaccgttgtttgctccacaatg

SEQ ID NO: 97858 - DNA, 584 bp, Heterodera glycines
  Promoter: Source sequence=SeqID_15494; Location=1..584; Strand=+; Gene=SeqID_79764
aaaaaatcgtttttgggcataaagcggcgtgcggttgagacgatggaaacaccagcgggcaattagggtgcaactcttcagcaaaatgccacgccagtaatggcgaacattccgacaaagaatgtcacaaaaaaagtgaaaaatcgaattttttttttactttttcacatttttgttttaaagctggtgaagcgagtccgccatgaaattgaactgccgccgccagtgccgcaaacccttcaagagttggaacttcccgagcagtaccgaatctacaaacgcaccgaagaagcgcaggagcttttccttctggcggattctggaacatacaccgagaatgggcgagacggacaacagcgctgtgttttaaggggagcttttcacatattttctaaatttaagaattctgatttttggtcggctttctttcggaaattgggcttccgaaatgaagtatatttacgctgatggaactttcgcaagtgcaccgacgctcttcgcaactttacgtcattttggcgcggtacttttttgccaattttgtttttcaatcgtttttctcctaatttcagtcgtggaaaatg

SEQ ID NO: 97859 - DNA, 238 bp, Heterodera glycines
  Promoter: Source sequence=SeqID_1904; Location=1421..1658; Strand=-; Gene=SeqID_76685
tatttttgcaaaccatcctggactgggccgctaacaaatgggttttttttgtcccgataaacccccgtcccggtccatttctaaactcctggtttcgggctcgttcatttcaaaattccgggcctaaatttaaattctttccgtcgagaatcctaaacactaaacggagcagtaaatcccgtttcttttcttttttacagtccccattttctcttatttttggattacacacattatg

SEQ ID NO: 97860 - DNA, 604 bp, Heterodera glycines
  Promoter: Source sequence=SeqID_17274; Location=1079..1682; Strand=-; Gene=SeqID_47429
ttggattaatcaaagttgcttctccttatttacctatttgtaaaaaaattgcattaaaaaaagataaaaaataaaaatgcgaatgtataataatagcccggcggtagcgtgattaccgcggccgcgggaaaagccggccaatgtctgcattttttgtaacttaaattttcataataatctcttagagtgaagtgaattaattttcacaattatcagagataaaaaaataagagagatgtttttttctccgcactctctatttattggttcgtctctcgtttttgactcggtgtgaaaataatcgaaaattcgaatacattcaaaagtaattttttgtctgctgcttttagcttaattaagcctagaaattctagcctagaattcagttatacgagaaattctagcctagaattgactaatttttaagtttttgattgataccaggaatctaagcattgaccaagtaagaaacacataaaagcccataggacgtctaaaaccgaaaaagattgaagcatttaaccccacaatgcttcattattgtataatttcatttaaaaacaaacgaaggtagctaaatacttttctgattttggctaaaatg

SEQ ID NO: 97861 - DNA, 467 bp, Heterodera glycines
  Promoter: Source sequence=SeqID_20191; Location=718..1184; Strand=-; Gene=SeqID_84985
ataatttgagagatgtccgactgttttatttgatgataattttgtttgctgttctgatgaccattttggcgatgaatattaaaaataggaatttgagttgggcggatagaaaaaaaaaataataataataattggcatttcattgtttcgggaaaactgagaatgttttgcgggattgacattggcaccaaaaaactctcacaaaaaagaaaattaaataaatgtaagaatcaacaaaaagcatttcttagaaaaaagagagcatcaaatccattttcaattggtgcgataagttcatttccaattgggattatttttcaaacccctcctagactgggggataattggatattgggggattaatggagatttggggataattagagcaaatacggtagtgagatttggccatgcctcaaatataatgtagggagtccaaaaatatggatataaaatcgcgaaatatg

SEQ ID NO: 97862 - DNA, 303 bp, Heterodera glycines
  Promoter: Source sequence=SeqID_3125; Location=1..303; Strand=+; Gene= SeqID_83304
tccaaaaaatttttggaaaaaatgggcgcggcaatttcatattttacccacatttcagtccggtgccgcttggtccgtcctcaattggttcaattcgaacgaaaaagaccgaaaatcggttcctccagcagcagcagaacagtgccaataatgccacggttgtgccaacatcgacttcttcaccggcaccggctgccatcagccaattggtgttggagcaacagcggcgccaggagtggcgccaggcgcgcatggcatcgctggaggccgagtctcggcgggtcaaccaactgttcagcgatg

SEQ ID NO: 97863 - DNA, 229 bp, Heterodera glycines
  Promoter: Source sequence=SeqID_6071; Location=3172..3400; Strand=-; Gene=SeqID_60215
tagttgagctgaaaatgatttgttgtcctgagctccaactgagtgggaataataaattgctaagtaaatatggaaatttgaaaaattactgatttctttaaacaaatttctttttctaatcaaggttttacaatattttgatttattaaaaattaaaaaaagaattgattggagagactgcccgagaaatttaataaataaaaaataaattacatatacagtaaatatg

SEQ ID NO: 97864 - DNA, 883 bp, Heterodera glycines
  Promoter: Source sequence=SeqID_26039; Location=94..976; Strand=-; Gene=SeqID_56790
ttgccgtggatttaagtaaatttagtctcaaaaatgtctgttttgataaaaagaaggtaatagatttggggaatgcttagttttggggacagaataggggtgggagaggagaggggagaggagaggtgaggggaggtgaggggacaggagagggttgggagaggagaggggagaggagaggtgaggggaggtgaggggacaggagagggttgggagaggagaggggagaggagaggtgaggggaggagaggggacaggagagggttgggagaggagaggggagaggagaggtgaggggaggagaggggacaggagagggtgggagaggagagggttttgtcgtacgcatgggaattgttgttaatttgcacaaacaaacgaaacattcgttcattcaccctcattacggagtaaaaaggaaaaacataaaattgcatcttcatcaatatgtatgtgggaaaatatttttgatatatgaaattagataataatatcgaaataataaatacgctaaaactaatttttattataatgaaaaatgttggtgacgtcgaggaattttataaattgttttttgacaaagattttaaatgtaaaataatttttaatagaatttaatctgctggtggtgacgaggaattttttcgcctaagatttcaaatataaaatactttttaatttaattacacctgatggaggggtagagtaatttttttgaatttttggccaaatgttttgaataattctttgagatttacttttatatatggctaagttttattttaaaattattttactaagatcttaatgccagaataaatgttgaaattagctttataaaaagtatgaaattaaattttttagaaaaaatctcttccccatg

SEQ ID NO: 97865 - DNA, 1003 bp, Heterodera glycines
  Promoter: Source sequence=SeqID_2858; Location=1444..2446; Strand=+; Gene=SeqID_81990
gtaaaagaaaaattaaatgtcttagtgtatgcatacctataaaaatgaagtgttggcatccaacactataatgatgtcataaaatttttattttcatccacgaaaaatttacaatactatttcgttgtttctctttttctttctaatttctctcatcacttcggcatactatcttgtcatttttttttctaaaaagcactcactcgctagagaaaaaaattttgcaccgaatattctataaggaattaataactttctgtcctgttttttagtaaactaatttaaaattttcatattccttttttctccttttggtgcactattttcaaaactttaaccaatgaaaaaaacatgaattttgttggataggatcaaagatcacttacacctcatcactgttattgacttttcccctccccctttctctgtcttacattatttccattgtctccctctctgccatctcctccacatttctctgaccccgcgtctttataagggtgcccattccctcactcatggctctccgctctattcattcgcattggacacttattattttgttctcctccgccgctgcactcctccgacctcaccatttttgtgcatttatttttatttgattattaataaattgttggtacacaacaattttggcgcagtcagcagcagcagataaattctgcacatcattaagccaaatcaaggctaattctgcaaaatctagccaatttaaggcatatttgcacaatcttcaagccaaatcaaggcataattctgcaagcctaattttggcacttcaaaagcctgggtggctttcaacggacagcgacaaaaactgatcacctgggtggtgtaagttccgctgggtgcggtttctcatcgacaaaaactgatcacctgggtggtgtaagttccgctgggtgcggtttttcatcgacaaaaactgatcacctggggggtgtaaagttccgctgggtgcggtttatcaacaaacaaaatg

SEQ ID NO: 97866 - DNA, 257 bp, Heterodera glycines
  Promoter: Source sequence=SeqID_36582; Location=1..257; Strand=+; Gene=SeqID_65858
aattttcaaattttaagcattgaaacttcaaattttcaaattttttcaattttaatcattgaaaactctaaaaacactaaaattttcaaattttaagcattgaaacttcaaattttcaactttttcaatttttagcattgaaatctctgaaagaatttacattttttatttttttcaatttaatcattgaaaactctaaaagcattcaaattttcaaatttttttaaatttttaagcgttgaaaactcccaaaaatg

SEQ ID NO: 97867 - DNA, 316 bp, Heterodera glycines
  Promoter: Source sequence=SeqID_37867; Location=1..316; Strand=+; Gene=SeqID_66849
tcacggacaataattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatg

SEQ ID NO: 97868 - DNA, 514 bp, Heterodera glycines
  Promoter: Source sequence=SeqID_16031; Location=1045..1558; Strand=-; Gene=SeqID_80390
ttctcgttaacaatgctataaattaagaatggtataaaatgctctaacacctatactcagcatcagggatgtcattgaattccaatttccaaatcatcactgcttagcgcatgtacatatttttcgaatgctcataattagagcccggaaatttcaatttgaaggatcccgctatgagattggaactaaaaattttgcaggataggaacaccgggattaattctgcaatccctcatttcaaacttgcgggatcccgctaaaatttaacaataaaattcaaaaaagttattataatatttgtatccttttattttctgtcgcgcttttttttaaattttgaagaggaatgggacagacaatccgggaaaacttttttgaaaacattaccccggtttttttagcaattttgaataaatgaccataaattctctaatagaacttcatacataaaaattcataataatcagggaacggatttttaggttttcacctatttttttgcagatagcatatg

SEQ ID NO: 97869 - DNA, 252 bp, Heterodera glycines
  Promoter: Source sequence=SeqID_424; Location=1392..1643; Strand=-; Gene=SeqID_45659
atgcaagctgctccattccataaaatcgaccgagactcgggtaatgcagtatcctcagcattagcgttcttcgaaatcccggacactgatgtcagtctatcgcattcctctgtggtagagtgcctaacgctcaacccggtgaacatcacgccctatcacttcaaaatacacgcaagttccgactacatagatctcagcaagtgttatgtgtttaccgagttacgcattcgaaaagaacagggcggagaaatg

SEQ ID NO: 97870 - DNA, 125 bp, Heterodera glycines
  Promoter: Source sequence=SeqID_4872; Location=387..511; Strand=+; Gene=SeqID_45920
agtaaggaaacaatgtttttcagtttaaattatttctaatgcccttttcccttcccaccccatcaacatcaagctggataccaaagccgatgttccagaagatgaaaaacgaccagatcgacatg

SEQ ID NO: 97871 - DNA, 140 bp, Heterodera glycines
  Promoter: Source sequence=SeqID_34895; Location=1..140; Strand=+; Gene=SeqID_64585
cattcgagactggttcggctgcaaccgccgactttttcccttaagcccgaggattggacaacattttgggcctaggcccattgctggaggcaaaattgccggtgcgagtgctcacggaattgcggatcagagaaagcatg

SEQ ID NO: 97872 - DNA, 91 bp, Heterodera glycines
  Promoter: Source sequence=SeqID_28093; Location=807..897; Strand=-; Gene=SeqID_58749
ttttttgttcccccttctcccccccgcggcgtcatatcaatttttttctacaggtcttcattctatttctgatttttttttggcaaaaatg

SEQ ID NO: 97873 - DNA, 53 bp, Heterodera glycines
  Promoter: Source sequence=SeqID_8600; Location=1..53; Strand=+; Gene =SeqID_68651
ttcagtatttttcagtttctgctgatcagttcaaagcgattcgggaaagaatg

SEQ ID NO: 97874 - DNA, 580 bp, Heterodera glycines
  Promoter: Source sequence=SeqID_18954; Location=1885..2464; Strand=+; Gene=SeqID_83685
acaaaaggcggaaaatgtccgtgagcgaaaaaagggggaaagatgaaaaaaaaatccgttattcattcgcttaactttttaaaaaatctgttcaacgttcttgctctccgatttaaaaaatattatttgtcaatttcgtatttacgccgtaataaatacttgtcaccgggacattttttttgaaggttacggtaggggaaaatttggtgctaaaatttgtttcaccgggaaacgggagattggtccaccagggactttttgaaaacaacatctgtaaaatcaaggggcccaccaggaattaagaagtgattggcaaactctaatttgttccaccaaacaaaggctgattgattgattgattgattttattttgccttttttcaattaaatctttcaatttaaatatttaaaaatatatttatacttcagctttttttgcaattttttatttttactaaagaattcatttctgattaacctagtttgcttattatcagctaataaatgagatgttgttttgttggtcctctcgacgcatgcaataattgttgtaaataaatttccattcccaagaaaaatg

SEQ ID NO: 97875 - DNA, 135 bp, Heterodera glycines
  Promoter: Source sequence=SeqID_20695; Location=1355..1489; Strand=+; Gene=SeqID_51256
atttcatttttcaattatttgttgtaaatatttagaaattgacgcaaaaatttcccaacaaaaacattttccttcaccccaaggctccatgttgacggtgatttgaaaagagttagccaaattttaaaagggatg

SEQ ID NO: 97876 - DNA, 260 bp, Heterodera glycines
  Promoter: Source sequence=SeqID_34071; Location=562..821; Strand=-; Gene=SeqID_63954
acgtcgatgatagtctctccctcgtcaagaaaaggtacctgtgagaaatttagaaaaattataattcaaattgaaggtcaaattttagaaattgaccaaatagaaggaaaaattacttcggtaagcccgaataaattaaatcatcacgaagtaaaatttgggttcaacaatttgcttccttaaatagaagcacatgcttttcacaaattattctattaaatctaacagacataaaagattatgcttttgtgagcaacatg

SEQ ID NO: 97877 - DNA, 266 bp, Heterodera glycines
  misc_feature (89)..(89): n is a, c, g, or t
  Promoter: Source sequence=SeqID_38834; Location=1..266; Strand=+; Gene=SeqID_67551
cctttctccccatcttcaccaatttcgtgtattcatttcctattctttgcgcctttaaccacacaacttttgtgccaagaacaatcatntaattttgtcaaatattctgcgagaagccaattaaaatataattttgcattttttaaataattaacatgaaaaaatcaaggtccagattaggcacaaaaacctgctggacttcttggatattaatcaaaaatttaaattgatgaataacaaaaatttttaatttaaggcccaaaatg

SEQ ID NO: 97878 - DNA, 1003 bp, Heterodera glycines
  Promoter: Source sequence=SeqID_30164; Location=6..1008; Strand=+; Gene=SeqID_60599
ttacaaccacatattgccaatctaattcttgcagattgaaagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgactcacttcaaaaaataattcattacccaaaagttttttacaaccacttattgccaatctaatttcttgcagattgaaagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgtttgactcacttcaaaaaataattccatacccaaaagttttttacaaccacatattgccaatctaatttcttgcagattgaaagccatccattgcctgccggttctcggcacagcaaagcactaatagggtgttttgtgataattgacttcctttttaatttaaattaattaatttgtggcattatgtttcgttaattggttttcctcaattcattttggtttttttctgagttcttcggattgatattttttttgctgtgaatgacttttttgcttctcaatttctctctcctccgatctttgaatattttttggaaataaatctctctcatctggtgaagtcgtttggattgtcgtgttcgtcttttgtttaattttgtttggacagggttttaattgttggaatttgccgcggtgtaattgttggtcaacgagcgaaaatttgtgcctgtttcagtcgaaaattggagagtatttgactcagctgtcaaagagcaaaaacagaaatccaaaatg

SEQ ID NO: 97879 - DNA, 513 bp, Heterodera glycines
  Promoter: Source sequence=SeqID_23268; Location=2649..3161; Strand=-; Gene=SeqID_45771
atatattttttttaattctcatactaaggtttacacttattcaaactaaatcagaaaatttgtgagtttttcaaaaagcaggtaatcatttctcgaaaaatatcgcattttcaaaaggaatcctcatttactcctccaaaaaccacaaactgaggataaaatcctcatcagattaattcccataaattgatatgtagttccaaaggaaagaaaattcaaaaaattttggtacttttcggttgggcctagatttgatttttttttgtttaaacaacaaagatcagcttaaattgtgacatttatgcccacaatgtaattttggctgacatttatgctcacaatataattttggcacataagtttgcaactttgcgtgtccttttttatttgaaaaaaattcaaatctaggccccaaaaccgaaaagtaccaaaatttgcattaaaaaccaattctttccacctttaaaattttacaattaagcagtgcctttatttattgaatccgacaaaatg

SEQ ID NO: 97880 - DNA, 1003 bp, Heterodera glycines
  Promoter: Source sequence=SeqID_1186; Location=2915..3917; Strand=-; Gene=SeqID_69481
aaatttgtccttatttagaaaataactttaaactattcatttacatttgaaatatttaagtttttacgtgttttaatacctaaaaagcgttaataaaaaaattttttgcctatttttgtgcctaattgaggatttttatgcctatttaatgcctattttgcgatttttttatgcctttttaggtgcctatttcgcgattttttgtgcctaaaaaagaaagccctattaatgatacagaattttgtttttaaaaaacgcattttatgtaagccgaaattttcgactcattgacattctgtcagttgttagctgacaaatgagttaatttatatattttgtacggtcgagattttgtttatccatcgttttccattttatccccattcatccttaattaaatgcctccaaaaaatttaatggctttttcttatacaatacataattaatccatcaattctttattttactatattaaattatttttttttattattttcagtcaatttccattccattcatttgccaacacttttcccaaacgattggtcgtcggatggtacaaaaaaatgaattttttttgtatggaatattaatccgaaaattgtctaatttgtccattcccatccatcggaaatggcattccatcggccgttttggcgatgattcggcttcccattttcgctttttctcattttgccaacgcttttcccagcgattggacaaaaaattgtgcttggggagtgtaaatttgtggtgatttggccattttcccattttccacctccccccccctcttttttgtctgtccataaataggcaacgaaaagccatcaaaaatcacacatttttcattttcattgatcagaccaatcagctaacattcctttcttgcttcatccattcccatcactttgccttctttccaatcgaaaacggtaaatggtgaattgaattttatatggcaattaatgggaaaaagagagttttaaaaactccaaaaatg

SEQ ID NO: 97881 - DNA, 1003 bp, Heterodera glycines
  Promoter: Source sequence=SeqID_8335; Location=1235..2237; Strand=-; Gene=SeqID_67725
gttttgttttaattacttgcgtggatcatctttgtagttattaaaaacctaatttgctcaaaacgttaaaaagcaattatttaaacattagtatatgataatttaaatgcaattgtttaattaatttaggtatatatttttttggatatcactcgtacgaaaacgacccccgtacgaaaacgggctggctttatgtcttgtatcggtctcatagaaaaaagtctcgggtttttgagtcttgtctcggtctcgagtctcgggaaattttcgccccaattgtcggaagcaataatagaaaaaaccatcttctaaaaaacatgaaaaatttacagtcaaaaagtatggaagcaattcaatcgaacaaaaactagataactttaaatagagaaaaattgttgaaaaaattcctactaagtctaacgattctgatcaaaaaagtcttttgcaccaacttgatccgactactccttcatggtgacctgaacaccccaaaacactgaaaatcggggtcctaggaggtttggaaattttttctctaaaaaatgagtaagcctatcagaaagagcgcaaaattcgctaattctctaccgaattgcattttgaatggttattcgacgacgaatacccgctgatgatgagacagagaaagggggcaaaatttggcatggcaaaaatgactgctttctacagtatttcaaggggaaataatcaaaattgagtattgctatggtactcaattttttcattcaatcactcatctgctggagaagcggttttgcataaaaaagcgttgcttccatacttttgcaccttactgtatgattgcgcaacaaaagcgcatgaataaaagaaatggaaaatattttgaaagagcgccattataataatgccaataacccatattcctcgagggaattgaaccaagacaaaagctgagtgttaaactgtatacaaattcttaatttattattttagtgaagcaaattgtttttttcaacaaatg

SEQ ID NO: 97882 - DNA, 215 bp, Heterodera glycines
  Promoter: Source sequence=SeqID_5851; Location=1..215; Strand=+; Gene= SeqID_59439
ttcagatcatttgtcaatccaaaaaccggtgctgaatgggtcgacaattttttaaataagccgataatttgctcaaaaaaatccccgatcgcctattttttaagggcgtcttctcttcgaacgtcgatgtcgaaaatttatttccgaccactaaataattaaaatagccactaatttagctttcaattcaaaaatttatttcttcactctctatg

SEQ ID NO: 97883 - DNA, 597 bp, Heterodera glycines
  Promoter: Source sequence=SeqID_23102; Location=318..914; Strand=-; Gene=SeqID_53810
tttgtccccccccccccccgaggggtcggactcaaccctaattttttactattaaaaagttgtagaaaaattttcacaattttgcgtttctatttactttcatttcgcattttatttttcgatttggcccatccctggtacaaaagtacacatacacgcccaaaattatatttattgagcaaaccacaggcacattagtgctcttatgtggcgcataaaaaaaaaatcaaaataaataatgtcaaaaaatacaacaatatgaaatgtaaagtaaaataaaataaaatggaatgaatgtcaatgcaaatgtcaataaatcccttagaactcatacatagcttttagcaatgccctgaattgatttgccttatctgcctgaattggaacaattggtaatttgttccaattcttgtgaatcggttcacaccatatttagctattttcgagatttttagcttaaatttgacgaacttttgagaaatgttacccttaatttggaaaaaattatgaacatattttgcacaattttatgcgcttattttgcaaattttgacggatataattggttgcccttagtgatcagcagcagcaattatg

SEQ ID NO: 97884 - DNA, 855 bp, Heterodera glycines
  Promoter: Source sequence=SeqID_25047; Location=1..855; Strand=+; Gene=SeqID_55780
aaaaaaagggggaaaaaaatggccaataaataagtttgtttttaaaataaattatttcaagaaaatttttttttatttccaggaaaaattttaaagatttttgttggatttttcaggcttggggctcggttaaaaattaggattcggccgggcttctgtacccggcaatccctgacccgtatttgcccaaatccccaggcccgttcccctaattaatatccgattttgagtttttttaaattaacaaataaggctacagaaaaaaattgaaaaactctcgcctctcgtcctctcgcctctcgccaactctcgtgttttgggggactctcgcctctcgccaaactctcgctctcgtctttttggggactctcgcctctcgccaaactctcgctctcgtcttttctgagacaagtcacacccctgatatgcacatatttttatacatattctggactttttcgcattttttttttctacatatttcgcaatttttgaggattttttaacgaaaattcccccccccccccccccccccgccgcctcgaagtttttttttttgagtcagcgattttttgggagattaaaaaaagttggtataaaaaacttattgtttgttataagaaaattcaaaaagaagatattaaataaattcttgcgattttttagacaaattttcaaaaaacaaaagtttcgagattcatcaaaaatttttaaaaaatcgcgggaaaaatcaatataaacattttctagaaagtcttataaaaagcaaaaaatccaactccatcccccctcctggtgaaggtgttcatccacccgttcatggacgggaatgggcgcacctcgcgtctgctgatg

SEQ ID NO: 97885 - DNA, 65 bp, Heterodera glycines
  Promoter: Source sequence=SeqID_33753; Location=967..1031; Strand=-; Gene=SeqID_63722
tttttcgtttgttaaattttttactgttgattttgtttttcagaaaaaattagtgccaaacaatg

SEQ ID NO: 97886 - DNA, 159 bp, Heterodera glycines
  Promoter: Source sequence=SeqID_29340; Location=1056..1214; Strand=-; Gene=SeqID_59852
ttttccggcccgtccattcaattcacccctcaagaatttgttccggaatggtcgtcactctttttccgcctcgcccggaaatttgctcccgaatttgtcgccaggccttggaggacactcttcgttttctgaccaaaaatgttaatatttttcaaaatg

SEQ ID NO: 97887 - DNA, 101 bp, Heterodera glycines
  Promoter: Source sequence=SeqID_12994; Location=2020..2120; Strand=-; Gene=SeqID_76765
attttccacatgaaattattgtccagcctaaaaatgccatcaagaacgggagaagaaagaagcgtggcggtgacaattccggccaatgcgtcactgccatg

SEQ ID NO: 97888 - DNA, 337 bp, Heterodera glycines
  Promoter: Source sequence=SeqID_17203; Location=37..373; Strand=+; Gene=SeqID_81666
aaaacaaattatgcaaaaaatgatattaattctaaagagattgaaaaagggaggcaggcaattgggatgaatcagcggacagttggccatcttcatgaccaaattcgtcgtcctccattttctgcaaaattccgcggcggtgtactccttctccatgacaacgcacgcccacatgttgcgttctcaacgcaacagaaaattgagcaacttcgatgggcggttcttcctcatccaccatacagcccagacatcagcccgtgtgactactatctgtttcgatctatggagcacttcttgagagggaaagaatttgctgatcaaaacgaggtcgaaaatg

SEQ ID NO: 97889 - DNA, 67 bp, Heterodera glycines
  Promoter: Source sequence=SeqID_6900; Location=1..67; Strand=+; Gene =SeqID_63236
aaaaaaggcaacggatatttgagattgaagggagagcaatgacatgagggcagtgatttttaaaatg

SEQ ID NO: 97890 - DNA, 836 bp, Heterodera glycines
  misc_feature (658)..(658): n is a, c, g, or t
  Promoter: Source sequence=SeqID_12552; Location=1011..1846; Strand=+; Gene=SeqID_76204
tttgcgcctatgcttaaaatcggtttcaatctcagatttaattgcatcttgatgcattataaattatatcaatttacgaaaccgtttctatcataggcgtgaatatctgcacacggttcagttttagtcctgtgaaaattgcattaccatgtggaagttcggcaagttctccgagggcatttcggggaagggcactctcggctgtgccgaaacatacgctgcgcacaccgccgtaatggttcgtagcaaaaattccggaatatggcccattaaaaaattagggataaaatcgaattattggaggaacgagttcgtcccctctcctcccatcattccccctcaaaaaaaagttttttcattttatttcagtttgcatttttttaactttcaccattttctccgtcccattttaggagatgccgcgcacggaaatgtggttcatcaaaatggccgtggatccgtcccgcagagtgagtttaggagaacgttgaatttatgcaaaaacacgagttcgctagctgacttgtcgggcccgcagttgcattattatttattgttccccccaccccatcttttaaatatttctctcatatgccattgtaattgtttgaccagaattggcgtccatttcgaccaatccctcacaaattaatatttncttccgtcagtttctcgtctgcggcagcgaggagggcgaattgcgcatttggcgattggacacagagaaactaccgaaccgaaagaggtgaaacggacggagaggaagaaacacttggggcgtcttttgactttagtgatttttgtttggtcgcgccgaccaaagaattgaggaaatg

SEQ ID NO: 97891 - DNA, 619 bp, Heterodera glycines
  Promoter: Source sequence=SeqID_26360; Location=1182..1800; Strand=-; Gene=SeqID_57098
aggcataaatgcgtcaatttgatctaagatctcttcgaaggggtctgcgccaaggttttggatatttatgcaatgggagcggagattaatataaaattcttcgcgcccgctgctgatttaaaaaaaaaaaatcaaactttggccccaaaacggaaaagtacctaattatcatcaaactataatttattttaatcacaaaatccaaaaacaaactttttgatagtttctgttcggctgctcctcagatcacatgtgttccttttatgatcagagcggcggatgagtagcaaagcgattgatgaatcaattatcgaaaattaattgcaagatccatcttcattaccatcatccatcccctgtataactcgagaacatcgtttcaaatgtgatccgattacttttttgggatccgcccacattaaaatgaaaaagatttggtgcggctgatactgacattaattaataaggtcataaattggcgaacagttgggtgaatgttattcctaattaggcgttcattttaagaagtaattatgtcccattaattaattgtattctttctttggacagacggcagaaatcaatttgaaaatacaattatattattatgctaataatg

SEQ ID NO: 97892 - DNA, 1003 bp, Heterodera glycines
  Promoter: Source sequence=SeqID_14860; Location=1326..2328; Strand=-; Gene=SeqID_79011
tttgtctgctctgcattccgtaaattcatcgtccgcaaattgtgaacagcccaatttttgatataatattcaatctggcgaaaatttgaatttccttaaaaaacatgaaacaaaagcttatgttataattctattcaaaaatttttaatttttgcactcaaaatttttttaaaaaggtttctttcataaaacttttcacttttcaaggattttttttattgtcttggcttacattggaaaatttctaaaaaaaaaaatctcggtaaagtttttaaaaattctcgggacgaaacgacacgaggggagggggggggggggggggaaaccccgaaataagcacaaaagcaatcgatgattttacatacatatcaaaaaacagcaacaactgcgtatcgagctgttgctgcttcgacaaattatccgacaacgaaacggatcagaattgaggacgactacgaatctgaccaatcccaggaggagtagccgtcacaatgctggcctctcattgtgaaaagtggccatatggccataaggggcggagcgcgtgccgctacctgcgatttgtcacttaatatttcaaacaaaatttttcagcgcgattgtttaaatcggagcattttctgaaattgacccaccctttcttaacaaaatcctttcaaaattctaattttccccgagggcgcatgtttttactgtcggactccttgcccaaatcgcaaaaatatacggcactgaaatttttaatattgaaaaaaattgtgcaggcgatataattttaaataatggttttataatttccggagcaggacaaaacgttgttgatcgaaacgttgatcgaaaacatcaacaaagcttaatttgaataaaaaaaagtaatggtcggaaaaccatccggcgacgtttcagccgggtatataacggcctatcccatacccatgccaagttcagaaaaaaaatcacttcatccctaacagtttcttcgtcgtcggtctctcgtcctatg

SEQ ID NO: 97893 - DNA, 707 bp, Heterodera glycines
  Promoter: Source sequence=SeqID_10170; Location=935..1641; Strand=+; Gene=SeqID_73276
tttttttgtttttaataaacctaaaacagtgacaataaagacaataggtaaatgatagaattttataagtggtcagcaaattatattcattcttttggtgcctttcggttctgccccccccccccccccctccgaaacttatcggtgatttgattttctctgattggtctgatctgatatggttaaggcaaggtgtaaaaaaatcaatcgtccgaattaattttatttttaatgaaattttaattttcatttattttacgaaacgaaaaaaatattagtcgaaacaataaaatatttaaatcctttctttccctgcctctaaaaataagtcaacaacaatccctcttctgtgaaatgaatgctttagctatttttagtctctttgtccaaagcacaaaaagccgcggcccgggcgaaatattcagtgaaacatccatcagctgatgatgatagccaaaaattgagaagaaagccatcattttattcactgtgcttttattttattttatatttttagttttttttattttacatttatttttatggtggacaaaagccatgcgccattcattgtcattttgctgactctcgtcgtcgcactgcttatttttattgcgatttcacgtaaataaattaacttttgaattaatattttaaaattcttctttaagtaaatattatattttattagtttatttggctatatg

SEQ ID NO: 97894 - DNA, 529 bp, Heterodera glycines
  Promoter: Source sequence=SeqID_43880; Location=647..1175; Strand=-; Gene=SeqID_71455
tttggggttctccaatttataatgaaggcctctcatcaaaacgaaaagcaattcatttttttgcaaataatttgccttggataaattcaattcggccaccgcccactcgtcgacaaatgtccccactttccccccccccctcaattgctccctcctccctcttctttttcccttttccactaatatttctttggctgtgttagcttctttcttcactttccatgcgtgctcaataaaaaccgaaaaattgtaatacccaaaacacaaaatatttaaaattcgaatcataaagaaatagtcgaaataagcagcaggtggcaaaagattgagcatctcaacgactttttcatatccaatgtttaataatgtctctgtatttcggggaaaccaatcaaaaaactgcaaattattgttaatttttgtctgtgtccatgcagtcgatcgactatcagatcgaattctttgttcgcgccattgccatttggcctcgttttcttttccctcaatttagccgttcaattccaaaatg

SEQ ID NO: 97895 - DNA, 105 bp, Heterodera glycines
  Promoter: Source sequence=SeqID_24605; Location=207..311; Strand=+; Gene=SeqID_55343
tttgacaaaatgtccagaaataaaaccaattgtccgtacaattcatcatgaattttgtccgaatccctccgcccttaacggcgtttccgtttcagtccccaaatg

SEQ ID NO: 97896 - DNA, 423 bp, Heterodera glycines
  Promoter: Source sequence=SeqID_1608; Location=157..579; Strand=+; Gene=SeqID_74787
ttcattcgcattggacatttttattattttattctcctccgtcgctgcactcctccgacctcatcaatttgtgcatttatttttattggtgtttattaataaattgttgatacacaacaattttggcgcagtcagcagcagcagataaattctgcacatcatcaagccaaatcaaggctaattctgcaaaatcttcaagccaaatcaaggcatattctgcacaacctccaagccaaatcaaggcataattcagcaagcctaattttggcatttcaaaagcctgagcggcttccatcggacatcaataaaaactgatcacctgggtggtgtaagttccgctgggtgcggtttctcatcgacaaaaactgatcacctgggtggtgtaaagttccgctgggtgcggtttaatcaacaatcaaaatg

SEQ ID NO: 97897 - DNA, 230 bp, Heterodera glycines
  Promoter: Source sequence=SeqID_5741; Location=2706..2935; Strand=-; Gene=SeqID_59087
ctaaaaagctcaaaaaaggccaacatatgtgccaaaaattgaaaaaaaactgtcaaaaaataagtgaatttatcactaactggtactaaccaatactaagtccctcacttaatgctaactcgcttgcatcaatcactagtgtgtacttattgagactacacaccttggtttatagataactttaaactcaattcactactccttcaaacccatcccaaccccttcaaatg

SEQ ID NO: 97898 - DNA, 1003 bp, Heterodera glycines
  Promoter: Source sequence=SeqID_11323; Location=2465..3467; Strand=-; Gene=SeqID_74705
taaaattttccggggattttcccttgtaaaaatggaagagccgatctcgagttaaaaacttaagttccataaaataaacttggaatcgctagaggaggtcaaaatataggcctatacaaaatttcaagaaaatctgacccgaggaaaatttttttgaccctagtaaaaatttcaataattttaatacttttttagccaagtccacaatttaaggccaacccaaataaaatttacaatattctctagaattttcccttcaaaatgagcataaaatggttttatttgctctagtattcaccaagttataagctaagaaaatttcataaaattgtcgatgttgtacgtaaccaacgctttttgaatatgattttttttgacacgaaaacttttattaataaaaaatatttctgccttcttctgtaaaagaagaaattgaaattaacacacaacataaggaggactcgaacctgagaccccccttttggtgactaacgcacagaccactaagacgaaaaaaccaacttaattgtacttggagcgcaaaattgaatcgccgtgtatatgaatagagagagccctgatttttttagatttttcctattttttacggattgtacttgatgaaagaaacacgaaaatcacattttattaaaacaatttttgaagttttttgccttcaatggggttggacaatgtgccaatgggaaacgaaaaatcattgacaaaaacggaaggggcggaaacattttggcataaaatgaccgattggaagaggaagaaaaagggaacgcaacagaggaggaccaccaaagaggagaatattttgcaaaatgatgaccatttgccgggcgttttaccttatcctcaaccaacaaatcaatcaaataaatcaatttgacggataatttttcatttgtaaaggttaaatccgcccttttcaaattttgaaaattggcaaacgttatgattagggatggtaattattagggatgccacaaatatg

SEQ ID NO: 97899 - DNA, 249 bp, Heterodera glycines
  misc_feature (38)..(38): n is a, c, g, or t
  misc_feature (104)..(104): n is a, c, g, or t
  Promoter: Source sequence=SeqID_27335; Location=1..249; Strand=+; Gene=SeqID_58025
atgctttgagcgggttatctgaccatcgcttcatcttntcattccgtggcactttccgcaatcggactctctctccccatattcgccttgtctcttgggccccncaattggaagtgctttcccatccgaagaccaaagtctttttgacccattccggactgaagaggttccaattttggctcttttgcctacgcattgtttttcagtatcaaagaatcgctgtgttctggcactccgatgctaacaatg

SEQ ID NO: 97900 - DNA, 1003 bp, Heterodera glycines
  Promoter: Source sequence=SeqID_1056; Location=4024..5026; Strand=-; Gene=SeqID_66966
ttgttttattgcaaatcaaaaattaaaagaagaaataagtataaatattcaaaaatgaaataaacaaattaaaacaaaaattaaataaattaaacattttaaaaggaattcataaggtataaacattttaaatattcggtctttgtttatgaaataattcaaactcatattgattgggaatgaaatctgaacgcattcaacatgggaagcagacaaaagtctgattttttgggtctggacaattaatttcaaaaaattaatttaaataagagaagaataaatcgcagaaacataataaattaacaagatacggagataaaaaatttaaagaaaaaggaatctgtcaaaatttttttataatagaagtgaaaaaataaactatcagaaaaaatgattataacttctacccttaaaatatattttataaatatgtagctcattattaggttattaaaatagcaaaatttaaaaatttaaattaaataaacaattattcattttataaaattaaaaataaaatggcaaaaaaagcaaaaataatataattaaatgtttatgcataccaagaagaatattagccgagtctacaagataaaaaatttaaaaatatagaaaaaattcaaagcgaaataaaagtttatttgtgatttattttaattgctagaaccattatcatactaataatttctaaaaaaaattgcaaaataaattttgaaatatttattttaaaaaatgcgcgtccacgctaaaaacacctgaaagtacaaaagaaaagtgatgcccaagaatagattcaatgaaaaattctataaaattaataagaaatacattaattaccggcatttaccggaataataaaattacgggtgttttttaacctgaatcattctttaactgaacagatcaagatcgaagccaaaacctggctttagcggggggctgaagttaaaaattttgatttttaggtgtgtatttttcttttttcagtcaatttttaggcatg

SEQ ID NO: 97901 - DNA, 145 bp, Heterodera glycines
  Promoter: Source sequence=SeqID_2242; Location=6036..6180; Strand=-; Gene=SeqID_78667
ttgtagcagaacaaatgagacatagctgacaaattgccggggcttttatactcccagaaaattaggccacgcccacttttgaaagctatttaagccgagattttctcacacaatcaaatcattcttgcaaaatcatcatcaaatg

SEQ ID NO: 97902 - DNA, 91 bp, Heterodera glycines
  Promoter: Source sequence=SeqID_24311; Location=1..91; Strand=+; Gene= SeqID_55033
aaaacaaaggcatttgtgtcccattgcgggatgaccctttttggagagcgttttccacggagtgccaatcgtttgcgtgccgttcatcatg

SEQ ID NO: 97903 - DNA, 1003 bp, Heterodera glycines
  Promoter: Source sequence=SeqID_8124; Location=163..1165; Strand=-; Gene=SeqID_67048
aaatgaatttgcaaattatctgaagtaaaaaatgccgaatttatctaccgtatatgctctaattatagaccagtctctattatcccgcagtctccaattatcccccagtctacgaggtgttttgaaaaataatccctctatcataatcccccagtctctattcttttaaatttaatctaaaattggaaattcaaaaaacaattttcatgtaattagtagttttttactttgtcccatggtcacaccctcctcgctgacccttctattctatcacttttccaacttgaaggtaaaaactgaaattttcagaagacctaaagttatagaaataattcgcggttgggttttataccatttttattcgttttaattacctcattttttcatctcaattagtgaaaacaacagcaatcgctcggttcaattttgaatagagttgtacaggaacgggactttttgggttgaaaaaccgggactttttggctgggaaaaccggaaattttcccggtcccgttctaaactggtcaaaaccgggacttaggtaatcagttgtccgtgtttttcagtaccaggtcccggtcccgtacaacactgtacttctgaataattttcaatagtcggatttgatgaagattttattcgttttaattgtctcatttttcatctaattagctcaatttacttaatttggtttgttagaacacaaaaatgaattagacagaatttgtgttccaattataaccaaaggcacaaaaacgaatttggaaatacagcgaaaggcacaaaatataaaatttaatttaattttttcttcctccccgcctttatttttgtgtctcttctgtgttttgtgcttttccaattgcgcaccctataaaaggacaggtcaaagtgacaaattcaaactcaaattcaaatcatcatcagcaacaaaaacagcaacaaattcatttaaattcccacaaataattaattaattaattattttattttctacaaaatg

SEQ ID NO: 97904 - DNA, 233 bp, Heterodera glycines
  misc_feature (17)..(17): n is a, c, g, or t
  Promoter: Source sequence=SeqID_20542; Location=1..233; Strand=+; Gene=SeqID_51080
tcaaaaagaaaaatatncgatgaagggaagcaaagcgccaagactttttgaattactatttcctctgatgtccattatcccatcccccgattcttcaagtgtatccgagtatataaagccgaccaaatccctttccagtcatatccttcatccctttcattccatttgtttgataaattttgttttttcagttcatttctgttaaattttctgtgcttaccaattcaaaaatg

SEQ ID NO: 97905 - DNA, 134 bp, Heterodera glycines
  Promoter: Source sequence=SeqID_13924; Location=1040..1173; Strand=+; Gene=SeqID_77877
ggtaaatatggcccatggcatttacccatctttgaaatgcttgaggccattcaaagcagtgccattttgtcaaattcccggccccgcacagtttcggcgcgtgccctcgctatttgctgtcttccaccgtcatg

SEQ ID NO: 97906 - DNA, 372 bp, Heterodera glycines
  misc_feature (4)..(4): n is a, c, g, or t
  misc_feature (69)..(71): n is a, c, g, or t
  misc_feature (183)..(184): n is a, c, g, or t
  misc_feature (190)..(190): n is a, c, g, or t
  misc_feature (282)..(282): n is a, c, g, or t
  Promoter: Source sequence=SeqID_23454; Location=1..372; Strand=+; Gene=SeqID_54160
ttcnattccaatcaattcccttattattccccgaaaattccccgtaatgtcgaacgaagtggacacacnnnagaggaagtgagtgcccttgaggcaatgattttggagacaagcgtggacccaatggccacgctgggggccaaaatgctgaatgggaaggagcgtcattcgtgacgaatatcnntgaganaagtggtgaggaagtgaaaaagtgccgggacaaatgatctcatggagacggaagaaggagagaaaaatgagggaatgccattcgtggcaganatcctgaatgtggttaatgaaatgagtggcacggaaatgccatagaaagctcaaaaggagggttttgggtttattttagatgatgaaatg

SEQ ID NO: 97907 - DNA, 151 bp, Heterodera glycines
  Promoter: Source sequence=SeqID_588; Location=881..1031; Strand=-; Gene=SeqID_56956
ttttcattaaaagctgtcataaattaatgtttttttaaaactttctcttaatgaaatattattattttgattttttaataataatttttgattgaatttttatttaaaaatttaaaagaaaaattattaagcaattattaataaaaaaatg

SEQ ID NO: 97908 - DNA, 184 bp, Heterodera glycines
  Promoter: Source sequence=SeqID_11879; Location=1..184; Strand=+; Gene=SeqID_75390
ggccaaaaatgaatcgtccttcgtccgcctatatatagggaacgattcgaagaaaatgctcacattttgcgtctgttagtatttttatcattattttctatttgccaattgcatcaaagcatcgttctgctgctccttcatcgaccacatcaaacggaagaagtcatcacacggagtcatcatg

SEQ ID NO: 97909 - DNA, 790 bp, Heterodera glycines
  Promoter: Source sequence=SeqID_2896; Location=1..790; Strand=+; Gene= SeqID_82232
aaaaaagttataaggaaaaaacctccaaagtttttggtttttttgtaatttcatattataacttttttgaaaattgtctaagcgcgaagcaatagcttagaaatagcttctaaacatattaagctttcgaatgataccaagattgttagatttggttgacaatcaaaaaagttatagtcaaaaaactagtgctggcgccgaaacgccgcctactccgaattgatatgccaaaagatgaagtataatggatgaaaatgccaaaagatgatgtaggaaaaataccaaaaacggaaggaagaaagggcacaataaaaatttacaaaaaaaaataacaaaaatttctcaaaaattaaaattaaattttcgaaaaatttaagatttttattttttagactaattgtgaaaaatcattgtaattcataaagaaagaaaatttatgtataagaaaactgatatttggtatctcagttcatttgagattcgtgtaaaaattatttttaaataattatttttgaacatgaaaaaagtttttgacattttcgaatttatttaaatttttcgaaattgggaacgacaaattatttaaaataaaggattaataaaatttaaattggaggagatgaagcgcgcacacacacacaaagcatcaaaatggagctaattcatctgcggcgggcagaacaatggaagtgcgcgaaatttaggcaagaaacaaacaaaagttcaaattgatcgattcaatttttgtgctttcgtaaatcggcaaagcgatcggacagccggcgaaatg

SEQ ID NO: 97910 - DNA, 683 bp, Heterodera glycines
  Promoter: Source sequence=SeqID_2039; Location=152..834; Strand=+; Gene=SeqID_77452
taatcaaaaatgtccacggccaagaccggcataatcaaaaatgtccacggccaagaccggcataatcaaaaatgtccacggccaagaccggcataatcaaaaatgtccacggccaagaccacataagcagaaaatgccatgacgatgactcgcagcattatggatgagttgggtctatggatgagttgggtttggatgagttgggggtgactcccaaaaatctgatcaaaatgttattctataattgttaaaaatgggattttttaattttcgcctaatttttcaggacttttttgcattttttcgtgcttttttggatttttttttgtgacttttttgcctttttatgactttttttgtgactttttggcgattttttatgactttaagtcgactttttgaaggttttaatgacttaaattcccagccctagtgatgatgatatcgaataagatgtttcaatttctataaatgcacaattattattaagtaaataatataggaaatttgtttaattctcttcgatatgttgcttcggtcgcttcccttcggccgctcctttcccccgtgtcttctgcgacggagtgcctcttcattcacgtgggctttcaatccatcgatgtttacaaacattgactacttgtgagtttcgctttagaggcctcacttcggaacagttcatg

SEQ ID NO: 97911 - DNA, 636 bp, Heterodera glycines
  Promoter: Source sequence=SeqID_32381; Location=188..823; Strand=+; Gene=SeqID_62693
tttcaaaattttggtttaattacccaagtttgaggtcatttcccggaataaattttttattaattctgtgtctcgtccctgcctaccccgaccccagtgcccgacctttggccccgaacgcaatcgggacaaattggcgctcctgcagctggatctgtgaaccacggactgactcaacgaatcccgttgacacaggggaagggaaaagcaaattagagagcctagacaaggaccctctgaggcttgtctagtgttcatagtttcgtgtagttattgtcctccgaggcataacttcacgagggacgtagcggacttagtgtttgccctccgaggaaacatttcgtccgagcagagggttgtaaggtgttgtgtagtggacgtagtacttgccctccgaggaagtacttcgtacaaaaagggtgttaagcgcgcactaggccacttacaaataaggaaaaaaggcaaactaacagtcctccgaggctttagtttatccataaggcaaaaggcaaacaccttgtcctccgaggcaggtgtttagtcacagaggtcccatcaaaagccccagggccaagaccagactgatcccggcaaaagacacaaaacaacacacgcacaaccaaactgcacgcaatg

SEQ ID NO: 97912 - DNA, 163 bp, Heterodera glycines
  Promoter: Source sequence=SeqID_1286; Location=2728..2890; Strand=-; Gene=SeqID_71576
ggggggggggagttgccagcaaaaataatttccaggggtagaaattgttaccttcgcaagttactgcgatcattcatttttacaataaaaataaactcaattctgctgctcacagatcacacgaccgactgatatcaaatcgttgcgcgttgctgaaattatg

SEQ ID NO: 97913 - DNA, 76 bp, Heterodera glycines
  Promoter: Source sequence=SeqID_11277; Location=2205..2280; Strand=-; Gene=SeqID_74646
atttgggggactgctgcttactttgggtgtcggtactcaaaatgaatgcacgcatcgccaacagtgggctgaaatg

SEQ ID NO: 97914 - DNA, 98 bp, Heterodera glycines
  Promoter: Source sequence=SeqID_30342; Location=761..858; Strand=+; Gene=SeqID_60766
agtaatttatttatagtttaatttcattttttaattgttggtttcaaaatgccaattttaaggcgttaaatgaggctcgaactgttgtcgaaaaaatg

SEQ ID NO: 97915 - DNA, 81 bp, Heterodera glycines
  Promoter: Source sequence=SeqID_13409; Location=3222..3302; Strand=-; Gene=SeqID_77299
aaaaagaaaagacgcgaaattaatttgtgggggcgggggacaaacgacgattttggaatttggaagaatgacgacgaaatg

SEQ ID NO: 97916 - DNA, 409 bp, Heterodera glycines
  Promoter: Source sequence=SeqID_85; Location=650..1058; Strand=+; Gene=SeqID_63767
tttgtcgcaccaaaaatggttgctggatctaccccttcggggggattgtggttcgcaccaaaaatggtcgctggacctaccccttcgggggattgtggttcgcaccaaataatggttgctggacctacccctttgggggattgtggttcgcaccaaaaatagtggctggtcctgcccttttgggttatggaccggacatttttgcatctgcattcttaatgggatgtgtgagccctgactgatggatttcagcacaggacgactacactccacagcgaagaatgatgtctttgacctttatttgtgcattttttgttaataaatttttaacatatgtgtgcatttattggttaattacctcatatttttgccgcatttgtaatacttttctgatttgttgttttagatg

SEQ ID NO: 97917 - DNA, 103 bp, Heterodera glycines
  misc_feature (59)..(59): n is a, c, g, or t
  Promoter: Source sequence=SeqID_14523; Location=2904..3006; Strand=-; Gene=SeqID_78575
acgaagagaatgttcagatcccgaaattcttcagggctggcacaaaggacatcagaaantactgcagaatgatgatgaagttccaaaatctttggcaaaaatg

SEQ ID NO: 97918 - DNA, 110 bp, Heterodera glycines
  Promoter: Source sequence=SeqID_835; Location=267..376; Strand=+; Gene=SeqID_62542
ttctcgggtaaaagcccgaatttggggcaaatatttaaaaaatagaaaataattaaattgtgtgtgtttacttcccatagggggcacagttcaagcggaccaactcaatg

SEQ ID NO: 97919 - DNA, 1003 bp, Heterodera glycines
  Promoter: Source sequence=SeqID_16724; Location=716..1718; Strand=+; Gene=SeqID_81126
tgatgtaataattggaagccaaactcttagaaaatggaaaatgaattttaatatttgatttactctaaccgaattgttttcattccaatttttcattctgtgctgtttattttattctttaaaatcttatatttaaaatcttttaattaaaattctgaatttctaaacatttgattcttgagtgcactaattcttgtaaatgaataattaaatttattaaactaaagtttttcatttaaatctttgaaactgggacaaatgcaatgcgttttctgtgaaaaatattttttcaaaaattgcgaataaccaaatttggtaaatttttgaagtttttgagtaaagctatggaaaccagcgccaaaaattctcttttaatacttaaatatctcatatgcttataacctcaaaaaatggttcttgatctcatttcttgggattttttttttttttttttgctataactcaggaaggaaaggattaaaacaaaatctctatttttgaatacaatggaatcaattttaacattgagaaaattggaacagattacgcgcaatgcgcacgcctttgtggtccaagggacggacaatggtgccatttacgagtgcgcgagtcaaaccaacgcgaacatgtcgccgctgatcagtcgggtgacactgcgcgttgactgtaagcgtaattaatttttcctatttgtataatcatttttcaatcccatttaatttggccattttatatgctttaaaaatattaccattttttaatcaaaaattgtcaaaaaatttagaaaatgccaattaaagtcccaaaaatggcacccataaaattgggacattttggatataaaccataatattttaatgatctgggccctggtctttctttcattttttaccgtgattttccccgcattaatccccggctttgcgcctctgttacctaattgtccaattcccctcaaatagaccctccggcaagtgtgttcattttcggcaataccgtaatg

SEQ ID NO: 97920 - DNA, 614 bp, Heterodera glycines
  Promoter: Source sequence=SeqID_43014; Location=362..975; Strand=-; Gene=SeqID_70789
ttcaaaattgtatctagcgcagaaaaaagataaaagtcttcaaagtttgaacctaggtttttgttacgccaaatttgggccatttcagggaaaagtcgtaaaactttttttctatactttacaatttattttattatttaattacatgtaaaatattaaaaaattcgtaaatcaatacatgcgttaatattgtatgacgttttgtcatattttcgtcgtccctctgctgtcattataaacatgggagaagggagaaggcaggcaatggcattgtggggggggggagaaggccggcaattgctaaaagccaacaatgaaaataggcataatgtggggtgaagacaaaaaaaaattatagtttttattgtattctatgaaatttatatggcagagaaaaaaagtaatagcattttgcatataatggaaacagaaataaatgaaaggggtatagaaaaaaatgaaataacacaaaaggaagacgcacacagccgaaagaattaggcaaaatgccacgtttggcaacgtggcaaagttcccttatttaatcagaaaggaaaggcaagaatatcataattcaatcaacatttgaagcaaaggaatcaacaccagacatg

SEQ ID NO: 97921 - DNA, 998 bp, Heterodera glycines
  Promoter: Source sequence=SeqID_1705; Location=2267..3264; Strand=-; Gene=SeqID_75418
aaaagggaaaggaatgaatggccaatgaatgggggggaagggacgggacactcgaatttgagttgaaatcattaaaaatgattaatttaatttaaaatatgttgaatttactaataagtttagtccaaaatgttatgcttttcgtttggacttttcatcttttttttgtgaccaaaattcgaatttgttttcaatcatttatttattttttgcgatatttaatattttttctgggtaaataaagaatataaatttaaaaaagaaaagaaatgcaaacattgtatcaaaatcataatgaacgaaaactttttgataccattttatcgccctataaaaagatgccctttttgcatatttcagaccgagggccgagcccgaaaatccgaagttgttcaatagttaaaattaatttttaaatttatgttgaaatgaaaataaatagtttaaatcaaatagccaagaaaatggtaccatttatggccaccccattttttgcgtgtttcgcttttggcttcgtctgtccgtccgtccctttatctcctccaatggttttgttgccaatgtttttggttgttcgccgcgactgatcatcaacagccattcttggcccagtccatctcggcactctccgaaccgaccaattcattaactaattaaccaatgtatttattgctttgccgcattcccttttgctccttcagaaattaggaagaaatgaacggaccatttatgaaattatttgcctaattggtttttggcggtggcggcgcaccaatcgcagcatgaaaattgcacttgagcaaaaagcgaactcattttcaggactaaaaaagcgcaaaagaaagtgcaaaatgagaggacattgtgaaatttaattaaatgaagaaaagggcaccgaaagaggcgtatttaagacgaagaaagagggaaagagaaggccaaacagagaattagtattttatttttcatttttatttaagagaattaaaattgaaatg

SEQ ID NO: 97922 - DNA, 349 bp, Heterodera glycines
  Promoter: Source sequence=SeqID_6802; Location=374..722; Strand=+; Gene=SeqID_62950
tgtaagtgtgtcgttaggagaatgaaggtgctgatccaaatcggacaagattctctaaccgacctaataaggaatccttggtcggtaaacgatcggcatcaagaccagtcaagtcggacgtccaggacgccttacatgccattgaagtcgagccggaggaccggctcttctgcaaaatcctgtggttaaaaaaccctgctcacccgtctcaggcgacaatctgttggtctatcgctacaagcggctcgttttcggcgcgacatgctcccccttcatcctcgccgccgttcttctccaccacttcgataggcacgaccacccattcgccaaggaattggccgcgaatatg

SEQ ID NO: 97923 - DNA, 1003 bp, Heterodera glycines
  Promoter: Source sequence=SeqID_224; Location=57..1059; Strand=+; Gene=SeqID_78600
gtgaaaccggcaccgtccgtagggtttaggacctggttttcgcgcactttgcggacggtaattctcccatttaaaactaaaaggtttgggaccaaattttcgcgcacttgggggagggggctaccgtaataaaaaaaaaccaaaaggtgtggagccgaaatttaagggcgttactgtaaccaattctaattaaaattcaaaggttcgtggccaaattttcccgcattttgtgatactgtaatataaatttgacttttaataaaatttattttatccaaaattgggggtcatctcaccccccccccccattttttccattcaattgacaatattgttgctttgcatattctgcctgcgagacgatgtgcggctaagggaagagaagaagggacagagtgaacagtgtatgctatctctgcttttctctcttcctcttcggcgcacttcatccaaattggtgtcattctttgatcaaacgcatctgcgttttgggccaatagccatcgcggcaaatgtgtgaaaagaaatatggaagagaaatcggggaagggggggggggtttgatcgcagattgcttttaggtgtgtccaatggtcaacattttggacaaaggatcacagcagacaatggccacgacttttggtcccattgaatgtaagtttgggatgggcgggatagtcatacccgaatacccacaggccacatcttcaccatcatttgtacaaaatttggcccttttccttttttttagcacaactgatcaaattcccttaccctaatgagcatcattcccatttctgttcgtcccaccaatttgacctggatggtcattgagggttgcgtatgcaaccggccggatgctgtatgcatccggccggttgattatacgaaaccggtagagtgcattaatgtggcccatttggggtcgtttaccgaccatctcctcagcaaaccgtgcgacaataccagcaacttcaatgtcaccgagttggtggctggaatg

SEQ ID NO: 97924 - DNA, 153 bp, Heterodera glycines
  Promoter: Source sequence=SeqID_16420; Location=1511..1663; Strand=-; Gene=SeqID_80825
ttactaattctgctgggcggattaatgtgcacaatcaaaaaattaaaaaaaaacgaaaaattggcgaaaataaatgtttcattggacgcaaaaattttacgagcaaaaaccataaaatatataaaaactattttttatagatttgatgttatg

SEQ ID NO: 97925 - DNA, 163 bp, Heterodera glycines
  Promoter: Source sequence=SeqID_22572; Location=976..1138; Strand=+; Gene=SeqID_53238
gacatttggggattttattaaaacaaaaaaaatatttaaaaatttatcccaaattagacaaatttacaactgctttagccagagttaattccattgcaagaaaaaacaaaataatatttttaaaattaactctaattactgactctaagaaacagaaaagatg

SEQ ID NO: 97926 - DNA, 769 bp, Heterodera glycines
  Promoter: Source sequence=SeqID_38283; Location=1..769; Strand=+; Gene=SeqID_67146
atcgatttaacaattagacaagttataaatgttttttctttttttgataatttttctttaaaatggtttttatttttgattttttgtcactattttcataactttttcattttagtatcattattagttaaccatttatgggtagcactttagcatttgtttgccccctaacttttataaaatatgtatcataccaaaagagtttcttgtcaagacctatcaacttgcaaatttcttttgggtataaaaaagcgattttttcggattttttgcggcctaattgagcttttcaagctcattcaaatgatatcaattttttaaagtttgttggcaagtaattttaacgtttggccccgaaataaccccggcatatcatgggaatgtaattttttttattatgttagtaattttattcaggactcccatcggcaaagttgggtttcaatgtatgggcgagccgattctcaagtacacaatggggaaaatatcgaaatccaagtacatttcatatcaatatggattaaaaaaggatgcgttggttttattttatacgcaaattccaattttgaattaggaataagatcggatttttcaatacttacaacttattttaagaacgctggcgagcaaataaaatagagaaatttcgtactattgtagaataaaaaaaaaacaaaaattttaaatttctttaaatttacaacccaaaatgggaaaattattcaaacaattttttaatttaaaattctaaaaatattttaagataatg

SEQ ID NO: 97927 - DNA, 199 bp, Heterodera glycines
  Promoter: Source sequence=SeqID_5010; Location=1..199; Strand=+; Gene= SeqID_56558
tttttatgaaatataaattatttcgacaaaacatgccataactttgcttaaacacaatcaaattttacactttctttgtaccattcgatagccaagttttttctctattagcttgcagaatttcaaacaaaatttattaaaatgaaatataaaaaatctcaccgccttataaacggagaaaatttgattttaaataatg

SEQ ID NO: 97928 - DNA, 1003 bp, Heterodera glycines
  Promoter: Source sequence=SeqID_11659; Location=948..1950; Strand=-; Gene=SeqID_75119
cattaaaatgaaaggtcttataaacttataaagaattaaaatttttattattctcaatacataccaaaacttgttggtgcacagctagtaaaataaaaccaattattaattttattaaaatcatgcatgcaaaacgcgttaaaacttgaattaaaatgcaattttaatattccgcacacgaaaaaagctaatattcgtatctattcttccgattttagcagttttaaataatgttacatttataaagtaaaattgcttattacttttatttattttgtttccgaatttagcaaccagaatttcttgaaataattttatatttatgatattaatcatttttcggatcaaaaatatgactattattgtctttggtccaattatttgctgagaaaataatgtatcacttatttacattaaaatgaaaggtcttataaacttataaagaattaaaatttttattattctcaatacataccaaaacttgttggtgcacagctagtaaaataaaaccaattattaattttattaaaatcatgcatgcaaaacgcgttaaaacttgaattaaaatgcaattttaatattccgcacacgaaaaaagctaatattcgtatctattcttgcgatatttgtcgcgactcacgtcacgagaaataaaatggaaaagataaattttaaagcatgatgcaatttcattaaaaatgggaaaaccttaatttaattggaaatgttccccctcttcgtcgttctattcaaaaaatatttgtttgtttacattcaattcttattcatttctcacacaaaaatgtattaatcagcgaatgacaccctatttaagtcgtggaattgttattgaaatcggttcagtcggaataaaacatcattcccctgcttgtctactgtttgtcccaatttctattttgccaaaatttttgccgggccgaatttgcctctgtttggtcccgacaagtggtgcaacggccgggaacctatgcactgatgaatg

SEQ ID NO: 97929 - DNA, 1003 bp, Heterodera glycines
  Promoter: Source sequence=SeqID_9102; Location=407..1409; Strand=-; Gene=SeqID_70257
aattaacagccgatatgaaaataaaacaaaaccaaaatttatgaatcccaaaaattccatatattttgtctaataaaaatattgttaaataatgatgcttaaatatttattaaacgatacaatgagcaattttccatttaaaaattttattgattctctattatgaatgaacaaataattaactaattaattataaaaaacaggaccataaaaaattatcggaaagaaaaatataaaaacaaataattacaattgatataccgaccttttattcgggagaaataattaaatgcaatatgtcttaacattaaaatgctattgaaaatagcaatgaagaaatttacgtgggtgatgcaggaaaaatgaaaaatttgtaatatattcaaaatatttttatggtttgcaaaatatttattcaacattgaactcaaaaaagtattgacaaacactacggatgcattgaaaatcaaaaaccaaagctttagctatggaatgaatttatatttgctaaaaacgatacaagaaatacgcgaaatatttgataaaatcccaataaagctcaaatatttgccaaaaattgaaacaaaactgcgtaaattaactttattatttaattgcaaaaatatgtcccaaactaccaaacaaagtttatatgaggtaaaagttcaaaatgttctaaaacttactctgattgaaaagaaaatagaactgcgagaaaattaagagtgtagaataaaaatattctctgtacgaaaagtttttatgtaaatatataaaagaaaatccgttaaatcctttttataaagacaatttaacaagaaaatacagctattattctttttatgatacatattaatcaaaaattttgtaaaataattagatcagatctttgaaaactgaaattctaaataaaaatttcaaagaatatacaaaaaatatttttattatgggtaaaaaatattatttgttcaattatgtagagttaaataaaacgctcaaaatg

SEQ ID NO: 97930 - DNA, 249 bp, Heterodera glycines
  Promoter: Source sequence=SeqID_43157; Location=1127..1375; Strand=-; Gene=SeqID_70897
gcattttaaaaaatttgggtatttttgtttttttgcttttttttgaatttttttccctcaccaattttgggattatttaaatttaccctccttttttttcaaatttttttggaagttgaaaaactcaaaaaaatgtttccaatgggatttttctggcatgttgaacaaggagtttaccatttaatttgatcaattttaacatgaattcgatttttcaaatttcgtttttttttccaaaaagaaataatg

SEQ ID NO: 97931 - DNA, 295 bp, Heterodera glycines
  Promoter: Source sequence=SeqID_10011; Location=1948..2242; Strand=-; Gene=SeqID_73061
ggtatgcatttcgtattttgccaaaaacattgtgacattcaaaacatttttccgcctaatattttttgtttacactggtttaaaacaaaacacaataaaattataaggaaattgtaaccgttttaagtaaaaataaatgaataatagaatctcttcaagaaagaagggacctattaagatgagttaattgcatcgacattgacttgggggaggggggtcaaaaatcaaaagcactgacaataattgttctcgttaatgggaacgatgtacataatatgctaacccttgttcaatg

SEQ ID NO: 97932 - DNA, 249 bp, Heterodera glycines
  Promoter: Source sequence=SeqID_23893; Location=349..597; Strand=-; Gene=SeqID_54583
agtgcgaaaccaattaaatgttcatttcccatttcacttctatcgcaaatgccaacaaatttaacgcgccattggccgctcctaatgaaagaaacaaaacgggtgcttacttatgtttttgcgcgtttttcttctttcaaaaattcataaatttgcgcgaaatttctatttaaaataaatttaaaaatattttttaaaaattcattttcgattttaattattttattttattgcatcattattaaaatg

SEQ ID NO: 97933 - DNA, 95 bp, Heterodera glycines
  Promoter: Source sequence=SeqID_7150; Location=956..1050; Strand=-; Gene=SeqID_63967
ttttgtgccaattgagcaagagaaaattacagtaattttccgttttgggcctacacctaaaaattttaaaaaatgcaacaaaacaatacaaaatg

SEQ ID NO: 97934 - DNA, 59 bp, Heterodera glycines
  Promoter: Source sequence=SeqID_8028; Location=1..59; Strand=+; Gene =SeqID_66742
aaaattttgatgaaatattcggcaacgaatggaacaaaaatgaacgacaagataaaatg

SEQ ID NO: 97935 - DNA, 145 bp, Heterodera glycines
  Promoter: Source sequence=SeqID_5493; Location=334..478; Strand=-; Gene=SeqID_58241
ttgtagcagaacgaatgagacatagctgacaaattgcagggtcttttatactcccggaaaattaggccacgcccactttgcaaaggtatttaagccgatttttcacgagcaatcaaatcagtcttgcgaaacatcatcaaaaatg

SEQ ID NO: 97936 - DNA, 154 bp, Heterodera glycines
  Promoter: Source sequence=SeqID_4212; Location=1880..2033; Strand=+; Gene=SeqID_53612
accgacctcacatttcattggcgcggaggacggaactgttggagatgttgtccgagcgtttgatgccgtcgccctctcatcaaaagtcaaagtgggactgatcatgatcggtcgtgatgcgttgatgcgcaatgaaaccgccgacagcatcatg

SEQ ID NO: 97937 - DNA, 104 bp, Heterodera glycines
  Promoter: Source sequence=SeqID_20491; Location=2667..2770; Strand=-; Gene=SeqID_51032
agagaggggagagggagagagagagaggggagagggtcattgaaggcggacaaaaaacgattaatgttaacgaaaattgccttaattacaggccgaatggcatg

SEQ ID NO: 97938 - DNA, 59 bp, Heterodera glycines
  Promoter: Source sequence=SeqID_465; Location=4681..4739; Strand=+; Gene=SeqID_53453
agtatctataataatatattttatactgtaattaaataaatatgttacagtgtgagatg

SEQ ID NO: 97939 - DNA, 1003 bp, Heterodera glycines
  Promoter: Source sequence=SeqID_10385; Location=3597..4599; Strand=+; Gene=SeqID_73575
ttttttttgcaattaaatgagcaaatagccaccaaaaaatgtagtggttgcttaaaatcgcagtcatttggatgatttaacccgttttttaaaattgtctcttcttttttgtgttaattgcataatttagtattttaattcctaaaatttgattgattttctttgtttatcatttcaaattagataggtttgcatttaaattttgactattatgtaggtaaagtcgtaaattgaaacagtgggtaccggttgcgcattagttaatccatcgatttttatacataacatttaatggtaatggatgaacataaatgtacacgagttaagggggaggggggagatttgccgacaaaaaagttaaacatattaacattcaaaattttttgttgtcatacatattttacgttggtattcaataattgatttataatgacatcatcactaaaaattaaaatattttgtcttccgattccattttccacaatgcttttcgctttgaatattataattaatgcttattaaaattaggtatgcttctgctgtatgcaagcacactcattcattcatatgtttgcgcacctttcattcaaagatttcccaaaaaacagcgaccaaagtgttcaggggagaagggaaggggcaggtggggtgcatggaggcaagaaatgtaaaaaatgcattaatatttattattttcttatgtaattaactctgcttttctttgtattacatagaaaaatggctcttaattaaatgaaatatataaaaatataaaattgcatttttgtttttctgtaataataataaattaggtattttaaattgctttcatctccattatcatatcacatatcatttacacattttgacttatttcatgtgtcttaagacttaggcttgattgtttattgcttcactcccacatacacatattttttttctcatattcaacggccttgggcttttgctttccaattggtacagtcagtgtcaaacagaaatg

SEQ ID NO: 97940 - DNA, 174 bp, Heterodera glycines
  Promoter: Source sequence=SeqID_7890; Location=2729..2902; Strand=+; Gene=SeqID_46496
aaatggaatacgacaggaaagcaggccactccaaattatattttgttttgtttcgaataaatttgaaattttcttcatagttaatatttaatttggttgcgttatttccgaactatctattttcatttgtttaattttttcctttttttgtcagttaatctagaaaaagtaatg

SEQ ID NO: 97941 - DNA, 133 bp, Heterodera glycines
  Promoter: Source sequence=SeqID_6008; Location=1..133; Strand=+; Gene= SeqID_60003
aacacatggtgctctctctaaagcatgagaggcacatcgcgcccgtcacaaaataatacattttaaaaaacgttgacaaatttcacttctgtgtctcatggattaaagatggggtgaaaataaggaagggatg

SEQ ID NO: 97942 - DNA, 508 bp, Heterodera glycines
  Promoter: Source sequence=SeqID_18658; Location=1714..2221; Strand=+; Gene=SeqID_83319
ttttttgctattgtttttttgaaaaatgcattaataaagttcagcaatttataaccaacggacgaataggctttttataaattaattttatatattttttagtagaatattcaatattcaaattctatttttttcgtcatttatcagattatgctaaatcatccatctgctgttggtacattttccatctcttctcataaatgatcaaccaacaattttagttgagctgtgctttctcccattaatatggaaataacttttctaatgtaaaagaaatattagcaaatatttaataaaaataaatcgaaaaaacaaaaattttttatacatttctttcttttttagtgtaaaaaatgtgccattttttgaatgtgaatttaatccttttgttattcactttgttcaatgtgctgctgaccatcgctcaactgtatttttattattattattttttactgaaattacatttaaattttcaatttaaagttttcaaaaaacggatgaaatg

SEQ ID NO: 97943 - DNA, 84 bp, Heterodera glycines
  Promoter: Source sequence=SeqID_2787; Location=3087..3170; Strand=-; Gene=SeqID_81589
tgttgtcattttttccgatatctctataaaattgttcttttatgacaaaatgatatacaactaaatctccagtttttcataatg

SEQ ID NO: 97944 - DNA, 255 bp, Heterodera glycines
  misc_feature (20)..(20): n is a, c, g, or t
  Promoter: Source sequence=SeqID_11625; Location=1536..1790; Strand=-; Gene=SeqID_75073
tattttattttaattaattntaaattacattttttgcatttagcccgaactgttcggcttacagtaccaaatgaaggtgacaaaattcaattttattctctctcttttaacaaatgtcttacaaaattgggccaagaatttttcatttttaaattttgggaccaattaatattattttattattttttgttttggttttagactgaattaagaattttttaattaaaggccactgatacggagaagcgaatgatg

SEQ ID NO: 97945 - DNA, 123 bp, Heterodera glycines
  Promoter: Source sequence=SeqID_19176; Location=1036..1158; Strand=+; Gene=SeqID_83927
ccttaatatatatattttttttaaattgaggattggttgtgtttaaaataccgagcccaaacattgaaataaaaacgatctgaacggctaaacgatacgcaatgaaattttgtccagaaaatg

SEQ ID NO: 97946 - DNA, 56 bp, Heterodera glycines
  Promoter: Source sequence=SeqID_29756; Location=1500..1555; Strand=-; Gene=SeqID_60222
tttttagataaatttcaaatggcaaaagaattggtgaatgggcaacaaatttaatg

SEQ ID NO: 97947 - DNA, 685 bp, Heterodera glycines
  misc_feature (105)..(105): n is a, c, g, or t
  misc_feature (110)..(110): n is a, c, g, or t
  misc_feature (138)..(138): n is a, c, g, or t
  Promoter: Source sequence=SeqID_24883; Location=1034..1718; Strand=-; Gene=SeqID_55630
atgttaggaccaaaatttgaattcgttgtccaattattgcatatttaattcgtatgaatattaaatcattcgaattaggtcaatttcgcggcttggatttgtcanaattnaaattctgagtccgaatttgtgcatatntaatttcaattgtgtggtttgggctgatctaaatctgaattcgtcgtccgatcggtgcatagataattagggaatttttaatttagcagatacatcaaaattttgtcggtattaagtaaagcaaaatttcaaatttaccgacaaaacaagacaatgaaatgggtcaagaattgtaattaattagcttttttggatataaaaggcagtacgaaggtttactgttcataaaccaaattcataattcctttcaaatattgtttttatgcaaaaataaaatatattttaaattaactcattcgcctcccaccctgctcttttcgtttcttaaaatttttcacatttactgtttacattttaccatattgcattattccaataaatttaaaaataaaattttgtttagcatttatccataaactaacttttatttattccaaattttaaaaatgtctacatcggaatcaaaaaatggtaaaaaacactcaattcctcccttaacattaacaatctttcacctacagcaccggacgacgtcgactgcgaaatg

SEQ ID NO: 97948 - DNA, 1003 bp, Heterodera glycines
  Promoter: Source sequence=SeqID_16520; Location=404..1406; Strand=-; Gene=SeqID_80928
cccaaaattaacgcacaatataattacaaatatttaaaaaagttttcgaaatataaaattgcaaaatatgatataattaattaaacgaataaaaaaattaaataatgctattaataagttcttttttatttcaatacttgcatttttgaaataaataaatattaattataattcaatgtgtgtaaaaaattatcatgaaaaaataataaaaaacaaatgtattttttgttttaaaaaaaatgaatataaaataataattgagtataacctaaataaaacaaggatctctgcgatgaaatctagaacgtctttcgaagcgatcatttttttacaatcagaatataaaaatggatttaaatattgaaattaaaaatagtacatgaaaaaaaattattttattataggttttaatacgtgttatattaaagtatatataatataaattcgaaatcaacacaattatttttgaataataaattgaaattcataatgtatatcttattaaatataataatttttaaatccaagctgtaaaataaaactaattgtgaaattatttagataaacttatcatgactttaaatagtttaataaaaaataaatgaatatatttgcataaaaaatattttaataaaaaaagtaaaattgcattataacattctgtaaagtcacattttaaagtattattaaaatatttttattatttatgcttttgtttttaataaggaattaaacatttattaaggaattttatcaattttctaaaaatatatttaataataagttgttcaaatgtaaaaaataagtttatcaagtattaattgttccgatcaacatttacactggtcccagctcaaattatacatgaaaatataacattttacaaaaacagttggagccgactaatttccgacgacgatgtccgacctgccataagaccttccgcttcgtcctggcgcgcttctcgtatttgaacttcgaaacgccgtggttgccaaaaatg

SEQ ID NO: 97949 - DNA, 290 bp, Heterodera glycines
  Promoter: Source sequence=SeqID_12644; Location=57..346; Strand=+; Gene=SeqID_76319
ttattgtacatatataaactaatgccatcataatttgttcaagacaagcccaaaaaccgaaaaagccaattcgatggcacaatattcatttgtgtagctaacggagcccttttacaaattttgccatttttttttgccttaggttagatttccataaaaacaatgacaatcctttcattgtcagtgaacactttggtggtgccgtttctctctgcccttccgttcaattgcgtctgtttttgccgaccgcggacaatcgccggcgcctcttcgccagcacagtgacaatg

SEQ ID NO: 97950 - DNA, 113 bp, Heterodera glycines
  Promoter: Source sequence=SeqID_4711; Location=5766..5878; Strand=-; Gene=SeqID_55478
ttccaaaagagcaatatgaaatcatcatgagcaaccacacaagagagagacgcaacgtgcaacccgagcaactcgcttcgcagctttcagctgctcaactagccacaacaatg

SEQ ID NO: 97951 - DNA, 268 bp, Heterodera glycines
  Promoter: Source sequence=SeqID_10217; Location=1..268; Strand=+; Gene=SeqID_73357
cgacccagtcccccctggtctataggagccgctggtaaaaaatttgtaatttttaatgagatttgttaatagcctttttgtccaaattgatcaaattataataattttgaatttttttcgagtgcttatttttaaggacattttgaattaaagaatttttttcaagtgatagggcccaaatttcaagacgttcttgcctcaaggacgaatcccatccctactttaaacagatcaaaaattaatttaaaaaattaatgcacgacaaatg

SEQ ID NO: 97952 - DNA, 1003 bp, Heterodera glycines
  Promoter: Source sequence=SeqID_14210; Location=157..1159; Strand=+; Gene=SeqID_78222
aaagcggcttttgagctaacttttctgcttctgtcggtattcgatagattggcagtcctatttttggcaatttttaatacattatattaaaatattaattaatttgacagggacaatttatattgtagcataaaattacagaatgtaatgttttattttttgtttatttgtgtcatatttttggaagtgttcatctattaccgggtgaagaagatgctggaggtatttcataccatcgaataaggcttccagcacgttcagcctttaataaataaataaattgaataattaatttttattaattttgaaattaaaagtgggttgaaattattaattatataattaaaagtgggttgaaattattaattacaaattaaataatatccatttcttcctctgccagttaacccggctaaaaagaaattataagtatttaaaaaaaaccatttacgttaattttttggaaattttcccaaaattttcgattttaggacgtatttaattgataattcaaatgcattaaaaaattgaaataatgatttaaatatcggaaaaatgcataataagaaaattagtaaacatataattaattatttttttcgtcctcaatcagtttcttctccgttttttcacttttcaactttctttccgctctaaaattttaaattattaaaattaaaatgtttttaattctataaaaatgccattacatccaattcttatgccgaacaagcagtccttttgttcacatggcttctcatcaatggtttttgcttaattaattaaaaatatttgacgctaaaattgttcatattgtaatgtaccaattaatttgttccgagaaactcaaaaaagttttggccaaatgttcaaatgccatccttttttccgaaactcccgcattggatcggtaaaaaccccaattttttttacatgacatcattttgatgcttttatcgaccaacacccatccgtgtccattaattgcttacatccacggatg

SEQ ID NO: 97953 - DNA, 349 bp, Heterodera glycines
  Promoter: Source sequence=SeqID_20031; Location=323..671; Strand=+; Gene=SeqID_84805
agtgagtcatggcataacccaaacaatcaaattaaaaattggtgttcgactggtctcgtgccaccgtttctttctctttttttttctaagtgccgaggtcggaggcgcccatttgccctttgggtcgcctttgctgcacccgtggaagggcggctcgcaagcattgggcagtttgatcgacaagttcagcactcggcgccgctcctcttcctctgccgcaacaaaattggcagttgggggaaggctcggcacgacgcccgaagcggcggtcggacaatgggaggagggcacgtcgaccaatgcatttgacagagcgatcgaatgcatttgcgaagcgatgcaggaaatg

SEQ ID NO: 97954 - DNA, 94 bp, Heterodera glycines
  Promoter: Source sequence=SeqID_44058; Location=561..654; Strand=+; Gene=SeqID_71604
tgttgcgccccaacaccgcagtgccagggatcacacatcagctccgtaagaagccttcactttcattgcgcctttgggttttgaacacccaatg

SEQ ID NO: 97955 - DNA, 1003 bp, Heterodera glycines
  Promoter: Source sequence=SeqID_8364; Location=1586..2588; Strand=+; Gene=SeqID_67813
gaagaagaggaaaatcagtcattcatggaccaaaaatattttgaagtaaagatttttgtatggatgcaccaagaaataataggtcaggtttttcttgccatttgcatatttgtcacaatttgcgctttcgcatggatgataatggagcgtagacggcgttatcccatacgcttaagacgcgaccgtgtcgaaccgcaaagacgaccgaccctagtaatgcaatggctaactccagatggacggccggcattagtcatgcagtgacagattagtcgaaattgcctatgtacaaaaatcccacccacactttacgctaataattttataaaattttttcacattgcccaccccaaatgtgcattaatcccgatgggattctctatcagcaaattggggaagtatataaataggaaattcaccccatcacaccactctcgtttatgttcctaattgcctcctatacccgtacgtcctcatatttgttctgcagaaacatgaatcccaattattcataccccaacacttactcctacccggctatgaacaacaacgtacccaatcccgggtacaaccaggcaccccctccgggaatgggggtgcaacacaacaacccgccccgtaccgaatttccatcccaaaactacaacccgtaccaacaacctttttaccctcaccctaccaaccaaaatggtgcgtcaaaccctccggtttaccatttccctacggatgcccaaaataaccaacaacatactcacaaccaaacttacaatgctccggctccccaaaatccgctaccaaatcattcgactcaaaataatgccccagcggcggtccaaaatcctccccaaattacccaaaatcaccaacagccttagggcaacattttgaacggacaaaatgcggttcctttgaaccagcgcgttattcccccgccaaaatattacaaatcgaacaaagagaaaccggtaagaaaccgctccccattcttttcccacaaaacatg

SEQ ID NO: 97956 - DNA, 251 bp, Heterodera glycines
  Promoter: Source sequence=SeqID_2520; Location=2060..2310; Strand=+; Gene=SeqID_80186
acttactgtagtcgattgttactgtataaaaacgggtttgcttcttttgcttgggaagggagcataaagttactgtaggtactttacagtaaaaaatgtttagttcttttgcttaggaggaaggattatttactgtagttgactttcacagtatgaaatgggtccgttttttattggggttgtagagataatttactgtcgtcaatttgtaagtaaaacaccaataagagcttgtcttgggatgggaaatg

SEQ ID NO: 97957 - DNA, 232 bp, Heterodera glycines
  Promoter: Source sequence=SeqID_14165; Location=906..1137; Strand=-; Gene=SeqID_78169
agttgccctgccgggaccgggaaatgggtgggggggggggaaaccttaattcccgtctcggccccgactaaccaatgttattgatgcttcatgtccaaattaacttttgcaattactttttataattacaaaataataaatctcgttaagtttttatgattgaattttttctgaattttaaatgattttgtttaaaggactaataaatttatttattcacactttaactatg

SEQ ID NO: 97958 - DNA, 771 bp, Heterodera glycines
  Promoter: Source sequence=SeqID_22839; Location=1..771; Strand=+; Gene=SeqID_53545
ggaccccctccgttccccaaaagtttttaggaaaaaccgccgcaaaaaaatagggtgaaaagcaaaaaaaaaaaaaggtcgtcgcccgggagggaggtaccccccccccaagccgaaatcctgggaccgtccctggtggggggggggggggggtcaactgggccccaggccggttttttgtgcgataacttctttcatagttgaccgaattgaatgaatttgataccattcgatagccctatatgttctctatttccctgccaaaactcgaaaaatttcgttaactttcaaaaaagttagggccaacaaacttcaaaaaattggtgtttccgaaaatttttgaattaattttttcccagtccggtaaacaccaaaacacagccgccgaaaacacagctgggacataacacagccggagataaatttttttaaaattttcaaacttagaatcttaagagaaattttctttgaaaattctatgagaaaaaaaattttcagcgcttttttttgaaacttttttgaaaattcttagaattcgtcattaaattttgaaaaatagtctaaaatttcgttatttgaatttttttttttttaatttattcccggtgtgttatgtctcggctgtgttttgtgctgttccgcacacagtcgtcccagcagttcgtttttaaaacttgtcatacatttagtgaattcttttgctgttctgttcaggtgctcggtctctacggaatgattgtctctctgctgctaagttcctcctgaacaatg

SEQ ID NO: 97959 - DNA, 100 bp, Heterodera glycines
  Promoter: Source sequence=SeqID_7754; Location=1232..1331; Strand=-; Gene=SeqID_65839
gtatttgaatgctttaaacccttcagggtttccgcggcataagttgagactgaagaaaaattcaattgttttgttaatgcgtaatttgaatatagaaatg

SEQ ID NO: 97960 - DNA, 222 bp, Heterodera glycines
  misc_feature (98)..(98): n is a, c, g, or t
  Promoter: Source sequence=SeqID_7453; Location=1008..1229; Strand=-; Gene=SeqID_64860
tgtgcggcgcgtctccaacatcgacggcatccacctttgactaaaaaccggcaaaacgtcaaatttatttttatttttttgacattaattaaaattanaattttttgttataaatttgcatcaatactaagtaaaaaaaggcttctacaaacttaaaaaattcatattataaaataaatgaatgtcaattaacacctgttcaacagccaccgagtcagaatg

SEQ ID NO: 97961 - DNA, 1003 bp, Heterodera glycines
  Promoter: Source sequence=SeqID_5109; Location=2182..3184; Strand=-; Gene=SeqID_56938
ttcgaaaaatacaaaatgattaaacgacatatttgtcaaaagaaaattgaaaccaaaaggaagtcataagttgttatctacgattaaatcggataataaaaattgttctgcggtaatgaaaataaataaatgatttacaaaacatgaaaaataacggaaggaatttttacggtttgagttcacagcgaaaaataactttcttttgcattcaaaattcaaatttggcgcctcttttgacctaattattttggaaaatccagctgttgctggcacagctgtcaacttaagtgattgatggctcaaaatttgcattcaaattggggaccggaccttatttcgcaataaacacgtgactcatcggccagtcagtgcgacgcactgtgtggaaaaggccaacaatactcgcggtcccgcctaattgactcatgaaaaacaaccacgtgccaggcggtccgcctgtcacctgagcgttctgcggtcgctataaaaagcgcaatttcgcaaaaatatttcactttaatcgagaaaaaataaaattgcttataaaaatattttacaaattgaattttatttcaaatttaccaataaaatatttattttatatttaaaaaaaacatatttcacttaaaaaatgtcccaggtccaaaaaaaattcttggccgtccccggtgaaaaaagaaaagaaagaaatataaaaaattttttcaaaaaaactattgatgaaataaaattaaatgaaaataattatatcgaaatatcaacaaccgaaaaaagtatgcccgattacgggattcaagaaaatattacaagatttatatttaaaaatccaaaaaaagaaaatcgaaaagagagctccgaaaactttaaaaaaataatcgaaaatttaattaaaaaagcaatgatgaaaaaaagaattgggtgggatgttaagaggatttctattgatttgttttgtgagttgctaaatgacccaatcattttgccggcccgggaccctaaaatg

SEQ ID NO: 97962 - DNA, 269 bp, Heterodera glycines
  Promoter: Source sequence=SeqID_10508; Location=561..829; Strand=+; Gene=SeqID_73733
ggtaagaaaaatttgggaggaatttggacacggataatgcactttcctggccaatgattgattaaacatatttataattcctgatttaattattcatctgaatttcatttcactcaaattctgaaatttaaaatttgaaatgtttttgatgacttttcaatctattttcttcttcgatagtgactctaataataggtcactgaactgaaaagcccaggtttttatttttggctctttaaatctttaattttagtcttttgtccgttatg

SEQ ID NO: 97963 - DNA, 189 bp, Heterodera glycines
  Promoter: Source sequence=SeqID_22483; Location=980..1168; Strand=-; Gene=SeqID_53157
aattaccctcaaaaatattttggcatttgaatttgccaatccatggcttaaaagaagccacttttggattcttccccaaagctcgactttgatttggtttcaattaattggctgttaatttcttaattcaaagattgtaaaaataaaactccgcgtgtgcattgaaccaccttctcacagtgcgaaatg

SEQ ID NO: 97964 - DNA, 62 bp, Heterodera glycines
  Promoter: Source sequence=SeqID_45263; Location=1..62; Strand=+; Gene= SeqID_72593
cgcggacgacgcgcagtgccgccactggcgctgccccgttgacgccgcctcgtcagcgcatg

SEQ ID NO: 97965 - DNA, 263 bp, Heterodera glycines
  Promoter: Source sequence=SeqID_18741; Location=1262..1524; Strand=+; Gene=SeqID_47540
tttattcacatttttaaatttatttttggccattatggcaaagcacacgtgttttggcataacaaatgtgcactttatcatataataaaccaatttttattttcaaagaaattaatttttaaagtcagtttttctttgctaatttccattaaatggcatattctaattagcttatcaaatattatgaatgcttaaaattaaacaatatatttcatttttaagattttttaatttactgacacacaataaaatttgcgggaatg

SEQ ID NO: 97966 - DNA, 984 bp, Heterodera glycines
  Promoter: Source sequence=SeqID_11749; Location=1..984; Strand=+; Gene=SeqID_75242
ccaaaaatttgcaattatctaggcacatatgccatagtttaagaggcgcaaaaatccgaaaatgtccttaggtatagacaaatctgcttggcaagctctattaatttgcaaaacatggtacaaaaaatatgccaaaaaatcagttgagaattttccgctgtttatattcgaatcttcgggaaggattttcagaattcagaagcacttactaattaatccctccccgtttgcggatgggttgaaaaaaaggcagctttatttttgctatttcagtaaaatcccattaaaaatttcaattcccatcacaaattgtcactaatgatgaaaattttaggtttttacctattttttcctgagctccctatggtctgaatgcacgaaaaacatgtttttttggggcggggggggggggttgttaggttacttttcgagttatttgcacctatttttagttttaatttttagaacttaaaaatcctaaaaaaaattaaaaacctattttaactatttggtattttgccaaaattattaacaaaaatgcaataaaaacgaaaaatataccccctaagaatcgaacccaaaaatttcaggaaaatacaccctacaccccaaagaaaagaaaattttccccaaaaattcgtctcaagaattttaattatttattttcttgacaaacgtttgactttaaaaaattatgtaactcaatattgatttggcttaattttgttgattttttgataaaattttacaattttacacccctaatttagaatagaacttactgacgcagaacaacaggtgaaaggcacttcgaccagcaacgatttgaacgttgcttcgagcgatgatgaataaaattgtgagtctgttcaattcaaaggtggcaaaacaaactgaggagcgctttgtcttttgcacaaggtgttaatagtttttttgtttcattattttcaggcttccgattaatcaaaaacagaaaatatg

SEQ ID NO: 97967 - DNA, 145 bp, Heterodera glycines
  Promoter: Source sequence=SeqID_22687; Location=2218..2362; Strand=-; Gene=SeqID_45731
tttggaagcggaaaaacggagtataaaaaggaaagggaacttatgtgcaatggtcatcaaacattaattgggccgccttattgtaaaacaggcaaaaaaagcgtattcgatcggacgctttgggactttattaattaaataaatg

SEQ ID NO: 97968 - DNA, 1003 bp, Heterodera glycines
  Promoter: Source sequence=SeqID_148; Location=5839..6841; Strand=+; Gene=SeqID_75162
ccaaggacatttaaaatttttattatatgcaatgaaaaatgattaatatttattcaaatggcttgtatttttcaccggaatggattttttccaacattttttttgttttcactgatcattttcctaattcgcgacgacttttctgctttaaaaacgctttttttgcggcgtgttttttcaaaaaattttgtgggacagaggggaggggggggggggtgtccggcggtgccgacaggcgaatttgttaacagattttcaccaaaaactgcctaatttttgtgattttaagcctaaatttgcatttttttgacataatgccataatttaatccaaatattgttgaaaattacaaaaatttatcaattttctttgattttttttaaacttttcctaatactcatttccaaggacgtccttggcatccaaggacggataccatccctggcctattataatgaaaagaacaatatatgtgggtggtagatgcactaattagcgtaaattattaatgctctaattgccttctttaattggccaaatcaaagcatccatcatttgccttgatgagcccagcggtttttttttcaatttttcaaattaatggaataaataaaccaaggatgttttgtttgatttcaagtacattaaattagggatttggcgatttcaacaaatttttggcaaataaagaattgcctgcataacataaaacagaaatatttacctgagctattttttgcattgacgcttttattctcttctgaaacttaacgaaattttttgaaattttgtagactgattgagaacattgagaacacttagggctatcgaatgattatgcggatattttccaccgtttgcgttgtaaatgtgccccgacaattttcaacgattgcctaatgttacgtgttgtctctttccatgccggtgccgacgatttcttcatcgaatttcagcccgatgacagtgccatggcatcggatggacaagcggtggcaaaatg

SEQ ID NO: 97969 - DNA, 373 bp, Heterodera glycines
  Promoter: Source sequence=SeqID_16046; Location=803..1175; Strand=+; Gene=SeqID_80402
tcttttctgacagaagtgttcaaagtctttataatgttttattataaataaaacaaaaaatgaataaaagacagacaaaatttgatgaaatttttaattttttcgaaaaattaaatcatttgacccaaaataaataataaacttattaacacagtaaaaccaatccaattttcgatttaaattatgccaaaaatattatctaaaaactaaataaataaataattttttaatatatcaaaattttcaaataaacatttgaactttttctaatttcgattaaaaatgctttggcttacggagccgaacaaaaaaaaatggttttccttgaaaaatttttcgcgcagcgctcagctgacggaataaggggaacatg

SEQ ID NO: 97970 - DNA, 447 bp, Heterodera glycines
  Promoter: Source sequence=SeqID_19827; Location=1..447; Strand=+; Gene=SeqID_84575
aatatcagtatataaatcaaagcgggggagagagaccctttgatttgggtttgcaaaatttttggcataataaatcgtgaattgaactagctgttatacctttcatccattttcgaccaaacccgaatccttaactctaattcaataagtcgaaaattttccttattttgaattcttgttctagttgtagttagggatttggatttttggtcaaaaagaaagatatcctgatcagaacgactcataaaactcccagaaacagattttacgatttgacgacacctaaaaaatttccaattttattttccgaatttatttcatttggaattctatgaaaaaggaattgtcttttgctaattaggtagcaaattacgaaaagaacatatgctagcttagtttgggcttatttcatgggaaaattaggtgggcggtactgctgcgcatatg

SEQ ID NO: 97971 - DNA, 357 bp, Heterodera glycines
  misc_feature (22)..(22): n is a, c, g, or t
  Promoter: Source sequence=SeqID_25204; Location=423..779; Strand=-; Gene=SeqID_55944
aaataaattggtgcacaaaatnagtgagaaattcctagaccttccagggcttcagattcaaaaaattttttgaataaaataatttcttttccacataaaaaaattaaaatgaagattttttcatagattatttagttgcgaagcaattatatatgaataaattttttttcgtcatttgtgaccttgaatggaaaaaatctcatttaaattgagcaaaagttcattaacagaaaagttgcttttttttggaatcgatgaaaacaatacaaatttaatgttaatttaattaagagaattattttaaaattaatattaattaataaaaaatcacttatttgtcttttgtagtagtatatg

SEQ ID NO: 97972 - DNA, 765 bp, Heterodera glycines
  misc_feature (78)..(78): n is a, c, g, or t
  Promoter: Source sequence=SeqID_10117; Location=1579..2343; Strand=-; Gene=SeqID_73201
attttgagattttggccattttatgtccatatttttcgatttttggtccatattttatggccatatttcgcgatttantatccatatttttggactccctagttataacgtaatgaaaatttgaaactcccacaactttttttctgagatgtcaaattgcttaacattcgcttaaaaaaagattctccattacaaaatctttttttagataccaaatttgttcagtttagttgggaatgaagcgagttttacgccaattacgctatttggcgttatgagcaattttgtctaacacttggcttgacctagagcccggaaatttcaaatttgcggatcctgttgcaggattggaattcaaaaaattttgcaggaccggatccggccggattaatcctgcaaatcctgcattttaaatttgcaggatcccgcacaggattgcggattcttagaaattttgaaaaaatttcaatgaaatttccaaaaaaaaaaatacctgacaagaaattttaggggctggcgggatgcattaaaagggcgactaagatgtttcgaatgggtcagacggtaaaaagagatcggaaaccaaatctgttaatggtcaataaatttgactattttgcttttcaaaaatgctttttttcggcgcaattttttcaaaaactaggaacaaaggggtccgtctatgcagataggcgccgtctgaatttttttttttgaaaattttatcaattaattaactgattttgaccaaaaaatgaccaaatg

SEQ ID NO: 97973 - DNA, 176 bp, Heterodera glycines
  Promoter: Source sequence=SeqID_3760; Location=1905..2080; Strand=-; Gene=SeqID_51760
aatccattactcccttccttcccccgtaaccgatttttgtatttagtcttagcttcttatttcgatacattgaaatccctaccatcttcgagtactgtaaaaaccgcacagaactgcctaatgaatactttattatttccgaaatcggcgacggtgacgacgaccaagtcaaaatg

SEQ ID NO: 97974 - DNA, 400 bp, Heterodera glycines
  Promoter: Source sequence=SeqID_2592; Location=6525..6924; Strand=+; Gene=SeqID_80606
agctaatcaccaacaatcgtccgcaatgacgttaaactagcctaagccatcaacaactgtccgaaacgctaatcacccggctgccacgagtccggaatgacgttaaactagcaaagcatcggccaacccacacaacaatcgtccgcaatgacattaaactaaagaaccaaccaaacaacaaatgtccgcaaaaacgttaaactagcaaagcatcaattgtccgcaatgacgttaaactagcaaagcaccggccaccaaacaaccattgtccgaaaagacgctaaactagcaagcaatctatccgacggtcagggtccgaaatgacgtcaaacaagcaacgacaattggtcataaggacgttaaactacgtcaccaattcaagcaaaagcactcgagcatg

SEQ ID NO: 97975 - DNA, 622 bp, Heterodera glycines
  Promoter: Source sequence=SeqID_4341; Location=1140..1761; Strand=-; Gene=SeqID_54107
ctcaattttttaaattacaatacaagcatgttaaaatttaaataaattgatgcttaaatacacattcttctagaagttttgttggaaggatttcaaataaaagaaccataatataaataaaatcattagaaagattactttgagttttttaaatatttgaaagttcaattacaaatggaaacaattataaatgagcttaaattatataaaatatgaaaatatttatatgtaaatgtatccgcttcaactcaagctaaatgaatgtgtatttaagcatcaatttaatcaaattttaacatatttataatttaaaaaatgataaaatcataggaaaaatctgatttttgatttttgcactttttttgaagtgacttagcacccaccctttatcctagttaaaaagccgactattgacacacctgtctagtaatctgttacattgattttcttgaattattgaattgaaatccttcttaaaacatggaaaaattgtgtggggcgtgtaataaataattcatataaaaaattaataatattattttattttataaataatgaaattgaagaaaagtaaaaattattttaataaattttcaatttaaagctgataaaaatttaaatg

SEQ ID NO: 97976 - DNA, 912 bp, Heterodera glycines
  misc_feature (386)..(386): n is a, c, g, or t
  Promoter: Source sequence=SeqID_24253; Location=739..1650; Strand=+; Gene=SeqID_54972
actgagaatatttttaagctttcagggccattcattgttaggttttgataaatttaaatttcttaaaaatttatatattattcggcatttcattcattttccaatttgttgcttatgtaagagttaaaagtattatgcataatgtttgaaggttgttttttttgttctattttttgttgtaattgccagggaacggatttatatgtgccaaaaaacctccaaaatatgtgctaaaaagctcaaaaaaggccaacaacatatgtgccaaaaattgaaaaaaaactgtcaaaaaataagtgaatttatcaaaaagatcacatttttttatccatttcgctagtacaattctaatcaaaaacatttcaattctttgtgacgtaaatatntttctcgctctccaagatttacttatttttctgtttttcatcgataaaattcaaattttgccttaaaaatgaaaaaagtcattaaaaaatatcaaaaagtgaaaaagaaaaaaaaagaaaatttttgatcatttttggatatcttgccaagaatttgagtgcaaaaaagctactttcgtaaaaaataaaaataaaatttccaaaaaatccccaaaatatgtgctaaaaaaaattagtgaattaatgacatcagatgagaacgaaaatgtgatatttgtgatagttaccttaaaaacctccataattatagttatctcatattaattactacccaattcgctgataaaaggaaaatttaataattgaattattataaaaatgttgtatcaaattaatgaaataatgattaaatgtggttaatattgattgaagaaaaattaagccatgctataaaattaataattacaaaattcattgcgaaaaatatttttataaaaataattcattatatttttacaaaaaaatg

SEQ ID NO: 97977 - DNA, 142 bp, Heterodera glycines
  Promoter: Source sequence=SeqID_12692; Location=3124..3265; Strand=-; Gene=SeqID_76376
agttatttgtccgaatacaaagaaatccggccgtgaatggaacactagtcagacaaagccgaaagcacaattcaagagaacacatgcagaagtcaatataacgacaattggttcaacagaaaatggaacagtagccacgatg

SEQ ID NO: 97978 - DNA, 1003 bp, Heterodera glycines
  misc_feature (20)..(20): n is a, c, g, or t
  misc_feature (31)..(31): n is a, c, g, or t
  misc_feature (35)..(36): n is a, c, g, or t
  misc_feature (53)..(53): n is a, c, g, or t
  misc_feature (61)..(61): n is a, c, g, or t
  misc_feature (73)..(73): n is a, c, g, or t
  Promoter: Source sequence=SeqID_7994; Location=2654..3656; Strand=-; Gene=SeqID_66623
ttttttgagaatttcttttnaaagaaaaaanattnncgaaggattaaagtttnaaaaattnaaaatttcatcncctaaactcaaaatttggaagttttattgagtttctagggcaaattctatattgcctaatgaattgaagatgaaagaggtcttcaaaatatgcaaaatgcgtatacataatgtaaaaattaattatttaactataattaatttattttttaatccaaaaagcacctacacctaaattcttcaaacacagaataaaatttcttattaattaattttaaatttttaaaatccaaaatttaaatataaaaatccaaaaatgatttgccttttttaaataactttccgacttttttagccaacaggaaaagttcttttttttaatgtaaaggtgacattcttggaatttttgggaaaatccccaaattaacatacctatacaaaatatgcaaaatatatacacattatttttttcaaaatggatgccaaaattctccaattaaattcattggtaccgcataaatcccataatgatcaaaaaagaaggactaaaaaaattttcattttgaaaatttggtgccattttctgtgtcaaaatgtttggagatgacatctgcgctacttttagtggtcatccccccaccacaacattcaaactgtctccaattattttttttgttatataattctggcgttatgtgtcgtctcaaatttgccgccgccacatccccgcgcccccatctgccgctgcgcaatatgatttgttgttgaatgcgttttgtgtgtgctgtgcccgtacatacgcgtctcccaccccgacagggcgggggcggtcgcgtcatttcttcaaaagggcgcaattgccccccgggcgctccccccccccccccccccttttaccaaaatccaattcatcccaaaatttggatgatgactaacgaaagaaggatgaaaacggagcaggagagggtgacaaggaagaggaaaaaagatg

SEQ ID NO: 97979 - DNA, 1003 bp, Heterodera glycines
  Promoter: Source sequence=SeqID_23114; Location=408..1410; Strand=-; Gene=SeqID_53820
tattaattcatttttttatcaaaaaatttcatcagataaatgaatgaatgaatgaacacaaaagagaatggcgaagtcattagcaccaaacatggtctttgccgttaagcgtctaaccagttatccaaaccgagacatgacactaagctaaaaagagtattaccattagcatcataacaggatttcgccgttaagcgttgtcctgtagcccggctgaatggtcctaattagtcaactaaatgaatgaatgaagacaaaagagaatgccgacgtccttagcaccaaacatggtcttcgccgttaagcgtcgaaccagttatccaaaccgaactaaactaaaaagcgtattagcattagcatcataacaggatttcgccgttaagcgttgtcctgtagcccggctgaatggtcctaattagtcaacaaaatgaatgaatgaattcaatagaaatgagatgaattgaaaagcagaacacaaattccattgtatggggtgcgtatcctcgtcgagaattgcatgcatttatcgaaatgaataaattgagtttgcataaatctaaaaacgtaataattgtaaacaataaaataatttgaatattgggaaaggcaggtaaatgagtgaacggcaaaatgggtgaaggaatgagggagaggcgtacgaataatagaaatgcagttaccaaaaaaactcactttattttttcaatgaaattttttttataatagataataaaaaatatgccaccaaaaaacctatttgtaagtgcgcacttgcgacgagtgcagccgcaaaaatgaattgtcgagcacactaaattgaataacgcaattaccgcgtgccccggggaccatttgcacccggatatgcgaaagcttaaggaccgaaacccaaatggggttaaagtgcctaccgaagaattaaatctgtaatcgaaaaagtaaatgggggggggttcaaaaataaaatttaaaaaaggaataaattttagggcctttttagatg

SEQ ID NO: 97980 - DNA, 112 bp, Heterodera glycines
  Promoter: Source sequence=SeqID_43192; Location=1316..1427; Strand=-; Gene=SeqID_70924
taaataatttattttcaattaataaaattttaattccttaattccccctaatcttttcgcccattttaaatatccttaatttctcctatctttttttttcggcttttagatg

SEQ ID NO: 97981 - DNA, 334 bp, Heterodera glycines
  Promoter: Source sequence=SeqID_5653; Location=2936..3269; Strand=+; Gene=SeqID_58790
ggcatttaaatcccaaaataaacttggttcaaaattctgcagttttggttttcgttgtttgtatgtaaatttatgtgagtaagttctttgtttttctctctgtcttttttaaatcaataaatcgattaatgcttatttcacaattggtaacgctaatgcattggttaccatgcacttttaagtaggtacctatatcgatcattataatttcataattcctttgttggattcattttcttacattgaattaattacctaaaggagttttagatttactttttcgcaaaaagctcacacgtaaattttggcaccaaataattttatttaagaaatg

SEQ ID NO: 97982 - DNA, 119 bp, Heterodera glycines
  Promoter: Source sequence=SeqID_33764; Location=1..119; Strand=+; Gene=SeqID_63727
ctgagaaagccctcgacagttgctctaatccgactcattgtctgcagtcgctacaatcggtcgctggaggaacagctgatcggtttcacgaagacggaaacaaaaagacatcagccatg

SEQ ID NO: 97983 - DNA, 101 bp, Heterodera glycines
  Promoter: Source sequence=SeqID_12352; Location=434..534; Strand=-; Gene=SeqID_75947
taaaagcctaaaagattcagttctttaaagcccacctttttgactaatttattttaatttttttgaaacctaaattaaagccttctctaattttagtaatg

SEQ ID NO: 97984 - DNA, 140 bp, Heterodera glycines
  Promoter: Source sequence=SeqID_23042; Location=309..448; Strand=+; Gene=SeqID_53746
taatgtgtgtaatccaaaaataagacaaaatagggactgtaaaaaagaaaagaaacgggatttactgcttgtaatggctgatcgaaaatagctgtgggagctcaaattgctgtgggagcaaaaagacaggggccaaaatg

SEQ ID NO: 97985 - DNA, 577 bp, Heterodera glycines
  Promoter: Source sequence=SeqID_32077; Location=314..890; Strand=-; Gene=SeqID_62390
ttttggcctataacttttttctatgtaatccaaatccaacattgttgatatcattcgaaagcttaccatgtttagcagctttttaaaagagattgcttcgcgattagacaattaccaaaaaagttatactattaaaatttcgaaaagtcgaaatttttgaagttttttcttaatcaaattttttacaggcttgaaaatctatccgctttttgtaaggctaatagagcatgataagagctttcgaatgataccaatattgttggatttggatgccaaagaaaaaagcttaagtggaaaaacgagctggcgccgaaacgccagcgccgaaacgcgtgggtccctgattttttgccactttttttccttttttaccgtccacgagcctaaagccttggcataacctaagcaattgtacgagttgccttttgtacgagtagtcatgacacctctaaaagactaatttgagtttataccaatttgacacaaatgttagctgaagcatatttggagcgagtcttaattgcttaacaaatgcctaacattttatatattttaagtgcttttatttttcaaaatg

SEQ ID NO: 97986 - DNA, 388 bp, Heterodera glycines
  Promoter: Source sequence=SeqID_19707; Location=149..536; Strand=+; Gene=SeqID_84453
tggttatttaaccattaccaccttcttattgaccgggcccgaatgtcatatatattttttattttaattatttattttaactaattatttttcaaaaattttttattcccatttgagagttattttttatttacgacctctctcgcgacataccctcaataataaaaaataaccgggttgataaagttcaatacaaattgtaagttaatgctagccccaatttattttcggaagatcgagtattttgttattcatttatgtttgctttaaaatgtatattttgtttagatcaataccaacaaaaatgaatattattaattttttatataacaaatttaatttttattaaaatctgttttaaaattaatgatccctaacttccagaatg

SEQ ID NO: 97987 - DNA, 378 bp, Heterodera glycines
  Promoter: Source sequence=SeqID_10191; Location=1774..2151; Strand=-; Gene=SeqID_73304
ttattattctgtctgattttaattctaattgccctaattattccaattgaaacagaagagaaaaaactacaacaaaagtcatttgatgaaatatttggagaaaaatgggaagaaaaagaagaagaaaaacgaaatgaactcaaaaaaagagaaataattggaaaatattataaaataaaagagaaaataaaggaaaaagggagaaaatattcagcaaaagaatgggataaaatttatggaaaaatagcgaaaaaaatggggacaaatcgcacatatatccaacaatggatcaaagaatttggtcttcaaaaaaagaaaagttataaatcaaaaagtgatgaacgaaaacttgaaattgttcagaaatttattgaaatg

SEQ ID NO: 97988 - DNA, 162 bp, Heterodera glycines
  Promoter: Source sequence=SeqID_17288; Location=2986..3147; Strand=-; Gene=SeqID_81767
aaatctgaccaactcttgacccattacgacccggaaaaggacatcattgtatctgccgatgcctctgattatggaatcggagcagtgatctcccatcgttttccggatggcagcttgaatgcaattgcacatgcttcttgctctttgtcgcctgccgaaatg

SEQ ID NO: 97989 - DNA, 324 bp, Heterodera glycines
  Promoter: Source sequence=SeqID_15190; Location=1355..1678; Strand=-; Gene=SeqID_79388
ggatgtttaatttggatgcttcttgcagttggcgaaatgtcatttttgggtgggttggcgaaatgtcgtcgtgccgaattaattcattcttgctactattgtattcgaaaaattttctgattttcaactgttttttctaatgaaataattagaaagaatagaaaatgctacaattaataaagaaacaaatttttggcggaaacacaaaaatatggttgtgtttgtggcgctatacccttcctccgcttcttttttttcatttttaataggattggttaaatttggctaattccatttgagggagttcgagaagaggagctgatg

SEQ ID NO: 97990 - DNA, 189 bp, Heterodera glycines
  misc_feature (31)..(31): n is a, c, g, or t
  Promoter: Source sequence=SeqID_5773; Location=1..189; Strand=+; Gene= SeqID_59181
gtccatattatataattaaatagccttaatntagtttataaactcattaaattataaaataaaaattcgttagaaaaaagagtgaaacaaattttggtaaaatataatgtgagttatgaattctcttttatatgcaaccatgcgaaaacggccacgcggaaaacgtcctggcccggccgacgaggcatg

SEQ ID NO: 97991 - DNA, 53 bp, Heterodera glycines
  Promoter: Source sequence=SeqID_27346; Location=1566..1618; Strand=-; Gene=SeqID_58040
tgacagcgaaaacgaagggaattctgagcaacgtgaacaaaacgccgaaaatg

SEQ ID NO: 97992 - DNA, 609 bp, Heterodera glycines
  Promoter: Source sequence=SeqID_4291; Location=1..609; Strand=+; Gene= SeqID_53926
attaatcatctcaccaaaaagttgatttatagtttacacaaaattaggattttcttgaatttttaagtcttataaatcatagctttttggtgagatgattcagcgcttagcttctgcttaatgattacttctaatctcccaataattaagaaaaaattcatccaggtttcattgcctttttatcgaccgaaaattttatttttcggcattttcttctgtaaaactcaaactttgcctcaataagtcaaaaaaatcacgaacaaaagtcgcaaaaactcaaaaaagtcataaaaatccgaaaaagtgtaaaaaaaagtcaaaaaaagtctcaaaaaaatgcatgttagaagtagggatcggatttttagtggcaaaaatcccaaaataattaactaaatagtggcaaaaatagtggcgaaaaagttccaaataattacttttaatagaaaacttttaagctctgatggggttttgaacaagcccaatttcgagaaagaattactcgattgagtaaatttcggcataaatttgaagagaaaaaaaggattttcgatgagagacctattttgattttggcagcaaatgtcgggacgcaaatgtccgaaaatg

SEQ ID NO: 97993 - DNA, 183 bp, Heterodera glycines
  Promoter: Source sequence=SeqID_18805; Location=446..628; Strand=-; Gene=SeqID_83484
tcagtgcgacggtcgagttgaacccacggctgatgcaacggaatttggcatttattatgccattcttgaaaagcgatgttggtaaattcaacaaattatcacttattcaccccttaattaatttgcattttaactttttgtcaattaatttgcttttttatttccattttttagcccccaatg

SEQ ID NO: 97994 - DNA, 512 bp, Heterodera glycines
  Promoter: Source sequence=SeqID_2311; Location=1114..1625; Strand=-; Gene=SeqID_79034
ggttgttgtgatagaacaactggaattttggggaaaggtgtgactcgtccgtcgggcaatgagttataccgtatcaaaaacctatactgtaattgacggtaaattactgtaatgcacaacccggtttttaaatgttcagcttcctaaatcatcgtgctaatcagccagtgtgtgatattagaagcctattaatgggcccaaaatacgctagactagactctaacaaaacaatactttatactctctgcgtttgtattttaggacttggtctgggcctggatctaggcctggacttttgctggatccagatgtccaagtcctggccaatttttgcaatcctggacctggatttttgtccagaaatccaagtccaggtccaggcttttttcaaaatgccaagctttactttattctaattcctcacattttgtggtggcgagaacgagttgttgttgctgctattgttggcaccagccgtggtcgtcgccgtgggcaacggcggctgagaaatg

SEQ ID NO: 97995 - DNA, 1003 bp, Heterodera glycines
  Promoter: Source sequence=SeqID_11678; Location=554..1556; Strand=-; Gene=SeqID_75145
cgcaagtgagattttgtgctaattttaagcacttttatatgtgcgtaggagcactgtaacttcgtctttcacgtagcacgcagcactgtaccttttcgctatataaaagcgcgcaaatatgatgcaaaacttcattttaatcacaagaattttttgtaaaataaaaatgaatacttttaataatcaacaaaatgcgccagcagagcaaaacaacaacaacaacaacaccagcaacaaccacagcgacaatgctaacgctcaattatggaaacttttacgaaaaaaatatattctaactttcaatctttgtcattgctgctcacaaacattgttcaattcgacaaaaaacaacagcggcggtaattatgcttttgagttcgatcccttaggaggggtaaaagtgcaatttcacatgtgcaggggatgtgtttcacttaatatgagactgagcgacatgaactgtgcaaataaaaacaacgattacaacaacaacaatcgctttagaagcagcttcactaataataatggttcaacttttggcaatttcggaaacaattgcacgaactttgatgctgggaataaccaaagcaacccatacaacaatgctaatgaaagtgggcaaatgttcaacaatgccggaaggatggattgatcacaaactttaatcaattttgcaaaatagttcatgtatttgaatcatcatttcataataaatttaaatattaatcattataaatttctttaatcccctttggtgtttgaatacacccgtaaatgtgacaagcgcatcgccggtagcggcatgatgcattagtttctcttttgtgccgatgcagaaatgccgcacatcccattgttatttgaatttgaccccgttcgcatcggtcaccgaagcgtcggaccttcgctacacagatggccacgatcccgcctcatacaaaagggcccatgggaaagtcgccctctttttttcaccattcatttaccctgcaaaccaaaaatg

SEQ ID NO: 97996 - DNA, 146 bp, Heterodera glycines
  Promoter: Source sequence=SeqID_21013; Location=1509..1654; Strand=-; Gene=SeqID_51591
ttgaagcagaacgaatgagacatagctgacaaattgctggggcttttatactcccggaaaattagaccacgcccactttgcaaaggtatttaagccgaatttttcacgagcaatcaaatcagtcttgcgaaacatcatcaaaaatg

SEQ ID NO: 97997 - DNA, 498 bp, Heterodera glycines
  Promoter: Source sequence=SeqID_1299; Location=5072..5569; Strand=-; Gene=SeqID_72002
tgcctgcaattagcgctacctagaagatgtatattaatgtctaattgaaaaaaataactgataaagtgcgggagaggaatgtaaaacgttatgaatttatacgaagtcaagttgtccatccagttgtaagtgtattaggctgcgagatcgcgaaaatgttaatgagcaacaaataaatgagcggatttgaagacggaatgaaaattttctatgtgacttcatttctctctaccccttcgttaattttactacacactactcgattggtaaaccaatgtacatgtgctgaatgaataagtcgagttaaatacccggaagataaacactaccccttgacaatactcaaagtttgggtgatttctttagaaaattcgatattctgttttgcccgtcaaagtgaatggtaggctctgattctctttatttatgaagtgcaccaaaaacaatcaaaaaggcaggatagacgtaaatacatatgcaaacacaaacaatgagatg

SEQ ID NO: 97998 - DNA, 433 bp, Heterodera glycines
  Promoter: Source sequence=SeqID_3708; Location=1362..1794; Strand=-; Gene=SeqID_51565
ttttgtttttcaccccccccccccccctccccactcaaatggtggagggctttctttcaaaattaggggggaggggaagttccaattttttggggggggaggattttattccacgatatacggtaatatatatgatcggtgaccagcgatcagtgatcagagtgacctgtaataacaatgtaaatgtgttcaattaattttccattgctaagctcataaatccggcggcgggtggaaggtttgtccgccgaaaaattagcttcaattttggctgttcttttgtcaattcaccaaatgaatgaatggtgctcaccaatatattttttgatttgtgggaggaatttctatttttattgaatctttttaaaaaattccctcaaaatttgctttttaattttatttttagatttttgctcaatttttcataaaaatg

SEQ ID NO: 97999 - DNA, 350 bp, Heterodera glycines
  Promoter: Source sequence=SeqID_2934; Location=812..1161; Strand=-; Gene=SeqID_82416
tctgtgtgatttggggggaaagttggagggaaaatggacaaaaaaaacccctggaacttgttttatggcaaaaaaaaatttaaattttccaaaaagaaggggggggggcaaactacactgttacacttacccaaagttggttaaaaaaaattttaaaaattcctgactggataaaccaatttacaaaattgtaaaaatgccaaaaaaataaacatttccaaacaaccaatcaaagagccatggcgatttgtacctttcccactcaaaaccacaatacctcgcgctggtcgagcagttcacggaccagcaacgatttctgcaccggcacaaacgtgagcggagcgaacatg

SEQ ID NO: 98000 - DNA, 159 bp, Heterodera glycines
  Promoter: Source sequence=SeqID_2072; Location=3063..3221; Strand=-; Gene=SeqID_77669
aaagaatgcaaaaatagataccctaattatcaattttattggaaaataaattataccttggtctttgtgcttctgtttgaatgtttttctgcataacaaatccttcctttgccttaattttgctgatcattttttcttttttgattccaattttcaatg

SEQ ID NO: 98001 - DNA, 225 bp, Heterodera glycines
  Promoter: Source sequence=SeqID_38776; Location=919..1143; Strand=+; Gene=SeqID_67497
tgaccccgttttttagcttttccaaagaatcgctgaatttttttcaacaaattaattttgaaaaaaatattttccggcggtgccaatcgccgcggcggatgagtgaattccaataaatttacaaaaaatttatccaaaaagggatcattgttagaattaaaaatctggggggttctaattttttaggtgtggaaaaacctgggcacgataaatttacaaaaaatg

SEQ ID NO: 98002 - DNA, 128 bp, Heterodera glycines
  Promoter: Source sequence=SeqID_9339; Location=681..808; Strand=-; Gene=SeqID_71056
agagagagagagagagagagagagagagagagagagagagagagagagagagagagagagagagagagagagagagagagagagagagagagagagagagagaggagaagagaagagaagaagagatg

SEQ ID NO: 98003 - DNA, 69 bp, Heterodera glycines
  Promoter: Source sequence=SeqID_13427; Location=3468..3536; Strand=-; Gene=SeqID_77318
cgtaacacttgccattagccttctctaaacaaatctcccatttcaagtgcttctgtgttggcggcaatg

SEQ ID NO: 98004 - DNA, 553 bp, Heterodera glycines
  Promoter: Source sequence=SeqID_3506; Location=774..1326; Strand=-; Gene=SeqID_84957
ttttattagtttactgaatacttgcaaaatgttttgtctttgtaaatattatgtagattactcgtttttgaagctattagatcctcgcagaattacatttaaagtaaggcaatttgtttcaacttgagatttatcatttcaaaataatgaatgagctcagtacatgcacctacatattttgttgggttttcttttcacttccctttggccgagctaacatttttccctgtccacccaaacacgttaatgttagccgaaaaagaaagaaaaatcaattcaattccttgcgtggtgaagataagataaaagcaaatgtgtacagaccagatgtttatgcattttttatgtgctaaaacaaaaaggaaaattattttcgctttctttttttttacatttaacacacaatatgtgattgttatggtaaaaacccaactcgtactattttagagtatctttttttctctgttctgttatgtatgcatatgcatagcttatcgcttatttttttagtttatctacctatcttttttttttgtttaattcacacacaatg

SEQ ID NO: 98005 - DNA, 168 bp, Heterodera glycines
  Promoter: Source sequence=SeqID_34183; Location=733..900; Strand=-; Gene=SeqID_64036
gtcttggatttgtcaaataaatccaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 98006 - DNA, 1003 bp, Heterodera glycines
  Promoter: Source sequence=SeqID_6402; Location=1259..2261; Strand=-; Gene=SeqID_61426
caaaaacgggggcccaaacgcgggggcccaaaaactggggcccaaacgcccccgactctttcgcgacagtgcaaaaatgggcacttcgcgaaacgtgcaaatttaaccgaaagagaccgggcctcatcagtacggtgtctctttgggttaatttatttaaattaattattatttgtgtttcggccctaaaccgtatacacacaaagccacagcaatcaagcaaagcaaataaattttattaagcaaactaaatattttatattggtttttaatttaatcttttaactaattatatttgaatataattaatcaacataatttgttagtagcattttttaaatttattttgagtttgcaaggcttcaacatttgcattattctgtgtagaatcagttacacaaatacaagtctaaacgttttccattggctaaacaatatagcaagataaggggaaggttttcttggcctttgtggatttctttctgcttcccgtttgcatcctgaaaacagatcttatgaacgtggtgatgttttgttagtcgttcaaaaagatcgaagatcattagacaagctcgaaaaagtcctatttctcggaatttgacgtgtttgggtccccgtgcaaggtttttaggttaattttctttggcattttcaaatattagacaaaaattctgtaagaaagaagatgccttgctcaatacaatggaattaattgagtgccaaattaataattcaataaaaatgtatcattttaaggttattacacgaatttttggtgattttagggggacagcggtggaccgcttatgcaacagacacaaaatggtaacatttggacacaggtgagaaatcagacccaactagtacatactgtctaaaactggcaacaaattgagttatacattctttttactcctaataatttgaaaatcctagttacctaaaccaaaatataaaattaaactcacatttttgaaaattaaagtaatggaatgccaaaatg

SEQ ID NO: 98007 - DNA, 131 bp, Heterodera glycines
  Promoter: Source sequence=SeqID_36331; Location=666..796; Strand=-; Gene=SeqID_65671
aatgcggtaaccaaaaattgcaagacatttaaaatgaacacggaaaaatgacggacgactatttttaagacgtcgtgccgaccgagggcattttgcccaaaagccttttatacaagccggccctgaacatg

SEQ ID NO: 98008 - DNA, 597 bp, Heterodera glycines
  Promoter: Source sequence=SeqID_42029; Location=393..989; Strand=-; Gene=SeqID_70037
aaaaaattattcgaatttctccaattttgttccataatttcccgaaagttattcggtatcataatgccaaaacaaaacgaaatcgtttaaaatattctttctggacttgacttgatttcttgatatcgaagctgttttctacactatttctaaaacggttataccaaaccctcagatttttgaatccggttttcagaaaaaatgccttgtggtgaaaacaatatttcacatttcactccataactttgtgagttcggcacggatcgagaccgggataagaccattggaaagagcagctcgagctctacatgaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 98009 - DNA, 103 bp, Heterodera glycines
  Promoter: Source sequence=SeqID_22662; Location=636..738; Strand=-; Gene=SeqID_53343
aagtgctttgaaatgttcaattatttcgcgtactgtttactgtacaaatatttcatactttaattttcctcaatcttattttacgatttttattgaaaaaatg

SEQ ID NO: 98010 - DNA, 1003 bp, Heterodera glycines
  misc_feature (79)..(79): n is a, c, g, or t
  Promoter: Source sequence=SeqID_13094; Location=579..1581; Strand=-; Gene=SeqID_76883
ttttaaatctagaaaataagtgattcaaggacttgaagccatgaatcatagatttgacaaaattatataggtttttatntcatccggtaaaaacggttatcgtacccggaaaaaacaaatttaaattactcttggtaaaatttatgggtttaaaaaattccatagaaataatttgttgtagagtttttttatgtaaaatggattttgaagggtctccgaattggttcattttcaaaaacgaaaaaatcgcacaaaatcatgaaaaatgtgataataaaaaagggaaataatcaataagacacatccattaattaaaaaaaataattttggaagttaattagcactcaaaaatttgtagcgtttttaattgattattatggggttgctaaatactaggcaaaataatcaattgatttacaggaaaagttatcgtgatccaaatgcaattgtcctaatggtgtcgaacaaattcagtcgttggcacgaatttatccaaattgacctattaatagaagaaatatcaaaaaagaaaatcaaaatcatttatttgagtctgtttgaatgcgctgaaaagtaaaaattgttttaattatttttgggttggcactttaaaattgccaaaaagcaaaagaatgaaaatgcgaaaaagttgtgaaaagcttaaatacacaaggatatttcaaggattttatgcataaaaaatcaaattgaatgaaaaaaaatttaaaaaacataaattttaaagaaaaatttcaaaaatcctaaaaatatattttttaaaattgtttttaaaaaattgttttttttttaatttttatttttttttgcgtttgaatttaacactaccaaaaaaaaactcacaagaaaaaaacattaattgaattaataaatcaaaaaaaaaacttttttaaagcaatatattggagaaattttaaaatgtattttttttaaaattttatttctgggccttagaaagatactgtaatttggacaataaaacatg

SEQ ID NO: 98011 - DNA, 984 bp, Heterodera glycines
  Promoter: Source sequence=SeqID_5186; Location=690..1673; Strand=-; Gene=SeqID_57202
ttcaacgccaattatcgtgcagttttttcaatgtaaaatttctaaggtcttccaacgcagccatattatattaaatgctaataacacacaaatcaatgcaaaacaactattttaatgcaattgaaccgattttagtgaataaatgtgaattattaggaaattgtattttcgaatttttgttcgaatccgggttcgaggttcgaaatgggtcaaaacggatgtcagattcgaattctacggccctaaaaaccctaaagacaattttatctctgaaaaatttttgaaaattttttttcaaaaaaggggggcaccatcggcagtattaccgccaagtcaattaattattggcatcacacaaataaaagatgacatttgttcaaatcgtccgccgaatttttgggtttccgctgaaccgccgccgccgtctctccaattgggcatcgcttcacagccaatcactgttggaagacgaaaaacgaacgaatttaatattgtaactgacagaggaaggagaaatggtggcacgcagaaatgcctaaacaaataatgggacaaatttcacggacaaaataattgaaacgggtcgaacaatttgaggccgagttgaggacgaccaaaaaatgggaaaatgtccttccaatccaaaggtcgttgcaaacccatctgaaaaccgaaaaaaatttaatcattaaatttcattcgcaaatccaacgattgctgcttatattcaccaattttgaatgttggaaactgtagaatattcaaccttttatagcttttgagagatgcaaatgcaaattgaatatcaaaccaacttcatcaaaaatgtgatttcagcaatatataaatagacaaattttaggcatcacttcatttctacaaatttcttctcttttgcctatccccttccaattcctccgcattttccgttttctttttttagccctattttccccttccaattgtgctccccagtccattatg

SEQ ID NO: 98012 - DNA, 458 bp, Heterodera glycines
  Promoter: Source sequence=SeqID_29452; Location=858..1315; Strand=-; Gene=SeqID_59953
ccttaaagacatattttttgaagattttgggtgaaaaaatttttccactcaaaaatcctgtccaccccctttggtcccgaatcccaaaatcacttttatttttataacttttttcaaaaaagtgataaaaatgctaaataaaatttatataatagagcaaaaaattgcgcattttatcaatatttttgtataccttagcacattgtttggagtgagttatgaatttttatgtgaaaaattgaaattttcaagtttttcaggaataagttttattgtttgcaagatagaaatcccaaataaatctcataaaattctccctatttttctctattttttaaactttaaatggactgaattggacctttttgatgggagttatgaattttcaaaatgtagcttaaattttcaagggccaaaaaattctaaaatttcaaaaatttttaaaaaattccaaaatg

SEQ ID NO: 98013 - DNA, 495 bp, Heterodera glycines
  Promoter: Source sequence=SeqID_6830; Location=436..930; Strand=-; Gene=SeqID_63016
ttcttaatagttagaatattaataaaaaatcaaaatgcattaaatgaatttatttaatatctttttgtttttaatctttttttattattattcttttttctctaaacatctttgccaacagtaaaattgtcacgtatttcatagcattaaatcgatttttcactaagctttttataaaaagattgtcgtaaataggattaatattaataaagctcggtattcaaatcgcactcaaatttcaatttcccccccccgggggcgcctatcggcaccgccggaccccgccccctcccactgttccaaaaaagttttttgaaaaaacattgccacaaaaacagcgatttaaaagcaaaaaatttaaaagattgtaaatttattttaaaaaaatacagaatttacaaattgttgagcctattaatcccaaaaaccagccttttttgttgaaaaattaatataaaaatggaaaaatgaattatatttaaagaaaaaaaaatg

SEQ ID NO: 98014 - DNA, 149 bp, Heterodera glycines
  misc_feature (26)..(26): n is a, c, g, or t
  Promoter: Source sequence=SeqID_17357; Location=861..1009; Strand=-; Gene=SeqID_81841
atttttggtataattggccatttttntggatccgtcttcttgaacctaaattcgttgtgctcgcggcgatgccagtgataggtcgtcatacaggccaaaatttttccaacatggtttcaaaagtttgtttttgggtaaagcttaaaatg

SEQ ID NO: 98015 - DNA, 741 bp, Heterodera glycines
  Promoter: Source sequence=SeqID_265; Location=599..1339; Strand=+; Gene=SeqID_80656
taacttttttctcacttggtcaacttggtcaataactacattcttgatatcaatcgaaagcttaaagtctttagaatattttgtagacctaaattctggaagaaaagcaacagaaacaaaataattcttgaatgtactcgaaaaagctacgttacgagttttctcgttgtaattcttctcttatagccaagtatttgctttttttacatttaaattcctgggactttaagctttagtttgataccaagaatgtaggcattgaccaaataagaaaaacatggccaaaaaactgcacattggatgcctaaagtctacatagagcaattgcttctcttttccttttgttcttgccgcctttgtccaaattttctatttgcatattattattatggcattagcacaattctcgatgtttgtccaactttcgggactatcgatgtcaatttttcctcaggtgaatttgtggctttggactttgcattgggtcaaaaatgagttggcgcggagaagtgagttaaatgatcagcaaaaatgctgatcagtgaatcaaatggcggagaacagatgaaacacattaatgagggaagtgcgcagccagcaaaataaaggcacaaattgttggcattttgttacaaatccatttcgaaaatttggatcaattaattgaacggaaagagtcatttcggcaaacattgcaaggtaattaaggcgcgccaacgattcgtcaactcagccaaaatg

SEQ ID NO: 98016 - DNA, 315 bp, Heterodera glycines
  Promoter: Source sequence=SeqID_44858; Location=502..816; Strand=-; Gene=SeqID_72270
gaaaaaacaagaaaatacctaaattcatgtcccgggattcgaaattggtacaaaaaatatcagatttatgttcagcgactccgaaaaccattagaaataaatcacatttgcggttaataatattaccccaaccccagttacatagcttaaattagtttaaaatatacaacaccagaaaagcaaaacagacaaaatgaaaagccatcctaattttccaattaatacaaaatgaaaagccatcctaattttccaattaatacaaaatgaaaagccatcctaattttccaattaatattttcataaagcattaaaatg

SEQ ID NO: 98017 - DNA, 133 bp, Heterodera glycines
  misc_feature (11)..(11): n is a, c, g, or t
  Promoter: Source sequence=SeqID_1038; Location=4345..4477; Strand=-; Gene=SeqID_66720
tttaatctttnaaaaatattattttttaaaattattatttaataattttggaatgggagtataaaccaaaataaaatcagtatagaaaaattcagaatttttttctctatcgatatgcaaaaattaggaaatg

SEQ ID NO: 98018 - DNA, 418 bp, Heterodera glycines
  Promoter: Source sequence=SeqID_20302; Location=985..1402; Strand=-; Gene=SeqID_50810
ggtttgggggcagggcgtaaccataattaacgacgtgcttccctaatagttttcaatttaattggtgcgtttttccaaggggtcgaacttcgacgagcggaccccgcgtatccgtccgaattgctttgtcgcaccagggacaatttgttgcgacaattcgacatcgacgacggggacgtactcgcctttgtttagtggttcattacgagtgacagttctcggcaaaaaacaatcccaaaatgtgattcactttaaaattgttttctcatcccttttgtttctttccgatcctttcattttttaaatggataaaatattttaaatgataatgtagggtttttcgataaatggtcgttttaaaaattaaaatattttagaaaaatttttgtctatcgctaattggtgactcaaaaaaatg

SEQ ID NO: 98019 - DNA, 883 bp, Heterodera glycines
  misc_feature (851)..(851): n is a, c, g, or t
  Promoter: Source sequence=SeqID_5587; Location=1..883; Strand=+; Gene= SeqID_58564
tatgtcccctctcttaacagttcatttccaggtaattacctttatgctgtttgggtaggggtcggaattgacaaaagtactttcatgttgaggatcatatcttctaacgcattttatttcttaaatttaagtgcgaagtttgcggacaaattttgtcaattcattttttgtacaatgcgctgcttcacctttctctgaccatcttttatgtggctcctctttttcaaaggcttttatttgggatttacaggtgttcataacgtttgtaattgtttacatttgttcagttttaggaggatcgcaaatattttcacgacatttcgtctcattatggaaaaaatcatgcacataaaaggaataaaaaaatgttaccaaatgcaaaatttgtgttggatggacacgataaagaagtgaattgggagacaacggaatggtacttttctgactatttaggttgaatgtgttcaatggagttcaaaagggaaatatttgataacaatggacagtgaaattgtccgaatttggtcgccatggaccggcagaaccgaaaatggatacgctgaacaagtcccacccccctctattcattgacataattatttttttttgaataattaaggtcgttttgaaccatcgtccggtcaaatttacctacccaaaaatgtacaccgacgtcgaagacgaaaggccctcgtcaagccaaacactcagccaacggacatttggtagcgaaaatcgcactgacaatgagtcgcgttgttccaatgacaatggcatccaattgctgattgaacactcccctacgcggaacgtctttaatgccctcgacaatctcccgtcactatacgccnaaacaagggaagaaacctcaaaagcagaaatg

SEQ ID NO: 98020 - DNA, 180 bp, Heterodera glycines
  Promoter: Source sequence=SeqID_2251; Location=371..550; Strand=+; Gene=SeqID_78728
ttggcactttaggagagagattgacatagtctccacagcggctaccgttacttgctgttggcggtggatgttctatcgaggcgaatgttcggcgcgcccgtaaagagtaagcgccctgtggacatgaaaagggcttttgaagagctatttgagcaaatgccaagggtgccagacacaatg

SEQ ID NO: 98021 - DNA, 74 bp, Heterodera glycines
  Promoter: Source sequence=SeqID_11315; Location=509..582; Strand=+; Gene=SeqID_74694
taattgcgaggtgtatggtgtcaacaatcttcaaaagtatgcgctttgttaacaggtttacgctaaaatagatg

SEQ ID NO: 98022 - DNA, 1003 bp, Heterodera glycines
  Promoter: Source sequence=SeqID_28800; Location=20..1022; Strand=+; Gene=SeqID_59376
catccatcccaactctccggcgagcggcccgccgcccgcgcgcgtaggggcgagcttccatcgagtgaaacccctccaccagcaacgagacgaaccgtgccgaatttgtgcgttggttggcacaagcgacgggagggggcggggaaaacggttgtcattagagactgtacaggccctgagggcatttaccgagccgcccgtccctgtcccgttttttggacaaaccacctaggccaggccgccccattgggaaagtctcggatttttgggcgtttgtctcggatattgggaaagtctcggctttttggacgtttgtctcggatttcgtctaccgggctgcccgtccctgtcccgtttttgggcaaaatcaccgggaccaggctgccctgtaaaacgggattttttaccggacagcctagccacgatcaattttctaagccgggcccggtactttcaaattccggtatttatttgtgatgcatgctcgagagtcccgacgttgggaaagtgtcggctttttggggcgtttgtctcgaatttcgtcttggctaggcaaacttttggcctcaaaaccaaccaaaccaattgtcaatgtaattttgcatgaatttttgaatgcatgaataagaaagcttttttggaaaaagtttagctcttgagaagattctcgccttttcagtggtctcaatgttcaagaccattcttaacacagtattggcaattttttaagtcatccaaaagttcataaatataattttacatgaatttttagaatgtaagaaattttttgaaaaaaacgtcgtgaatttaataaattttatacattttttaaagatctgtcttctatagattagtctcggtcaagagtatcggcaatgttttttcccttttttcctccacgcgatgggaatttgtgaaagttgtttagactgtgctgaagcccatgcagaaatattgtccacgcattcacatcgtccgctctgacaacatttattcacagatg

SEQ ID NO: 98023 - DNA, 272 bp, Heterodera glycines
  Promoter: Source sequence=SeqID_7176; Location=1929..2200; Strand=-; Gene=SeqID_64051
ttgtaattattttgacaatgtccctctactctgtgccttttagcgagtcattttccaggtgtcaatgattaaatagcatcacatcctatttgaatatgacagtgattggacagtggcgagacggggggggggggggtcattggattgatgattaatgggcgcgccgtatttgactgctcggtggggtggtggagattggcattgagaagccaatctgggctcatttccgttttcttcctcattcttattaaatattttgcttgtgaattatg

SEQ ID NO: 98024 - DNA, 54 bp, Heterodera glycines
  Promoter: Source sequence=SeqID_6077; Location=1660..1713; Strand=-; Gene=SeqID_60229
ttttgtgctttatctgctgtttatatcccccaatccccgaatagggccaaaatg

SEQ ID NO: 98025 - DNA, 401 bp, Heterodera glycines
  misc_feature (64)..(64): n is a, c, g, or t
  Promoter: Source sequence=SeqID_13886; Location=3130..3530; Strand=-; Gene=SeqID_77832
tatttataaatcgtttcacattttacgaatttttaattttatatttgctgtttaattatttttntagtaagattaaaaaataatgctgttattttgtaaaaataaaaatggtcatcaataataatcaatatgatgtggcaaatacttgtcataaattggatgaaattaattggttacagaatattacgaaaaaatatatgaaaaatggctatataattaattacttttaataaaaaattgcagtttataatgattaaaaaataagtagccctgcctttatatgagacgaagcttagttttgctcaggatattttttccttcgaaatttttttcaaaactcattttttcattttatattttaaattaaataaggtaaaatataaaaaaaatagtcttaaatg

SEQ ID NO: 98026 - DNA, 479 bp, Heterodera glycines
  Promoter: Source sequence=SeqID_5523; Location=437..915; Strand=+; Gene=SeqID_58330
tcggaattccgttcgctttctgttcaattttaatgcctttgtttgtgtccagcaaaatttttgcaacggttttctctttttcaccggtacataaaacggaaacaaaaataaaaaataataaaatgcaaattttaaaaaacattttctttcgaaaattgccaaaatgaaaattaaagcagcctttttacgtttgattattatgttttatgaaaaataggtaagaatttaatcattattatgtaaatttgaaataattatgttaatttttgttttgtcaatattgatttgcttattgaatttttccaacataaaaaatttataataataataataataaataaaaataataaaagcaaaattgttcattgaaatatcaaaaatgtaaaaatgaaattgacgcacaaaaagagttaaaaaataaaaataaaaataaataataataataattgtgattacaattataacttttcacagggatg

SEQ ID NO: 98027 - DNA, 261 bp, Heterodera glycines
  Promoter: Source sequence=SeqID_844; Location=1598..1858; Strand=+; Gene=SeqID_62626
tgattcgttgtgctgttcattttccccaattgactttctccgttttgcctttggcaatgaatgccgtcttttacattttcagcgattgaacggcggaatttgcttatctgtccaccgcaatctcttctgccctcggcgcccgccatttaacgaggttaacctttgaacagatgtttagaggaaaagtggtcgaagtgatcacaaaaagggcgacaaaaaatgcgagtggcgggggggggggggtaattaaacggccaaatg

SEQ ID NO: 98028 - DNA, 1003 bp, Heterodera glycines
  Promoter: Source sequence=SeqID_2169; Location=1228..2230; Strand=-; Gene=SeqID_78229
atcaaaaaaagcaagaccaaaataaataaattagaaaatttagcgaaaaaatgcatgaaggattaaattgatctggaagctgagcttgaaatattgagaatttccatccagcagtccccacaaactaatcttttaccatgagcaatttcttcgcctggatatgcatttgatatttctatttggaggaagaagataatagtgtaaatgaggcaatgcggttgaagacacatcaaaaataagtaattacaacgttaaaaataggtaatttaaaacaataaaaatgattattattattattttaactttaaattatataatatttatggttttataatatttaaaaatgcatttttatgaatagtagggtgaagtcattgtaaatattggcaatctcttctagaagatgaaacgcatgccatacactaagataatcaatgttttaatgagatataagccttattttatttctcacgcataaatgttttataaaatatattatgtaaaaataataaaaattcacgatgaatatggagatttccgtaatataaaaaaggtatgaaaatttttttgtttatttttttgtcaaaatctaaaatatttttagcgttttaagttttaaaataaaaactccggaaaatttttaatttacaaaagtttcgaatagcttttaataaattttgttgctaaaaattgttaaaaataaagaaaaaaatttttatatatatataaaagtttcacaaattgcatttctgttttttggccgccaagtgcacgccacgcacaatggtcatcaaggaaaaatggtgctatgtcgaccgacgaaaagtgcaaaaaccaagtccttgatttctgcatatgatttttcatctaattattagattaaagttaaagaaattacaaaaattatattatatttgaattcaaaaagttactatatatattatatatagtaaaattatcctatgcctagcctaaaactcagccatagcctaagcctagcatg

SEQ ID NO: 98029 - DNA, 83 bp, Heterodera glycines
  Promoter: Source sequence=SeqID_19841; Location=1..83; Strand=+; Gene= SeqID_84595
agaacttcaaagggtggctgtgattcgccgacgccggcggttgtccctgtgaaaactgcaaaggtggaaatcttaaagaaatg

SEQ ID NO: 98030 - DNA, 101 bp, Heterodera glycines
  Promoter: Source sequence=SeqID_26621; Location=1..101; Strand=+; Gene=SeqID_57377
ttttcatttttttcataaatttcaaaaaattttgcgaaaactttaaaatttaaatattaattatttttttttgaaaattcatttttttagggggcggaatg

SEQ ID NO: 98031 - DNA, 933 bp, Heterodera glycines
  Promoter: Source sequence=SeqID_502; Location=2798..3730; Strand=-; Gene=SeqID_54649
ttttttatgtgaatggtttccagcaacaacatatagacgcggcacattcattttcgagtggtgatataatcggtctcggcgttcatttgacaactcttgaaattatcttcacaaaaaatggacaccgtttgggtttttttaatttaaacaaataaaaataatcagggatcatttttatgtaagaaaaattgcgaaatatgtatgaaaaacttctgaaatatgtacgaaatatgtacaaaaatccagaaatatgtacaaaaatatgtaaataaaaatgttttaaatgtgatttttttggaaaaatattttttctaaagggtaaaacaggcacaaattgccataaaaatgacctaaaagggcttagaatcaccttttactattttaaaaataaatttttgatattccatttaaaaaaaaattatttttttggagcacattttcaaaaaaaaattttacttttcacaaataattctataaattctgaaaatttttgaaaaaattgcgaaattttggatttttggtggcatttaataaaaaattctcaaaaaatgcaaaattatgtaaataaaaggcccgatttttgttcgcaaacacaaaaaaagtgtttttcctgctaattatgctatggagaatccaggggaaaaacatgtatttacataaaaaatgatccctgataataaaactcgaattgatttgtaagattcaaattcttgaaagatcgattttgtttttgaaccggttcatcaaaaaaaatacatttaaaatagagacgatgcgatcggatatcgtctgattactatcgaactttttatcgtttttttgttgattttttcgcttttttgatcatattgttcaaatcacttctcggctctctaataaaaagcaaaaataataaaaaacataattgtttaatttacagttaccgccaatatg

SEQ ID NO: 98032 - DNA, 125 bp, Heterodera glycines
  Promoter: Source sequence=SeqID_38587; Location=948..1072; Strand=+; Gene=SeqID_67357
agtttgagaataggttaaggacatttcgtctccaagtcctctaatcattcgcttttccgagtatacctgcttaacgagctccagctatcctgggggaaacttcggagggaaccagatactagatg

SEQ ID NO: 98033 - DNA, 257 bp, Heterodera glycines
  Promoter: Source sequence=SeqID_10408; Location=2397..2653; Strand=-; Gene=SeqID_73602
actgcaaaaatgaaaaatgagtaaattttaaatagcatatttcctaaaatagagccgacccccctaaattagagtccccgtgaaatagagccccagggggtttgaaaaattgagtcctacccccaccaagctttatcccccattaaaggggattgaacatttgtgccccctgttatccaattaatttctcgctgtttatgctgtcttggatcgaaaaacgtggcatttgaaacaaattttgggcaacacccaaaatg

SEQ ID NO: 98034 - DNA, 65 bp, Heterodera glycines
  Promoter: Source sequence=SeqID_15565; Location=945..1009; Strand=-; Gene=SeqID_79849
aaaatccgattatatttaaactcaagtatttatttttaatttcagctagaaatgagaacccaatg

SEQ ID NO: 98035 - DNA, 514 bp, Heterodera glycines
  Promoter: Source sequence=SeqID_28904; Location=907..1420; Strand=-; Gene=SeqID_59472
ccagcccgaattcacttcagtctatcattggatgtaagtggagagttgaagaaaacgcaacaaaataaaatataaggatgtaggatacgatttgcagcaccgcggcagtctgaggttcgcagtatcctccaaggcggtaatgaacaatagttcgttggagaaggcatttgtagtaagtttttgtagtatattttaatgattttcaacttatttgagctggttgtgaagaaatgagcatttgggagttattcagtgattactgcgttggaaaaggtttatatactaagttgacttgcacccgtaatgatgcagaggtaactaaaaaggaagaggtcaccgaaagtggtgtggtagaacactttcgattacgacgcaattgtacatcataatttcgcgtgcttcgtgtggatggttcgcgtaatatatgggttgtcaatgataagcaagatccccaacctacatgggatccattttaaaagtcaatcttttttgaaaggcgttggctgagcacatg

SEQ ID NO: 98036 - DNA, 534 bp, Heterodera glycines
  Promoter: Source sequence=SeqID_9445; Location=1879..2412; Strand=-; Gene=SeqID_71451
catttgtcagttacaaatagagttgtacgggaccggggaattttgaaaaaaaccggggacccgggacttttcgggttgaaaaactgggacccttttggctgggaaaatcgggaaaaaaccgggaaatagtcccggtcaaagccgggacttgggtactcagttgtactttttttaagtgccagtctcggtcccgtacaactctagttacaaattattatttattattattattattttattattttttacttcctcattttccaaataaatacaacataaatctaaatttatgaatccactctctctatccatcatacattcattagttttcacgtgaaaaaaggcagtcgcatggataggcaacgagtgaattcatttccttccttttttatagccaacatataaaaccaaataagaataattaattaattaatattcttattaattaatcatcagtttaaaatattaaataatttgcttttatttttctaaaaattaaataatttaattttgccattttcagtgtataaaatg

SEQ ID NO: 98037 - DNA, 609 bp, Heterodera glycines
  Promoter: Source sequence=SeqID_2538; Location=6643..7251; Strand=+; Gene=SeqID_80276
atagattgtttgaaaaaagccaaaatatgcagaaatatggattttaatctcctaaaacatgttttgcatgcatttcaggtctcccacagtccagtaaaaatttgtattttctttttatggatgccttgtcataactcgcgaatttccaattagactgaacaaatttgacatcaagtgaaaaatgaaaaagtagtacaaaggaaaaaaggcaatgaaatagtgcagacctttctttacacactggagttgacgcatagtgtgggggtggggctgtcggcaaatcggaggaaggaaaaaattcttgaaatttagtcaatttttcttaattaatttattaaaaatcttttaaaaatcgggtaaaatttcgaaaatgtcctcattaacatcgatttttttttgacaaactgttaataagttgcacaaatttcaaaatttttcaaggagtgctgaatgtttttgaaaaaggcacataaaaaagtggtttgtaaagaaaaaagaaagagtcatcaacaatttctgtttatggcctctggtccgaactaaatattttctgcaaaattttaattggtttttggtcaggtgtccactgattgggccggtcataaaatg

SEQ ID NO: 98038 - DNA, 1003 bp, Heterodera glycines
  Promoter: Source sequence=SeqID_10236; Location=744..1746; Strand=+; Gene=SeqID_73385
ttttcttcaaaataaataaattttattttgtattttgggttttaaaatgcttattcatacgatatttagctattttcgagatttttatgcttaaatttaacaaatttgtaaaattttgccctcaatttggaaaaatttatgtgcatattttgcatttttggtttttatgcgcatattttaagattttatatgcatataattcccaaccctattcataactttgctcaaaagtaactaaattaatttttgatttcattcggcagtgttaaatattctatattagcttttgaaatttgtaggataaaaatgaaagtttagtgctatcaaacgttaagaatatttattaatatgattatttttgagcaaatttataaccaatatcattaaattttttcatataacggaggacatagagctatcgtatgatatagaaaaatgcaaaagtaaaattattcttaagagggtgtttctttccattcattattcatcaatcagcagcttggaacaaagggaaatttatcaacataaaaaacgggcaaaggtgagggggcatttgcgatgaataaacaaaaattcccttaagggttgggttgttgattaatttattttgcttaatttatcaccatatatgtatgtatgaatagatagagcctcctatcgttgcggaatgaacgtgtgtaatgaattttaaaatgatgaatccccccccccccctccttttgcctttgccttttacgcctttccataatccttctccattcagcatcaccaatccctgtgcgtgctgtgcactgtgcgggggtgtgtttggttggcgaatgttcggtcgatcattttgtaatttcttttttccacgctgtcaatgcgtgcgtttcgttggcaatgactttccctaggctcattctgcacaaaattatattctttcggcaattccaaatctttttgctttaacaattgaatattaggccatcttttacgagtttctactttattttttcaaatg

SEQ ID NO: 98039 - DNA, 387 bp, Heterodera glycines
  Promoter: Source sequence=SeqID_41163; Location=176..562; Strand=-; Gene=SeqID_69352
accagcaaaacatcaaaaaactcctcaccgaactcggctacataaattatttaaatataaatgagacagcagcggtaatttctggaattaatcattttaaatataaaatgaaaattaataaatcggaattttggataatgaaatgacaaaatggaaaaaggcgagcgggaacccagagaaaatcccgaaatgccataagatttactaaacatggaaaccagaaaatttattgatgagtgaatctagaatatatcaataaacaatgatgcagtaaaagtcgagaccgaaaataatggacaggaaatctctcaattttgaagtgaacatacccaaatataaaacaagattaaaaaaacaaataaaattatttattttttttagcaaatg

SEQ ID NO: 98040 - DNA, 326 bp, Heterodera glycines
  misc_feature (18)..(18): n is a, c, g, or t
  misc_feature (36)..(36): n is a, c, g, or t
  misc_feature (67)..(68): n is a, c, g, or t
  Promoter: Source sequence=SeqID_14228; Location=1693..2018; Strand=-; Gene=SeqID_78244
aaatggcattggcacttntagcggacaaaaatcatnttgagtttagcagaacgaaaaaacgaattcnnaaattgggtcaaacgccaaaagaaaattttgcacaaacgctaattgaattcacttggaaaaaatgccataagaaaaagtatgaaaagcgtgataaaagcgaggaaaagccattggttggcacggaattggatttattttgcccatttttcaaccgattttctctaatgattgagcaaattgagcagggtaagcaaataaaaaataaataaattttattaatttacaaatcgaattatttagatcaaaaattgcacatg

SEQ ID NO: 98041 - DNA, 111 bp, Heterodera glycines
  misc_feature (60)..(60): n is a, c, g, or t
  Promoter: Source sequence=SeqID_26795; Location=828..938; Strand=-; Gene=SeqID_57549
aaggatgagcgcttcacctttccgctgtgtgggtgggtgccgaccgaagacagcagcgancgtgccgtcacggtgatgacaagcgttcgtgggtgacggcctacacgcatg

SEQ ID NO: 98042 - DNA, 447 bp, Heterodera glycines
  Promoter: Source sequence=SeqID_38609; Location=357..803; Strand=-; Gene=SeqID_67375
tactggcctaataaaaattatcatttttatcgttaaaattaaaaaaagttaaataccgtatccttaaaatagagcccccccccccgtaaaataaaaccgtcctttttaggggggctgaaaaaaaatctcccactaaattagagccttccctctgaaataaagccacccttctgctgagggggttggaaaataaaccgcccgccggagactgtattttaggaaatactgtaatataaaaagtcatttggtaggcggagtttttaggttttttttttgttaattggttgcttaattaggcaatttaaaaccatttattaaaaaattgtaaaggtacaatgatcaaaatcgcagtaaaatttcgtaaatctttgatcaatgaaataaaaacaacaacaaaaaaattacttgtcccagtgctgataacttccatagtaaacgataaacatg

SEQ ID NO: 98043 - DNA, 442 bp, Heterodera glycines
  Promoter: Source sequence=SeqID_24828; Location=1700..2141; Strand=+; Gene=SeqID_55577
gtcgttctctgcccatggccagttttatgatggattttttgctcaaaacttgaaaatcttttggcagagtttgtgaaattgcgaaaattttactagcgatttttttttaattttatgatgaattaataagtttttttctaaatttttgaaaaaatcactgaaaaattttaaaaaatcttaagttttccttcaaaacattttcagatttaaaaattaatttgatgggtgcacctcaaaatattgccgccttttcaaactgagaaatttttctagaaaaaaaatttttcgaaaatttttataagaaaatttgaagaaaaaaattattgaaaattattttggaaattttttcaaaaaaaaactttgtaatttatcataaaatttatgcggcgatattttgtcccgtccccaatttgatggggggagggacgtgactgaatatatg

SEQ ID NO: 98044 - DNA, 1003 bp, Heterodera glycines
  Promoter: Source sequence=SeqID_17066; Location=690..1692; Strand=-; Gene=SeqID_81497
tgagtgagcctccaacccttttggctgtgataagattgttaatttcttttattcccaatttttgacttaattaattaattgtatttccctctcatttatttttgtccgttcgttctcaattttgaatctcccgccttttcattatcgattgttttccgctgccgactttttttttcctggtcacttgcattcagattggatattcgctcgtttttggttaattttaaatgtttgtgaattttcttcgctgtttggacttttgattgtaaaaggatttttgtttggattgtgtttggattttgggatacaattccccgttcctaattgttttgtgtggactacaacgtgctccactttgtacgacgtggcgctcctgctaaaagaggtgagatcaacggcaatttcgaaatttgtaaagcgcgaaaaggagcaacaaaaaaaaacgggaaacaaatcctacgagtgcttgaatgtaaagcggggaaacaaatccctaaagtcaaacgtggaagaaagaatctccgaatttgtttaagagggaaacaaatcccgtaaagacagtggaagagaaatcgccgaatttgttaaaaaggaaacaaatccttttcatcttatcaccactcgccgaaatcgtgtgaattgaaaatttgcaaaaacggggaaacaaatccctacgaaagtgaaggaaaagcagacaactaagtcaaaaagctttgaaccataaaacgagaaaacaaattctcacacaccaatggtgccggtaatgcgaagcccgccgttaacgcgacaaagggcgctaaaccttggcatacaagtgcgaaatgaaggcataggagatacgcaaggagaacagcgagttcagcaacagcacttcgtcgttgaaaatgctccattgcgcgaaaaccaacatcgccaaagtcgagtttcatcagtttcgtctgttttaggacccgaagcaattcatcagcgacttttggaaattccgagaccacgaaacggaatg

SEQ ID NO: 98045 - DNA, 300 bp, Heterodera glycines
  misc_feature (58)..(58): n is a, c, g, or t
  misc_feature (94)..(94): n is a, c, g, or t
  Promoter: Source sequence=SeqID_31669; Location=1..300; Strand=+; Gene=SeqID_61982
gacttatatgcggatttgacgggaggtgtaaggcagctatacatttatgcaccaaatntaatcgaaaacacaattatcggcaaccagatggccncactcttaagaatagttaacgtcgtcgatgacccgggatcaattagtgaagttatatatagcaccgagtattttcatcgtctacagtcgaaacgaatttcagaaattacaattgaaattcacacaccgtttggtgaattcgttaaatttcactggggaagttgtattcttacattacattttaagaaaagtatattttaaaaaatg

SEQ ID NO: 98046 - DNA, 375 bp, Heterodera glycines
  Promoter: Source sequence=SeqID_36432; Location=214..588; Strand=-; Gene=SeqID_65738
ctaaattctgggctaaatgcaatagacaaaaaattattcttgaatttactataaactgaattccgcattttctcattgctattttctatgtgaagattttgatgttttcttgagtttctaaattccttagacttttagctttcgtttgataccaagaatcaacaatataggcattgactaagttagaaaaagtccttgccaaaaaactaaagaaagttactgattggacgaataaactggaatagacccgaaaattaattattatttgatcaattagtaattggttaattaaaaacattagcaaaaagtgcactaaaattaattacccttaaataaattttcttaaatttcaatttcaaagtgcatcccaaaatg

SEQ ID NO: 98047 - DNA, 865 bp, Heterodera glycines
  Promoter: Source sequence=SeqID_9126; Location=571..1435; Strand=-; Gene=SeqID_70332
tattaaattgcatataaaactgtttaaattttttggacgttttcggttttctttgatcatcgacactttcggatggaattaaacgtcagtgtatagatttcattatgtcggggggggggcagagtggggaactgactgatcgacactgatcgcgcagtgactgcctttcttccctccctccccgcccttcccttctctccctctgctttcatctgcgcatcgctgtgactgactgcgagcggagcatcgcatccatgcgcccccgggcgatcaattgttgccgactttttctagaagtttcgtgcttaccttggaaaaagatatcgcgcattttggagacacgttttgtcgtcgcgggagaccaatcggtggaacagcgccacgtcgtctaaacggggaaaagggtgtcccttaatgaacgcgctgcagtcgaatcatttgctgtcctttccccccccccccaattgcccgtcgcattccttcgcccatcctccgccttatttgaatatcgaatttgaccagtttagctcattgttcggccacttgtgctgtttcggctccaatggcgcttctcccgtagttcctcctccttttgcctttcttttgcccttccctttgctcctccgatttgccggaatgtccgtgggttaacccggagaaagagttgcagaaatgggcaaatttgccggtgtttccctccaaatgcaatgtgaccaaagacacgccagcggaggaaagcggagacgaaaaggaatattgggagaggggacagcacaggtgggagagagagaggagaaagagagaggggggggggacaaacagagggagataaaagagtacggcacaggtattacttcaaccaatg

SEQ ID NO: 98048 - DNA, 165 bp, Heterodera glycines
  Promoter: Source sequence=SeqID_16769; Location=1..165; Strand=+; Gene=SeqID_81176
ataatttcataattcattttttatttttttttgacaattttaatatattataaatattttctgaaacattaaacttttgtagcctgaaaatttttaaataattttaataaattttctatatattataagggttgctatcgtcgcaaatcgtcttcatgctccatg

SEQ ID NO: 98049 - DNA, 414 bp, Heterodera glycines
  Promoter: Source sequence=SeqID_17303; Location=1712..2125; Strand=-; Gene=SeqID_81780
ggtgtcttaggatgttgcaccagacggggggacggttcggaagcggctcacttactaacatttcctattaacaatttctttgtcgctcggctgcttcacggcctcgcacccttttttggcattttcttattatcagacatttcttctcaatattttaatgacaacaattttaaaaatttatttggcaaacgttaataccaaaataagtgtaaacatataaccatttacaaataaaatcacaaatcaaattcaaagtcgatctttttcatattacaaagtgaaaacaaattaaaaatcctttgcttcttcaattttttactaagcaaaatcaaaaaaacacgtctctttaactatcaaattcttttctctttaacaataacaaattcttttatagaattaacaaattcaataatg

SEQ ID NO: 98050 - DNA, 424 bp, Heterodera glycines
  Promoter: Source sequence=SeqID_23653; Location=761..1184; Strand=+; Gene=SeqID_54350
attgtgaggaagaaccgctgatgatggtcatgatggaggagggggagatgttcaattaaaatttgttatttgtgtgtcatcggcacagaccacccatttttgttccgttaaaaattctttgttgttgtttttgttttcaatgatttttgttattgctgatgaagcatcgtattgaaacatgtctggaatatttgaaacaagaatatttcttggggcttgatttgactacttttgtccctcatgagcgttgggaattggcaaatttgcctcacttttggcccattgttttgggctgccttttttcgtacattttggttttatacgattgctttcattgttttcagtggtcacacattccgacgcaattacttcattattttgggattagtacccaacgcttttcttttgcagcttttgaacaatg

SEQ ID NO: 98051 - DNA, 202 bp, Heterodera glycines
  Promoter: Source sequence=SeqID_44450; Location=896..1097; Strand=-; Gene=SeqID_71935
gctgatcaaattccccctgaacacatccatttgtatatcgcgtggtcttgatcaaattccctgatcacatttattgtatatcgtattggaaccaatatttttcgatcaactttttcgatcactgccaattttccgatcacccgactgatcagtagtaactaattcccctccaaatatttcagcccaattgccggcacatatg

SEQ ID NO: 98052 - DNA, 175 bp, Heterodera glycines
  Promoter: Source sequence=SeqID_16064; Location=1179..1353; Strand=-; Gene=SeqID_80420
ttgtcccagaaaatttgccaaatttggaaattaacgactttgaaattggagggttgttgaaaagcaattagttgaatttgcaaaagaaagttggttgaattattattaatttaggtcattaaaataatatgaattttttatcccttaagaattggtctgcccgacaacagaaatg

SEQ ID NO: 98053 - DNA, 238 bp, Heterodera glycines
  Promoter: Source sequence=SeqID_6667; Location=904..1141; Strand=-; Gene=SeqID_62404
agagggggggggggcatttgccagggcaattcgggtagcccaaaataggccattttttggtttgcattggcaaataaacgaacgaaacattcattaaatgtgcattattatttgattacaaaataaaacatatagaaaatataattgttattaaattctcatttttcatcggtcgggagaataaaaggcattggaagagtaattaaaagtgccaaaaggggcggaaggagtgaaaatg

SEQ ID NO: 98054 - DNA, 500 bp, Heterodera glycines
  Promoter: Source sequence=SeqID_14701; Location=1369..1868; Strand=-; Gene=SeqID_78819
gctggaaaacgaagaaagcgaaaatatgaagaaaggtggcgaatgaacaacaaacagccctttttatacagcataaaaatggggggggggaggggcggaaattgcgaatgaaaaatgggaaaaaagtataaaatgaattataaaattagtatttggaaaattaaattttattaaattgaatattattacttctttttatcgatcaaacagtttctgataaaatttttatttattttaaaaaattataaaattttgaatgttctttcaaatgctcattttcaaggatatctggaattcaagaatattttaaaaattttccagaaaaaggccccaatttccaggacgtccttgccattcaaggacaaacccaatgatttattaatataaattccactttcgtaccatttaacccaaaccctcaaaaatatgagtgggcgacgataattatgtaaatattaaatgcttatttatttatccaattgtcaaatcaaattataatg

SEQ ID NO: 98055 - DNA, 265 bp, Heterodera glycines
  Promoter: Source sequence=SeqID_3865; Location=756..1020; Strand=+; Gene=SeqID_52206
ggtaggccaatcaatcaattaaaacgatcggtcggtcaatcaattaaaccaatcaaccggtatttaaatcaatcactcaatcaataagccggccaatcattatttcttcggcaaacaattgatcaaactttgctcgaggcatttgaaaggtttttatgggacgggaatgccggggcttattttggcattaattaatttaatttctttggagactaatttgcctcttttttgaaattcatttgcttttcggcgctgaaatggcatg

SEQ ID NO: 98056 - DNA, 752 bp, Heterodera glycines
  Promoter: Source sequence=SeqID_16333; Location=734..1485; Strand=+; Gene=SeqID_80719
tatgtgttggatttgatgacgctaaatccaaaactggatcagaatgacgtccatcttggtctgttccatttccattttcaatttgaatctaattaaattgcaagggaaaatatcgtgtccagacatttgcgacctgatatttgcgactatgtccaaaatcgggtcaaacttacattttttcaatcttagaggtcttaaacagcattgaatttaagaaaattcgttcttttgggttattaggaacaataattatgttgtttgaaagattaattattttttcaaaaatttgctgacgataaaactatcacataaaatcactttcaatcgcttatttaaagctgtttagtccattgaagatagaaaaaatgtaagtttgaacccaatcttggcattcaaacccggcattagttaattaactggatttcctatgattaggaattttatcaaacataaatatacttgttttccatttgaatgcattggcgtttttttacgacaatgattttataaatttttcgatcattaattttcctttttctgtgaaaatcacactcaaaaagtgtataaatatggccacttttcgagtcaaaaatcattccctccagttttttctcattttaatttttaaccatcaatttgtcttctaattgtgtcacacatttcatttagcgttcacacattttgccatctgtcaaccaatcatcatcgtcaacatcgtccgtcaacagttcaacaacaaaacgttcaaaatg

SEQ ID NO: 98057 - DNA, 190 bp, Heterodera glycines
  misc_feature (131)..(131): n is a, c, g, or t
  Promoter: Source sequence=SeqID_1423; Location=1..190; Strand=+; Gene= SeqID_73480
ttaatatttcggccaaatttgagtcaaaaatgaactgtccagtgccaactagatccccggaattctcggaaaatcccggcggggtccagactcagtccggctctaatgtcaaccttctgaactgaacactntagaacaaaaattgtaaattaattttgaaattttttaatgggatgagtcaatcaaaatg

SEQ ID NO: 98058 - DNA, 464 bp, Heterodera glycines
  Promoter: Source sequence=SeqID_34917; Location=1..464; Strand=+; Gene=SeqID_64600
ttttcctcgtcagatggtttccctgcgtttgtcttccttgctttgtcgggccaaattgtgcccttccacaaccgaacggcggccgaggcgaaggattggcaaagggttggcaattgaaaccaaaaaagggggcggggcgttttaattaaataattgataattttactctaattgtgatgatgtttttccgttattaagaatcggggccaatgaaccgtgacaatttggggaaacatttgctcggcactttttcccatcagccgacacaaagcgaaaaggagtaattactttattattattatttttaatttcattttgtcatttttccttttggataattttggccaattatattttccttatgattaattagtgttttaattttatttccgtttagtcagccgacggagcaaaaggccaaaagcaaacaaattttggaggaccaaagggacagcggagaaatg

SEQ ID NO: 98059 - DNA, 696 bp, Heterodera glycines
  misc_feature (348)..(348): n is a, c, g, or t
  Promoter: Source sequence=SeqID_41478; Location=1..696; Strand=+; Gene=SeqID_69584
ccaaatttcaaattcaatttggcgactctctgaagaaagcaaaaagaatggaagaaggagaaattcatctaattgctgtcatttttactttatttatgtttattttttaaattcttttttttcaattttgattttggctttataatactaattactattttatttgctattaatttcgtttattaaaacgtcgattttgtgactcatttcaagtttcttcgaaaaaattcctatgaatcttaaaaattaatacgagaaacttcacaaaataatttaatttctcttaaataaggatggcatttcttgactattggttttaaactagggtttctccccgactccgagccnccccccccccccaggcccgtaccaaaggaatttttacaaatatttgttctattctcagatattaattaaatccaatttttcaattgcatttttaaataaaattctgaattggggcattcttttttaggtcatcattttgccttaatttatgttaattgaccccgataaatatgttaatataagcaactgcagaatcagcagatgttcatttattacttctccaatttgttaataatttttctcatttattacttcttcaatttgtttaataatttatcatttattaaaatttacatcttttattgtgaactttcattttaggaacttaatgaaaagtttgtcaaaatg

SEQ ID NO: 98060 - DNA, 91 bp, Heterodera glycines
  Promoter: Source sequence=SeqID_24894; Location=1..91; Strand=+; Gene= SeqID_55640
tttttatacataatttctctaattttaatttgtttatctatcgttcaattctttgtgatttggaaattccaacattttctgggttcagatg

SEQ ID NO: 98061 - DNA, 102 bp, Heterodera glycines
  Promoter: Source sequence=SeqID_11240; Location=1381..1482; Strand=-; Gene=SeqID_74601
tgtaaggctaaaataggaaaagagcaattaaaacaaaaaatttcgaaatgaaacagactttgtttgtcgtccaactttttcttgcactacgaggagattatg

SEQ ID NO: 98062 - DNA, 290 bp, Heterodera glycines
  Promoter: Source sequence=SeqID_54; Location=4570..4859; Strand=-; Gene=SeqID_56536
attggccaaaacaggacaaaaaattaaataatgagagttaaataggttaattaactaattgtccaactgccaaattaataaataacgtaatggattataatgaaatgaaacatattaaggcagaaacggtcacttgtaataatttaattggcattatgcaaaccatggcacgactgaccaaccccccgcggatattccccatcatagggctaactttgatggaacttttggcgaaatatgaaagttttcggcactttttttgtcatgaagtgctaaaaggcgatgaaatg

SEQ ID NO: 98063 - DNA, 645 bp, Heterodera glycines
  Promoter: Source sequence=SeqID_7075; Location=2732..3376; Strand=-; Gene=SeqID_63755
taacgagcccgaaggggaatggccatggagactccagcctcaccctgtaacttgaacctaagtccaggcccctttctggtgttggctcgcactggttaggaacatgacagtctcgtgtaatcccacacgcaccgaaagccctagccctcgtaggcgaaggctgcgttgctggtttcagaactgtgagctagtggggttcggatggccgagtgtaccaacctgcttgctaacaggtagcatagagtaatatgctagtaagcagggcacgagaaagggccgtaaaagctccggctatgaaggaccttgcgaccacacgtgtgtctcccacgtgcggattcttgaagccagagtcttgcactgcgcgcaggatggagcctgtgcaactcctccctcgctgatcgcaggagtggaggatcaccactcttttttaccttgctagcttggggtaccaccttgagctggggccggccttgctagcttggggtacgaccctttgagctggggctggccttactagcttggcgcgccacccttggagctggggtggcgcaagatcacttgtatacggtctaaccaatacatttgaaaagcgatcaaagcgaaatgatatcctgtgatttggaaagagaaaccttaacccaaatg

SEQ ID NO: 98064 - DNA, 440 bp, Heterodera glycines
  Promoter: Source sequence=SeqID_16217; Location=1515..1954; Strand=-; Gene=SeqID_80589
gacaaagactttttggcaagaaaacgcaaaaatattgcaatttcgaaaagtcattcatacaatttgctggaggcaaaacgaacacttggcctcagtcccattggaggattggcacgctttttgatgagcggcatattgggaaggaagaacaaaacacggacaataccgtaaaaggaatactataattcaaattaatatagtaaataataaaacaaattaaaattattattttaagttggcaagaaacaatttcaaaaatacaaaaggcaaaaaaggcgcacaatcagttgaaaagagaagaaaaaaaatggaaggattatgcgcttaaagaaatggtaatttgttgttattaaaagaataataacttttgctttattcagcccataaaatcggcaattgcaacaaataaaaaatatgacaaaaaaacactgctgaaaatg

SEQ ID NO: 98065 - DNA, 700 bp, Heterodera glycines
  Promoter: Source sequence=SeqID_30186; Location=898..1597; Strand=-; Gene=SeqID_60623
tggtcgccaaaaccgcaacggaaaaactgctcgaacaagcattccggaagggtaacccaatttaaattttaaataattttaattaatgctaaaatgggcaatggcgaaaattgtaaaaaagctggtataattttttgaaaaaccatgaaaataaattcaaaaaactacaacaatttgggactaagaattgataaatcagaatttgagtaaaaaaataaaaattgcacgagtatctattaaaaaccattttaagtaatttttctataaataatttgttccacagattgcgaatcggtcgcaaaggcgtgtacctcctgcggctggggggcctgccacattagtcccggagcagtcgcaagcgcctgttgcagggaggactactcgtacacctgctgcgaaaaagttagaaaaatatggggaattagggttatattttgaatcatttctatatttatgcgccccaactcatcgacgtctgccggaaaggatgcagctgcggatggggaagctgtttcccgtcagctggggtcaaaacacggatcggcgattgctgtgagaagggctacgcgtggcaatgctgcgctaaggtgagtataaagcgagcggaaaagccattaaatatatctatatatatatatatattcgcatgtttaaatgctgaatttagcctccacctgtgctgaaaggctgccaaaaaatg

SEQ ID NO: 98066 - DNA, 284 bp, Heterodera glycines
  Promoter: Source sequence=SeqID_40715; Location=882..1165; Strand=-; Gene=SeqID_68968
agagcagctcgagctcttcaagaaggtatggaaagaaacaatagttatttctgggtctttatcagaaatcagaattaattctccaatgtggcgcaaattttaggcccccagccacagccttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 98067 - DNA, 257 bp, Heterodera glycines
  Promoter: Source sequence=SeqID_35884; Location=678..934; Strand=-; Gene=SeqID_65339
caggcatgcaaggaagaattgcgtgcactgaaacagggctgtgttgaatacgactcccgctatcagccaaaggtaataaatggataataaataataaatagatatatttatatcaaatgtaataaagcaattttgaacaataaataaattttcgggttatttaaaacaaaaaaattcataaaaaatggggcgactttctgttcattgtcagcatgtatatttattatgacaattacactcattttcagtttgtgatg

SEQ ID NO: 98068 - DNA, 290 bp, Heterodera glycines
  Promoter: Source sequence=SeqID_10773; Location=1123..1412; Strand=-; Gene=SeqID_74029
tatttttattgacttgcatataatttgttcgcatatttttattgacctgcataaaagcgtaaattttttttccccttaatctgtttcttataaaaattcaattgtttcaaatcttaaatattttattaattgatcaattctcactaatggcacccgaaaaatttccagccataatcaacaatgtattcacttttgcacgagaccgatggtgccacatcagtaaatttcagtgcttggggtaattttttgccgggttctggcaagcagctggtcactgtttgtgcaaaatg

SEQ ID NO: 98069 - DNA, 151 bp, Heterodera glycines
  Promoter: Source sequence=SeqID_35643; Location=119..269; Strand=+; Gene=SeqID_65160
ttttcaaaagggccgtcctttctctgtcatttcctcccccgcccccaaaaaagtgatcagagcgatcggaaaatgcttacacgaacacctattttgtgagttttaccatggatgatttggttttaactgtttagcaaacggcacaaaaatg

SEQ ID NO: 98070 - DNA, 350 bp, Heterodera glycines
  Promoter: Source sequence=SeqID_12712; Location=1..350; Strand=+; Gene=SeqID_47074
ttatggaagacagcgaggaggaggagtaggagatgtgttgaggtttttatggagagcacttttactaaaattaaaatctgctggtacattattgggtagagaggcattagacactggaacacgtgtattggatacaatagagaaagctgaaacaccaaataaacaagcaataattaatgaagtaaagaagggaatggataatgtaaccgaaaagggaggggttggtcgtcaattcggaacgggaagaaaaaagagtattaaaaggaaaagaattattggaaaaactgtacctaagacagtaataaaaaggcgaaaaagatcagacgtatttggaaaattattttaaaatg

SEQ ID NO: 98071 - DNA, 136 bp, Heterodera glycines
  misc_feature (76)..(76): n is a, c, g, or t
  Promoter: Source sequence=SeqID_11091; Location=1..136; Strand=+; Gene=SeqID_74424
tagaccgaacaattttgaccctaacttttttgaaattccataaagttttcgaactttaacaaaaaaaaagagaaanctttttttctatctaattatataaatacaattaaattggttctttcagaaaaaagttatg

SEQ ID NO: 98072 - DNA, 316 bp, Heterodera glycines
  Promoter: Source sequence=SeqID_23125; Location=468..783; Strand=+; Gene=SeqID_53836
atgaaggtgcgaatgatgatgatgtatggcgccggtaacggacaagatgttgacccgcaagccaaattttaaggctagatattctctgatgatttttagcattcaaccaaaaaaacgctttacacgatttttcgcttttcatcttaaacaagtcgcttctatttgcatttgccatattatatatatagtaatgcgttaaaaaacgctccttatttccaccgaggtgctgaagatgtgcgaaaacagaagcattaatctcatgtttagcctttttcttttgcacacaaccacaatacatttgaagagtcaaataatg

SEQ ID NO: 98073 - DNA, 143 bp, Heterodera glycines
  Promoter: Source sequence=SeqID_30734; Location=1244..1386; Strand=-; Gene=SeqID_61137
ggttggtttcaagaagaacattgacggtagttaaaatttggaattgacaaccaaaaatgggcaattttgctatatttttcaaacgaaagattttgactaacgacgagcaaaaatctttcgaatgtttattgggtttttagatg

SEQ ID NO: 98074 - DNA, 70 bp, Heterodera glycines
  Promoter: Source sequence=SeqID_33775; Location=1..70; Strand=+; Gene= SeqID_63733
tagttttttaaatggggattttgaaaattaccgtgaatataaagtcaatgagtataatttttagaaaatg

SEQ ID NO: 98075 - DNA, 721 bp, Heterodera glycines
  Promoter: Source sequence=SeqID_5333; Location=1213..1933; Strand=-; Gene=SeqID_57707
aattaataaattaaaaaactatgggaattaaatataaaaacatttaaaataaataaattattttttattgccgtttatttaaataattgtctttcttataattataattaggttgggttttgttttatgtacatatattgtcagtaaaatgattaaacattttatttttttaattttaaaataatttatttgttttttttacaaaaataaaaagtaaaattaaatatacttaaatagatattgaatgatcaaaattggcgccaacaatgtgccaacgaattattccacgcattgcagcgggaacgtgccaatttggaggtgtaaatcaattaatacatattgaatttcaaagttttaagaaaaattcgaatttttatcaattcaaaaaattgatacaatttttttgttcagtttaaatgaatttgaattgatttttctttttaagagaagcctttgggaataagcctaaatttctttagtccatgacgtaaaaaggggttgaattcagttccctatggaatttacgtttaccattgaatgccaaatttcttagcccatataaacaaactttttttttggcaaaacaaagttcggtcttttaaactcatttggattaaatttttaattaattattgccataattatgcaattaaaaataaaatcaaagacaaattgcaaaatgaaatttacgatataattaaatcactaatcatttcacatg

SEQ ID NO: 98076 - DNA, 716 bp, Heterodera glycines
  Promoter: Source sequence=SeqID_6289; Location=1..716; Strand=+; Gene= SeqID_61037
aaatttggcattgacatttcaaaatacatcttgttttacgtgatgctcagtcggcgatgaagcttggcacaaacatccttggatgtgattcccaggattgttttttacataaaatgcaacttgtaagtctgtgttttcttctagttaaaaatgaaaaattaagtcaatcggtgatggtattaaaatttactcggattttttaccgctttctgaaaaaatcaaaaaagtcattaggaaaataaggaaatcatcagttcaaagagaatattttcaaaaactgcaacaggaaatggatttaccaaatcatgttttaattaaatcaactgaagtgaggtcagttaaatgtctttgataaaaattcttaaattcattttaaagatggaactctgtttatcaaatgtgtgagagattttatgaaaacaagacggctattggactgtttattggaaattctaatattaatattgagccgttttcgggttgtttgtcattttattttttcacacatttttttaagaaactgattgggaattgattcgtacacttgttgaccaactcaaacctatttatcacataacaaaagaactggaaaagcgggactcaacaattgcgtcgattattccaatttttcggtctctcttgaacaaattgagaaaatttaatagcgcattttctaatcgtgttgctgatggtttggagtcgcgaatgacaggatg

SEQ ID NO: 98077 - DNA, 386 bp, Heterodera glycines
  Promoter: Source sequence=SeqID_9368; Location=1348..1733; Strand=-; Gene=SeqID_71129
aaaataaaaatatccggatccaattgaaaggcatgaaaaacattaattttcccatttttaaaatcattatttttgtcaaataataccgacgatttataattccaaaaatggggaacataaattaggggcgggtcgtttcggcgccagtccaaatttttgggctataattttttgttttaatattggtatcattcgaaagccgttcaaatactttattagccttacaaaaacacaaagatgttcaagcatgcaaaaaatggataaagaaaaaactttaaaaatttcgacttttttcattttataacttttttgaaagcaatagcttagaaacagcttggatattaagccttcaactgataccaagattgttggatttattgacaatg

SEQ ID NO: 98078 - DNA, 63 bp, Heterodera glycines
  Promoter: Source sequence=SeqID_6953; Location=1..63; Strand=+; Gene =SeqID_63386
atcgaactcaatcattgttgttcatcaattgttaatcgtcgtgagcagtgagcatcaaaaatg

SEQ ID NO: 98079 - DNA, 69 bp, Heterodera glycines
  Promoter: Source sequence=SeqID_976; Location=1675..1743; Strand=+; Gene=SeqID_65291
tttgctaatggggaataattggcgagaaatgccatcgcatgctttagctattcgcgcgcactaagaatg

SEQ ID NO: 98080 - DNA, 632 bp, Heterodera glycines
  Promoter: Source sequence=SeqID_12371; Location=1..632; Strand=+; Gene=SeqID_75972
ttggcgcattgaaatgccacaaataaatgccaacaatttcccccccccccccccgccccgggtggtcccctcacgtcctgctgggtgtgccctcccctcaaatttcggagggcattgccctgctggtggaaattaaatggctattttttcctgccattcggcactttcacatatttttttgggcatggaggattcaaatttcgcactgttttgccttatcctattttctgcaccctttccttttttctcctccaatttcggcatttaactatttttgtttaatcgcttaaatatcttagagatattattattattatttttgacgtcatcatgctgcgaaagatatggcaatgccgcatgagaatgaatttgccgagtctcgaaacaggggtttttaagaatggcaccgagacccaaacccaaattgctcactcaaagtgagacaattattatttaattccaaaaaaatgtgtgggtattctggattgagtttggcaattttcgaagctgccaattggcactgagactaaaaattcttcgagaccctctgatttaaacactcaaaatgtctatgtaaatgctaatatatttaattttgaattgtaaaattgtctaaattaattttcagcatg

SEQ ID NO: 98081 - DNA, 787 bp, Heterodera glycines
  misc_feature (14)..(14): n is a, c, g, or t
  Promoter: Source sequence=SeqID_471; Location=1..787; Strand=+; Gene =SeqID_53583
aaaagcaaaattcntaaaaatcgcacttttacaaacaaaaaaacagaattttgaaaaaaagtttttattttcagtgggttttagacaaaaaacgtttgaaattggaggcccgtttttggcagaaaatccataaaaaacaataaaacccctaaaaaacaattcacttttttgttgccatcaaaatgtttgtccaccaaaagctcgaaacatggcgaaagaagtgccaatttgagaccgagttgaagtcggtcaaaaagggaaaatgtccattcaaaaagttattatgtacacaaccagctgaaaaaaaatcacaaaaaaagccaaagagggaaatatggatatttttatataagcaaatacccgggacaacagtgattataagagaaaaaacttggaaatacgatgattgaatatttatttaaattaaaaaattattttttgacaaattctaattgaaaatgcaaatgaattatttaattgaaaaacaaataaatatttaattaaaaaaaacttattaatcataaaataacttaatttaaaattaaaaaatttttaattattaataaaagcaaaacatttaaattaataaaagcattgaaaaataacccaaaatataaagaaaaataatgtacaccgtccggcttcgaacttgccccacccaaaaaaattatgcccagaatccccaatcacacagggattctgaggtttaacgatgtcttagatgaaatctgatcttcgcgctttggtaacttcgctacctaggaacagaagaggtacaacagtgatg

SEQ ID NO: 98082 - DNA, 576 bp, Heterodera glycines
  Promoter: Source sequence=SeqID_3221; Location=2636..3211; Strand=-; Gene=SeqID_83754
aagcgacagagtgtttttgttgttagacatttacttgttttctgaaatgtttcgatgctttggaaatttgtagttaaaaaagggcagtgaaaatggcaaatgaatggactttgggagaaagaatgagcagttggagaggcatttgcactgcttaaataccaaatttttgctgctgtggattaatgtttcttttcggtgtttgtcaatttgtcatgctcatcaattcattcattctccgcccattataaagactaattttcggcttgaggctattttggagagaaatacacatttatgtatgtgtgaagaaattgacggtgaattaagatgatgaattaaaataatcttcaattgggtaacaaaaaaaaaactgaaattttggatatgttctctttgtcggtgaaatgtatcattagaagcaattacgacaaagtaataccaccgatggtaccgcccttttttcgaagaaaaatttcaaatttttatattttggcattagcgacgcaaatatttattggtgtttgtgcgtggtgaacattgagtgtcggtgggtgattcaaatgcaattgaaaaatg

SEQ ID NO: 98083 - DNA, 234 bp, Heterodera glycines
  Promoter: Source sequence=SeqID_14405; Location=1960..2193; Strand=-; Gene=SeqID_78442
tggtccgttttcactcacaaacagatagagatggagcgacgatcctcccgttcgcgttcccgttccgccacccctgcgttcgaccgaccctccaaattggaagcatctgctggacctacaaaggtttcccgtctcaaattgtcaagagtttgctctcccttcccccccccccccccacttgttcagacttcgactgttgcttttacctcgaattcgccgccagttgatcctatg

SEQ ID NO: 98084 - DNA, 1003 bp, Heterodera glycines
  Promoter: Source sequence=SeqID_10208; Location=1610..2612; Strand=+; Gene=SeqID_73333
cattataaaattacccaatccaatgcgtgcgcagaagggccaatattcaagagaaataattaaaaatcaaagaaacttccaaaataattattaatattaaaatatatgataatgtaaaattaaaatgttttttttcccaaaattctttaaacagtaaaaaagcacaaattaatcaacaattagaaacaaaagaaacaaatcattattagatttttgaaattcaagaatatacttttaaaattgaaataaaattggaaattttttaaaataaatcaaatattaatgaataaaattgaatttttatttaaaaattcaaatacaaataacaaaaaagtgaataaaagaataatttgtgtcatcgcttcgcagagcgatgacgaagcacggaaaaagaaagaaagaaatgactaatcataaagcgaggacggaggccaaattgactgttatttaaccgccaccattttgccttttctgtcagttgaagcataaagagcaaatttgttgggcttttcaatcaataggcaaataatttaatattgttcatttaagcttgtaaaatttcgggttcctctggcggctataccagagaaggttcacttaatttattataacagtaaataagacgtaacaaagtggtgcaacggccgaatcctaaggcaaacagtttgtgtaaaataaaaagagtgcagtgggtgaaccattataaatgtcggaaccaatcagaatggctttagggataatggtcgagaatttaatcggtagactgaatgaacttctaccaattgtcagagcacagcagaggaacgaagagggattaaataaattgagagaagatagaatatttttaacagatttattagaaagaattgagcaaaaaaaccgtgaatgggatacatatataagagaaatatgagaagctcagaatgaggaaaatgaaagataccgcttatttacccacgatgggcgacatttttatgaatgggcagaaaggggaagagaaatg

SEQ ID NO: 98085 - DNA, 128 bp, Heterodera glycines
  Promoter: Source sequence=SeqID_19083; Location=1..128; Strand=+; Gene=SeqID_83826
acaacagcaaattgatgtcccgatggatcgggacagccccaaacgaaattttcggatgcagcgaaattgaaatgcacaacatccgttttcgagcctcatcacggtgctacactttcatacccgtcatg

SEQ ID NO: 98086 - DNA, 124 bp, Heterodera glycines
  Promoter: Source sequence=SeqID_1243; Location=2861..2984; Strand=+; Gene=SeqID_70549
tctgcaaaaaatataatttcgtagggatcttgggaaaaaagaaccagttttaaaaatcattaaaacggacactttccaatgtcacgccaaatgcccattttgacttaaaacattgtgccaaatg

SEQ ID NO: 98087 - DNA, 75 bp, Heterodera glycines
  Promoter: Source sequence=SeqID_34742; Location=1..75; Strand=+; Gene= SeqID_64462
aatatgattaaattttagcttgtgctcgcacatcgtgccattctttcggcgtcttccgatgtttttgaggcgatg

SEQ ID NO: 98088 - DNA, 555 bp, Heterodera glycines
  Promoter: Source sequence=SeqID_30329; Location=659..1213; Strand=-; Gene=SeqID_60749
tctggaaatttataaaaataaaccacaaaaaagaaatttttcgaaatttggcaaatttttttaaatattttatttgcctccaaaaattttcgctgacagaatgagatttaccaaaaaatcttgagatgtatttggtctgcaatttttgtagctagatttgataaatttggcatttttttgaggtttaaatttattttttgtaatttttatgatattttttaaatttatttaaccaaatttttggtacatatttggccatttttgagctttttagtccatatttagcttttttaagtccaggtacatcatttccagcactaatgatgagtcacagcaaaaacttcaaaaaactctcctcttttcggcacttttgttcatccacctgtgtccatctcttcccattgtcagtttatgagtgtgagtgtttttttggtttttccattattgttaaattccctccctccttttgagcccctccccaattaaaaagttcaactctcttactcatcgctcacattgtcccctcccccgtccccctcaaactctcagaaaatg

SEQ ID NO: 98089 - DNA, 667 bp, Heterodera glycines
  Promoter: Source sequence=SeqID_2534; Location=1..667; Strand=+; Gene= SeqID_80245
cggtgcgaatgggtgagcattggtgagtgcgtgcgcatgtggtgtgagtatgtattggtataagtacatgtgtgtgaatattggcatgtgtatgtgtagatagaggtagggtgcaagagcaaaggttttgtttgtgcattgcgatgcgtgtgagtgcatctgtgcaatgcgtgagtgtttgcaagtgcagatgcaggttacatgcaaatgcatgaggcgtggatggtgtgttttgcatattaagcctgtgtgtttcgggtgcagggcagagtgtagatgtatgtgtaagtgtgttttgtttgcaggtgtatgtgcaaatacaggtaatgtgcaaagtcatattggctgtgtgttttgcgtgcagggcagagtgcagatacaggttagatgcaaatgcatgaggcgtggacggtgtgttttgggtgcagacaggtgtatgtgtgtgtgggggtgtgggtcaggtggtataccaattgtatgttacatggtataacatgtatgctaatggttaggatgcaggcaggtgtatatgattgtattggtcacgaacaggtgtaattgtctgttggtttgcaggtgctggttcacatacagccattaatgtgcaattaaatctcgggaaaaggccccctatgccccaggggttcgagaatggttcgtaaaaatg

SEQ ID NO: 98090 - DNA, 75 bp, Heterodera glycines
  Promoter: Source sequence=SeqID_39995; Location=777..851; Strand=-; Gene=SeqID_68437
tttgttgcattttgcgttctaatgaggttagtgtatcatattgttccatcatccagttgttttttttcggggatg

SEQ ID NO: 98091 - DNA, 56 bp, Heterodera glycines
  Promoter: Source sequence=SeqID_27357; Location=707..762; Strand=-; Gene=SeqID_58053
tcttaaaataagattcgttagaataataatcatagaaattacagtgaattcgaatg

SEQ ID NO: 98092 - DNA, 879 bp, Heterodera glycines
  Promoter: Source sequence=SeqID_3614; Location=499..1377; Strand=+; Gene=SeqID_51124
atatcggacgaggcaatcaaaattaaaatttaatggaattttgaaaaaatattttaaataaacatttcttaagctctttttgctggtgctttgtaaagaaatgcgcgttatttttgtgcgaatgattggcaaaattttgccatttgtccggaagagaaatgctactgaaatggcgccattcacaacccaatacagtagccaaatgccgaagccaaaccaaacacagcacagtaaaaggcagatgcgaatgatcgatgtcaataacacggcaaatcattacgcagagaacaaattgaggagataacaactgatcaatcagtcagcagaaaagaagtttttgaaccccgagaaaaattggccaatggatgcttttcttttaattgttcattgactctttttattattttattagtaatgtatttttaaataaatttttgaaggagtgacagtaaataaactgttttaaaattattttatataaattgctatattaccttttttaaattacaaaaataattaatggaatttatttatttaaattatatttgttttattaaattacatttttaaacgagagaatctcttcacaatttatttgtgaagagattaatgatatggaaaatatgattcatcgaaagtgtcagtggtttccatccaaaaaagagagaaaatgtaaatgacggacatttttacaccacaatatgttatgttgatttgtacacaattatttatttttcttctcaaatgaaaataaatgtatttccaaaattcactttttgtattaaataatttcgtttttcaatttttctttccagttattaattaataataattctttagttcctctaattgcctctacattttccaaattgcggcatg

SEQ ID NO: 98093 - DNA, 159 bp, Heterodera glycines
  Promoter: Source sequence=SeqID_550; Location=11853..12011; Strand=+; Gene=SeqID_56034
attatttcgagaaatgatcgatctcaccaataggaatcggatttgatactctctttttctccgaaatgtttttgctgattatttcgttcgaataaaacgtacatttaatacagtggtgtgatctgctgttcttatttctatgaaatctgttaaaaaatg

SEQ ID NO: 98094 - DNA, 65 bp, Heterodera glycines
  Promoter: Source sequence=SeqID_17559; Location=785..849; Strand=+; Gene=SeqID_82071
ttgaccgccggtgatgctccgcgtccgccttggccaagtcggccttggtgaaatggtacacaatg

SEQ ID NO: 98095 - DNA, 173 bp, Heterodera glycines
  Promoter: Source sequence=SeqID_4931; Location=1657..1829; Strand=-; Gene=SeqID_56256
ttttgacaaaaattggtaaaatgattctgggtttttggcaggcaaaatgttttggcttttagtgggcgtgtctaaaaccgtgactcttttcaaatagtgtaggcgtggccacacttttgcgaatataaaagtaaaatttattaacctcattccaatttcattctcctgccatg

SEQ ID NO: 98096 - DNA, 76 bp, Heterodera glycines
  misc_feature (28)..(28): n is a, c, g, or t
  Promoter: Source sequence=SeqID_22552; Location=898..973; Strand=-; Gene=SeqID_53222
ttatattaaacttaattagataaatttntcggaaaatcccacttaaaattattatgtcagattcataaaggcaatg

SEQ ID NO: 98097 - DNA, 207 bp, Heterodera glycines
  Promoter: Source sequence=SeqID_39171; Location=800..1006; Strand=-; Gene=SeqID_67803
tatataaaaacaagtaggatttgcttaataaagcgcaaataaaatcaattagtaaaaggatttgtattcattttatggttttttattcaaaaatatgaaaattaaaataatattattaatattaatcttcaaaaatacatttgataatatttatgcgggaaagaaaaacgaagaaaaaagctttgatgaaatatttggccaaaaatg

SEQ ID NO: 98098 - DNA, 430 bp, Heterodera glycines
  Promoter: Source sequence=SeqID_9679; Location=1991..2420; Strand=-; Gene=SeqID_72313
tgttcacagcatcatttgatgtgctttaaaacggatagacgaaatggaaaaatggcagaaacaacaattttacgaattgaataaaaaactacagaatcttatggtgaattggggaggagaaaagcaaaaatttgcctcaaaagcgatcattattttgaaagaatgaaaaagcataaccttaacataattaaggtgcatttgattttccaaccaaatttctgggacgttgacgcctgtcacaaggacctcaaaattattgacgaaaacaatttgactgtccacagcaaggaacacagatcgggtaaattataattcaactgattattttaaaattaattttccctcaaaaggctgccgttccatcttcgcaaaacacccggttttgctaaagtctgacattttttatttcgaaatttcggtcaaaacaatg

SEQ ID NO: 98099 - DNA, 652 bp, Heterodera glycines
  Promoter: Source sequence=SeqID_7088; Location=2500..3151; Strand=-; Gene=SeqID_63812
atttttactcgccaccgcaaaacggcaccaacgaaatggaaaagaggaagaacaacacgaaaacgaatatttcttgggctgtgcccctcttttgcttaacaaaaacaatggcatttctgcacaaaatttgacgacggaaaaccgacggaagaaatcaaaaaatgttttcttttttattttattaaataacgaattttggctgctttagctgtccgaatttgaattgtcaattcccgtgaatttggaccacctttttaagcacattatttggcttctcaatttgaaaatttaccgcctcaaagaggttcagtaaaataatttatattatgcaatataataaataattaaccattttgacaacaaacaaattttatcatagaaaaactttggcgatgattgtctccgtctaaagaattggtttgtttgaaattaaaattaagatgaaaaaatatacaaataaaatttaggattgaaaaggcagaaaaagaaaatgatcacgatcatccgaaattaattttggtaatttatatgtcaagtgaacaataaaaattcagactaattaaattttaaatttcttaattaggaggaaaaagtcttggcattattcgacgggttgcaaaacatttcacgaaatttattctcaaatccaatg

SEQ ID NO: 98100 - DNA, 522 bp, Heterodera glycines
  Promoter: Source sequence=SeqID_32231; Location=683..1204; Strand=-; Gene=SeqID_62557
ttcttcgactccattttactccattgtttgtgatttgtttttgacgggtgggagttgggaaaatttggaaatttttaaatagaatttgtcagcaaaatttcgaattattgtaatatgggagaaagggaacaatcgtatttttgattttttaacttggggttaaaaaaccttccttaataattgtaaaagaagaattaaagaaattccttttgacaaaaattttttgggtgtttaactaaaaaaaaaatacgaagaaataaaaaaagcgaaaatgagcgggagacgtattgtactcgggagaaaaactctcattgtcagtttgtgaattaaaaaaaattgaattcattggggttcgagaaggagggtaaatgatccccttactacacaccctagggtcaaagttttaatcgaattttgggtgtttttttatgtgcattctgctgattacatacccctgaaatttggtagcttcagcgtaactcgaactcgacccgcccttcctcgtcccatcatgcacaaatg

SEQ ID NO: 98101 - DNA, 782 bp, Heterodera glycines
  Promoter: Source sequence=SeqID_5433; Location=1136..1917; Strand=+; Gene=SeqID_58012
ggtggggaggggtccgcggcagtggaaagagggggtccgtgaaagagagggggtccgcgctgccccgcgaaaagggcggagggcgacgagcggggaggggtccgcgccgcccgttgaaagggcgctgcgagccgcggggagggtccgcaccacttaacgcaaaataacacgacccgtccattccatcggtggccgactggttaacgcttcgggcccaccaccatctcgggttcaatcccgcgcggcgaagtcagagacgcagacacaaccacccaataggcacggacccgcccgctcagcctctctgcgctcagcggagaaaatcaatcaatagttaaggtggtctccccatgtagtaatatgtaatgctatttatcagtatgtaaaacgaaattttatttataatttatatatctgcatgataatattgcattttttacataatcacacttaaatatgtttagatgttcatttaaatttatttaattctgtaacttaatcattttatttaaatgctatcttaaatttaagctaaaagaaaaatttttatatcagatataaaaattagaaaatttttttaggaaaactattaattatcatctttttttcaattagaggcatgaatgtaattttcattcaggttgtcaaggtttattttcatttttattttatctcttttattgtgtttttgaattacaaattttttaacagtctaagatttcttttgcgttattaaatattctttgtacttttatttttttcttttagaatattcaaatatg

SEQ ID NO: 98102 - DNA, 1003 bp, Heterodera glycines
  Promoter: Source sequence=SeqID_54; Location=5902..6904; Strand=+; Gene=SeqID_56537
aaataatttttgaattataattaccattcttttaagagaaatatttttctcttttataataatttattttctttcattgtgtcagtaattttaattaaaaatcactgataattaattaatttacatttattaataataataatattttatggtttattttcacaaattaatgtcaaaatgagtttattattgtccaaattgaccacgtggagataaaaaaaagagttgtgatatgaaaaatgatcaacaaaatggcaaattcattctcattcatttcgattcactaatcattcgccgcttattttattctttcgtttttaattcgtccattttatttattatttatttatttttcgttttattttttaattacccattaattttcgtttttgttttttaatctctgtgtcttccaatgcctttttttaagttttcgtttattttctgatcaaaaatcattgatattcgttcattgctccaaatcagccgaatatttgtcttttttgcaattattccataatcttcgtcccatcattccccaccccccgtaattaccctaattaccttccaccttcccccgctaagatcgaataatcgttcagcattctgcgcaaaagcaaaaaaaaacaaaaactgataaaacaggacaatgcttaatcaacaaacagcgcaataagcaacataataaaaaaactcgtttaattatttattttattaattattttcatcaaaaaatatataaaaaaatattcaaaattgacaatttttttgataaattatttcgacgtgaattgagtgattatcgctccatcagcagacacaccaaaacattcatttttctctctctgattgactgtcaacgaaatttctatgaaattgaccaaaatgtcattgagacaaaatttgggaaatattttttctcgcttcgctttttccaaagatttttgtctttttaaatggaaataatttttaatttacaaaagcaattaaagcgcataaaatg

SEQ ID NO: 98103 - DNA, 407 bp, Heterodera glycines
  misc_feature (7)..(7): n is a, c, g, or t
  Promoter: Source sequence=SeqID_23477; Location=1..407; Strand=+; Gene=SeqID_54174
tagattntggtcaacaatgaaaaaaggtgtagtccaataattgggctggcaacgaaacggcgggcaccgaaccggcgggcaccgaaccgtcccctaccgaaatttaaatcatatcaactgatttgaaaatatttgaaacttaagcgtatgtatttgttaggggtgtatttttccaataaattacccgaagttcgaacccaaaaaacgcgaagttttcgaagctcgaagtttcgcccgtccctggtcactgcggaaatgaattattcttttctattaatttaaaaaaatgcgctgatttcgaatctgagcccggcatttgaaaacattgattttgtctatgtttttcatcgagtacttaaacttcttaaacccctagggggataacaccgcattcgcccctcaaaatg

SEQ ID NO: 98104 - DNA, 356 bp, Heterodera glycines
  Promoter: Source sequence=SeqID_43518; Location=423..778; Strand=+; Gene=SeqID_71157
ggcgagtccccgtgaataaaaaggagattcatcttttgcttattttaggtgtggttctctacaaagaaagaggagagtggctcgaagtttatgctttcaatgcaagaccaatgaatgttaaggaactcaacccgtgttagctctgtctcatattttgcgtccgttaaatgaatgtacgaaaatgtattaatagtaatctgtcatattatattgtgtttatggtatttatatgcaatggagattacttttttgtatttgtttcggctatcttttgttgacactcataaaagccatatttccattaagaccattgtaatattatatattttgtttaaaaaagcaataaaagtggaatg

SEQ ID NO: 98105 - DNA, 707 bp, Heterodera glycines
  Promoter: Source sequence=SeqID_21026; Location=1328..2034; Strand=-; Gene=SeqID_51610
tcgaagcagcggagcattggcgacggcggcggcgctggtggtggtggcgcgttgctcacgcgactgacaatgatgagagaatggaacaaatagacggggaagaaatagtggaggaaaatttgtcagaaagagagagacggagagagagagttggtggcagagagacacacaaacagagagagaatgagaaaaggaggagaaaaaattgattggttttatttcttatttacttcccgcttaaacacaatgccatggtttagcaaatttgtttgttttctcattaccatatgatacagtaattgacgtatgaatttctgtctagggcagggttcggatctgtccttatttataagatttgtccttatttggagggtccaaatcttacaaaataaaaatgtccttattttggacccaaaaatcttattttttggctttgatgttcttattttgaaaaattttcgatccgaaccctggtctagggtgaaggaacgataaaaatcgtggaccattttttttaattgaaaaagcattcattttctcgatttttcatgaatcaaggcatgaacaataatttgttgagaatatttaatttcatatttgtgccgttgccatggaaaattaagtacatgaagacagaataaaacatatttcatgcattcatgtgattatagagaaaatttattaaatcataaattttaattaaaatg

SEQ ID NO: 98106 - DNA, 751 bp, Heterodera glycines
  misc_feature (43)..(43): n is a, c, g, or t
  Promoter: Source sequence=SeqID_2874; Location=4784..5534; Strand=-; Gene=SeqID_82087
ggcagttcgccaatggttgaaacacaccgcgaacggctgattngacgacaattcatttggattaaatattttttttgttgttgtttttgattttataatattttcttgtttttgttacagacttataagttatgattttgttgttgttgaaattgagaaatttatgcttttttgaaacttacctaatttgtgtctttttttcaaaccaattttttattctttgaacatgactagggatgtcaaaaatatgtacaaaaattggtcaaatatgtacataaatatgtagaaaaaaatcctcaaaatatttaaaaaaaatgaaaatatgtaagaaaaagggtactttttcactttacgccacataaaaaaatatttttatttttctgggattttcggggtcgctgatcacgaatgtggcattcatttcgaactatttcgaaaccaggacccgaattcgaacaaaaaatctaaagtttaattggtaatagtaccgatggtatcacaccttttttgaaatttttttaaaaaatttcaaaagtcaaaaatatttattataaggttttcggggtcgctgagcacgaatatggcatccatttcacccaattccgaacccctgatccgaattcgaacaaaaatcgaaaactcaaatttttcgaaattcacatttatccaacaaaatcgctccaaacgcacgaaaaaagaaaaaaaaacaaaaaaaaattcaatgttcgcatggataaaactcagagacatg

SEQ ID NO: 98107 - DNA, 386 bp, Heterodera glycines
  Promoter: Source sequence=SeqID_2976; Location=1034..1419; Strand=-; Gene=SeqID_82600
gttttctaaagaggcatagtccatttccagaatttattttgcataaatgacaataaattttaccgaattataattgcattttctttaagttttataatgtaaataccttaaagttcatattgtcggtaaaaatcattttgttatgaattttcaaaaccctaaggcaaaaagaagcgcgaaaaatcttcttctttttttgacttatagaattaaacataaaaatgaaaatattttctccagctcttagagtttttcataatgcattgattaattatttttcagttattttttttaatttttaatttaaaattcatcactcaatgccaaaaatttattgtgtatttttacattcaaaaattggccagatgtatggcggtacaaaaatg

SEQ ID NO: 98108 - DNA, 1003 bp, Heterodera glycines
  Promoter: Source sequence=SeqID_3748; Location=2282..3284; Strand=-; Gene=SeqID_51719
aaccgggaaaaacaagcactggtaagaatgggggtctgagtgaaaaattagtgaagaaaattggagttaaaaagaaaaaattttaaaaatatattaatatattctttaaaagtaactctgtaaattgtgcggatggcctagtggctagtctccttgctttcccttctttcccctggttcaatccctctacagaaactaacatattttgaattttctttttgtatattcatggctttcctatcgacaaaatatgattactcataattttattttaattaacacatttttatcattttttgaggaaaatctgttaataaattacactcaaattttcaaaatttcccctggcggcgcctatcggcaccgccggacccccttcttccccaaaagttttttggaaaaagcgcgccgaaaaaaattatgtgaaacgtaaatctgaatttctataatattcgatcatttagtccaaaaatgattaattgtttgaaataattaaagaaatttgtttgaaaattttcattaatttaatttagctttaacctttggattttattaaataaaaaacaaaataaaaatttaattttgtattattttcagttgaaaaaaaaaattaaaatttgaattttttaaaaaatttttgaatttttaaaaattcccggttggtcccggttggtcccggtcccgaaaaaaaatcgaggtcccggtcccggcttctcatgtcccggcaagtcccggtcccggtttttgcaaaaattcccggtcccgtggcactctaataaattttaatgttggcaatcaataaatatatatttgcatttgcattaactattaaacgaagctttataatggcattttatttaaaaagtattataaatttattgacatttttttattgccaaatcatttttataaagaaaatttattttattattactattataaactattattttcttaattttattttttctcaattttattattacactatttagttaaaatg

SEQ ID NO: 98109 - DNA, 169 bp, Heterodera glycines
  Promoter: Source sequence=SeqID_39034; Location=1268..1436; Strand=-; Gene=SeqID_67704
gctggagaggttagacggtgcactctctcgcccaaaaagaagccaataggttggcggtgaaaatcaatcgataaaaaaagtggtctgctattgtagtggcatttaaataaaaaataataattaatgatagttattattataacttcactaattatttctgttattcatg

SEQ ID NO: 98110 - DNA, 424 bp, Heterodera glycines
  Promoter: Source sequence=SeqID_14673; Location=2296..2719; Strand=+; Gene=SeqID_78776
tcaataatgggacgacgcgaaaaacatgttttgcattttgaccgaattaatttgattaatttaagcaatttggaaatttttatcaccttaaactgcagaattgattacagtacaagaaagatattgtatcatttcccttggcaacttaaaataattatttgaaaaacgaatatggcggcatttcgtcacgcccactcatccaatcgccttcaccacaccactctcctaaatgccggtgttcaacatctgatcagaaaataaaatgaaaataaattaaacaatttaattgcccgtaggaaaaatctaaaaaagtcacaaaattacagtaatcgcttaaaaatggaatcggagcattagcaaacaatcattattatctcaattgtcttcgataacgctttttttttgcctccagcacattaaaatg

SEQ ID NO: 98111 - DNA, 228 bp, Heterodera glycines
  Promoter: Source sequence=SeqID_10352; Location=490..717; Strand=-; Gene=SeqID_46861
tattttctctctctccctccctctctctctttctctctccctcacctctctctctctctcctgtttctctttctctctatttccctctctcctcgtttctctcacattctctacctctctttctgctgatttgtcatcattttgctgtttttaaagggatttgtttcaattgatttaattttaaatttcaaaggaaattactataagtaataattgtcctaaaaaatg

SEQ ID NO: 98112 - DNA, 260 bp, Heterodera glycines
  Promoter: Source sequence=SeqID_7526; Location=3626..3885; Strand=+; Gene=SeqID_65121
ttacgattaagaaatagtttatgattataattgttaaaagcataaaatgaacctgcgaaaaaacacgtaattattgattgatagtgagaggggtgttagcgcgcagcgacctccagacgggctgtcccttttaatcgacaggccacgcccatccacaaacacatagacgagagtgtagtggttagagaaagatacaaaagggcgccaattcaaacacacagtgaaacccaagccaatttattgattttttacagattatg

SEQ ID NO: 98113 - DNA, 150 bp, Heterodera glycines
  Promoter: Source sequence=SeqID_42864; Location=891..1040; Strand=-; Gene=SeqID_70672
tagtaaaattggaaatatttctcatcttttcttcatttttcagatgatatttatttatttgattaaagaaaattaattttcaaatcatttgttttatttgatttattctgcggttgttctactgttattctgtgttatcttatcaacatg

SEQ ID NO: 98114 - DNA, 1003 bp, Heterodera glycines
  Promoter: Source sequence=SeqID_6428; Location=780..1782; Strand=-; Gene=SeqID_61535
tccaacattttctttttggtggttgttttttttttgaaatatttatgaaaaagcgggcattaaattttaagacttctcatcattgttagcatcatagatacagcagcttttgaatggtccaacactttttcttccatttgcctgtttaataattcacaccaattgcagaccgccatcacaattgcccattccattctgcaaattgcgcgcgatttggccaacccttccagcaccattttagcccgtccgctctccaaaactgtgtggcaggtaaggacatggccattttcgtaaaagttttcgaaattttctctcacaaatcagcattttcgggggggggggggggcgtagtgcggagccccgacatttgcgcctatgtccaaaatcggactcaaagttgaattttttcaacccctgatagcctaataagcattaaaattaagaaaacacggttttatggttcattatgatcaataattttttgtttgaaaattttattaatttttcaacatttttttgaagatcaaatgatcatgtacaatcacttttaatcgcttatttaaagctatttatgcgatcagtgattgaaaaaacttagttttgaaccagattttggacaaaggcgcaaatgtcgggccgcaaaagtcggggccgcaaatgtcgggacacgcgtagagtgcacccattttcacaagttccatcactaactcgaattccaagaactcgaaatgatcagttagattaggggccggaattgacaaattagatgtcagattcgacgtctgaaacccatgaaaaccgccaatagtgaccggattggttaaattggcgtcagattcgtggtcagcaacccagaaaatcaccgggaacaatttttcagattaaaaatcatcttaaaaagtcttttccgtttgttttaataaaattttaaaaaccaccatttttaattaggcccaaagttttttggccgtcaattatacgacgcaagtgaatgaatgaaatg

SEQ ID NO: 98115 - DNA, 340 bp, Heterodera glycines
  misc_feature (10)..(10): n is a, c, g, or t
  misc_feature (24)..(24): n is a, c, g, or t
  Promoter: Source sequence=SeqID_19432; Location=1..340; Strand=+; Gene=SeqID_84156
ttgcattttntgttaacaaatttntgggcaaaacgccaaaatatgtgaaaataagttcttaaaattttttttaggttttaggtgctaaaaataaaaacctagaaaataggtgctaataacttgaaaagtagcttaacaagagccaaaaaaacatgtttttcgtgtgtttcaggccacggggagctcaggaaaaaataggtaaaaacctaaaaatcgtagccctacatattacactcaaaattgcataatggaaaaattcttcgaatttctccccacaaacgagaattaaaaaattttatgggtacatttttgaatataggcaatttttcgtaacaaaatg

SEQ ID NO: 98116 - DNA, 454 bp, Heterodera glycines
  Promoter: Source sequence=SeqID_1243; Location=4270..4723; Strand=-; Gene=SeqID_46713
tcttaactttttttttaaattcgaatgtacctactttcatatatgtatttaattgtcatttgttaggtaatgttcctaagttttcgaacatcttacccaactaggtaattcttacacaaaaatgtcacgacacgggttgtgcaacatagtaaatgccagaatcccacaaagctgtggatgaattaagtatggagaattgggcatgactcataaacccataagttaattttagtgttccaaataataagtttttcaattggtggatttgattccggcatcgatttcgaattttttgtttattaatttccatttacatattttcggtcttttctaatttcatttgttttgtcagctattcgcaaatttttaaaaagtgcacctaaatttggcttgaactaaaaaaggcgcgccacttgttataaattctgcggaatttctacattttgtgaaaatg

SEQ ID NO: 98117 - DNA, 243 bp, Heterodera glycines
  Promoter: Source sequence=SeqID_22673; Location=1..243; Strand=+; Gene=SeqID_53357
ctctagagtcaaattgggtagagaattccaattattaaacatttaatctctttaaaaacaaaataattctatttccccataaaattcaatgaataatatttcatttttgctgctattctttttgtttgtcgttttcgttgatttcggttagaatatttaaattattattttttgctacattttctgtattttcagctacattgaccataattgccgctggtctgtttctctgcgtgccaaatg

SEQ ID NO: 98118 - DNA, 97 bp, Heterodera glycines
  Promoter: Source sequence=SeqID_416; Location=567..663; Strand=-; Gene=SeqID_51897
ccttgaaaagggaagcaaaactttgaaaaaatagataaaacattaaaatttaaatagattaaaaaggtcaaatttatataattgcaagaattaaatg

SEQ ID NO: 98119 - DNA, 922 bp, Heterodera glycines
  Promoter: Source sequence=SeqID_5221; Location=1..922; Strand=+; Gene= SeqID_57313
agtttagaacactttttaagccattatacggtcatttagagtcagaaaaaaaagtcattgacttaaattcccagccctaattattagggaaacggcggcggttcaatgggaaaatgacgaaaattgggacgccaatttgaacattgtccaatttgatctgtggtatggcaataattggattgggagaacagcgaaggtcgaggcctaggcttaggcttgcttgggcctaggcttaggcttgcttcggcctaggcttaggcttgcttgggcctaggcttaggcttgcttcggcctaggcttaggcttcagcttaaaggcgtgggcgggtggtgatttagtgatttgtgttcagcagacaaatctgtgcaaatggttgtgaaggagaagacgcaattgatgacattttgaagaaaaaatgttaaatttcaggacggattttttctcattttcacaccaatttttaagttacatattttataataaaaatttaccactattttgtttttatttcaagtaaaatataagcaattttgatgcttttgattgaatcaaaagtgattttaacttttttggaatttatttaattgcttttaaagaaaaaattaaaaaatgtagttttggcataatgctcattttgaaaccttttgaagaaaaaaaatgtacattttctggatgattttttttctcattttcataccattcaaaattttcccgccttctgaccacctattccctggattttcaaaattttgccaaaacttggtttgtcgaaatctgttataataacattttttgaaaataatattgcaaaaacatagtgaaaacaatgcataaataaagtgttttttagtttaattacctaatttctttttcgcaatcacaacttacgacaaaattgtttgcttctaattgccgcaaaatg

SEQ ID NO: 98120 - DNA, 361 bp, Heterodera glycines
  Promoter: Source sequence=SeqID_12686; Location=1256..1616; Strand=-; Gene=SeqID_76365
aatctgtaattaggaaaatcggaggggaaaaaatcacattatgaaattttgatgagggaaaaatctgagtcgccttgatttgatttgacttggcgctcctctacttcggctgctatagaacaaaaattcaaacttttggaatattttttttgggacggtgtcccgcctcgtaatgggatcccgctaaaatcccgcgcgtgatcccgtctcgcttcagtatctatcttctgcctctgctttttttattttttcaaataaagacacaatgccaaaaggaaaatgttatcgtgtcaataatcaaaaaaatttaaataacaagaaaagcgagaaatgctaaaacttttacatcaccacaaacatg

SEQ ID NO: 98121 - DNA, 586 bp, Heterodera glycines
  Promoter: Source sequence=SeqID_11059; Location=975..1560; Strand=+; Gene=SeqID_74395
agcacggagcggataggatgatgattaatgatcatgaagatggtgttgaacaacatataattaatgaatgcaaatgataaaaataaatatgccacaaaatttaatttttcaaattgttcaattgatggacaagttaattcttatccattttatttttgttcatttccgatgtatttttcgttttgttaattttaaaatatgtaggaaggatgaatgaggagcaaaaagctaagatgtcttgcccattctgcgcttatttattcagaaaaagagagagaattcaaatccgggccctaaaacagataccattttctcaactcagaaatggctatcattatcaattattgaacattggcatccttttgattgtatttttacagttaaataccgtatcccatttctaccctaccatatttttggttggcattcttttacttgttttttaaagttagatactgtatcccatttataccctaccatattttctggggccgattttgttggtttttttctagacaaaattgattgtgacttcaactagttcaaaaaccgtattttgcttttgccccctcactatacattaatg

SEQ ID NO: 98122 - DNA, 1003 bp, Heterodera glycines
  Promoter: Source sequence=SeqID_5049; Location=3407..4409; Strand=-; Gene=SeqID_56718
aatttggatatttctttttaattttactttttttcgtctttttatggctttttagtgccttttttgctgttttaaaactttttttagtcgactttttggcgatttttcgtggcttaaatcaccagccctattttttttttgcaaagagatttagcccaggatgtggttttgtagatcccctttttatcataacaaaaaaattgaaatcaatcaatcgtttttggcattctgtcgaacaaaataatgccgttatgtttttctttttttggcattttatccaacaaaataatgccgcttgttgtggtaatagcattgtctgttcaatcgctcgtccatccgttttgagccgtatttgttccaatgtttgtattcgtcatcaaatgggtcaaacacactgaaaaaacgcttcggtggcagctcatgcctggtcattaagaaattaattaattatttatttaaatttttatttttaattattatttcaatggtttttagccaaggcttcaatttgaatttaatatttgtaaaaaaaagaattgtaaataaaatataaatgaatgcattacacaaatgaatggcaaaattatgccaaaatttcaattttcataaaaatctaattgttgaatgaccttaaaaatttccattttttcttttctatttattattaacattgttttgctttaattgattttgttgttaagaaaaaattctgaataacaaaaatataaaatatattttctttagcaaacttttaaaattatttcattaacattattaaaccataaaatcaattaaaataatttgcaataaaatgcattctgcggaaaatgtataatttaaataagcttaaacgaataattactattcattttataatcattcgttattaatttttataaaaactaagataattttaaataagattattaaaacatacaaataatatttctttagataacaacaaaataattaatatttaagaaccaatcaaagaattaatatg

SEQ ID NO: 98123 - DNA, 1003 bp, Heterodera glycines
  Promoter: Source sequence=SeqID_19673; Location=459..1461; Strand=-; Gene=SeqID_84406
tgtctttcattcaggagaatattttcgctttatttcaatcattttattgcatatttccaaattttgctggaaattaaataatttttgttcgaatccaggtccagggttcgaaatgggtgttagaattgtatttcccaaccctgaaaacatataaacaaatttatttcgaaaaaaagttgagaaatgttcttttaaagagggaggtaccatcggcggtagtctacataaaatttttatgggaaaatgagaatgattgtgagtgggcaatggaggagatttatcaaagtgggcgggggggggggggagtgggggcggagactttgttcttgggcaatcgattgtgcagagaaaataaacattgaattgcatgttgcatttacaacactctgctttttttcctacacactttgttttcatgatttttcaacaataaaatccataatttttgttttaaaataaaaaggaagataaaacgccaaaataaatttaaataaaaattctcaagataaaagcatcgatctttacactcttgccaggttcttaaagatgaagataaattggagagtaaataggtattgaatgctttaattttagactgggtgaaatttctgaccgtaatttttaggggtttttgtctttggcaaggaatatcaatattaaaatacaatgctgaatggtctgaaaaaacaatactatcctttagttcaattgaagagactaaatcaaggtttgtaaaaagacaaagatcaagaattgaatttcctcttgttggacctataatattagtgtttagtgaaaatttattaaaaaaatcaagaaaagttattcctagactggtatgaggtactggaagattgttgacccaagttatatctttgctgccaatgttaaaagtctcctatgataatagtattgtttgttatatatttttctaggagtaaaaaaagagattttgtaagtttcaattacagatcaattttctgtttaaacataacgaaaaatg

SEQ ID NO: 98124 - DNA, 170 bp, Heterodera glycines
  Promoter: Source sequence=SeqID_11704; Location=1548..1717; Strand=-; Gene=SeqID_75193
gctaaaaagcaattaatttttaattatgctaattaattttaaattattaaaataaattacaaaaaacctccctaattcactctttctatgagtatatcattacataaaaactgtgaattttatttaaaataaattaaaaatattcaaaaaaaattgcaataattcagatg

SEQ ID NO: 98125 - DNA, 286 bp, Heterodera glycines
  Promoter: Source sequence=SeqID_14782; Location=1..286; Strand=+; Gene=SeqID_78923
tagataaagctaaaaaacataaaaaagtttcgtataaatggtacagaaaaaaattcaaagaaaaaaatgcgcaaagattttgggcacactctgtgtttctttttgctttttgcatattttcaaaaaaaattttttttgttgttgtttttttttgtttcattatgaatgaattttttttttcatttttttattggcttaagttaagtaaaatcactatgaatacaattgtgtccttgaatgataaggacagtccttaaaatttcccaagtgatggaagaaaacaatg

SEQ ID NO: 98126 - DNA, 957 bp, Heterodera glycines
  Promoter: Source sequence=SeqID_3673; Location=5913..6869; Strand=+; Gene=SeqID_51388
tttttgcttaataaaagtcgtaaaaaatattttgaaaattataaataaaaaataaataaactgacctgctgcagaataaaaatgaatttccaattttcttaatttatctaattaattgacttgacttttttattcatttaatttattaccacatttattattatgagtgcaaaacgtaatgatatcgctaataggccgaatattatccctctgtttttataatacatttacttcccttattaacaaaattgttaatatatttctaattaaaagttgttcggaatgcgcggcgaatgatgaagcgaaatgcgcttccgacagacggaacaaattagcagcccattagcatgacttagtttactttccccgttttttggtccctaaatttgctatacaaatatttgaaagtgaaaatagaacggaaactagttaaataggttcaccaatatttacataaacattatggaagtgaaaaagaaacaaaatattaaaattaaaggggctaaatttatgcatttgaaatgtttacatttctaatgcataatttatgtatacaaaatgatttctgaaccttaaaattttgtttgtttttttcaaggcaaatgacagtctagacagacacttcctttcacggataacaaaaaatatatgcaatggaatagtttgtataataatattgatattatattaaaatggcacttttaggaaacgcgctgacagccattttggctcatttaggaaacgcgcatgggtggcactgtttaggaaacgcgtcagcacgcccccattgaagggttataccccaaaactatttttatcataattatttttaactattttaaagaaattaccaaattggaaacgtaacaccggcaatcggtctaatccgatgcacatttgcatcgccaatgcgaaaggacttgcggataagataactaattgaatgtaatagcaatg

SEQ ID NO: 98127 - DNA, 87 bp, Heterodera glycines
  Promoter: Source sequence=SeqID_21365; Location=3123..3209; Strand=-; Gene=SeqID_51968
aaacggtgtgattaattatcaaatttactttttctcccgctttttaagaatccgaataacaaatgaaggagaaacattgtggatatg

SEQ ID NO: 98128 - DNA, 471 bp, Heterodera glycines
  Promoter: Source sequence=SeqID_14368; Location=1732..2202; Strand=-; Gene=SeqID_78398
tttttgccgttcaccactctattgctaacagcgcctagcttgttaacagagtgggtgcgcgtggatgaactgaaaagtgtcgccaagacacaaaatcagcagcgcaaattttcaactactaacagtacctaactttagcaggtccaacaaaaatgttgtttattatcgcctagataataaacaaatgtagtccagcagcgatgactttcgattgctgttgacctctccctccaattaagagtccaaagtttggaaaaagtttgttggttgcttcaagcaaaccaacaaatccaaaactgcttccacatttccaataaataagcccacagtgcaatacgtaagggcgtcgccaattgttatgccggccgatggcaaacaaataatcaatatttatttggagcagaggggaaaaagacacaaaataaatggggaggaatttttaaataacaagaaggaaaaataacacaaatg

SEQ ID NO: 98129 - DNA, 83 bp, Heterodera glycines
  Promoter: Source sequence=SeqID_5617; Location=1..83; Strand=+; Gene =SeqID_58669
aaaaatgaattttatttgtcttacaatggatcgaaaaaagatttaaattcttcaaaaatgtcgtgaacacaaacgatacaatg

SEQ ID NO: 98130 - DNA, 98 bp, Heterodera glycines
  Promoter: Source sequence=SeqID_22507; Location=1375..1472; Strand=+; Gene=SeqID_53176
attggccaattaattaattaatcccttttccgttggccaacagttagcgaatttgatcatatgctcccattttgtttcagatttctctctctgtaatg

SEQ ID NO: 98131 - DNA, 578 bp, Heterodera glycines
  Promoter: Source sequence=SeqID_14002; Location=1..578; Strand=+; Gene=SeqID_77969
gaaataaaaaaatagattttagggtcgaaaatcagaaaaaaattttcaaaattgcttcaaataatttttttaatcaatttattcgaacaaaagggtttaaactttatatttccgaatcctttattaattttaacaattttttgcgccgtattttttgaaaaaaaactttttgaggaccagggaggaggaaggaggccggcggtgccggtaggcgccgccgggaaaaaattgatatttgaatacaatacagtgtcagattttgtccaaaaatgaccaatttttgcaattttttgaacaaattttttaagaaaattaaggattttaaaggccctgtggtgccgataggcgccgccggaaatttttttttgatattttggctatatatttaacagtttttcgatcaaaaattattaattttgccaaaaaaaattcaattcttaccagtgtaattttactcccgtatttgggtgaaaatttacgggagcgggagcgcgattcctttacccgttgcgctcgcgtgaccataattgtgcgcatttagcgccactactcgcgaggtgccatatgaccaacacatg

SEQ ID NO: 98132 - DNA, 113 bp, Heterodera glycines
  Promoter: Source sequence=SeqID_23915; Location=1..113; Strand=+; Gene=SeqID_54605
ctcgcgtataatccgtgcttttatactcggtttcattttctcgactcaaaaagccacgaaccattcttttaaggacttcgatccaacaaagttttggatttgcttgtctcatg

SEQ ID NO: 98133 - DNA, 524 bp, Heterodera glycines
  Promoter: Source sequence=SeqID_4650; Location=1011..1534; Strand=+; Gene=SeqID_55234
taacttaaagaaaagaataactgtatcaatgaattcgtatattggagaatctgggtcccacccaaaattatttttctctcatgaaaagaccaacccgggggttttcggggcttcttatcaagaaaatatcttcttaaaagttttttggaataggctatgcaactaataattttgatacttaaattgaattttttttctgctttaaaaacgctttttttgcggcgcgcttcttcaaaaattttgtgggacagggggggtgatccggcggcgccaataggcgccaccgggaaacatttgtaatgtttaattcgatttgtttacagctttttgtccaaaaatggccaaaatttgcgattttgggctaattttttaagaaaaactttatgccataaatttcaaaaattctcaaccatgagaaaaaaattacattttgttgacataatgccataatttaatcaaaatattgttgaaaattacaaagatttctcaaatttcttaattttttttttaaacttttccaaatg

SEQ ID NO: 98134 - DNA, 443 bp, Heterodera glycines
  Promoter: Source sequence=SeqID_19855; Location=490..932; Strand=-; Gene=SeqID_84609
tcttcaaagggaaaggcggcaaaacagtgatcagaaaatggttgggaaaaagtgatcagaaaaatgatgagaattttaaaaaagtaaagtggggaattggggggggggggttctctgatcgatggaggattgctaattataaaatgattggagctataaattgggaatgtaatggttctcggatcagcttggaagtttattctgatcaaaaagtgatcagagtaaaaaaaattttgggatttcactgatcagaaagttttcagaagcaataaatttattatctaataagaacaaaatttgattggctaatttatttgatcagagaatgatcagaaccaaacatttacgtggtgttggatttgatcggaaccaaaaaactatggttttttttcagtttgtcactttctgacccaaatttgcgagttctgtatgatcagaaaatg

SEQ ID NO: 98135 - DNA, 354 bp, Heterodera glycines
  Promoter: Source sequence=SeqID_32332; Location=1..354; Strand=+; Gene=SeqID_62648
aattttaaaaaacaaccaaatctaggccccaaaacggaaagtacccaaaaattttttatcatcaatcggcagcaattgaaaaaaagagtttttttttgattcttcattgtttaaagattttttttttattattttggtttttctattttttatttttggtctaataaatattattttttttaatgttaagtgggttctgttttgctatcaaaattacaaaaattataccaaattcgaaaaaagagataaagcaaggacccggaaaatttttttttaatttttacttgcggatcagtgaattttatgctgctccatggtgtccaattttttatgaaacaagcatgcaaagggatg

SEQ ID NO: 98136 - DNA, 781 bp, Heterodera glycines
  Promoter: Source sequence=SeqID_4472; Location=3865..4645; Strand=+; Gene=SeqID_54577
tgtcgcagcagtcgtatagaaagagggatatgctaaagcgacggaagcgacctgcgctgattcgatcaggcctgatcactactaatcaatgtgtgtatgaatgtcactaattgttgtgtgtcaagagtgagatatatgcataataataatggaaatgagaaggaccataacgattaagcatcaagtaatcaatatcagtgatctgatcagaaagtctgatcaattacttttaatcagcaaagcacctttttaggcagtgtgatcagcaaattaggacagtgtctgatgatcaattgatcagagttccggttggaataaaactgattaaggcaatacaaatggaaaaagacaatgcacagattacaaaagaaggcatgcaaaaatttatgagacgaaaagatttttgagcaaaaaaaataaatcaaaagcaattaagatttaatgaagtgattgattagtgtgagtggagtaaaagagaatattaaaaaacatcattaccaccaaaaagtgcatttcgaaacatttttaagtcaatttttttttgtcaaaaagcaaagttcgatcgatcagaataaatattagcaaaaatgtgtctcagcaccaaacactaaaaaagaaagcaaaatattacgtcaactaaacccgaaaacaacaattttcatacataaattttaggctattagggccccacacaaaacgcttaaatcgtaaacaaaagcacaggcccccgcggggggggacgacgagggggggggggggggggggcccattccaaccaatg

SEQ ID NO: 98137 - DNA, 350 bp, Heterodera glycines
  Promoter: Source sequence=SeqID_7945; Location=2099..2448; Strand=+; Gene=SeqID_66463
tttctttaaatttaaaattattataaaaaacccaaaaaatgattacttttgttctcaaacaccaattgatcattgatttttctcgggccattacgattaagaaatagtttatgattataattgttaaaagcataaaatgaacctgcgaaaaaacacgtaattattgattgatagtgagaggggtgttagcgcgcagcgacctccagacgggctgtcccttttaatcgataggccacgcccatccacaaacacatagacgagagtgtagtggttagagaaagatacaaaagggcgccaattcaaacacacagtgaaacccaagccaatttattgattttttacagattatg

SEQ ID NO: 98138 - DNA, 102 bp, Heterodera glycines
  Promoter: Source sequence=SeqID_11188; Location=415..516; Strand=+; Gene=SeqID_74540
ggtaggccgagaaggataaattgttttaaattccatttaaggatcgtccattgggtgacttatcttccctctcctcactctgatgaaaactgccagaaaatg

SEQ ID NO: 98139 - DNA, 668 bp, Heterodera glycines
  Promoter: Source sequence=SeqID_26004; Location=826..1493; Strand=-; Gene=SeqID_56754
cttttcccccttgtttttttacttttttactccttgacacagaaaattcagtgattggtccaacgacggaattcaattcactgcttccatccgaccactttcattcattcatttcatttgatcatttggaaaataaatatttaattcgtaaaataaaataaaatatttttaatactaaataattaaatagtattacataatattaattaattaatcaattagcaaatgaattgcttttttctattgaccgtctttctgagcttggtcattaattgctcagctcctccaatacggtaataatttcttatgtaatcaaaaaccaaataaatattttaaaatttaaaagcattttaaaatattggggtccaagcattgatccaggcctaagcctggatatttgggcttcattttcacaatctctgctgctaaatgtgtggtcgttcgtccgctttttcttctgctatggcttttccccctttttttttcacttttttacacgtcgacacaaaaattcagtgattggtccaacgacggaattcaattcactgcttccatcccaccactttcattcattcatttcatttgatcattttaaatcaaataattttttaattttcattaattaaatagtattaatattcattaattaattaatcaattagcaaatg

SEQ ID NO: 98140 - DNA, 159 bp, Heterodera glycines
  Promoter: Source sequence=SeqID_15580; Location=124..282; Strand=+; Gene=SeqID_79870
ggtaaattaaatattataaattagaattatttattttctaaaattaaggcactccgttggtccgacgaacagtgccgtcaaaatgacattgaatgttccgctgaaaatcgacgcgaaatacttggcccggcattgttaaacattcattttccactaatg

SEQ ID NO: 98141 - DNA, 207 bp, Heterodera glycines
  Promoter: Source sequence=SeqID_1518; Location=1869..2075; Strand=-; Gene=SeqID_74149
agtcaataaaaaaaaattcagcataaatttaaaaaaaaccagaacattaaacccgtttaaactttatcaaacaatttgcaatttttgttttttttttgacattttatgcctttttctaaaaacttaaactttcatggatttattggaaaaaactcccagaatatggattaactattaatttatgtatccattaagaatggcctaatg

SEQ ID NO: 98142 - DNA, 148 bp, Heterodera glycines
  Promoter: Source sequence=SeqID_16557; Location=249..396; Strand=+; Gene=SeqID_80965
aagaaattcttcatttgaccgttggaaattctcattaaaatttggattttttaaaaatcttaaaaaattatgcacaaaaatatgaactgaaaatttttgaatatttttgtttaaacttttttttaactttacattcagaaaattcatg

SEQ ID NO: 98143 - DNA, 318 bp, Heterodera glycines
  Promoter: Source sequence=SeqID_10261; Location=1138..1455; Strand=-; Gene=SeqID_46853
ggggtgtattttaggtttttataaaacgattaaaaggtgcttttttgccgtgctaattttctttaaaaaataaaaaaggcagggacggtgaaaatttggtatttttaatgaaatcttttaagaaaaataatatattaaataaattgtcaattttcctttaaaaagtaaaatacattttttctgtttgtctgttttgtacctatttttttgatcgttttcggttaaccgaaacgttttgttaaccgaaatgctcggtttcgattatcggtttttttcataaaatgtaatttttctttctccttttcagccgtgcccatg

SEQ ID NO: 98144 - DNA, 135 bp, Heterodera glycines
  Promoter: Source sequence=SeqID_41174; Location=1067..1201; Strand=-; Gene=SeqID_69362
tttgaaggcccctaactttttttgtaaaactcgaatcaaaaagtgcccgctgtgagggcactccgccaaagtgtcctctaaatgctggtattttttaaaattttttttgagcaaacccctggcctgcaaaaaatg

SEQ ID NO: 98145 - DNA, 151 bp, Heterodera glycines
  Promoter: Source sequence=SeqID_21710; Location=1..151; Strand=+; Gene=SeqID_52320
tttttgaagagatttgtttttctccaatttcagattcatctttaagaaaataaatatttaagcctaaaattaatctattgtaaatttgccaaattcggcggcatttggtcagtttggagcagccgatgcccccccccccccggcgggcatg

SEQ ID NO: 98146 - DNA, 69 bp, Heterodera glycines
  Promoter: Source sequence=SeqID_28091; Location=1..69; Strand=+; Gene= SeqID_58745
atttccgttggttcaaatcttcaagtcgaattatgtagctggccgaagaagtggtggcatggagaaatg

SEQ ID NO: 98147 - DNA, 77 bp, Heterodera glycines
  Promoter: Source sequence=SeqID_38620; Location=1..77; Strand=+; Gene= SeqID_46572
caaagagagcccaatttcttaccacattcatttggtacagatacgtctcgacccccgaaggcgacgtggtaatgatg

SEQ ID NO: 98148 - DNA, 323 bp, Heterodera glycines
  Promoter: Source sequence=SeqID_3083; Location=305..627; Strand=+; Gene=SeqID_83129
tttatttttttttgcttttccgactttttgtttgcttgctgttgcttatttttgtgcgctgtttatgttttaagatgcttttcagttttcgttcttttcttcactttgtttgtgtgcatgcttacaattagcttgtttgcctgagttttacggcatttttgcagtttttttttggttttttgcattttgatggatttgcatcactaattgcatgaatgctgttgctttttccgctattcccttcgtttataagtcccccattttttgatagtttatgtatcaaaatacagtcttttcattttcagagtgttcatgccaatatg

SEQ ID NO: 98149 - DNA, 958 bp, Heterodera glycines
  misc_feature (136)..(136): n is a, c, g, or t
  Promoter: Source sequence=SeqID_30745; Location=1..958; Strand=+; Gene=SeqID_61143
aaaatggggtatgaaaagtttattggggaaaaaaagacttttacaaaataatacccctgggagaagggagtgggaaacatgatttcaaaattttcaattttttctagtctaatctactcaaaacggctcagaatcnaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgacaagtttattggggaaaaaagactttacaaaataatacccctgggagaagggagtgggaaacatgatttcaaaattttcaattttttctagtctaatctactcaaaccggttcagaattcaataaaaataacattcacggtgcgaaaaatggggtttgaaaagtttattttgaaaaaaagactacaaaataatacccctgggagaagggagtgggaaacatgatttcaaaattttcaattttttctagtctaatctactcaaaacggctcagaattcaataaaaataacattcacggtgcgaaaaatggagtttgacaagtttattggggaaaaaagactttacaaaataatacccctgggagaagggagtgggaaacatgatttcaaaattttcaattttttctagtttaatctactcaaaccggttcagaattcaataaaaataacattcacggtgcgaaaaatggggtttgaaaagtttattttgaaaaaaagactacaaaataatacccctgggagaagggagtgggaaacatgatttcaaaattttcaattttttctagtctaatttactcaaaacggttcagaattcaataaaaataacattcccggtgcgaaaaatg

SEQ ID NO: 98150 - DNA, 270 bp, Heterodera glycines
  Promoter: Source sequence=SeqID_9854; Location=1110..1379; Strand=-; Gene=SeqID_72875
tatttttttgtaggaagattaaataatttaaagccagtcattcgagaattccgcgtaagcttttaataagcgtgcgatttaattaaaccattccaatgagagcgttaaacggacaatttgtttttacgttgttttaagtatccttcttttgccgtagctcattcatcggaatgaattaatgaagtttcatagaattaaagcttccaaatgactctaattgtgcaattaaattgacaattagtgaactatttgttagagaacattataatg

SEQ ID NO: 98151 - DNA, 1003 bp, Heterodera glycines
  Promoter: Source sequence=SeqID_4864; Location=715..1717; Strand=-; Gene=SeqID_55994
gcagttttaacaaacgcgcatgggtggcagtttttaacaaacgcgctagcacccattcattgctataccaactaggtatcctctgcatcaggaatgacattttttcgggaattaaaattaaaaatataatagaaaatttataaattttttaatttggctaaattttaaaattcataaaagattacaattttaaattaaaaaaaatttttaataattgcgacaaaacttggttataataattaaaattttatagtgtgaaaaagctaaacaatttccatttttgttattttcaagaacatttttgtaatttgtagtttgaatgtttctgtccttctcaaagattcaaaatgcaatgtcaaatttgaaaaaaaaattttttttttttgcaattatctaaaaatactccttaactattgttttggtattttcaaagacaattctgagtttttaaacaatttttggcatttttttgaggattcaaagtcatttttggaggcagattttagtgcatatttcggcattttttgggtttttagggcatatttgagggatttttagtgcgtattttatgcgcatatttgccattttttagtgcatacaactaataaccccataatgattaagaagaccaaataccttatcattttttatcatatgtaaaagccaaacaattttctatttttgaattattttcataaatattttttgtaatttgtagtttgaatgtttcggtcctcttccttcaattactgataaaagtatttatccattcattcattcgttggtcatgtgtgtacaaatcattgaattaacacttttaatgagaaggtaataatgctggcatatatatatataaaaaaaagaaaatcagctaaacacttgcagaaataattaaattaatttagtcacaatttttcaaataatttgagtccaattatattttaattttcattatttttaatttaaaaaaaatattaaataaaataactttcagactccgatg

SEQ ID NO: 98152 - DNA, 294 bp, Heterodera glycines
  Promoter: Source sequence=SeqID_44003; Location=798..1091; Strand=-; Gene=SeqID_71560
ccactgctgattgtgaactgtgatgaaacaattttatgcctccattgtgattggcatttgtctttttaaaaatttgcttctttgacttggaactttctgtcattatccaccattagttcctaattatgtccaagaagcaataaattttttatgaatcaagctaattttgcataattaaaaagtcttggggcgcatgcgtctgtttgtctatgttttttcgatttggttttataatacccttttttttcctcggttttcatttaccataatttgcccatttttattaaaaggatg

SEQ ID NO: 98153 - DNA, 386 bp, Heterodera glycines
  Promoter: Source sequence=SeqID_37481; Location=256..641; Strand=-; Gene=SeqID_46516
ttttgtcgtcgaaatgtggagaggcgaaggttttgccgaagagagctggtgaatcgattcgtttgctttctaatgaaagtggcgaatggggcacagtgagccccttttatgtcgctaaagtggagggaacgcccatcccattgacagacaatgcaaatccccggtgggagcagagaaaaatggacgtgagagagtgtgagtgagagagtaaaacggcgtccaattttaaatggattttttttttggcacgaaaggagtctccgcgcgcctcaacaatttagccgccatttttcttagcataaatagcgcccacggtcattctcttcctcactcttcttcttttgctcatttgaattcgcttcactcatccccaatcagctaaaatg

SEQ ID NO: 98154 - DNA, 610 bp, Heterodera glycines
  Promoter: Source sequence=SeqID_4469; Location=1..610; Strand=+; Gene= SeqID_45818
atgaaaaacccggtttaaaaggaacgatagaaacgttggcaactgagagtaaacgtggagcggataatgttttagagaagggcggatttcggcgtcaattgggcacaggagggcgaagaaatcgtataaaagctaacaattcctccattctatcacatcaaacgctaattggaaaaacaataacaaaaccgttaattcaaagcaaaaagaggcttcgatcagacgcgtttgggctttattaaaaaatgacatttcacaaaattgacgcgagtagcatcgattcgattaccaatgccgttgattttttcagtatacctccgacaaatgttaccgtatcatcgtcaaaggttttcgagattttgccgagtaatccactcaccgacactccttatcattttaaaatacactcgagccaaaactacattgacctgtcaaagtgttaccttttgaccgaatttcgaatgcgaaaattgacaccaccaaatggtgaatggggacatttggatgctactgatcaggttgtaccgatacaattgatcgggcacaccttcatgcgagacctgaaaattgcaataaacggtcgtgaattttcaattctaattcactgatg

SEQ ID NO: 98155 - DNA, 390 bp, Heterodera glycines
  Promoter: Source sequence=SeqID_10545; Location=335..724; Strand=+; Gene=SeqID_73780
tagggagtacaataggtttggtttggaacacacccccctcccctcctgggttttgatggggcggcaactttaaagggctgcgcccctcccatagggtttgggattgtgcgggaaacacccgcgagaaacccgcgaggttttgacgccatatactacttgcatacttacttaggattagggtctaaaaagccacaatttttagaaaccaagttttttggagttcaccttattgtcggggattaactgaaaaatcgtttctgggtttgcttggtccggaaatttgtttgtattcggcatttttaattttctctgatccaattcccagtaataaaaaatgataaatcctaaaaattgcattgaattagttaaaattcccgagaaaaacaaatg

SEQ ID NO: 98156 - DNA, 531 bp, Heterodera glycines
  Promoter: Source sequence=SeqID_5567; Location=1634..2164; Strand=+; Gene=SeqID_58501
atttgtatttggtagagaaagattaccgtaattattttaatagagccgccccggggctctgtttttcaacctcccctcccccctcaaaaggggggctttatttcggaggggtggctctaattcaggggggggggggctataattcaataaatacgatatattattttattcgtactgtttttcgacaaaaaatcgtcataacttttatttaagtcggtcaaattaaacattcttggtatctttcgatagccctagatgttttcttttagttcacaaaatttcaaaaagtttcgttaaatttcaagaaattgatgatcaaaaatcgaaaaaaaatttgtttcatttataacattttattcaaacaattgtcaattttttgaaacttggtatgcaaatagagaattttaagggctttcgaatgataccaagaatgtttaatttggtcgactttgacaaaagttatgacgaattttttgtcgaaaaatttgagtttgattctgcatcaaatattattttctgctgttaagaatg

SEQ ID NO: 98157 - DNA, 94 bp, Heterodera glycines
  Promoter: Source sequence=SeqID_32647; Location=948..1041; Strand=-; Gene=SeqID_62939
gaaattcattttccaatttaatattagaaattgaaaaataaacctttgtgattgtttttttctctattattttcagctaagaaatttttaaatg

SEQ ID NO: 98158 - DNA, 279 bp, Heterodera glycines
  Promoter: Source sequence=SeqID_12031; Location=2355..2633; Strand=+; Gene=SeqID_47006
aggacattttgtatttcacaatattttgacagattttatctcagtcgtttttcttgttgtttagaatctcaatttatcatttacatcgtgtttattccgtaaatgagtatcaataattgaattaaaatttttatttatctattatacattcacattgtgttgttgtctgacaactgtttgtgtaactgaattattttacctgcatgagcattagtcctgaatgggagagccatggttatttattatgttttttaagatatcctttctatttgacaaatg

SEQ ID NO: 98159 - DNA, 368 bp, Heterodera glycines
  Promoter: Source sequence=SeqID_26073; Location=1..368; Strand=+; Gene=SeqID_56819
ccaatatttcaaaaactacgtaatgacaacaatgacttcacaggtgaacaaggggtgcgccggcgcactcccccccccccccccgtaagggggggcggctgtaaaggagggggggggaggtcgtaacgaagggggaaaaatttaaaatttgagcaatttcttagcggcgaaatccatacaaaatttaaaaaattttcccggcggcgcctatctcggcaccgccggaccgccccagccccttcccaaaaagtttttggaaaaacgcgccgcaaaaaaaaagaaaatatgagaaatttatgtgatcctttttttcatgactggtcatttctattttagggcaacaacagcaaaatgcaccggcgacaatg

SEQ ID NO: 98160 - DNA, 242 bp, Heterodera glycines
  Promoter: Source sequence=SeqID_18773; Location=968..1209; Strand=-; Gene=SeqID_83448
agtgccaagctgagcttcgcccgtccctggtcggtggtcgggggataggcccaaaaaagtcgggggccggggggcaacccaaacaaaaagaattgaagtgtttttgatttgtaattgtgcagagaattaggtaaagaatgaaatacatttcttttatcagataaaaaccgagccttgctaattatttatgattggctttttgccttaccgaaatcatcgctttctgaagcacattgccaatg

SEQ ID NO: 98161 - DNA, 418 bp, Heterodera glycines
  Promoter: Source sequence=SeqID_42313; Location=1..418; Strand=+; Gene=SeqID_70231
caaattttaaaatcttgataattcgatagccctaagtattatctattattctgcaaaatttaagaaaaaatagttaagtttcaataaagttatgacctgagaagctcagaaaaccaagttttttttcaacgtttttgcccataacttttttgtggcttaacaaatttttttgaaattttttaggctaatagaaaacacttagggctactgaatgacatcaatattttaaaatttggttgtctttgagcaaagttatatcaaaaatctttccatttgatggtttcttgacaaacgcccattttaatggtttttgactaacgtcatagcacccttacatatatattaatggcaatttccgtttatttctttttagtgctaatttcaatttttaatttcagctttgaaattttcgtagatg

SEQ ID NO: 98162 - DNA, 369 bp, Heterodera glycines
  misc_feature (94)..(94): n is a, c, g, or t
  Promoter: Source sequence=SeqID_44461; Location=778..1146; Strand=-; Gene=SeqID_71945
agcaaaagatattatgcgccggtcgctgctcaattccccgaaattcgagcagattcattcgttcgttttgcgctttttattccaacaatttccncaattccttcaatttttcaatgaaaatgcgttagattttcccgcatttagtcactttggtttgttaattggcaattttaaaaatgaatgaatttttctttagcaaattttgagcacaacgaaatcttttcgctgtacaaaaaaattcttcaaaatggcaattcggcagaagcgatttccgcggaaaatattctgtcattgaaattgttaactcagtccataaaatatcgagaacaaattttggccaacgacgcgttggaaaattcgcaaataatg

SEQ ID NO: 98163 - DNA, 66 bp, Heterodera glycines
  Promoter: Source sequence=SeqID_898; Location=1016..1081; Strand=-; Gene=SeqID_46340
ggtcagtattgtcgcggtttttgggtgcaaaatcattgcttcttttaagggggcggtgctcggatg

SEQ ID NO: 98164 - DNA, 442 bp, Heterodera glycines
  Promoter: Source sequence=SeqID_3816; Location=1135..1576; Strand=+; Gene=SeqID_51991
agaaccaagatttttgtttgagcctctgggtcgggaatggaaccatggtcgaatttgctggatcaaaatttaatccaccccattttctgggtccgcttttcctaataaaaagtggataatgatggggttcatacaaattccggtttgaccattgccctgtccgaactcgggataaacacaaaattttgcaagcaaatgcgtgtcagcataggcttctgttattttttttattagatccggtcctctgtgtttcgaaccccactaattttttcgtaaaaattgccgaatttcgggaacttttttatggggtttactgttggtcccttttccggctttttttctaataaacaatggaccaaaatcaaaaaatgcctcccctccaggagaataccacgccacattctctccttttcaactgtcactacagtttttgcatgccatg

SEQ ID NO: 98165 - DNA, 1003 bp, Heterodera glycines
  Promoter: Source sequence=SeqID_22981; Location=350..1352; Strand=+; Gene=SeqID_53684
agctgagaattttgtaatcatttcatttcaattaaaaaactattaaaaatattttattttgaataaaacaactattatatatttcacaaaaaatcagtccaatccattttattatatagagcaaacatttttattggttttgcattatttattttggaaacaaaatatattttttgcaaatccactttaataaaattaaaagaattcaattaataatttattccttagaaatttcaaaattttccgttccctcaattctcttttacggatttaaatgcttcccatggcgcgctacccattttcaccagcaatggcatctcgctccaggctaacacttttaagctggtgaattgactccaattttggttgagacggcaaatttttcataaagccagggtcccggtagtcgtgttgggtcgtttctaagtgcattttcttaatacctgctggttggactcgatacccggaaccgagaaatttatttttttgcggattttttcaaataaattaaagctgagctttttaaacgatcaattctatctctttctttttgggatataagagagagagagagagaggaagagatagagaatgaaaaaaaaagaaaagaaggagaaagagccagcgataaaaaaaaagtgagagagagagactgcgagagactgagactgtgataaagagagggagaaaaagggaaacaaaaagacagagttatatcgattaaaagaaagaatagagaaaggttattaaagcatatatcatcattttgacaaaaattacaaaaaaccccactaatttaaaaattttgccgagattttcccttgtaaaaactgaagagccgatctcgagttaaaaacttaagttccataaaataaacttggaatcgctagagggggtcaaaatataggcctatacaaaatttcaagaaatttaaacaataggaaaaaattttttacaaggctaaaaattttacaaaattacattcattttcaaggtgcaaatg

SEQ ID NO: 98166 - DNA, 1003 bp, Heterodera glycines
  Promoter: Source sequence=SeqID_2778; Location=3752..4754; Strand=-; Gene=SeqID_81544
cctaaaatggtgttttgtttttatagaggaaaagaaacagaaaattaaaaaatataattggagattaatagagaaaggatgggtagtggagagagtgcagtgtttgtttctctgtcggcgcgggtgggagggttagaatggtgctgagtcgttatataaaaaccctcaaaaagggcgttatataaaaaaccctcaaatggttttttttgtgtttttattgatttttccttgtgttttgggcgttatataaaaaaccgtcaaatcaatcaaattgtaagacatttcatcaaaattgggcgttatataaaaaaccctcaaaaagggcgttatataaaaaaccatcaaatcttattattaccgtattaatttagaaaaaacaatcgtgccaataaaataaaacctatataaaataataaatcattttaaataaatattttttatacaatattgacattaaatgtaatcaattattggatttatgtaaatgttacgtcatctaaaaaaaaattattcgctagatttatattttttattattcatattaatggaaatgcatggattgaagctataatcaatcctcaagaaattaattaaaaattgagcaaattttccaaaaaattattgatcaaatgctttctctttaaattgttcgtttaatggttttcgctgataaactgaacaaattttgcaaaatttgctgcagcaagattttttagggtttctttgataatgtgaattctttaaattgttcttaatgggtttttgcgataaagtgatcaatttttctaattttgtgctttcatgtgattgtgcattggcttgacaattataaaagggttaatttttcttaaaaattatatttttataaaatggctaaattaaaaatatttttctttgcatttttgattttgtcacaaaataattttcgtttggcgaccgcgaaatttcaattgatttggaaaactttaacaatgaatttttgtttcgaaaaattggtgaaatg

SEQ ID NO: 98167 - DNA, 66 bp, Heterodera glycines
  Promoter: Source sequence=SeqID_35791; Location=97..162; Strand=+; Gene=SeqID_65260
aaaacccgttaaagtataaatcacaattaagtcaatattttgccatttattttatctagaaaaatg

SEQ ID NO: 98168 - DNA, 247 bp, Heterodera glycines
  Promoter: Source sequence=SeqID_38448; Location=1..247; Strand=+; Gene=SeqID_67257
tctcctggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacattttccttctctagtctggctctaccaaacactcacacgatatttgaaatgctaacgaaaaaaattcttgcccaaaaaatg

SEQ ID NO: 98169 - DNA, 79 bp, Heterodera glycines
  Promoter: Source sequence=SeqID_40554; Location=1297..1375; Strand=-; Gene=SeqID_68852
taaaacacaaaatataagcattttatagaagcgaaccaccgtggaagaagcacaaaacaatcaaagaaaacataaaatg

SEQ ID NO: 98170 - DNA, 977 bp, Heterodera glycines
  Promoter: Source sequence=SeqID_22060; Location=656..1632; Strand=-; Gene=SeqID_52694
actcactctccttttatttctctcgcgattcttatttcattctttttctctcttttcactctctctctctctctcttgtgtcatatctttcctttttattcgctctctctttctcttacatttccccaatccccatcgttttctctcacaaattagttttcgctctccttctctgtttctctctctcttctctctccctctctctcatttgtcctctctctcctcttttctctcttctcttctttctctaattctctttctcccccactctcttcccccccctctctatctctccatttcactctctcctctctctctctcttttctctgcctctacttcacctctctctcagtctctttttttctctactcttttctgtctctcccttctctctccctcctcttttctttatagctttttcgaataaggaaaaattttcaactcaaaaatttttattgaaaaaatgaaattttagcaaaaaatttttgaaaatttttcaattcttaggagtgtattttctgaaattttttcgagtcatttcttaagcgtgtattttccagattttaatgcattttcaatggaatttttcggaaaaacgccaaaaaaggcaccaaaacggcaaaatgccagaaaaagcatttaaggcacgaaaatcccgaaaaaggcaaaaaaaggcataataaaagtcaacgtagaagcctcaaaccaagtggaaaatgcgttttttatgcttaatatatcgaaactagtgcgtagaaaaaaaggcatatgcctcaaaatgcgagctctactgataattaaggattgtattaatttatttataaaaaaatgccaatgtttaaataaataaatatttaacgtaaaagcgatagaatgttttagaaaaaaaaaattaataaggcatagttcgtgagactaacggattataaatcccatccccaataatgaggctaattttcaaaatttggcatttatg

SEQ ID NO: 98171 - DNA, 166 bp, Heterodera glycines
  misc_feature (52)..(52): n is a, c, g, or t
  misc_feature (60)..(60): n is a, c, g, or t
  Promoter: Source sequence=SeqID_32819; Location=799..964; Strand=-; Gene=SeqID_63054
atttttctcgacttaatcacccatccttccatcaatcactaattaatgtctnggaaggtntaaattaaattgagatatctatctttatatttttgtatggttttgttttctcctaggctttgcccagcgtccgttgcctgcgctgccggtgcgcaaactgagcatg

SEQ ID NO: 98172 - DNA, 203 bp, Heterodera glycines
  Promoter: Source sequence=SeqID_1535; Location=2444..2646; Strand=+; Gene=SeqID_74312
tctggaaattgatttcagaattattttgcattttaagaattgacatttggctttcatccgttaccgcctttcttaattagtgttgccaaaaaaattttcgtgcccatcgccaccggcgcaattaataattaaaatgcccaaattaataattaataatttttctttgtaaaaaaaacaaaaattaaggcagcgagttgcgcatg

SEQ ID NO: 98173 - DNA, 58 bp, Heterodera glycines
  Promoter: Source sequence=SeqID_6869; Location=1574..1631; Strand=+; Gene=SeqID_63160
gaattaacaaaaatattgtcgttttatttttaaaaataggctgacgcttcgtctgatg

SEQ ID NO: 98174 - DNA, 141 bp, Heterodera glycines
  Promoter: Source sequence=SeqID_8983; Location=2490..2630; Strand=-; Gene=SeqID_69914
attaagtaaactaataaaatttaggcagaaattcggcgacagaaaatactcgagtgcgtgaaagctgaaccccgaatcaaaccgacacggcttttggcggaggtgaggcgttcaactgctgacgagacctatgtggcgatg

SEQ ID NO: 98175 - DNA, 329 bp, Heterodera glycines
  Promoter: Source sequence=SeqID_4405; Location=1704..2032; Strand=+; Gene=SeqID_54332
tctaaacagcattgaattgagtgtatgcaacatttcaaaagtatattttatttttttttttatttcgtaactaaaatgatgacatttcggttttaattgccatgaaattttacaaattttactgcaaaaattgagaaaaaaaccaatagggcgacagtgattcttgagtagttatgccgaattttttgtcaaaaattattgccaatggttgtgggaattggcaaaaaaaataaaaaatgagattaaattgtcattattttatttcaagaaattattattggggaaaaaattggttactgtatttataaaaaataaaataaaacaaaatg

SEQ ID NO: 98176 - DNA, 1003 bp, Heterodera glycines
  Promoter: Source sequence=SeqID_26217; Location=1272..2274; Strand=+; Gene=SeqID_56970
ttggttgcttatagggactgtctctctcattggataattttcttttgtctgttttccatttcctttgtttatgtgctttttgcgtatttttgtttctattcatcagctttttgctttttctcgctgcttggtatttccgtcttatgaataaaaatgtgttttattttattacactgcaattggggctgttttatggtcgggattttctcgcgaaaaaaggtattttttaggacaataaaattgttccgagtcagcgtaactttctcaagtcggtaatcctttggaattgctgtcccaccggaaattgaaattgcttataaactgagagcccttgtgaaactaaatgcgcttcttcaagttcgactttcctagtcggttcaggttctcatatccggaaaattctcggcttttcatgatttagttcctactctcgaaaattcatataatatgggggtgtcatgagtcttgacaactcgaaaaaacttgcatctgctgtttgtagaattatttctaaaacatcaaaacagtggcatattaaaaaaattttttagtttggtgaattttcgatatttatcaagacttgcccaaaataccgaagtaagcaaataagatatgatggagggactgaaatttcatgaaaaattgtctcctacaaattctctccaatatcgagccgagaacatagagaagcaaagaaaaagagatagtgttagtgagcaggacagacaacgaaaggaagaaaaaaagagagaaagagccatcagcgggaaagagaaagcgaactcacactgctgaacacagagaaagagagagagagagagagagagcaaaaggaaaaagagacaacgcagaagagaaagcccctcgggggaacaaaagcgaacggccatttcttctgctcttgggacacacaacctacagcgtcttcttcccatgccaatcagctaattagccactaattaaccccaaataacaaaactgtcccctgcttctcccgacaatg

SEQ ID NO: 98177 - DNA, 164 bp, Heterodera glycines
  misc_feature (42)..(42): n is a, c, g, or t
  misc_feature (51)..(51): n is a, c, g, or t
  misc_feature (55)..(55): n is a, c, g, or t
  misc_feature (128)..(128): n is a, c, g, or t
  misc_feature (160)..(160): n is a, c, g, or t
  Promoter: Source sequence=SeqID_731; Location=3739..3902; Strand=-; Gene=SeqID_60013
aggaataaacgcacacttaaaagagcgtgttttattttgacncaatatttncacnagaaataatcgttttccgtattcttcaaatcatttgggcacttgccatttagaccaagagattggcacttatntcatgatttctctgaagcaagatccttcccgnaatg

SEQ ID NO: 98178 - DNA, 686 bp, Heterodera glycines
  Promoter: Source sequence=SeqID_36758; Location=247..932; Strand=-; Gene=SeqID_65999
acatgaaaaacatttcaagttaagttaaaataaatggaattatcgaaaagaaaaaaattaaataaaaattttcaaaatgtaaaaatgattggcatatattatgaagaacggcaaaattgttaaatgacagaataatggcaaaccaacaaaatgaagaatcatttaaggattaacaaaacaaaattttgaatttggtcgtctaaattagctgagcggcaagggattagtataagaagaaacttgcagaattcaaaaaatggaaggggattaacaaaatgcaaaagtacaattataagagaaaaaataaagatttcgaatgatttaataaaattatatttaaatatatttttatgttttcaaacttttacaaaaagcaacaaactattttaattctaaaactaacaaaaaaaatcaaaaaaggcaaaaaagtattaattaaaaaaaatttttaaatttggtcggcaaaattagctgagcggcaaggatcaattgccgtaggcaaaaaaggagcatccaatgaaaaggggaggagggactaattaaatataaatagtaccaaaaatgtgacaaattctcattttgcttttcagttaacacttatttgtttatcaattttgctttaatatttttttgaaattttttttctaatttaccaaacaaatttagcaaattttttcttcataatg

SEQ ID NO: 98179 - DNA, 941 bp, Heterodera glycines
  Promoter: Source sequence=SeqID_30197; Location=1..941; Strand=+; Gene=SeqID_60632
tcaaatcgaaaaattattatgtaatttaaaaaatggatttgttatttttttaatagattagaaattttttatttataaaaataaaattaattgtccacaagattatatccgtggtgtcgatgaagataacgtatatagcaacattttatttgtttattttaaataatgaaaattttaacttgaattaaaaaaatttaaaaattttttatttaatgaaccataaactcatacatatatgataaagattgaatgtcaatcatattaattttaagagttcggtttaaatcatattattaattcagcaaacataatcgtcgatcaacaaaatatttatcaatttatgcgtaaatgatttgttaaaaaccatatattttctttctcctgtattatttaatattataacctaccattttaactcaaatttatttttgaattctttattttcttatggtagtattccataaattttctttgcagtaatgataagcataactttaattttgtaagaactgataataataaaatggtatgctaattaagcaattgtgattgtttgattaataaataagtatattttaaatgggtttgataggatacatgaatagtgaaaatttatttagctttatgtttgtgaaaatttaattgaaaaatatttttgtgaatgtttttacacataaatgtttttttttataaattgccatgagctatcaattagagtgccacgggaccgggaatttttgccaaaaaaaaattatttatttataaaataacctttaattcattgctttcttatttaagtaaatggaaaaaatggtattaaattgtaaaacaaaaagccaaagtagtatttgaaaaaaaaagtatttcaattttctattcttgaaataaaactattattttaaatttaaaacatatattacagcttcgaatccttctgcatg

SEQ ID NO: 98180 - DNA, 207 bp, Heterodera glycines
  Promoter: Source sequence=SeqID_7464; Location=1..207; Strand=+; Gene= SeqID_64901
aattttttttaaagggcaaaaaaaatttcacaaaataaacagagggcggttgctggccttttaaaaagcaattttatttttggacatgtctcgatttaaataaaattgaaatttgctctaagcatatagagagttagttatttttgagaaattttcaaaattttttcattgtgtacttttcgatttgcataactcgcaagcaggatg

SEQ ID NO: 98181 - DNA, 382 bp, Heterodera glycines
  Promoter: Source sequence=SeqID_31927; Location=720..1101; Strand=-; Gene=SeqID_62240
ggtgtggaattgtggtcccgatggaaaaatagtaaaatttggcgtaaaacttatacacggatgttgtaaagtttaaaaagagctttcgaatgagcttttgaatttatggagaaggaattttttgaaatttataacacaaaatcccagaatgagaaggacaatgaaggaacaaaacaaatgaatccaaatttccaaatacaaccataaaattttttaagtgttgaacatgacgccaaatttttctaaaaataaaaaataaattttggtaaaaaaacgagtactgatataaatgatggataaaatcaatgattttgtaaaacctaagctcagatgcgtaatcagtagggagtgtaattatatggatataaaatcgcgaaatatg

SEQ ID NO: 98182 - DNA, 1003 bp, Heterodera glycines
  misc_feature (278)..(278): n is a, c, g, or t
  Promoter: Source sequence=SeqID_12729; Location=182..1184; Strand=+; Gene=SeqID_76428
tacaaattttgaatatttaaagctaaaagatttataataaatttattgtaaattctaggcaataaaattcaaaaaatactcaaatttgataacagactttcaccaaaaaaaagcaaacttgcgatttttaaccatttcatgaatttcgttgacaaatattcataaaaaatatctataattttgaaaaatttacaaaaccaagttcgtaaaaaatttaagaaatagaaaaacgaaattcatttcttgaaaaaatttacaaattggaaaaaaaaattaanatagaatttcgtaaaggttcaactaatgcaattcaataacgtaaggattttgagttttttgcacaaaaattttgcttttttccattttttcgatttttgccaaaaattttacgaaatagacccgccaattccaaagtattggcgaattgactgcacaaaatttaaaaatataatccatttcactttaaaaaagccaaaaaaaaaatccctaatccgtatcaagaattgtacggatcaggatcgggattacggactaggcacccatacggattacggatttacggattaaaaatccgtaaaatccgtagtccgtaaaaaatccgtattggccgaaaaaaatacggattacggactacggatccgtaaaaatccgtatacggatcccgtccgtatccgatctctattaaaaacagtaattcacataaatgcgagtttttgaaattataataaaatataaaaataaattcaacaaaaatacaaaaagattttgtgaccgacatttgggaaattcaaacaataaatacgagcttttttcatgttttaacggaaaagtgacttttaaaaggaaacaaaaaacgacaaaattaaatggataaataggagaaaggaatgtttgctgatatttacggataatttccgcggaaaaaaaccaatttaagatttatctacactgattaatgatcaattactagttaatggtctttcatttccagattctcagtatg

SEQ ID NO: 98183 - DNA, 138 bp, Heterodera glycines
  Promoter: Source sequence=SeqID_8935; Location=1..138; Strand=+; Gene= SeqID_69707
tatcgggcgaattgggaacgcctttctcattaactcagatttgtttggcatcaaaagtgaagtctgctaccgggtacaaaaaaaatatttaaagacaaatttacacaataaatcatttagattgcctgtaagcacatg

SEQ ID NO: 98184 - DNA, 216 bp, Heterodera glycines
  Promoter: Source sequence=SeqID_16841; Location=467..682; Strand=+; Gene=SeqID_47398
aatatggtttttaagaaaatcgatcaagagtccgtgaattcgataacatcagctttgtccatttttaccttaccccctacaaatgtttctataagtagttcttgtgtacgtgaatatttaccgcttaatccgttaagcgatatccctttccactttaaaattcatccaagttcaaattttattgatttaaataaatgttatattctaaccgaaatg

SEQ ID NO: 98185 - DNA, 635 bp, Heterodera glycines
  Promoter: Source sequence=SeqID_2419; Location=4354..4988; Strand=+; Gene=SeqID_47293
taggaatatgtttgcactgagataaaattactgtttatcttaagaaatgcaaaattattgcccagcagaaaacaaaagcgatgcagacaatgtgagtcaaaatctcaaagtctatacacaaatgtatgtgaattgttgttctcatctcagttctcgagagagagagagtgacgactaggaaaggcttaaggccaaaggcatttaaataaaacgccaaaatgttacataagttaaaattttcgttttttcattttttttttctaaaatttttatttgtttcaagacaatttatgcgttttaccattcaattacttcaaaaatcgcaacgttgttataaacttctttttacaaattacaccaaacaagttgcttctgtgtcgccgcttttaattcatagtcaaaatttgataagtttttcggccttccgcaatttttgctcttcaattgagacgaaaaaggaggaaatcggccgaatcaaatcgcaattggcaatcatttttacgtgtaaagtctgttccacgagacaggcatggcttttgctttatataagcaaaccctttcgattatccccaaatttaggggcctaagcaattctcgcgttcagcttatgaaaacggcgttgtgctgatccgatg

SEQ ID NO: 98186 - DNA, 471 bp, Heterodera glycines
  Promoter: Source sequence=SeqID_5366; Location=1..471; Strand=+; Gene= SeqID_46030
ccatataagagcccataatatggtttgtgattaggaatataactacctctcaacaattttatattaattttcattaaagtaaatttatgatttaaactaattttaacaaaaatctttttaattgtaacacttttatcaaattgagggaggtccataattcatttttttgcatgaatttattttcattgaaaagtttgtgcagaagaaaccgacgttatcatttttttcttcaaaaatatttttttcttcactttatcaatgttttcgtttttatggggacattaaagttctgcacattttcaatagcacttttgtattaagtacatacttaaattgttgtgaataagatggaaaaaatcatcattaagaaactaaaatttttttatatttaaaaaaaattcaattttatttgttgaatttatttttgaagaaaattgtaccgcacttttcatttcaaattagcacataatg

SEQ ID NO: 98187 - DNA, 1003 bp, Heterodera glycines
  Promoter: Source sequence=SeqID_1961; Location=1181..2183; Strand=+; Gene=SeqID_77034
ggatttttagtccgtaatccgtatgggtgtctagtccgtactcttggtccttatccgtattttctcaaaataccgatctctaattaatacattttttaaacaaaattatcaataaataaaaatagaccattcttggcataattgttaacagattaaacccaaattttcaaaaaatttttatttcgttgaaatttaaaattcaattttcatgactaaataaatcatgaaaacaatatatttcaaaatattgacaaaatatcgaaacaattaaatttcaaaattcgcttggccgagtccaaaaattcgtaaatcttattaaaaaaattggctcaaaatcgaaaatattcagcactttttgggcaaaatctgttaacagacccatgcaaattttcaaaaattttcccggcggcgcctatcggcaccgccggacccctttctcctgaaaagtctagaaaaagcgcgccgagaaaaaaagatggattgaaaaagaaaaaagtaatcagaaatttttgatcattttttgaataagattcacttttttcaaattgccggatccgaaaccggtttccggattgggaaaaattaaaattttcacatgttaatatttgtaaaaaccggcaaaatttcatttattaatatagaaattcgatgcaccagaaatgtcgccgccaaaaagacataatgttgccgacaaaataaaaaattttaaaattttcaagatattaaagcatacaaaaatatttatgataaaaaataaataaataaatataaacaaataaaactttattatggaaattataaaaaattttgactatatggcataaggtaaaaatttaaaaaccccgaaccccgaccccgaacgattttgttaaccccgaccccgaacttgctgaccccgacaaccccgaaccccgacttttctaaccccgacgttcgggggtgcaaccctaaattatttacaagtaaaaacttaaaatactatgtttagctacaaatacgaatg

SEQ ID NO: 98188 - DNA, 1003 bp, Heterodera glycines
  Promoter: Source sequence=SeqID_9391; Location=1325..2327; Strand=+; Gene=SeqID_71225
tttttctttataaaatatttagattttatttttttttaatgttatttttgtatttatttaatattcaagttattttaaatttaattttaaaaaattattattttataaataaaaaaaaattattattttattttaataaatttaattaattaaaaaaacaaaaaaataaatctaaaaaaaaatgaagtatttaaactaaatattgaatagaaaacaaacatcagaaatgggactcgaaccctcagccatcacagaaccaaagtcaggcacactaaccacttgaccactgggtcgcttgtctgcatcctttttaattcccttttccttttccttcttttttggaagaaatcccgatcaaaggtgcttgaaatccctttttagagcatttcccggacccggacccaaacaaccctggtatcattcgaaagccaagagtttgtagatcatgcgaaattgtttcattttttgatttgaccacttttaaggcatgcaaaaagcgttcaaaaataggacaaccaaaaaaagtgcaaattttgactcgttttccgaacgcagttcgaacaattcttaaccaattgggatgccgatagtttttccttatagccagtccaaaaccctatcgaatgataccactcccgacccgtaacattcggtagaaagtcttaaattagtttttaagcttgaaactggggtatattattcttatatagggaataatgaatttgtggaccgaagtaaagaataagcttatgtttgtttctcatcattcggctcattttatcttttaaatttccaaattaattaaaatttaagtcggcgagtcggcccgcaaccgttttggccgcccttacatttcgggacggccgctgctgttgtgcgaccggcagaaaatcatcaaaatgtaccgggagggacgccgaaagattgcaatcgcacgcgaaattggcgtcacacattcatgcgtttccaaagtgatcagaaggtaagtgagtgatcggagatg

SEQ ID NO: 98189 - DNA, 330 bp, Heterodera glycines
  Promoter: Source sequence=SeqID_18861; Location=672..1001; Strand=+; Gene=SeqID_83561
acccccgacgacattcgaaaatttaacaaatcaaaattacccagaaattctgtaaattttccgaaattgggaacttttctaattggttttttaaatttttcttttattcatttatgttttaggaatgtgtgttctcctcattcttcgccatcaactattttatctcaatttggctttgcattaataggtaaacagaattgaaaaaagtgccgttgatggaaatggatttggcagagtctcaaaaatggctaaattttgggattgaaccaccagaaaagaggtcaaactgtggtaaaaccgaacagaaaatttagcaaagtgttcgcaatg

SEQ ID NO: 98190 - DNA, 182 bp, Heterodera glycines
  Promoter: Source sequence=SeqID_18036; Location=2720..2901; Strand=+; Gene=SeqID_82615
tttgaattgggcttgcctttaccggcctatgcttcttcccccgtccaaattatgcattttaattggccttaattcagttgcctttgatcgctttgctcattttttggcaatgacactccttaattagtttatggaggaatgccactttcgaacattggccaaaaagcgaaccatttaaaatg

SEQ ID NO: 98191 - DNA, 80 bp, Heterodera glycines
  Promoter: Source sequence=SeqID_14424; Location=708..787; Strand=+; Gene=SeqID_78469
tgtcaaaccaaaatcttaattagaggggcgccactttggcacgggtgccaatacattggggctgtcaagagtctcgaatg

SEQ ID NO: 98192 - DNA, 369 bp, Heterodera glycines
  Promoter: Source sequence=SeqID_8100; Location=5857..6225; Strand=-; Gene=SeqID_46544
ttcgggggttatcgggccgctgattacaaatatgacatccatttcgaccaattccttactatcgttttcagcgcatatgaaaacctataaaagtggttttgggtgtttttgagtttgggagctcagataaacacctttgggtgggtcactgatcagtgatcactaatctgacgttcatcttgaacaatttctacccctgaatcgaattcgaacaaaaaccgaaagtccaaatttttgaatttcactttttatgttcgtatctgtacagaaggatcggcactatgacatttcgccaactggacatttcgccaactaagccaaattcggacgtttcgccaactacccataaatcggacattttgccaaatg

SEQ ID NO: 98193 - DNA, 1003 bp, Heterodera glycines
  Promoter: Source sequence=SeqID_1157; Location=1892..2894; Strand=+; Gene=SeqID_68983
acatccctattaattattagccccggctcaaaaaattgatcccaaatcaatgcaaatgttgtaaaaaaacaaaacattgtttttcaccaaaataagagaaattgttgtgtacataagttgaataaattatatatatatatatatatatatatatatatattgtttaattttaaattaataaacagagaaataaatttgatttaaaaaaaacataattttttctccatttatttttcgtaataactaaatatgttaattcatatcttgctcacaaatcaacaatgttttgttgaaaaataatcatttgttttcccccaattattttgatcaatttgttgaccgtgggcaaagcgactaaaaatgagagaaatttggggggggggggtcataacgaaacattactttctcctgctgctgacctacataaattatcataaacaaattattggtttttgggtgtgtggcctattagccgattaattctttacgtttttttcgactcgaaaattcctttttcaaatttccttgagaaagttaaatttgcggcagaaaaaaaacaacttgcgaattggcacaattcggattatatgaattttattttatgcaagtccataatttggttttttatgaaacaaaattccaaaaaaaaataaaaataaataaaagcatcttaaatattttcattgccaaaaattgccattaataatcagattttgatttttaaaattgttttaatataaattttgcaatcttcaattaaattgttaaaaattaattttttattttaatttattcttttgaatttgttatttttaaatgtgagattgttttttattgctttgacaaaatatttttgcaaaaaccttttttctgtttcatttttgtgcatttcattacaaatttgttgtataaaattaaggaaaaaaactattttattataatgaaaagaatcggccaagaaagtgttaatggcgggcaaaagccaaggaaaagcaagaaaatg

SEQ ID NO: 98194 - DNA, 209 bp, Heterodera glycines
  Promoter: Source sequence=SeqID_30340; Location=1..209; Strand=+; Gene=SeqID_60758
cgcgataaagccatatgttgtggagagaatgtggcattttccgcagaaaaggatcgataacatttccttgcattcatttatttattcttcatgatgggttggccaaatacaatttcaaaatatcggaggaatggaattttaaatgcaatttattttcagatattttttgtattatttattcttttcaattaaaaaacatcttcaaaatg

SEQ ID NO: 98195 - DNA, 798 bp, Heterodera glycines
  Promoter: Source sequence=SeqID_20824; Location=1..798; Strand=+; Gene=SeqID_51412
aaaattctaaaatttagttgtcaatattattttcctccggtcgtgtgaactgcaatagagccacatcttttttgaaggggttaattcctttaaaaaattatgttattcacctctcagctttacaccatgacgacaaagaagaatttgatgcagtaaatgggaattttgtaagtgcaaatttgcgaaggattccggtgataagcaaagtcataatgtttccttaaacccaaaggttacaaaaaattaaattaattaatcattaattatggcggaattttatttacattgtattgcttaaaagcattatgaaagaagctcaaaaaacgcatttcatttgaacgtcaaaagctgcgtcaataaaaaaagaaaaaaaaacaattttttcggagtttttgaaaaaagaattttggcaattggcattattaatattcagaatgccaaatattttttgtgttttttcaaaaaatctgtggcaaaaaatatttagaaaacaagttttttgaagttttctggccataacttttttgaaacacaacgaaaaatttttgaaattttgtcttctaatagaggactattttggctataaaatgataccaagaatgtttaatctggatgattttataaaaagttatggtcgattaaaattgttaaattattttatggtcctgtgaactgcagtaaagccaaacgattcccattaagatttgcttgtttgaaaagataattcaagaaacaattatttattctggcatcaatcaattgtataatggcaaaagtgtgctaattgcagcaaaaatg

SEQ ID NO: 98196 - DNA, 1003 bp, Heterodera glycines
  Promoter: Source sequence=SeqID_9272; Location=502..1504; Strand=-; Gene=SeqID_70820
ttataaatttttcatttctcttgctgttgtcaaaattgctttatcccttctttgtagcatttgaaaattgttttctgatctgattgacgaaagcttcaaatgttttccaagtattttttgattattttatatccattaaaataaatattatttatatatatatatatatatatatatatattttttttttgctaaaaattgaccgatggcattttgccttttctccattataaatctttttcacttctcttgctgctgctgctgctgctgtcaaatgtgttggagatttattgctttatcccctccattaggctgctgatgaatagtggaaatggtgaacagttgtccgcccccccgtctcatctcccaaaaattctcctcccctcggggcaggggtcaaattttgtcagcagaataaattgttcgtattagctctgttgtaggtaggtccattttgatcagaaattgctttttttattgaaaataatattaataaaaataatttaatgctaaaatattttataaaaaatttaatttaattaatttgttcataaaaagattattttatcaattattttttattagaataattacatatgtttatataaaaataatttaattatttttctagcaattactcaaaaatttactctaaaatattataaaaatacttttattaataataataataataattattattattattattattatattttggaatgtttcatagacatttcttttaattcattttccatttgttgttattcacacttttttaaggaaattagaaacgatttgtcatcatcatcttatacatgtataaattgtcacctccttcttctcccgttttttgctgccaaaaacaaaaataaattattatttttattaaataataatttccattaatagagttagtcctcgaccccgaaatccccccgacttttcgtccccgtagaaccggggactaaactacattaaattttttgcagaaattatg

SEQ ID NO: 98197 - DNA, 1003 bp, Heterodera glycines
  misc_feature (947)..(947): n is a, c, g, or t
  misc_feature (954)..(954): n is a, c, g, or t
  misc_feature (988)..(988): n is a, c, g, or t
  Promoter: Source sequence=SeqID_27368; Location=115..1117; Strand=+; Gene=SeqID_58061
tttatggataattaaaagaaaattggcgttcttatacagtcgggtcagaagtattgcttaaaatttttttattaattagtatttaaataatttaattcttaaaataggcaaaaaaatatttaaattacttaatagcattaaaataacctaaaaaatgtatagagcgtaaaagcggtcatggagtttttgggaaaattcgttaaaaagaaaattcaaaaaccgaaaaactctctagagtggcttgcatgaaaactttgaaaattttcaaaaatgaaaaaattattggatagagcttacggaactcaataaaattttggaataaaaaagaaatttattaagaatcatttctgagaatttgttttaccgactcaagttgactaccaagaaaagtaaaaaatttctgaaaatttttgcggaaaacaccaaaaactacattttagtaagtataaaaattatttttttaatatatataaaaattaattgagggtttgaatacaccctttttgagatgctctttcgaattacaagactgaaattgtaaagtttaggaacaaaatctcagcaagccattttcttgttcgagactttatcgacataatttcaccatatatctggcatttcttaatcggaaatcaatttcaccaaattattatattctcataaattttatttcgattaattcgtagtaattcataaaaaattttctaaaatgttaattagttttttgccagactctgattaacaatttgctgtgaaagttatctgttggtcgatcattagcagagggatggacaaatcatcacatttaacattgggaaaatagaaaatcgaagcaaatgggccaccaccattgatggtcgaaatgattaatcgtagttgggttgggaaatcacaaattcaataggtaatttggccgtacattttcattcattgggtggcttttcccnagagttntacgctcatctctttccccttttctattccgccntaaatcgtggctatg

SEQ ID NO: 98198 - DNA, 139 bp, Heterodera glycines
  Promoter: Source sequence=SeqID_14089; Location=1..139; Strand=+; Gene=SeqID_78064
acaacaataacaccaaaacaccaattgttgttgttgttggagaagctaacggcccgtagggaaaaagcattctctgttgttcattatacttaaaaaaataagagaaaaaattttaaattttagcataaagaaaataatg

SEQ ID NO: 98199 - DNA, 54 bp, Heterodera glycines
  Promoter: Source sequence=SeqID_1471; Location=1..54; Strand=+; Gene =SeqID_73747
tcctttatttacgctcaaaaacttcgttccttcccgccacagagtccgatgatg

SEQ ID NO: 98200 - DNA, 305 bp, Heterodera glycines
  Promoter: Source sequence=SeqID_661; Location=2398..2702; Strand=+; Gene=SeqID_58491
gcggcatcacctaggggtggatagcacccttacggagttcctaactattgggtacctcactcgcgaacagcggtgaaaagggtactcaaacagtgcctccgatgtcgaaggatgaatgcataccagtttgcattaccaaaaaagcctccactgccggaggaacgtgtctgccgacaaatggcttttaagtcaattggtattgactttttgagaccaatggagacacgattggcaggacataaagtcaaagcattgataattatactaacctgcctcacacgagagcggtttacttagaagccatg

SEQ ID NO: 98201 - DNA, 176 bp, Heterodera glycines
  Promoter: Source sequence=SeqID_24344; Location=707..882; Strand=-; Gene=SeqID_55063
tttgagatgaaatcgtcgatggaatgtatgaaacttttggtggccaaagaaatggaaaaatggaaatatgccatccttttacaggcgcaaactccgctttttattcgttttttatttttacaatttaaaattggcttttgccattccctccccctcagaatgatgacgtacaaatg

SEQ ID NO: 98202 - DNA, 854 bp, Heterodera glycines
  Promoter: Source sequence=SeqID_5458; Location=3582..4435; Strand=-; Gene=SeqID_58127
gcttaaatttcaaaaaaaaaaatttttttttttgaaaaaatttacggcattaattggactgggaaatcgttaatgggaccttttgctcgagcacaaatctcgagagtcgagactgaaagctgattgaagtgatctgagatcagctagtttccccaccccctcggagaaattcataaaaatgaattcttttctcaaaaagttgaattttgaaaattaaaaaaaagaaaaaacttctacttaagaaatttagaaaaagaaaaaactcaaatttattgtcggcggggggattagtgcacccgtagtgatcttgataagaaagccatcaaaccgagattcgagataaaaaaatgccatagaaaattttgcccgttttttgatttttggctatctttagttccctggttttatcccgaattggaaatggaattggaaaacgagattacaaaggcacaattaaacttcaccaaattttagtcccatccaaaaatacacatatatcttcttgtggagcaagttttgtgagattaccgtataatcaaaattacagtaagcatcgcatagaaatttagttttcttggtgctaatcttgctaaaatattataatgaactatgccaaataaaaatgccattgcattattaaagcattccaacccctctgtctcgtaacatcaagttctttttacaatatatgaatggcacgtatcgcccaattattatagtatacccaccccgttttgtgcgccgccgccactgccaccgcgtgccttcaccaagtgctgctccgtgttgaagtgtgccatcaatgcggtgtcggacgcaaagcgttgcccgtccgcgcaaatgtcgcaaaaatg

SEQ ID NO: 98203 - DNA, 712 bp, Heterodera glycines
  Promoter: Source sequence=SeqID_8920; Location=3639..4350; Strand=+; Gene=SeqID_69646
ctgaacagtcaaataaatgctcttttgatatgcttttttgttgttattgaattttatttggcatcgttttattgactcaatttttgttttaattggacttgttttctcaaaatgttaaaaaaggtgtgacaaatattgtttttttaaataatctggaaaataaattcgttgtagatttgtttatttattgtttgctttgtctaatttaattaaaaaagcactctcagatgggcattgtcactttggtcctccgtttacccctccggcggtgtttccttttgattcttccgttggcctttttgtcctgcctttttctgttcttcgtcatttcccctatcagtatcagaattattcatcagaaaggtgatttccttttgcctttacaaatgtgtttggtattaaaatgccaataatcactaaaaatgccaattgttacggtgtttttcccgtccgtttctttcgctacgaccgtttgggtccgttcggcaatttcacaaacgtcgcattgcgacagcgcgtcggatgcgtcgacccttccaatggtacctttggcgtttgtctgtccatttgttgtttttgtttgaaggtgttccgatgagtgtccaatgggacaaagttccctatttctatcccatccaaataatccaatttgggctgggacaatacaatttggacagaaaaggtaagacggaaatgtggacaaaaggaaatg

SEQ ID NO: 98204 - DNA, 79 bp, Heterodera glycines
  Promoter: Source sequence=SeqID_4405; Location=2585..2663; Strand=-; Gene=SeqID_54333
tattttggcatttctgtggcccgccatttatttgaccaatttggacagcgacgagaagctgcactttgcgcgcacaatg

SEQ ID NO: 98205 - DNA, 75 bp, Heterodera glycines
  Promoter: Source sequence=SeqID_13164; Location=1..75; Strand=+; Gene= SeqID_76983
aagtcattcaggaatacatatggctcatatccacctttgccgtccaaagacgaagactcacccatagcgcaaatg

SEQ ID NO: 98206 - DNA, 322 bp, Heterodera glycines
  Promoter: Source sequence=SeqID_41667; Location=426..747; Strand=+; Gene=SeqID_69744
aattaatacataaatttgtaaaatgtcatgatgaaaaaatgaataatagatgtatatacgttataataattaataatatttaaataaaataaaaataaatattattttttaattccattttatgattcggatcaaattcgcgcatcattccgagatcacgctcacattatgatggtgttatcattaaaatgattcttgaaaacggctttaatgtgttcatccacccaaattataagaaggaagttctttgcttgttcgatttagcacgaattaaggcatttaaaaatataattaatttattattaaattgttattttagatg

SEQ ID NO: 98207 - DNA, 311 bp, Heterodera glycines
  Promoter: Source sequence=SeqID_3013; Location=1394..1704; Strand=-; Gene=SeqID_82770
tctgaaatggccaacacataaaacgaagagtgaatgaatgtgttgatcaccttggatggtgcgcggctgaacaatggccgccaaaggggacggctgaatgaaggaggaagtggccaattgggagaagggcgacggacggagcgcgccctcgcccagcagagaatggccaatgcgcgaggacgacgccgccatcgcatttggacggatcgaagccgcgagcggcggagggggaggcgacgacgcgtcccttctcttaagaggagcgacaataacaattgaccgttttgataaagctcatccacctcgtcatg

SEQ ID NO: 98208 - DNA, 257 bp, Heterodera glycines
  Promoter: Source sequence=SeqID_3785; Location=1146..1402; Strand=-; Gene=SeqID_51869
ttataaaccattttaaattactatacctacgcagtgggcaaatagttaactaattcttgtgaattattttgccttttttgtgagcgatgccaacctttgggatttttgttgcagtacgggcaaattgtcggggcgtctggcagcgcttggcccatgtccaacagcgggctgcccgaggaatggatgcttcatgagacggagaacaatggcattggcaccgtttcgtcatcaccaatcaccactaacttgccatgatg

SEQ ID NO: 98209 - DNA, 104 bp, Heterodera glycines
  Promoter: Source sequence=SeqID_44562; Location=220..323; Strand=+; Gene=SeqID_72041
aagtgctttgaaatgttcaattatttcgcgtactgtttactgtacaaatatttcatactttaattttcctcaatcttattttacgatttttattgaaaaaaatg

SEQ ID NO: 98210 - DNA, 625 bp, Heterodera glycines
  Promoter: Source sequence=SeqID_9513; Location=2242..2866; Strand=-; Gene=SeqID_71705
atttccgcacctcgggactattttttatgttgattagaggtcataagagattgattgaaacatgttttttgcggttttttagcgggcccaattctgcactacacccgttcgcccatttcagttatttatgtcacctatgatatttgaatttactcgtaatttgatgccatttttcaattacatgaatttccagtggtaaacaagcaattataataagtgttgtgctgtgttgataatgatacttatgcccgcattccgctttcgaattcgcgcaaatgcgccataataatctgctgaattttcccctctcccaatccaaccaaagctgtgtaaattttttgtgagaaaacatttttaaaaatataaaaatatatatgtacttttgtaaaatgttataaatgagaaatgcataatgtgaatattagaataagataattttattttataccaaaattttattcataatatacttaaaaataattgagatgaatgaccggttttgcgaaataatttattttggtttatttatttttgaatatttttcaattggttgaaagaataactttttcaaattgttttatcgatgacacttactatttaatattttaaaattaaatttaaaatg

SEQ ID NO: 98211 - DNA, 144 bp, Heterodera glycines
  Promoter: Source sequence=SeqID_14952; Location=1236..1379; Strand=-; Gene=SeqID_79113
agggaagggaaggaaaaacgaaagaaagagagggaagagaaaagccgaccattcgttgagcatttgtctgtgttcatcttccgcttcaggtcaccagccattgactctttgcgccaattcggtaaatatttcttggacaaaatg

SEQ ID NO: 98212 - DNA, 701 bp, Heterodera glycines
  Promoter: Source sequence=SeqID_3601; Location=4841..5541; Strand=+; Gene=SeqID_51049
tttttatacaaaaaatttccctgaaattttttaattgacagttttttttgcacaaaaagcgattcgtgccgattaccattttttgtctttacgcctttataaatagagacggaatgaactctcattttcattctatctgtaatcattcaacaattgtatttctctgcaattattattataatgtgtttcggccggaagaagaaagggaagcgacagagttcgcctgagtacaccaaagtggtgagttgtttttttggttttctattccagtttacatgaccataaaataatttgacaattttaatgcattaaaactttttctaaaagcatccaaattaaatattcttggcatcatttgatagccccaagagtccttcctctattagtctacgaaggtttaaaaaaattcacccaaaattcaaaaacttatgccaaaaaatgttcaggaaagcaattttttaaattttctgatcataacttttttgaaacataacgaaattctttgaaattttgcaggctaatatagaactctttaactatcgaatgatacaaagaatatttattttgatgcttctagaaaaagttatgatccattaaagttgtcaaattattttatggtcgtgtaaactgcaatagcgtcgttttttgtcatttaatcattttgtttattttctttaactcctcttcccacctttaagatg

SEQ ID NO: 98213 - DNA, 153 bp, Heterodera glycines
  Promoter: Source sequence=SeqID_10374; Location=627..779; Strand=-; Gene=SeqID_73561
gctgatcgaattaaataattttaatatcttttgatagccctaagtgttttctctcatttgtctatgaaatttcgataaatttgcatgagcttcaaaaaagtaacgaccaaaaagattccgaaataaagagttttgtgaagtgtttggctcatg

SEQ ID NO: 98214 - DNA, 171 bp, Heterodera glycines
  Promoter: Source sequence=SeqID_12826; Location=1..171; Strand=+; Gene=SeqID_76548
caaaaactagactataaaagctttacgcggcggaggattttgtgttcactctacgcctgcggagcctgcgtaggggtctgtacgcggcggaggacttttgtcttcactctacgacagcggagaaacttgttcactctacgcggcggagaacttcactctacgaggcggatg

SEQ ID NO: 98215 - DNA, 71 bp, Heterodera glycines
  Promoter: Source sequence=SeqID_13466; Location=781..851; Strand=-; Gene=SeqID_77357
ggttggaaatttttggaaaaaattaaaatttcaaaaatcccccccccccatttttaggtgccaatcgaatg

SEQ ID NO: 98216 - DNA, 211 bp, Heterodera glycines
  Promoter: Source sequence=SeqID_1091; Location=6018..6228; Strand=-; Gene=SeqID_67689
ggtcgcgtcttttgtttttggaaagtgcagcacataaaccaagttttagtggttctactggacagcggatgaccattacacgggcgtgggcgagtggcgcgaattcactccgctgtcggttgcgcagctgaacaaagctgtcagggagaagaagacttctgttcgtctgacggttgcccagcgcgtttacttcatcgacctgaacgagatg

SEQ ID NO: 98217 - DNA, 406 bp, Heterodera glycines
  Promoter: Source sequence=SeqID_212; Location=1128..1533; Strand=-; Gene=SeqID_77793
aatatgaataaattcaaattcatttaaaaccttccaaaataccatggaattggtttttaatcaaataagggtttagtaatagactaattttcatcatcacaaaaaattttacaacttagaaaagtttttattattttttcgggctctctaaaacgaaaaatgttatcttttaaaaaattgatggcatttttccattaataacggattatccactggtgaattgtttatttggtggattgtctaaaattgattgtcatgtagaaccaaatcattatatccccttatcggtcgttaaacacagacctaaagtgcaataaaatcaaaaaaaattatttgtaattgttcaatttaattaattatcaattatattgtcctatttatttaatttttaacacagataataatg

SEQ ID NO: 98218 - DNA, 63 bp, Heterodera glycines
  Promoter: Source sequence=SeqID_1218; Location=1..63; Strand=+; Gene =SeqID_70088
tagaaattctatccgtcatatcggcttttggaattttaatgagtaaatcagtaaccgtaaatg

SEQ ID NO: 98219 - DNA, 605 bp, Heterodera glycines
  Promoter: Source sequence=SeqID_24491; Location=1..605; Strand=+; Gene=SeqID_55219
aactcgttttgcatagtccccaaatttaccaaaataaaattttaattttcccattacggtacttatttatttttgaactggttttttaacaattcaataaattttttttaacttttgggaaagtattaaaacccaatacgaattcactgatcggaaagtacagaaaattggcagagagtgcatgtgtggaaactgattgttaaatcgttaccaaaaaggataaaattgacaagtgaattgtggtcagagtgatcacgatcaagagaaaaacagtaaaaattgtgcggaaaagtgagtgtgcccgttggattgtgagtaatcacggcattatttggcaaacaaattggtgttagacagagagtgtaccgtcccgactgatcagagagtgatcagggtttatcatacaaaagaggccgagagggcgatacaatacataactttggcttaacatattactaaccaaaatcaaaatacatcacactcctgactacctcgaaaggcgtttcaagcataagccaataagcgaccttgagcgggaaagacgtaagcttgagagagaccgaaaaagaaaaagtggaaaaaacttaggagaaaaccgaaatatg

SEQ ID NO: 98220 - DNA, 684 bp, Heterodera glycines
  Promoter: Source sequence=SeqID_7410; Location=5571..6254; Strand=-; Gene=SeqID_64740
taatttgttttttcggcactatctacaaaaatttttctcatctttaactagggccgtgactttttagtgacgaaaaatctcaaataattaacgaaaatagtgagtaaaatgccaaaatagtgataaacagtgggaaaaaagtgcgatataggaacgaatagtgacataatttttagccaaaaagtaagcaaaataatttttattcgcgcgttgcatttgaaaatgattagggctaggattgttaatagcgaaaaccaaaattggtacctaaaaataatttttaaattaaaaaaccttgccaagaaagtgcatttttgagaaaaatttccatctcaaaggaatttaaaaatttttgcgtcgattttttggggggggtgtctttttataaaattttaaatcgatttttagaggtgtatttttcattttttttcattttacgtaaaatcagcgtttcttaggcgtgccctttgaaatcacggggcatgttttgccgacgaaaattggacgataatcgccattgtgcggcgtgcggtcacacggcaaaaatcccattaaaaaatctttttcttcgcatcgaactggcggattgcttggatcctgaatgcacacaatacgcaaccgttttttcgactgctgctgaaaaatttttgcagttgaaggccgtcgcgattgatgagatagatg

SEQ ID NO: 98221 - DNA, 144 bp, Heterodera glycines
  Promoter: Source sequence=SeqID_11612; Location=609..752; Strand=-; Gene=SeqID_75062
gcttgtgttggattttccagtgtcggaatttccggtgtcggattttccagtttcggattttcctagagccgacgttacgacccgcagcgaacaacaccacgcccgctcaaggtggtcatgccaacaaccacacaccaacacatg

SEQ ID NO: 98222 - DNA, 1003 bp, Heterodera glycines
  Promoter: Source sequence=SeqID_15938; Location=396..1398; Strand=+; Gene=SeqID_80288
agaaatgtcacttgggctcgtctaatcgtgggttttactttacccgtttacaaaatttggctgtccacagtcacttgatccggctcttctcttgctggaaatttgttttccctttttccgatttttccacacttgtcgacacctctttctttcttattcggcgtcgtttttccctttttccctcatctgttgtgctttcaacattaaaaaaagtaccgaatgatttttgtcccccctttaaaaaaattcaaaaatgttaatgtaaaaagtttgctgaggtttggggcgtcgctgatcacgaatccggcatctttctgccaatttcgaaccccgggcccaaaatcgaacaaaaagtcaaaacttcaaatttttgaaattcgcattttcgactaaaaatggtttgaatataacggaaatattctctatgctctgtttcataattactggattcgtgaatacgacttgaaaactagagcccggaattttgaaatggccgggaccgggacttggaaaatggaccgggacttggaaaatggaccgggacgggatcccggggccgggactcccgtttttctgggactcccggtcccggtcgtttgtccaaaataaccgggaccaggagtcccggcaaaatcccggcgggctcccggtcccgtccgacgcattcaatgggagggaaaaattgtaattggggcgtttcagtaactcatcaagaattagaagataaatatattatgtaccacaattttaaaatgcatatttttaaaattctcggtattaaggtttaaaagcacaattaaaattcaggaagtggactcattggcaaaacaaattctatgtagtttggcgttatgtttctgctcactgatcaactcttctgttttctttgtaaacaaatttgttttctttttgttgccttttcatttttgttttcatttctgtttttaatttacaaatattttcgtaaattttcccaatttttagtaaaacaaaaccaaaaatg

SEQ ID NO: 98223 - DNA, 628 bp, Heterodera glycines
  Promoter: Source sequence=SeqID_3853; Location=4247..4874; Strand=-; Gene=SeqID_52153
gtttcttaaatgttgaatccccttttgacaaaatcatttatttaatttaatgatcaattttcacttatttattttgtacaacttttcttctctctcttcaccgatttcctctcccatcctaaccaatcgttacactttactgtaaacccaagccaagccaatttgtgtccatcccagctcactctcgactccaccccttttctcttttgctatttaaactgaattcattccttgcattattacccttttttttactcactttgactcattcccattttacttgcatttctcacttttgctaaataaactttcattaacaaacctaaagtcttacttttgattgggaaataagtcgggaacacaacatctttttggtgccacgacccgggagcaaaaaaaaaaaaagttcccttttcccaaatttctgagcaaggccgagtgccgaattgctgtcgagggttggtcgaagctgtgtgctcccaaccgaagagactaattgcggagggctagtcgaagctgtgtgctcctagctgatcaaacggataattatttgagttagtcgatctgtgtgatcctaaccgggctgtgtgccaatttcaaaaaaaaaaagtggaaaaacagtaaaatg

SEQ ID NO: 98224 - DNA, 380 bp, Heterodera glycines
  Promoter: Source sequence=SeqID_34753; Location=1..380; Strand=+; Gene=SeqID_64472
aatatttggtaggtgttatgtggtgataccctccttcaccttagattttttgtaatttttttctgctgtattgtaaaaaaaaaaatgaaaatttgaaccttcattatcatcatcttaaatatcgaagaaaaaaaatagggagccgggtcacaaaagcaagagcaagtatgaaaattaaaaaaaaatttttttttgctttatctcgaaatagaaaaaaattacggggttgctgacctaataaattttcttaaaagatcaattaatgtattcatttggctaaattggccaaatgtgtacggctcggcctttacattttttaatagttttttttttaattagattcgtgttcgggcaatcaattcggtgggctgcagtgcatg

SEQ ID NO: 98225 - DNA, 53 bp, Heterodera glycines
  Promoter: Source sequence=SeqID_16210; Location=2986..3038; Strand=-; Gene=SeqID_80577
ccccccccccccccacaaaaaaggtctgtgccctttatttgctgttcggcatg

SEQ ID NO: 98226 - DNA, 110 bp, Heterodera glycines
  Promoter: Source sequence=SeqID_34145; Location=589..698; Strand=-; Gene=SeqID_64017
agaaattttctatgcaacaaacgctctcgaacatgaaacgaagtgcggtgcgccatggccattttatttttcaaataatttttatatttaatagatattccagaaaaatg

SEQ ID NO: 98227 - DNA, 166 bp, Heterodera glycines
  Promoter: Source sequence=SeqID_7429; Location=1811..1976; Strand=-; Gene=SeqID_64788
aatgatattattataccgtatttattgcattatagccccccccccctgaattagagcccccctctgaaataaagccccccttttgaaggggggggggtgacaataaagccccctgaattaaagccccctccaaaaatgaaaataattccagtttttttacggcatg

SEQ ID NO: 98228 - DNA, 575 bp, Heterodera glycines
  Promoter: Source sequence=SeqID_457; Location=2531..3105; Strand=-; Gene=SeqID_53202
aatttctgttaatttttacattttttattgttaaaattattgttgaatttatttttaaactgtttattttacatttttatgctgaaatttaaaaagttgtttttactgtgatttcatttttctgtacttggggcccaaacgaccctggggcccaaaaacgagggcccaaacgcgggggcccaaacgcgggggcccaaaaactggggcccaaacgcccccgactcacatatgtaatatgtagaaaaatccgaaaatatgtaaataaaagtctcaacttttgttcgcaaacacaaaaaagaaagtgattttcctactaattaggttatggagaatctaggaaaaaaatgtatttacataaaattagcatccctataaatcaccaattatgataataaaatttattaaatgcattcccactgactcagcaccatccatcccatcgcatcacatttttctccactcggttttagaattggcggaatcactttattaaccaaaaataaaagaaaagtgaacaaaataaaacgaaaaagcattctttttaaatatttgtattttcaaaaacttccaaaatg

SEQ ID NO: 98229 - DNA, 97 bp, Heterodera glycines
  Promoter: Source sequence=SeqID_5247; Location=1437..1533; Strand=+; Gene=SeqID_57450
ggtgcggaaatttggacattcagtagcagcatctgttttttcacatctgtttaaacaatccttttcacaattccttttatttttagattataaaatg

SEQ ID NO: 98230 - DNA, 261 bp, Heterodera glycines
  Promoter: Source sequence=SeqID_15111; Location=1124..1384; Strand=-; Gene=SeqID_79292
agtcctcagccgtttgggggctgggaatgctcgcttttgcgttgaatcgacctcctcccatttccgtttgattctgaacgcgcggtcggtggtccacgactcgggaaacgttctctgcagagttcgcgaacagagcacggcccaacagttggaagaagcggctcgacgagtgactgagtctttgcggaaaacactcgcttctctgccggacaatggcattgtggacagagcggtgattttggcaccgaatttgccagcatg

SEQ ID NO: 98231 - DNA, 135 bp, Heterodera glycines
  Promoter: Source sequence=SeqID_43842; Location=821..955; Strand=-; Gene=SeqID_71422
taaatctgtaattttaataaatatttttattattataatttaatttgtttgaggatccaatttttgctgtgtttgattctgttgcgcatggccttcaaacttttctaaacgttccttcaattgaacgaaataatg

SEQ ID NO: 98232 - DNA, 457 bp, Heterodera glycines
  Promoter: Source sequence=SeqID_1819; Location=1113..1569; Strand=-; Gene=SeqID_76175
ttaaataagtgcaaatcaaaagggtcctccctttggtttttgataaatttcaaaatccaaagtgttaatgagttccttcttgattcgtcctttcttgttttcaattattaaatttcgtgaaatgcgtaaaatatggtaaaaaagcaaattctgtatcaaaataaaacaaaaaaattttagtccaaaaaaagtgaaaaaaatttttaactgggtttggtgctgcggtagcgccggattggaccatttccccccatttagccaagtggtgcatatgcacgcggcccctccggcgccaccgcagcaccaaacccagcgaatttttgtacaacagcagcagcagcaacaaatggtgcctacattgccaccccaaagtgcgcatgacccgtccctgcacccgccccctcttccgcacccgcacctttacatcggatcgcaacggtttaccgctgcgataatg

SEQ ID NO: 98233 - DNA, 125 bp, Heterodera glycines
  Promoter: Source sequence=SeqID_2632; Location=1352..1476; Strand=-; Gene=SeqID_80811
aataaacttttgcttttattcctccgccttgtaaaaagtaaatcatcctttatttaaggcatgaattgtatcaatcatcatctatttaaggctagaatttatcaattaaaaatactttaagaatg

SEQ ID NO: 98234 - DNA, 673 bp, Heterodera glycines
  Promoter: Source sequence=SeqID_2358; Location=823..1495; Strand=+; Gene=SeqID_79313
ataggcgacaccatgaaaattttttgtgaatttaattagatatgacaaaaaatagtgtaaaatttcaacaaaaaaaagcttgccaatttcttggaaaatttattccaagtcaagaaaaaacccatggaaacatgtgttcataattttgaaatactaaaaaaaagaatttttttctagcaataaatatatacacatgaatatttttaaaatcttttaattcgtcagtgacgaagggacagcccaaaaagaatgcttcaacgggaaaagccgccaaaaaagtgaaaaaagcggatgtcaaaggagcggttgattgaccaaacaattcttttttgaatgtataattttttcccagtgctcccaagtgtgcagtttttcagatttatgttaaattttaaggatttgagtgtaaaagttgtacgggacctggacacggacaactgagtacctaggtcccggttttttcccggaagttgggagcactgttttttccatatttgcgatcagatagacaataattgtccactcaatgttagtaaatgaagtatgtatgtttaagttggtatgaatataaaacatgttttttcaaagacaaatttttctatattttgtcaatattttgtgcatttctcacactactaaaatgcgataagaaagatttatttgatcggcaatg

SEQ ID NO: 98235 - DNA, 72 bp, Heterodera glycines
  Promoter: Source sequence=SeqID_3401; Location=348..419; Strand=-; Gene=SeqID_84528
ccttgagaaactaaataatgaggtgtactagtactagtataaagaaaaacccactccattgcagttggtatg

SEQ ID NO: 98236 - DNA, 130 bp, Heterodera glycines
  Promoter: Source sequence=SeqID_35172; Location=428..557; Strand=-; Gene=SeqID_64795
ggtaaaaaatttactttacggaattttttgaaaatttaaattgcatttttttaaaattaaaattgtgtcaattaaggaaatatttttaattttcgaaatttttccatttttagcactcaatgacctcatg

SEQ ID NO: 98237 - DNA, 591 bp, Heterodera glycines
  Promoter: Source sequence=SeqID_13721; Location=1..591; Strand=+; Gene=SeqID_77640
tgggccgagttccgaatgatgagacacaaatagcagaagaattaattgcgttggataaagcctggatttttagggtttcctattttttacggattgtactttggatgaaagaagcacgaaaatcaattttatccaaaaaatttttgaattttgttcgtcttaaattgttgccaatgggaggcgaaaacccattgacaaaaacggaaggcgcggaaacattttggcataaaatgacgacggattggaagaaaaagggaaccgcaacagaggagaatattttgcaaaatgatgactagggaacggatttttaagcgcgaaaaagtccaaactaaggccttaaataagggcgaaaaaaccaaaatttggccaagaaagaaaataaattacaaaaattttggtcaatgaaaaaataaatttatgtggaaaattttttgaaaatttgcaaaaatgtgatctcgtcaagaaaaattttcgaataaatgcgtcaaaacgaagaatttccgagcgaaaaatgtgtttttcgtgcatttctcgtcgagttaaagccgcagaaaaataagcaaaaacttaaaaatccgatccctaatgatg

SEQ ID NO: 98238 - DNA, 164 bp, Heterodera glycines
  Promoter: Source sequence=SeqID_26499; Location=467..630; Strand=-; Gene=SeqID_57230
ggtacgaaaccgtaatcttttataaaaactttatgacaaagttaattttctgtaattcaataatgaggattttttacggctgaaatgaggattttcaaaattttgagatcgaagctctgggttaattctatctttttcatatttaattttttagtttcgacatg

SEQ ID NO: 98239 - DNA, 316 bp, Heterodera glycines
  Promoter: Source sequence=SeqID_11727; Location=1526..1841; Strand=-; Gene=SeqID_75213
agagtttagccagctgaatttttttgctcatttgtcagctggaactgctgctattcccatatgtaaacttccggcgcttgacaaacccttgggggaatttaatttattcttccattaaaaaaaatgggaaaattcttttatggaatttccgtaggaattttccgtgcccagcctaaaaattcgcgatttaagaaatattttcgttttgcactaaattttttgaaatttttgtttctcgccaaagacctaaaaacgcctaaaaaataattttttaaaaataaaaattcttattggagattaaagatggaggagaatg

SEQ ID NO: 98240 - DNA, 63 bp, Heterodera glycines
  Promoter: Source sequence=SeqID_15006; Location=1839..1901; Strand=+; Gene=SeqID_79159
acacaattagcaatgtgaaaaaatgccaaaaaaaaaaatttgcggcgcctcacatcatggatg

SEQ ID NO: 98241 - DNA, 186 bp, Heterodera glycines
  Promoter: Source sequence=SeqID_8818; Location=278..463; Strand=-; Gene=SeqID_69309
tttattccaatttcaaattgcaactttctttcatttccttttctttctttttgggttaacggtttttccaatttgttttctctcatcggctttttatcaatttttcaaagtcatttagcttttccgtttctccaaggttttatcttttatcagtgccatttgataacataattcgcgcacattatg

SEQ ID NO: 98242 - DNA, 64 bp, Heterodera glycines
  Promoter: Source sequence=SeqID_7707; Location=4176..4239; Strand=-; Gene=SeqID_65696
tttctttcgattgctttttctcattcccgagtgcatttttcaggcaattcgtgttcaaccaatg

SEQ ID NO: 98243 - DNA, 776 bp, Heterodera glycines
  Promoter: Source sequence=SeqID_44014; Location=479..1254; Strand=-; Gene=SeqID_71568
tctgaaaaaatatttatgaattgattttgctaaaaaaataaaatagtgaagctttaaaaattaataaaaaattttaaattcagaattactggagttagcatcatagcagtgcttttccttgtctttttgatgctctcgcaaaatctggttcgcttctgaccagtttataaaaaaaaagttaagcctaaaatttttcccatatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttaattaacttttaaataacgttttgtgcgtttcagagcactttctgaaaaaatacttatgaattaattttgcaaaaaataaataagtaatgaaaaagtcagaattttgaaaaattttaaaaacaacaagcgttggcattttttcaggttaagttagtcctttacaatg

SEQ ID NO: 98244 - DNA, 63 bp, Heterodera glycines
  Promoter: Source sequence=SeqID_14398; Location=1519..1581; Strand=-; Gene=SeqID_47199
ggtaattacgccgtcgtttcgtgtccttttacactttttcagattgacggagctaaaaagatg

SEQ ID NO: 98245 - DNA, 1003 bp, Heterodera glycines
  Promoter: Source sequence=SeqID_22254; Location=492..1494; Strand=+; Gene=SeqID_52925
agtcagcgcatgactattttagcaccaaaaaaagccaaagatcattttgattcatttaaatattattttattttatattttaacaatacattatttttatttatttaaaaactatatatttaaaaataatattttttatttaattaataaactttacaaaaaaattaattaaatatttttccatattctcaaaaacaaacatttgcattcaaatgccgagaaaaaatggtgtttgcgtgccactaaagcttcacataattttttaaattctttttttatcaaaaaaaaggattaaaatttaaaaatgaataaattaaattgtgtttaccgcttctttccccccacataatctcaattttattgattcaattgatatatgtacttaggtaggtgtagtttcttcttcaaattacgcgttcatcagggctacatgacatttcgcctactcgacatttcgcctactaagccaaaaacattcatttcgcctactaacccaaaatcggtcatttcgcctactgtcatttcgcctactattcatttcgcctactgacatttcgcctactttcatttcgcctaccaagccaaaaacattcatttcgcctactaattagtaggcaaaatgaatgtttttggcttagtaggcgaaatgaatgttttttgcttagtaggcgaaatgaatgtctttggcttagtaggcgaaatgaatgtttttgggttagtaggcgaaatgtcagtaggcaagatgtcggtaggcgagatgtcgagtaggcgaaatgtccgtacacccatattttctctgttttcattcctttttttggtttccgtttttagtctgctctgaaggtcctccaaacaaaaacgtccgggggagaaattgagcaaagtgcgacggcgggagctcactgtacaaacaatacgtgcaaaaaagtagaatcaaattagataattaaaaaaattctaattgtttttccatttcatgtgttcaccggtcccgagagcgatg

SEQ ID NO: 98246 - DNA, 98 bp, Heterodera glycines
  Promoter: Source sequence=SeqID_3013; Location=1..98; Strand=+; Gene =SeqID_82771
ttcccccccccccccccctagatacgcccttgacttttccatatttaactgattgcattcgagtttttagcgagaaattgcgccatttcaatgaaatg

SEQ ID NO: 98247 - DNA, 398 bp, Heterodera glycines
  Promoter: Source sequence=SeqID_2219; Location=4827..5224; Strand=-; Gene=SeqID_78537
cctggaagaaaaagaagagattaattaaaaccgtaattggtcactctgttttaaaccatatttggtaaattcaatacaagcaaatgaatgtgttcaaaatcaaaggcgcccgaattttcaaagaattttcaaaaaaaatggaaaatattttcagcgactttaaaaaaattttctggcaggtttttttctaaaatttttaaaaatagagaaaattttttcatttttattgaaatttttaattttctggcatttcccactttcagcctgctgattgaatgactgactgaccagcagggtggacatgccgccgtggatgaccggcacgaacatgtgctgcaagcattgaccatccgctcctcccgggtgcccaacgaggtgagaaatgcgagcgcaacatg

SEQ ID NO: 98248 - DNA, 70 bp, Heterodera glycines
  Promoter: Source sequence=SeqID_22519; Location=163..232; Strand=-; Gene=SeqID_53185
ttagcaaagtgagggagaaagggtaattaaagggagggaaagagccaaagggcgaaaagagcgaaaaatg

SEQ ID NO: 98249 - DNA, 1003 bp, Heterodera glycines
  Promoter: Source sequence=SeqID_14021; Location=4..1006; Strand=+; Gene=SeqID_77988
attaattttgaaaatattttgtaaaaaatattttagaattaaagaaataataaattttcggtttatagcggtcataaaatcctacgtaatattttgatttatttgtaaaatgaaaaataaatatttttctggaaaaataattaaacatttaagaggaaaaaaattgtccaaatttttcgtcttgatgcaatttattgccagttttaacggttggttccaaaaaaaaatttgaaaatttgagccacatttgttgagagattttgttcaactatcaaaaaacggagtaatttagagctcgacaatgcgtaatacataaattccggaattcagtacaaaagcccttgaattcgggtccaaccgattgcgagaggggggggggcagcggcgagcagacattcttttttgcttttcataaccctttttgcgggatgagctttttgaaacaattttataaatttttgtttaaaaacttaagttttgtagtttgtaagtatcaaattcttagatttattgtaaatgttgaccgatttccaatttcttaacagattttgcaccagaatgggttcgtccttcgatgcacccttaataatttgaagcaccccactttctcattgttccctatttcgccatttctttttccttcaaattgcaattgtttaaattatttaattttaattttatttaattttttgattttttgtcaattttttgcgatttttgggtttattttctttcatttttcattaaaaaaaattcaaaagaatttgcctttttgtcgcaaaataaaacccaaaattttatgtttcctaatgaataaccaaacaatccaacgaaaaagcgacaattagtcataatttgaatgagcaatgatacaacaaaatgacatttaaaaaaagagtttggaatggaaaaacggagaatttacggagcccaagaaagcatcgttattaaaaaacataaaaattaaattgtcgaaaatatttttgataaaattcagagaatg

SEQ ID NO: 98250 - DNA, 521 bp, Heterodera glycines
  Promoter: Source sequence=SeqID_11356; Location=412..932; Strand=+; Gene=SeqID_74741
acttttgccatgccaaaattggtcccaataaatggaaaaggaaaataaaattaaataaaattcaaaatctggtcaaattctatcgcaaattttaattcatgcgcaatagaaaagacaaattgctctgcatatcaatggagtttgtgtcactttctttttcaactcctatttcgccattcatagtttcgttattttgtgccttctccatccacagcaaaatgtcaatttaaattatcgtagcaattaattaggcaattagttaattaattaattaattgcccatttcatccctcgccatttatttatacaaacgcagcatttcattcggcgaattttctttcgcctactctttttaggcgatcacaaatcacaaaatagttcagacttaaaacacacaactaactgtaccatttttggatcactcacgcggttaattagtggcataaattgtgacaatattttcgtatttaagcgattgtttctgtcatcattttgtcaccaatttctcaacaaaaaaaatg

SEQ ID NO: 98251 - DNA, 90 bp, Heterodera glycines
  Promoter: Source sequence=SeqID_23676; Location=1056..1145; Strand=-; Gene=SeqID_54373
aattgctttgtctgcttcatgaattctcatattttattaattatgtatttgtattttttaattaaatttccatagtcggccttgttcatg

SEQ ID NO: 98252 - DNA, 265 bp, Heterodera glycines
  Promoter: Source sequence=SeqID_34520; Location=610..874; Strand=-; Gene=SeqID_64287
ttatttttataatagaaaaatatatttgatatttgccattaatttctacacctaaaaaaaggaccccaatttaaaatatttttacagaaataaaattaaaaatctttcattttattaatttttgttaatttatttgtatttaaacggcctaaatttcattaattagcttatatttatcccagtatttggtatcatatgtaggcatcatatacaggaatcatatcatatgtagtcatttgaattgaaacagcccaaaactgatatg

SEQ ID NO: 98253 - DNA, 170 bp, Heterodera glycines
  Promoter: Source sequence=SeqID_21278; Location=2482..2651; Strand=-; Gene=SeqID_51874
ccatttaagtaaaaaaaaacttaaaatagcaataaacacataaaaaatgcaaataaaaaatcatatacgctataaaaaaattctttagtgctgtatggaaaaggaatgattacaatgaactccaagcaattaggacaaaattcgtgaaattgttcggcttcccaagaatg

SEQ ID NO: 98254 - DNA, 784 bp, Heterodera glycines
  Promoter: Source sequence=SeqID_39283; Location=381..1164; Strand=-; Gene=SeqID_67889
atcaggggcgtagctagacccttggcttcgggggggggcttaagtcaaaaattaggatttaggggtgtatttttcttttttccgtcgatttttaagactgtattttttgtttttttgtgaaatcccgaattagtgggtgtattttacaaaatttttcgacgtatttcgccaaaaattactatttttcccattttgatctccatttttcaaaaaaatatatggtaaaatgggggtccggcggtgccgataggcgacgccgggaaattttttgagtattttaatgtaattttgttaagaaaattgcttaaaatctcaaaaaaattcgctaaaaaagtgtaacatataaaaattgttaatttgcccctatttcaatcaaattaaacatttcatggtatcattaaataatgctagatgttttctataagaatattaagttacaaaattttttaaaatggtaaaaaaaagttatgattataaaattctaataagtctccttaagttagaattttttgtctataatttgcttgaaactcaatgaaatttctaaagttaaataaagaattcttagagctagtttaattttcgttttgaatgtgaaactctttgtataatccaggcttcccattcgtccttcaaatgtaaaaaaattttttttcttgatggaaaatttctatgttaggaaattttttttaaaacaatttcggcggcgggattttgtcccgtcccatgccctatgggacatacggtaatatattgtataaacatttttccaggacgtttcatg

SEQ ID NO: 98255 - DNA, 250 bp, Heterodera glycines
  Promoter: Source sequence=SeqID_4308; Location=2798..3047; Strand=+; Gene=SeqID_53984
aacaaaatttattaaaaagattttttttttaaatatacaaaaaaaaattttaaaccagctttttcaaaaatatgcaaaaaaaaaattaattcgccaaagatgctttttggcgcctcattatcccaaatcacttttaatgacccataattttttaagtaaactttaaattttacagtcatgtaaaaattaattgtttataatccacagattgtttatttaatataaatttttaaaatttaaaggtaatatg

SEQ ID NO: 98256 - DNA, 66 bp, Heterodera glycines
  Promoter: Source sequence=SeqID_19869; Location=1..66; Strand=+; Gene= SeqID_84624
agagtcatttatgacgggtcacatattttgacaaatacacattcgtttttgcattacaattaaatg

SEQ ID NO: 98257 - DNA, 675 bp, Heterodera glycines
  Promoter: Source sequence=SeqID_26643; Location=1143..1817; Strand=-; Gene=SeqID_57396
attttatctttttaatttttcaaagggaattccctgttctccgaggtcccggtaacgccaaatatggactataaaagctcgaaatatggataaaaagtttaaaaatgaacaaatatggactaataattgcaatctatcaaatgtattatttcgtgagaggactgcaatttttttttgtcttttaatttttagaaattttaatattattataaacgatttaataaaggaataaatttttaaatgagtactatttaacaaaatttttaattttttgttttaaaaattaattaaaaatgctatataaaatttaggtttattgaaacatttaaaactctgtctgaattgttgagagtttttttttacattttcaattaaattctttcttcaaacacttatttaaatagattctacttatttcttttgccttgctctaacaattttatttatttcattgaaaatcacacttgtaaaaaggatcggattagtaaaatgctaattcgttttctcatttttatgtgaattattctttggaactcttgtcgcattaatttaaattaaatttatttcataacattttaataaattttttaattaatttaagagtccatttcttttatattttttcaattattctataaaagtattgtttttaattcagttaaaattttcataatg

SEQ ID NO: 98258 - DNA, 205 bp, Heterodera glycines
  Promoter: Source sequence=SeqID_27930; Location=1..205; Strand=+; Gene=SeqID_58595
agtgatcgaccaacgttgatcaacttgtattgtgttccgtttttcattgcattttcgtgtcacttcgtcccccacccctccgtcagattgcatttggttcccaagacggcgtcgtgtcctttgttgacattcgtcaggtcaatcggcagttacccgtcgccttcaaagtctctcaacatccgatcagtcgggtaaaatcagaatg

SEQ ID NO: 98259 - DNA, 1003 bp, Heterodera glycines
  Promoter: Source sequence=SeqID_23338; Location=585..1587; Strand=+; Gene=SeqID_54048
cgaaaaaaacttaaacagaatttttaaaaattcaagaaactggctatttttcaatctttatgaagattacttgtttttgaaaaaaatttcttgaaacttcttattaataaaactaagatttttttttgaaaaataagtttcaaattttttgaatttttctggtgacaagctgtgagcggaacataatgactgcacccaaaaaagcactggtaagaattcgagacagctaaatattaaggaggtatgttgttgttcgaatgcaaaattttcagaatttctgacaccggtttttctgtttccggtcaatctggtcctggttttaacaaaaatcaaccgaacggtttcgtttaacacttaaatacaataacaaataaatgaataaatcggctagtctaacttcgtcactcacaaaaacccggtcttcgctatgaattccctcattagtaaatggccatttttatttgccttaaattttgataattggttaacaaatatattcccattaaccaatttccaatcgatttcttaatttgccttaaacaattataatttttcttatcattctgaacactactgtgaacattcgtttgattttatgttctgtttatttgtttgaaatttgtttggaataaatttatcattttttgctttttgggactctctttcatttttaattcttatggccatataattacattataattatcgggtctttcagctcccagtacctgttcaaaaaagtaaaagatcgctatcggattttcaattcgacggcaccggtactaaagaatcactggtaagaaaactgtagtccgtgcggaaaattattgaaaaaattgtggaaaatagaaaaaaaaacaatatttaatgtgcctgctgcggattgtgagccacaaatgtccgaaaatgccctagccttggccgtaacggattttaaatatgcaattgcaattttttgtttctcctaatgtcaaataaaagcaatttgctgcttccggccatg

SEQ ID NO: 98260 - DNA, 130 bp, Heterodera glycines
  Promoter: Source sequence=SeqID_32343; Location=119..248; Strand=+; Gene=SeqID_62659
ggtggcttcactttactaaataaatgacaaaaatgttttttaggacccccacggcgaattgcgaggcaaaaacattttgcacagagtcgacgaatatgaaatgtcgaaaattgcctccgaaaacaaaatg

SEQ ID NO: 98261 - DNA, 251 bp, Heterodera glycines
  Promoter: Source sequence=SeqID_18385; Location=1410..1660; Strand=+; Gene=SeqID_82987
tgctggggcccaaccgttccggcccaactgagcgagtccgatattttcctctcgacatttaaataacgaatccaaaagcatttttggacaaaaaagaaataatattttgacgcaattccatgcgtttttaccctttgaccgaattcgtgcattgtttcttcccctctcttcccacccacctcctcgacaacactgcacaacaaactaatttaaatagaactaaataattatttgttttatatttaaaaatg

SEQ ID NO: 98262 - DNA, 520 bp, Heterodera glycines
  Promoter: Source sequence=SeqID_11208; Location=2020..2539; Strand=-; Gene=SeqID_74567
tttttttcattttttcaaatccgttgccacggcaaatgcgcaaagaaatgccgcagcaggggaggagaaggtttaagaaatttgatgaatttgtgatggctttaagtgtcatcacaacgccaagcaaatgcagagaaaaaacaattggggcaaaatttgaaattggcacattcaaaaaattatggtggcattgatgccaccgttgaaaattgagtccatcatgagggcaaattgtaataaattttttaggtaggactaggcttaggcttgcccggacttaggtttaggcttagcctaggctttatttttgtaaaatttcaggtgatttttgtacgagttgccactgacccgcgaaaattttctctccccttttttagcattttaattgcttttggtatatgacgaataaaatttgctaatttgttaatttcaaaaatattccttcttggatttattattgtatgtacaataagtgagaaaaaggcgtcaacaaaaggacacaaaaaaagaataaaaaatg

SEQ ID NO: 98263 - DNA, 443 bp, Heterodera glycines
  Promoter: Source sequence=SeqID_23594; Location=1..443; Strand=+; Gene=SeqID_54285
ggggggggatataatcgaagaatacggtaaccgaaaactcagattttataagaaaaacaaaaagaaaaatttgacacaatctataaataaaataataattgaaaagattttcaaaagaatttcattttaaattaatttgttaaataaattccataattaaaaatactaaccaaataatttttagcattttgagtttttccattttttagggtccacatatttatgttatatttaatattttatcaatacaaattgcataatttggtaattagttaacttccaaaaaaagatttattaaataattaaaaattttgtgattccatttaaattcccttaattcggcattcttccccttttcgtctttactatatcggataaaaattgcttcattttaattaattgccacaattaataaattaacttttaaatcattgccccaaatg

SEQ ID NO: 98264 - DNA, 912 bp, Heterodera glycines
  Promoter: Source sequence=SeqID_20461; Location=1960..2871; Strand=-; Gene=SeqID_50994
actaaacaattcacaaacattaaaataacaacaaaacgccaagtaaatttaaaactaaaataaatattcaatataacacatttgcacttatttcgacttgtttgaactttgtaccagttcctattaaaacttgaaaatttttctaaatataaaaatgaatatgaattcgtgaacttttaaaaaaggttaaaaaacatcattttgaaattatttaattgaaatgattctgattaaaaaatgatagattatgaattcagagaattttcaaaaatttttgtaaaaaaaatttaaagcaatttggttatattttctcagacctattgctagcctattaaaaaattaaactagaagatttatttaagttttatgataacaattttttaataataatttgtttaaaaaattccaaacttagctttaattttgcttttttattattattatattttattattttaaaatttatatattcctatattttatctatttttattcttatttcatcaaaatcatatatatattcatcttttacagtcgataaatttatttttatattatgggaaaaatttttcagcggttaaatttattaatattaaatttacaatagagacaatgatttaatgctgacaatgacgcattagttaattgattgagattttttattttggcagttgaaaaatttttttatatattattttatatataatttttatattattttataaattttgtatcataaagcctagcgatttattcgtttagttgttgaagctttacgccataccaactatacataggagaagcttaaagcataggattttggaaaaacaagaaattagaaatgccggaaatggcttaatgatggcctaggaattatatttttaaatataaacacattaaaattggtttatg

SEQ ID NO: 98265 - DNA, 71 bp, Heterodera glycines
  Promoter: Source sequence=SeqID_9495; Location=1..71; Strand=+; Gene =SeqID_71629
aaattgagcaaaacattacggtggctgtgcgaagccgcgaaaatgagggatttgtgagggcattggcaatg

SEQ ID NO: 98266 - DNA, 162 bp, Heterodera glycines
  Promoter: Source sequence=SeqID_45124; Location=818..979; Strand=-; Gene=SeqID_72494
gatttgtcaaataaattcaagacttcaaattaataatcaaaaattctcttaaaatttttttgaacccaattcaaaaaaggaaaaaaatttgcagtcaaaaaattattcgaatttctccaattttgttttcataatttccgaaagttattcggtatcataatg

SEQ ID NO: 98267 - DNA, 217 bp, Heterodera glycines
  Promoter: Source sequence=SeqID_5740; Location=4813..5029; Strand=-; Gene=SeqID_59086
atattgcaattattgccgacgtgttggacatgttgccaacgcctgccgtattcgacttcgggattaccaggacgaacaacgaggatcctatggcaatactcgcttacaaccacagagacgcactcctgcaaccggagcaaacgcaattcaacatgacagatcaatcgaactgcttaacgaaattgcgtcgggtctgcgaaatctgtcacttgacatg

SEQ ID NO: 98268 - DNA, 1003 bp, Heterodera glycines
  Promoter: Source sequence=SeqID_2721; Location=1663..2665; Strand=-; Gene=SeqID_81261
ggcgccgggagagaaggttttttttgtttaaaataaattattaataaaaaacaaccacaaataaatataaaaaccacgcttttttttcttcttttttttttcttctccccccaccccacaaaaaaaagagaaaattaaatttgggtggggagagggggggttttttttgttttttttttgttgtggaaaagagaaaaaaaaacaccccccccccccacacaaaaaaaaaaaaaaaaaaaaaaaaaaaaataaaaattttttttttttttttttttttttttttattttttatattttttttttttggggggggcggggggggagaaaaaaataaattttttttttatttttaaaaaacccgcgcgcgcgcgggggaaaaaaaaaaaaaaaaaaaaaaaatattttttttttttttttttttttttttttttttctttttttttttttgggggggggcggggggaaaaaaaaaggggttttaaaataaaaaaaaatttttttttttttttttggaaaaaaaaaaatttttttttcctttccccaaaaaaaaaaaaaaaaaatattttttttttttttttgggaaggaaaaaaaaaatggggggggggtgaaaaaaatttggggcccttttaccaacctcgcccaaaaaaaagtgtggggtttttttacccccccccccgggaaaagcaaaacccttttttggggggaaaaaaaaacaaaggggggaaaaaaaggccgcgggtgttttttttccccccggggtatttttcgggggaaaaaaaaggggggatttgggaaaggtttaccctttttcttttgggggcggtgggggcccaaatttggggggaaaattttttttgggggtctctgggggtgggggcttttttcaattttttttttttgcatcttggaattcattttaattatttaaaaaaaattaataatggcacaagcgtttctccaaatttggcgcttttgtctttcaattagcatttcatttatatg

SEQ ID NO: 98269 - DNA, 858 bp, Heterodera glycines
  Promoter: Source sequence=SeqID_31691; Location=1..858; Strand=+; Gene=SeqID_61998
ctgcctaaaggagggatcaccagcccggcgggctgtccaagtctaccctccctccgacggcaactacccggtggtcgtgcaacttttaaaagagcgattcggcgacacggacgatttacagcgggcaattcgggcccggcttcttcatttggcaccggcaaaggacaatgtgaacagcttgacgacgatgatcgacgaatttgagcgatgcgtttgccaactcgagcagctcggagcgaacgtggacgacgactcatttgggccattgctggaagccaagttgccagtgcgagtgctcacggaattgcggatcagagaaagcatgatgggatcgaaatggtcagtgcgcgagttcaggagagcggtggcagcgcaagtgcggtgcatgcgatcagctgagtcagcattagcagcaatgaaagacccggaagtacgcactgatcaccgaaccgagcgtgatcagacgggacgaggaggcaaagcaggtcgggagccatttcaaagggcatttatggtacgggacagccaacaaacccgtgcgcagcccaacggaacacgaaaagaagagcagtacgggacgaatgcccgtttcaccgggcgaacagtggcacgcggcaacgagaacggacacacgggtgggaatggaccccgcttcgcgcaaaatgggctccctccaagcttcgggagggggaattgttcgttttgtctggagagcggacatcggccgagtgaatgccgcgcctatccgacgccacaggcacggaggaagcgactaattgaacaaaagcgatgcctgcgttgcctgggctctgatcacacattcgaccagtgccaacgaacggtccgatgtgacgcatg

SEQ ID NO: 98270 - DNA, 626 bp, Heterodera glycines
  Promoter: Source sequence=SeqID_6739; Location=2149..2774; Strand=+; Gene=SeqID_46304
gaagaatcttttcatttttggaaaacttatgaccaatttagaatgttctgaagacttttaaggtcacaatttttaatgttttatcagaaccataaaaatgaatacacaaaagtctgtgctctaacctttggttttctgcaaatcttggcccatggctgaggaagttaattagcttcttaaatagtgaaggtggcttgtttattaattatgactcatattgtgaaattttaatatattttatttgggactttcttctcttcttcctcccctttttctgcttttttatgattctgttcatttttaggtacggaaaaaaatatggaaaagagttgggaatcattgacacttcggtgaagagagtaccgcgttcattcttttattataccggcaagagcccttttattctttgacttgctgtgttttgtttttcatattgaatttcctttttcactattttcacgacgctattcatattaatttggtatttattaattcatcgtattattattttataaattcatccactgcgatactttcttttccttattaaaaatgttttaccaattaaatatttttacctgaaaagtattttctactaattgtaagtttcgacagataaataaatg

SEQ ID NO: 98271 - DNA, 82 bp, Heterodera glycines
  Promoter: Source sequence=SeqID_36454; Location=1..82; Strand=+; Gene= SeqID_65760
atgggtgcgctgtgtacgatgctctggaccccatcaaagtggagacccttgttttattcagcctctcaaagatgaacctatg

SEQ ID NO: 98272 - DNA, 51 bp, Heterodera glycines
  Promoter: Source sequence=SeqID_9879; Location=2326..2376; Strand=+; Gene=SeqID_72903
aagttgctgtccaattccgtggataattttattccaatagcgccaaaaatg

SEQ ID NO: 98273 - DNA, 82 bp, Heterodera glycines
  Promoter: Source sequence=SeqID_27784; Location=1264..1345; Strand=-; Gene=SeqID_58451
ttactattaaagaaaaattcctgttttttcatttttattattttgtaattctcccgtaccgttttcagttcccactaagatg

SEQ ID NO: 98274 - DNA, 547 bp, Heterodera glycines
  Promoter: Source sequence=SeqID_22796; Location=580..1126; Strand=+; Gene=SeqID_53497
tttgttaaggccgagcacaatacggtgggtgggtgggtgtacatgttggacatgcttttgtagcgcaaattgttggctttttataatagtacagacatatgaattttttatattttagtcaatgctgatcaaaaaaatacacatgaaattttaattgctttttgacactgatcactttggtcaaaagtcaagcttcgataaaacagatttgatttaatcaaagtgttatttcgaattcactgttttttttgtttcggacacttctaataacttagtcatttcgatcagatttggctatcctaattctaccccctgaccagttcatttgattatttatatagactttccgatcagttgtccgggttccaatcacttattcaattctatcagaccattaaggggttttgctcgcttttacccatgattacatgtgctggcctagtcagtctaattaggccagttaggcactttgatctgatcatttttttacccaattatccctaagcctattaagcctttgttaatttttagcaatcctgacacgatg

SEQ ID NO: 98275 - DNA, 151 bp, Heterodera glycines
  Promoter: Source sequence=SeqID_33482; Location=355..505; Strand=-; Gene=SeqID_63535
actgttggtataaaaaaggctagcttttagtatttcttaataaaaattgaaattatattcaaaatcataaaaaggtaaatgaatagacaaatttttaaggtttattttggttctgcaacagtacagctgttgcgtgaagttgctggaaatg

SEQ ID NO: 98276 - DNA, 185 bp, Heterodera glycines
  Promoter: Source sequence=SeqID_874; Location=26..210; Strand=+; Gene= SeqID_63063
actgtttccgatggcgatgccgatagaggctaacttcttaagtagtagttagtaaattgagttttcaaaaaacccatcttttccctttcatctttacttctctcccattttcattattgttatttctttagagacacgaccctcacaaattgatcgaaggttgtcttatcgcgggcgttgcaatg

SEQ ID NO: 98277 - DNA, 126 bp, Heterodera glycines
  Promoter: Source sequence=SeqID_10571; Location=2249..2374; Strand=-; Gene=SeqID_73810
tctgaaaattaattttcatttaaaattaaaaaataatttttattttttataatttgtgaaataattttcaattttccataaaattttgcaaaatttcaccctcacatccaattgtggttccggatg

SEQ ID NO: 98278 - DNA, 98 bp, Heterodera glycines
  Promoter: Source sequence=SeqID_8309; Location=1044..1141; Strand=-; Gene=SeqID_67649
gcttaaatttagaataataatcatttcttgtttttatttaaatactttgatttaattgaatttaatttaccaagataataaagaggctctggaagatg

SEQ ID NO: 98279 - DNA, 799 bp, Heterodera glycines
  Promoter: Source sequence=SeqID_18787; Location=710..1508; Strand=+; Gene=SeqID_83463
agtcagtgcacggacggacggacagcccctaattaagaaaatgggggattagtaaaatcaaatttagccttatgaccggatagacgccgattcaacaacaaaatctaaagtttaaattttttgaaaattagcacggaaatgctaaaagtaaaaaaagggtcttcaatgttttttttgcccattttgcaaaaattttggtcgaccccttaaaattggtttatttttgactcaaatcactttttttgatcggtgtcacagctctatttttttattgcatattattaatttattcaataatgtaaatagaacagaattgcttttatgcgagcgaatttatgtgtttttttaaactcgagcctggcccggtggtgcctgaaattgaccaggcttactaggcttaggaaagtctggggtttgaaatagagtagcttcggctcaccacatatataatttttataaaactttaattatgtagattgtgaatatttttaaatgatctttaatagtaatttaaaattaaaatacttttttatttttaatttttaaaataataatttggctttaatttgatcacttgcacttttcgtagttcgtctcatagcactggaaaaagcctagtttcggtcgaccgcttttgaaagtccccagacttaatgaaaacaattatttaattttaaggctcgccaaagagttatgtttatggagaatacgatgagatggtaaataatcataattaattttaataaaaaaatttttatttccggtggctctccgccgcggaacattggcgcgaaaaatg

SEQ ID NO: 98280 - DNA, 1003 bp, Heterodera glycines
  Promoter: Source sequence=SeqID_11807; Location=456..1458; Strand=-; Gene=SeqID_75308
tggaaaatttattgacgttaatgaggaaaatatgtagagttatggtgtttcgttgtgattactccgcttttatatggaacaaaatgatgaaaaaaaatttgctaattattgccatatatttattttttaaatttaatttgctctcattaaagcataaaccgtttttctgtgtataaaaagtcgatgtggaaccgttttttaacgcttatttgggtgcgcgaaatgacatttgtccgatcagttactcgctccgatttccaaacaaaaaaaaaactttcttaaaaaaacaactcatttgtgcgttcatgaatgatgctaatgatgatgaatgtgatttggaaagcaaaagttatgtcattacaagacaattaagtaattgcaattcataatttatagaaatattacataggcagcattagaaaataaaaaaagaagaaattatcagtcattatatgcctattgttttgtttaatgaaattaaaatatttacatattaattggacaagatccgactatgttaaaaaaattgatttttttaaattttttcttagtttatttttacaatagttcctaactttgctttattttaattacattttcttttccacttgattttgagacattattttctgttggatgtagaaaaaaaaatttctttgcaaaaaatatagtacggaaatttatgttaaaattaaataaaaaatattttttctgattttaatttcttcttttatttgtgctgcattgatttagcatttatttatgtatttttatattttattagatcaaatctcctatagcatcgacggttggtgttttcatcggttctgtcagcaaatgcattataataaaatgctaatatgtaataatgaataaattattatttttatctctttctgttgactgttcccaatttatcaactgtcatttcattcattatatgaaaagcaatttcaataaaaaaatataaaaatattttatttatttactttattatcaaatg

SEQ ID NO: 98281 - DNA, 59 bp, Heterodera glycines
  Promoter: Source sequence=SeqID_16310; Location=384..442; Strand=+; Gene=SeqID_80701
ggtgaccgaagccgaaaattaacatttttaatgccttttaggttgccgattttgggatg

SEQ ID NO: 98282 - DNA, 304 bp, Heterodera glycines
  Promoter: Source sequence=SeqID_9571; Location=3241..3544; Strand=-; Gene=SeqID_71931
attgtcttaattttatagaattgaggaaaatgcctttcggcacctttcactgaacactttttgctttcgtttttttgactccgatcccaactcattaaagtgatttgaatgattaatgaattgtttttacagtgttaaaaaaataaccgcacagaatcagagtacgtacgtaattttctagggttttttatttcaattttcaccgcaaatttgcgggtcaaatgaaaacgtcggattttgccttttttggcgaaaggtcgtcggcacacgcattaataattagaattaattaactttaaaaatg

SEQ ID NO: 98283 - DNA, 1003 bp, Heterodera glycines
  Promoter: Source sequence=SeqID_6718; Location=228..1230; Strand=+; Gene=SeqID_62613
ttttatcattttttttaaatgaaaatccgtacaaattgttgagcctattaatcccgaaaaccagccttttttattttagtctgagtggtgaaatggcaaaaaaatttttgcttataaaaggaaatttgggtcgtttgactttggcaccatcgacagaacctgatgaagatgatgaagaattgatgaaatttgattttggaaataatcgaggattaaacttcaaatatatttttacaaaatatttgcttgctttaaaatttaagagctttatttttggtttgactttttgaaataaaagaagcaactttataaatttggatttgtattcacaaaaattctcaaaattggtcccggtcccggtcccgaaaaaaaatcgaggtcccggcaagtcccggtcccggttttgcccaaaattcccggtcccgctcaactctattaaaaatcaacagctggcgagtagaattgtaataaatgcttgactcgtatttgtgcgaattcctctggcgcaaaaatgtcaaaaacccgtggcaataattttggcgcgtagctttagaattgtacgcgccctctgttgatttaaaaaaaattcaaactttggccccaaaaacggaaaagtacagagctttttgcttgagctcctctgacttgacttttgccaagctttgtttttctggttcccattacctaaaatttgaaaacttctaattgtttctcaaaaaatttaagtccttatcaaaattgtttttcttaaaaattttcaaaaagaggaaaaaaatgccaacacgaaagaattttgtttttttcccataaattggcgtattgagtcacaaaaaaaaaataaaaataaaacgcaattaacttttttgtaactcgctttaatttttgttacccaattacccactttataattgcatttttattcgttaatcagttttttttttaatttttcaaggtcacttccggcgctggtgggccaaattcgccggtgctcaatttggacatg

SEQ ID NO: 98284 - DNA, 491 bp, Heterodera glycines
  Promoter: Source sequence=SeqID_2895; Location=3029..3519; Strand=+; Gene=SeqID_82231
tttgcgccgccccccccccaattttgattatttaaagcataattttctcaatcaattttaatgtttaaagttaatgtagcattcggaattaaaacttccattccaattacattttaaataaaattcaacattaggtaattatcaacaaattttactaaaactataaattaaacgcaaatgacaactaattaaaaaaacacaacaataaatcactaattacaaaggtaaacacttaattttttgtctttggtcaacgcatacagtaagagcaatgacaagttttttttcttcttcactgccgagagtagcaagaaataaaattatttttttaatgaactcaatttcaatttttccggcttttaaacacaattttgaatggtctgatcaattcggaataggttattaactagtgaattttatattaaacttaattagataaattttcggaaaatcccacttaaaattattatgtcagattcataaaggcaatg

SEQ ID NO: 98285 - DNA, 296 bp, Heterodera glycines
  misc_feature (50)..(50): n is a, c, g, or t
  Promoter: Source sequence=SeqID_30036; Location=943..1238; Strand=-; Gene=SeqID_60486
aaagtccttaaaatgtggccgtacttaccgtatttcctcgattataagcnccttctcaattagaagacccctcgaatataagcctcctcttgaggggggttgaacaataaaagcccagggacttataatcttataatcgaggaaatactaaaagcaaaaaatgcgaattaccaatttctacagttcccaatatattcgaaaatgggaataaatttttaacttaaataccaaagttaaaacgcaagaaaaattgttgatagttttggctcgtcagctgagtcccattataggaaatg

SEQ ID NO: 98286 - DNA, 1003 bp, Heterodera glycines
  Promoter: Source sequence=SeqID_1501; Location=902..1904; Strand=+; Gene=SeqID_73998
atggtacacaattggcacaccaaaagttttaaatttaaaatattagtccgaattttgcagaaaatcttacttttttcatgataaggcctaccagtatgcaaaattttagttttcaatttttaaaattaaaaattcaaattctattcatcatctattcccttatggactcccttatgttttctgttttaccatttttgcattagcgccaaaattattgtgcaaaaatataattattttattatatgtataagacaccaaaaaacattttttggaggtaacaaaattaattaaataatcaattgaagcaattttttttttttgcaaaatttgcaaaagtaagcttttttgtttgagtaaattcatctcatacatatgtaaataaacgaatctgatattttatgcatcatttgaaacaaagaattttacatctttacattgagattttatggtgatgatagctcaaaaaaattctaatcaaattcttattttattattagaaaattatgcttagtttaaaattgaaataattaagcctaattaaaagcagaaatcatacttatattatattcaatcaaatttctttaattccgattatttttttatcattattgctttgaccaattttcagctctgattatttgaacttagaatgaaaaaattctttgtaatttggctcattttccaatgcgatttttttggcgaagtgttcggcaacgcttgtaaatcaaaagaggaagaaccaattcaacctattcgcctgctgaggatgagaagtggcgtatccgagaagcttgtatcgggtaaaaaattaaaataatttttttttgttgttatttaaaacgcaccaatttgaattggtttaaaaattaaatttcataaaatgtttaaaacattccagcaatacactcaaaaacgcttttaagataccattggatttattaaagaaaaccaacaaaagcattcaacaccaaaaaaaccagttacaataacaaagcccaaaatg

SEQ ID NO: 98287 - DNA, 995 bp, Heterodera glycines
  Promoter: Source sequence=SeqID_18688; Location=838..1832; Strand=-; Gene=SeqID_83358
atttttgatcgctaatgagtgaagagatgcgaaactgttcaactcttaattagtttttaattaatttattcttttttaagtattttcttttcaccctgtcaaagctcggttttgtaatccattccagtggggacgattgctgattgcacagcacccatttttttattattcattatggagattttttcttttattcattcatcattttgtagaaatattttgcctaatcgttgggaaagatttaatcacaacaaaccatcttttattcatttacatacctatttgagagaagaaaataatttttcgtttttttattttacattggattttcacctttcagttttcttaaactttttgcattcatatttttgattcaacattttcgaaatgaatctgccgatttacattgcacaatctgtgttttaaaaaaatttctgtatttaatccacattttgtttttttttattacattcttggattcttttaggaattgatcaattttaagactttcatcaatgggtgcatcacaatcttgtgctaatgcccaaaatacaaaccaggtttatgaattgattgtctatatttttgaattccataattcgctatttttggaaaacatattaagaattaaattttatgaagaaaattaccaaaaaaaattatctagtgttttttttcaaagaaattaatgaaaatattttgaattcctcattaactttttcacagaaaaaacaattttagggggatggtacaaatgtctccgaagaaagccgtctggaaatgagtaagactgcaatttttttaaagtagctaatttaaaaatatttagttaagagaataagttggcatttgcggtgccgacaaaaaatttttgttaaaagcataacagatataaataaatgttcttttatcatcctcaagcaatttgtactcttttcaacaacaattaattaggttcaaatttagtcaaatttgtggtggagaacgcgcaaatg

SEQ ID NO: 98288 - DNA, 63 bp, Heterodera glycines
  Promoter: Source sequence=SeqID_6046; Location=1125..1187; Strand=+; Gene=SeqID_60128
ggcaagtgccatcgaatgcgtacctttacgctctcaacggcacttatgcgtacgttagcgatg

SEQ ID NO: 98289 - DNA, 984 bp, Heterodera glycines
  Promoter: Source sequence=SeqID_5918; Location=1..984; Strand=+; Gene= SeqID_59679
gaagcgtcaaaaattatggcattttcttttgttttgtgtttttgtttgctttgttccttccgttggagtgagtcaccgcccccataaataagcaagcgttgttctgctggacagagtcgggctgcttctgctgctttccactatggccccaatgtttatgctaataccccaccgccttagtgcttcatttttcccactgacttctttgcccattcttctttcgggtggctttacccttcccgtccctactccgtccccccgggggcaattccatcgattttcaagctgtccactgtccactcccaacttcgccacccccagcctgcttcattgtcctccaatgctttttgaggctttagccgtccctcgagataaaatggcatcgatttggtggtgtccacccctaatttgccatgcttctcccctcccccaacaatgcttcatctccccaaatgtttataccatgaaatccctatcgattttcgtggtgtccaggccatcccccaattagtgccaccacaatgccctcacttttattgcttcggcgccagtctttgccaccacttcccgtccattgctctcatggtcacttcctccgaatttcagtagaatttatgggtcaattacaaatttgtcgcttattttgttaatgcgaatttaatttgccaaaattaagcatttaaaaattaagttattattttataaatttaaattgacgcactaaaaattctttttaattcgcttccttttattgtttttgtttaaatattttaaaattcatcaatcccattaattaaatattttaataatttagattaaaataaattttattattttaatttaacatagattaaaaattaacttttactagttttaattgcaaatttatttcctcatttttcatttgattcaatttttaaaattaaattaaattaaattatttagctttattagtctttcttcatcacattttctctcaatatg

SEQ ID NO: 98290 - DNA, 255 bp, Heterodera glycines
  misc_feature (14)..(14): n is a, c, g, or t
  Promoter: Source sequence=SeqID_16250; Location=1..255; Strand=+; Gene=SeqID_80633
atttttcaataatnagggctgccaattttatgtaacccttattattcgaaattttaatgatatgaaaaaatggtaatgcaattaaaaatacgaatattttgaaattaatttgataattaattttgttctcagtttcacggcgattttcacaacatcagcgcctttgttttgaacagaactcagggcattttctgtgccgcgcaattgcgctctttggacgtgcctttggtggcggaaattcccgagcaaagaatg

SEQ ID NO: 98291 - DNA, 107 bp, Heterodera glycines
  Promoter: Source sequence=SeqID_12326; Location=899..1005; Strand=+; Gene=SeqID_75921
atgagtcgagaaaaatctgctcgatttcaacacaccgtggcaactatgaagttaaaagacttccttttggcgtgaaatcagcgccagccatcttccaatcggtaatg

SEQ ID NO: 98292 - DNA, 64 bp, Heterodera glycines
  Promoter: Source sequence=SeqID_26228; Location=1..64; Strand=+; Gene= SeqID_56979
ttcaggtcatgaactcttccgggagtcggcccttccgttggagcatcagcagcatctcctgatg

SEQ ID NO: 98293 - DNA, 542 bp, Heterodera glycines
  Promoter: Source sequence=SeqID_779; Location=556..1097; Strand=-; Gene=SeqID_61021
tttgtatatttttttttgcgatttgcgcctaataatttaccaatttttgtctcaattctgcttctgttttcccaaacatattttccaattgccttcaatttctctttaattgcatcaaactttgtgataatttgtcttttattttaaatttttataatatgaaaattttgaattcattttatttactcagccattttctgccttttaaatattttattaaaatccagcataaatgacattcataaatttgtttgattagttgtattggtaattctcaattatatttcactctcattaatttcatcatttgatttaaaattaaaaaaaatcaattttattcaataaaaatcttattgtgataattaaatgcattatttttaattttttttatttatcttaatttaaagaaataatttagcaatgaatttacttcaaattttcttatttattgttatgataaacgcacttggttgttcaaatggtattaaatttaaaataaaaaaagtaaattattaatttttctttctagcccagcttaaatg

SEQ ID NO: 98294 - DNA, 226 bp, Heterodera glycines
  Promoter: Source sequence=SeqID_23149; Location=829..1054; Strand=-; Gene=SeqID_53855
gaaaaagcttatggaggagttcatggaaagactcattcccgagctccaattttgaggtaaaggcgggaagaccaaacagtttattcgggtgcctacgaactcgcacaacattttgaactgcttttggcatcccggagaacaaatcaaatttctgtagccgactctgttgcagaattatcctcaaaagttgaggcattgagccttgggcaatatcaaagagaaaatg

SEQ ID NO: 98295 - DNA, 470 bp, Heterodera glycines
  Promoter: Source sequence=SeqID_11021; Location=1327..1796; Strand=+; Gene=SeqID_74347
atattaaaaatgaattcccaatttacaaaacattactaataaatttattgtttcatatataaatttatttcgactatcattttgtgcattttacttatcgttcgttccctaatgaataaacaaatgacgacaaaataataaaaaatctgtgtgaaaaactcagcaataaataaataaattattaattagattttttggtttaataataattgggttatatttcttcatgcaatttagcgaacatcgtttcattgaactcgttttgttaagagtaatggtcaaagtaaatgtacaattaaaaaacggagaaggattcgcattttggttgaaattgcgaatgattgatcaccagaaatggtgctttaattttggctataaatattcgttttgcattttcaaaattcaatttttattttctaaaagatttcttttattttacataattttgtttcttctttcagataaaaatg

SEQ ID NO: 98296 - DNA, 948 bp, Heterodera glycines
  Promoter: Source sequence=SeqID_9409; Location=161..1108; Strand=-; Gene=SeqID_71310
tttgctctttttttgcaccgcatgatatctcattagaatttttataattcagttcaaaaaataaaaattggtatgggataaaaactgttaacaaaactggcaaaaatttcctattttccccggcagcgctattggcaacgtcggtgcctttaaaaaatattcatcaggcgaatttaaattatgaagagaaaaaaacttccgacttaaacggtgactattcacagttttttttaaatgaaagttgaattgatcaataagcaattgaataaaaaaccaaaaagaatgttaggaaatgcttcaaaaattgtgatttggtttttaagttaaagaaatttttgaaaaaattaccgattcacgcgttttaaaatatgaaaaatgccaaccttgaaaatcgaaataatgatgcatattgtaatttaaaaataaatttattttaaattaattaattttctttttcttttaattttttacagcttatttgttagtgccgaaggctttcccaaattttttttttaaatttcgaaatcggtactggattgtacctcttctatacacatacatatttggagaaacttcttcatttttattttacaaatattattttagatttgcatagccgcatttgataatatgtataaaaaaattgtaaaatcaaacatttaattgatttcattggctaatgctacgtgttttattctgcaaatcccctgctgctggagttaattcattttgtaaaaagtcagtttcattttaattttttctttttttgctaatttatatatttaaaattccaacaaaaaacagatggaaaacaaaatttttgcaaaatgtgtcttcatttccgtgttctttattcagtgcttttgtgctggtgacgttaaaaaatggccgtgtctattaaagttcggcgggagttcgtcacctcagcgttttacattgcgcgaaatg

SEQ ID NO: 98297 - DNA, 879 bp, Heterodera glycines
  misc_feature (43)..(43): n is a, c, g, or t
  misc_feature (65)..(65): n is a, c, g, or t
  misc_feature (95)..(95): n is a, c, g, or t
  Promoter: Source sequence=SeqID_7001; Location=1158..2036; Strand=-; Gene=SeqID_63542
taagatttctaatcatatactaaattactaagctgctattaanggattctcaatattgccaaatntaaaatcccgctctatacgtattggaccanagtttataagacatatattcgtcctcttttagaatatgcgcctgaaatttggaatccgacatacaaaaaagataataaattagaaagatgccaaaaatattttacaaaaattgcattatttaaatgcagacttccttacataccttacaaacaaagacttgatttattcaaactttagaagaaaggagaaaaacaattgatttagttcaggcattcaaaattattaatggtctcactcatcttaaaaaagacatattcccacaattttctggtcacatcccttataatcttagacgtaaagttgtgttaaaatcacaatccagtaaaacttcaaattcttttatcaacagaacggccttaatatggtctaaactcaacaaagatataacagatgctccatctgttgacagtttcaaaaaacgtataaataaatggattgagttaaacaaaaatttagtctgtaaaagaactccttggacttgatattaatttactaaaatctaacgtgtaagtggtcaccccttcgttggatattttatttcttctgaataaaagagatttttaggctctaaaaaccgccaaaatagacactaaaaaatggaaaaaagggcactaaaaaaactcaaattttggggtgtaaaatgacaaaagtgttcaaaaagtaaaaaaaaaataggaatttatctttgaaaagtgataattcgattattaaaaattagaaactttttttttgattaatttaaatattgatactgttaattagagatcgacattttgaaaaatg

SEQ ID NO: 98298 - DNA, 784 bp, Heterodera glycines
  Promoter: Source sequence=SeqID_10571; Location=1..784; Strand=+; Gene=SeqID_73811
tacgaatcctacaaaaaatatagtacttttaaaaatatttttgccacaacttttccgttacatggcaacaaaatgccaaacattaggtgccactgggcccatttaaataattcccttggggcacatttttccattttgccacctccgatgcctaaaaatgccaagcgaggcggcaccatttgcaatcgccaaaacggcaaaaatacgacaaaatgaagaaagtgttttatttaaattttatatttttaaaataataaaataaaattgagaaattaaaatttaaaattaagtttgtttttaaatatttcatatatatgaagattttctaaattcattcattgtttgttcttttggtgagcaattattcatatttaaattttttcattttaaattaattttcgaattctttaaatttatttttttcgcttttttatatttaaaatccaaatcgttgaaatttgttcctctttttggaagaaagattcactattcctgatattatgcataaaacaattaaagcatttttaaatgcaaaaacattatttttttaaaatatttttaatataagttttattaaaataattaatgttaaattaatattcattagtggattcttctttctaacaaaattcccaatttaattaaaggcaaccaaaagcattctacatcagcatcactactgaatcattcagcatcaacaaccgaattgatttccaataaaacaaattcaacattagggggtaaaaaaaatgtttaaaaaaaatcgtaaaaatattttgagatg

SEQ ID NO: 98299 - DNA, 1003 bp, Heterodera glycines
  Promoter: Source sequence=SeqID_14447; Location=191..1193; Strand=-; Gene=SeqID_78489
ccagtattacttagaacccaatttattagcccgccaggcaatatgttgtcaaaaaacactcggagacacaataattaaaaggggaaaaaaagagataaaatccttacaatatacgtaatttataaaaattttgtcaatttttaacgctttcgcggttttcggcggtgccaataggcccgccggtcggtgaaaggattaaaatttagttataatttgtaaaaaaactttttgcaaaaagtttcgagtatttggtaaaaagtgtcatttcgtcattgctaaatattctgggcgcaaatgtgaaaggcgcaaaaatggaggcgctaatgtgccatttcattaattataatatcaaatttttgagtttctcccaatgttttcgaaaagatgttagttgaaactgtaataatttaataagatccctttttatcaaaatttaaaagtccgtaaaactgaaaataaccctaaaaagaatttaaaaggaaaaaaattaaaccaaatatttgatgaataagtttttttttgtcattgtgttgtccattcaaaagagaactcaagcaattaagaatgaaaaattatattcgctaaaatatttttcataatatttaaattttaatttataaatttttgcttttttgaaagataagcttttgtttttcgataatacttattgcttcacatttcgtaaagttagttattccattgacgttattaaaagaagcaaatgcattttatcacaaacccaaaaaataataactcaatgaattgatcaatatattcaaaaatggcaattttttaatatttctaaatatttccatatttattatattcataaaaaaatttatacataaaattttacaattttttcctttcctttctccatttttgctctacactttggatattttacgattagaaacataaatattgtaaattattaaaaaactttattttattttaattaaataaaaattttggttttcttttctttcagttacagaaaatg

SEQ ID NO: 98300 - DNA, 233 bp, Heterodera glycines
  Promoter: Source sequence=SeqID_10248; Location=2307..2539; Strand=-; Gene=SeqID_73400
agggtttgttcgttaatgagcattcattcactgttttaattatgcaattaaattcaagaagaaatttggcaacattttcgtttctgttgttttgctgggagaagaaaagcaatttttgacggatttatcattcaacggccaggcaaagaatgatttaaatatttgcttattaaattaaataaatttttatttatttttcgctttttgccaatgtttttttgccaaaatcaatg

SEQ ID NO: 98301 - DNA, 874 bp, Heterodera glycines
  Promoter: Source sequence=SeqID_188; Location=7213..8086; Strand=+; Gene=SeqID_76955
tccttgaaaattgttcaaaaaattttcaaaaattaattttttttaaaaaacttaaagaaaattttcaacgaaaaattctaagagaaaattagaatttttgaagaaatatttctaaataaaaaatgtaaaaaaaattcataactttactcaactgcaaccaatattttatggtatcattcaatagctttaattattttctatcaaaatattaatacttaaattttttacaaagtatataaaaaagtttgtattaaaatttaaaaatttttagtttttgaaattctagtgtttaatagattatacaaaaggttttaaactccaaaaagaaattaaatttcaagtcattaaaatgcaattcaacgattttttttagaaaagttcataattttttatttattaatttacgaataaaaattaattttcccatgtttttataatattccaaaaatttttaaaaatatttttcaagttttcaaaatttttcaagaattttcttgaaattaggggggagggcagttttaagaaacgtgcatggcttttagttttatggctggcagtttttaagaaacgcactagcaccataaaaaccacattgagaagtgcccggcgaaaatctcctttggctcccgtccgtacatcttccaaaaaaataatgaatattgtgcatttattgtccgtacatggtggcccccttttttggtgcaaatggaccgttatattttgtgttcctgttttaaaattttttaatccaaatttgcttacaaaaaatcgccgaccaaaaaacaagtttggaaaaattatcatcacgttaattagaaattctattttttatttatttacttatcacataaataaatttcatcagatatgcatg

SEQ ID NO: 98302 - DNA, 73 bp, Heterodera glycines
  Promoter: Source sequence=SeqID_5597; Location=2293..2365; Strand=+; Gene=SeqID_58601
agtaaggaattagaaattaaataattatttattatttaattttaagaaacacaaagaagaaaccgagggtatg

SEQ ID NO: 98303 - DNA, 230 bp, Heterodera glycines
  misc_feature (20)..(21): n is a, c, g, or t
  Promoter: Source sequence=SeqID_19118; Location=2869..3098; Strand=-; Gene=SeqID_83858
agaagaattgggtgacacanncgaatcgggcatcaatttcgaccaaccttgttccccgggtccaatttggacaaagtcgaaaattcaattttttggattctgcatttttggttttgtcaatacttcaataaaatgtaattttaaaagatttaaggaaaactgtaaacaattatatttgattattttaccataccaatcaattcacatttaggctgaggtctgtcagtatg

SEQ ID NO: 98304 - DNA, 59 bp, Heterodera glycines
  Promoter: Source sequence=SeqID_24177; Location=113..171; Strand=+; Gene=SeqID_45845
tttttcctgatttaaattttcattttttcacacaggtcaaaatatcagacttcggcatg

SEQ ID NO: 98305 - DNA, 112 bp, Heterodera glycines
  misc_feature (8)..(8): n is a, c, g, or t
  Promoter: Source sequence=SeqID_6661; Location=3724..3835; Strand=-; Gene=SeqID_62376
cttctacnttgaacgcaaaaaatttgacaaagaaataacagccgagttgcagcgcgcttcctgtgaaattacacgtttttgggctcttcaacgggcaccaattcaacagatg

SEQ ID NO: 98306 - DNA, 222 bp, Heterodera glycines
  Promoter: Source sequence=SeqID_28203; Location=220..441; Strand=+; Gene=SeqID_58849
ttggaaagcactctttggacggggaaagggtaaataaaaaatccaagtgaaaaagtgccctttcgcgggaggccttccctttccccattcgtttttgttagctgtctcgtgatccaaatttaatttcattttgtcgtgttatagtgcataaattcatgctttggatttcaaatagctgtctgccaaaaagttttcttttttcatataattttttcgaaaatg

SEQ ID NO: 98307 - DNA, 165 bp, Heterodera glycines
  Promoter: Source sequence=SeqID_8674; Location=1..165; Strand=+; Gene= SeqID_68826
ccaaaatgaatgaggggggggggggcggcatttgccgaattgaccgctgtcacagtcactttttacgatcacatttctgctgctaatgttgcctttctgctcccatttaaaagccgtgtcgccctccgtttgcccattttccgtgccattctctctctcccgatg

SEQ ID NO: 98308 - DNA, 190 bp, Heterodera glycines
  Promoter: Source sequence=SeqID_32839; Location=192..381; Strand=+; Gene=SeqID_63085
ttgttttggatcattatgaatgatgaagagagagagagagtgagggacaaagagatggagagaatggagaaagagcaaggaacaaagacagagagatggagagagaacgagggacagacagaaagatggagagagagtaggagaatcgagaaaaagagagcgagggaaaaatatataaagcaagagaatg

SEQ ID NO: 98309 - DNA, 672 bp, Heterodera glycines
  misc_feature (106)..(106): n is a, c, g, or t
  Promoter: Source sequence=SeqID_11409; Location=1..672; Strand=+; Gene=SeqID_74803
tataaattttgctcaaagaacgtgtccaaagattcgccgcgcattttaattcaattaaaatctgcaaagaacaaatattatgctcaaacgtgtccaaagatacgcnccgcatttaattcaattaaaatgtggaaaaacaaaataataaaggagtggcaaatttgaaaagcacatttacgctatcgtggcaaaacgtacagcgaaaattcaaatctagatacattcataggcatcagccaataaatgtatcccttttacccggtatataatagagaccaaagtgtgtataatttaattgctgatacaatttaatttacatacatttataggcatcagccaaaaaattaatgcgcttgtttagaaagggattatagaaagggattatttaaatcaataacctatttattctgcattttttttacatcaatcaattcttaaacggcaaaaatttaataaaatcctatataataaagttgagtgtctgtatgtatgtttctgccattgtttgaatttgtgtggcattatgttttgtttttgcattaaaatgcattaaaaattatttaattaatttgaattacgcttattatgtttatatacataacaccaattatttctccttattcttttatattttatctcgtaatttttttacattttagttaaataaaaatg

SEQ ID NO: 98310 - DNA, 260 bp, Heterodera glycines
  Promoter: Source sequence=SeqID_27379; Location=1045..1304; Strand=-; Gene=SeqID_58073
tttgtgcccttttttacattttatgccttttgtgcgtgatcggacattggggcgaagtcattaaaaatctgaccaaaaataatacgttaaacaataaattttataaaacaattttaattcaaaagtaagaatataataaaaaaaatatatattggtttaatgatttttaccaaattattattcatttccaatgataaaacctaagcttttttgacagccattttcataatatatacaaaaattttacaaaataagaaatg

SEQ ID NO: 98311 - DNA, 324 bp, Heterodera glycines
  Promoter: Source sequence=SeqID_33077; Location=746..1069; Strand=-; Gene=SeqID_63250
ctttattaccataggtttttgtcattaacaataatggaaaaaaaatttttttcttttccgattcataaaaatttaggatttataaatggctttttactcgcccctttttttttcttaaactttccctttttctctgctcatccggtccattattttgggccacaaaaaaatgccaacggaacaaacgccaaacggacgggcgatgttcccaaacgcgccgaatgctcgaaacattcacaatgatttacggtattttaccgtcaaaacggaaagtaatcggccgaacaaagctcagaattgacagcgcaccaagtgaccaaaatg

SEQ ID NO: 98312 - DNA, 584 bp, Heterodera glycines
  Promoter: Source sequence=SeqID_4387; Location=2577..3160; Strand=+; Gene=SeqID_54262
tagcactttgaagaacggagagaaaatgacggctgacagctttttgccgacgaacggagagaaaatgacagctggcagctttttgccgacgaacggagagaaaatgacggctggcagctttttgccggcaaatggagagaaaatgacggctggcagctttttgccggcaaatggagagataaatgacggctttttgactacgaaaagagagaaaaataaagctaactttgcctgtttttgaatggagaaaaatgtgttttcttgagctggtagttggatttagtgcaattaaatgtttaaaggtttttaatgaaaaattgattggacgcataaaaattttattggacgcataaaaaatgatgggacgcataaaaaattgattggacgcataagagtcgattggacgcataaaagtcgattggacgcataaaagtcgattggacgcataaactgtacttgagccaaaatattcattaactttgctttgatcgaaaactcagaacaaaaacagtgaaattttatcgattgatttttactcgttcggtcaatgtgttgagtgagtgagtgcatttgtttacgtaatg

SEQ ID NO: 98313 - DNA, 159 bp, Heterodera glycines
  Promoter: Source sequence=SeqID_21622; Location=1..159; Strand=+; Gene=SeqID_52218
ccccccccccctagatcgccttgcacctggaagggaggggggggggggggggtgtggagtcacgcagaattttacaagacaaaaaaacagttggtcctcacgcgccccgccccttttttagtcgaattttttatttttgttttactccatttacagatg

SEQ ID NO: 98314 - DNA, 284 bp, Heterodera glycines
  Promoter: Source sequence=SeqID_708; Location=2117..2400; Strand=-; Gene=SeqID_59489
ttcctgtaaaaggacctgccccttcgaaggattgtagtctgacaaagactttacctgtggggattgtggttgtttaatatctgcattcttgaatgggatgtgtgaacctggctgatggattcagcaggacgactacacattgcggcgaagaattatgtcgattgatctttattatgcatattttatatgaataaatatttgtattgtgtgcatttaacggttcattcgcctcatattttttgccacttttcatatctttcttattttttttttgtttcagaatg

SEQ ID NO: 98315 - DNA, 1003 bp, Heterodera glycines
  misc_feature (853)..(853): n is a, c, g, or t
  Promoter: Source sequence=SeqID_16739; Location=1065..2067; Strand=+; Gene=SeqID_81137
ttataaattttgtctatataatgaaattttgtatttttttttcgtctgggagccaaagttcaaatggtgggtgctatggagaccaattatggttaattgataaaaagctttgaaaggtaattcacacaaaacctatagcattaatttcaataaataattttttttgacctaactaattttaatattatattttcatgattccaatcctttgttattaaaaaaaattttataaaccaaaaatcaatttttatctaataaataataagaaaaattttcccaaatttttctgttaatgtttggtctatttttgtattaatttctaaatttttgtcggtttgccgtaattatttttgggaaactgaaaaatttgtggtagttcatttttatcctgcgaaaggattgattgccactgttcaaataaatggatatgaaaagaattgttgcgtaaatgacatgagaccgcgactctcgagcagcaataataataaaattgaccggacatttggacagtggacattgggaccgaaccggacaattggacattacgacagtgaatgacttttttttttatcctttctctctatattccttatccttttctctttctcatccatctctctccgctctccatatcactttcttctttctctctctctatctatcccttctctctgtccctctttcgttttctctctctttcctattttcttattctctatcattttgtctttttctctctcttcatccctttcatcttttttcccttttctctctaactcgctccctcttctctttatttctctattaggaagggatttataaaaactggtctgaattttgttttcattgctanagatattttagtaaataatttgtcatcaactttcgttaatgttgtaaggattattcgacgcatttccctcatttaattacttcccattggccattatccattcaatcacatttatccttttcacacgtttttccttttctcattgtaatg

SEQ ID NO: 98316 - DNA, 96 bp, Heterodera glycines
  Promoter: Source sequence=SeqID_4456; Location=792..887; Strand=+; Gene=SeqID_54516
tgttcaatgatgacgacttgatgttttttgacaattttccgcgtcgccccttttatacggagccggaattttttcacgcgacattgccacgaaatg

SEQ ID NO: 98317 - DNA, 99 bp, Heterodera glycines
  Promoter: Source sequence=SeqID_5492; Location=1808..1906; Strand=-; Gene=SeqID_58240
ttttcctaatttaatcaacatgttggctttttaattcttcaattcctccgttcattaaatttctgtttatttggctattaaatttattttacaaaaatg

SEQ ID NO: 98318 - DNA, 244 bp, Heterodera glycines
  Promoter: Source sequence=SeqID_9016; Location=5123..5366; Strand=-; Gene=SeqID_46690
gggtaccgtacggtcgggcagagaccgtatagcccgtttacagccactcggagcgccattccacccaaaatcgtagcgtaagcccattataaggcgcttagcgcaaagaacggccctgcagagtacgcacaatttagttttaaggaatttggggtaccgtataagcctgagatggtactgtatagcccctgttcataaacttacatgggcacactgtaggggacggtagctgccatacagtatg

SEQ ID NO: 98319 - DNA, 411 bp, Heterodera glycines
  Promoter: Source sequence=SeqID_19261; Location=2255..2665; Strand=-; Gene=SeqID_84007
atccgagaaaagcaaggaaatcctttgtggaagcaaaaaggaaggaaaaagtgagcgaatgaaagaaaatggaaggggagtgatggcttttatagcaatgcgtcgaatacgactgattattaaaatcttcggcaaaataaattagtataaaagtggttgctcctcctccgccatttttcattattattttcctttcgccatttagtagatatttcttttcgctttcttcgaatttttctcatgacaattcctccaaaaatgattctatacatttttgcatattttttctcgacattttacccttttccttctcatttttggtctttacgatgtttttgaattgaatgaaattggaacccccgatggcttccgtttgaaccaaacaatcaaaattagaaagacctgcatatg

SEQ ID NO: 98320 - DNA, 70 bp, Heterodera glycines
  Promoter: Source sequence=SeqID_28346; Location=241..310; Strand=+; Gene=SeqID_58980
ggtaaaaaccctaaatatgaataattaatttaataattatttcttcagcagaccgacaacagtgccaatg

SEQ ID NO: 98321 - DNA, 1003 bp, Heterodera glycines
  Promoter: Source sequence=SeqID_3826; Location=1481..2483; Strand=-; Gene=SeqID_45650
atttttgctcaattttcagctttcccaaaatttatatacataaaaataaacaattcctgtaaagcatattaactaaaaatttaattaaaattttttttttaaataaattttcggagttttactttttttcacccttttcactgccctctttttcgctctctccaaaacacacacactctatgccagacaatgaatgaacaagcagcacaaagcgctttatggccaagccggagtaaacataatatgatcataaattgcgcaattaataccccccccccccccaactaaacacaattggcggtgatgatgccctccaaatgtcccgggttgtgtcgcgccctcgcgccgcactccaataacaattgggtgcttaaataaaaaaataataataatttgaataaataaataaaataatgctgcttttctccattcataaataataataataataataataatcacattggaaagtttttattgttattaaaaatgacaatcaaacaaatcaaatacattttgtgatcaaagaaaaaaaaaatttttgatcaggtcaaattataatgcattattgcttatttgtcaagttttattcaatgatagttggcttgaactgataaattctcaaaaatctaatcagtatcggtgtctggttagaaccaagccttttgttaagtcttaaaaaaaattttttcaatgaacctcaaattatccaaccaacaaatttttcctcttcattgccctgagttgtcattaattatgctaattaatcatttatttataattaatgatttagactatcaatggtctttcaaaaagaagtagttttaatcagttttgatcagacactcaatatttggtaattaaccgtttttgtttattcaatactattttttgatctttacaaattatcctttggctagctaattaacgtgaagcaattaattagaagaataattagtcgtttaatattaaatatcccaatattaaaaaatcatagcaaatg

SEQ ID NO: 98322 - DNA, 695 bp, Heterodera glycines
  Promoter: Source sequence=SeqID_15676; Location=680..1374; Strand=-; Gene=SeqID_79984
tttttagagcaaatacagaataaaggaaaaggaaaattctttttttggaaagaaaataaaagctttcgctttagaagaatattcaatcaaagttatttcataagaaaaattgtttttgcttttgaaaatgcacggtgtgtcaataacaaactctttttgttgtttggtgtcttaatcgagtgtgcatgtgagcaataacaaagaaagaaaagggaaggagagagaaattgcaaaatctttcgtgccaataaataatctgtttttccgctcaaaaaaggcaaaaaaacacggaatgacacacccaattagtataatagataggaccgggcccggtaccggtttttactggatccggaagccagtccagcgatttttagaaaaatttggattgaccggttttttggattacagattttgagagaccgggttcggaaaccggttgcttctgaaaaaatcagtcaagtccggcattttgaaatctatctcggtctctggttagcattacctcctccttctcttatcggcaacataccgtgcttttctttctttcttgccgatctttctatttgacaaatataatttacctatttatgagttttttagtgtcatgattttaattttcattttataaattttagctaaagaaacttttaacaaagtaccatcatttgcattgattttgcaacgaccaaatg

SEQ ID NO: 98323 - DNA, 413 bp, Heterodera glycines
  misc_feature (79)..(79): n is a, c, g, or t
  misc_feature (89)..(89): n is a, c, g, or t
  misc_feature (144)..(144): n is a, c, g, or t
  Promoter: Source sequence=SeqID_44573; Location=1363..1775; Strand=-; Gene=SeqID_72046
ccccataattgtttgagtaccccaaacgggacactgaaaaaaaatcgatttttttgttttcgggggcagtccccccganccgatgcgcncagatttatggggagaccgatcctttccggaatagcttccctatagcctgtactnaattctgcgttggattttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatg

SEQ ID NO: 98324 - DNA, 202 bp, Heterodera glycines
  Promoter: Source sequence=SeqID_18148; Location=1..202; Strand=+; Gene=SeqID_82735
tagcacttttctctctctccgggcctcaaacggttttcggtaattatcgcaaataattaatttaaaacctattaaattattattttttaaataattttaaaaataatttcgaaattcttagcccaactcactttttcaccgatcgtcagtgaagttgcgctcgaaaattgttgaagaatgtttgtatgaatacagaaaaatg

SEQ ID NO: 98325 - DNA, 63 bp, Heterodera glycines
  Promoter: Source sequence=SeqID_10650; Location=3510..3572; Strand=+; Gene=SeqID_73893
ggtcgtcttttaaattttattattcgttgttaatcttgtaaaatgaatttcaggggcgtaatg

SEQ ID NO: 98326 - DNA, 170 bp, Heterodera glycines
  Promoter: Source sequence=SeqID_25339; Location=808..977; Strand=+; Gene=SeqID_56091
tgtaaatacgatgggaaaaaattaaattgtaaattactaaaaataaatgtttttaggaataaaaaagttttttaattaaaattcttaattttgctaataattttaagagaatgcgaggaatttaaggaccgaggaataagggcttggtgctggaatagggatttaacatg

SEQ ID NO: 98327 - DNA, 410 bp, Heterodera glycines
  Promoter: Source sequence=SeqID_2006; Location=3057..3466; Strand=-; Gene=SeqID_77295
ttgggccaatggacgaggaaagacaccgccggacaaagcttaaaacagagagcgagggaataaatgataaacgccggtcgaaatccatcccacggaaataaattttgaaggataaattggcacggaaatgcagcaaatttaaaaagagagtcatgggagaggcccaagaaggaatattgcgaaaacgattaacaaaaataaaatgttcggcggaacggttggaggaggcggggggggggaggggggaggcgccgcttttgcatggccaaagggacggacggggcattccgccaacagaaaggcacaaccccgcactaacgggagaaaatggttttcgaagaattgtgccgagaagagaagggcattggttagagtgaatgaatggcaaaaggattttggagtaagaaatg

SEQ ID NO: 98328 - DNA, 750 bp, Heterodera glycines
  Promoter: Source sequence=SeqID_43749; Location=1..750; Strand=+; Gene=SeqID_71352
cgtagaaaacgtgttctagtttctgtttggacttaggcctgaataccggcttagttggcccgaaataacaagagacccgtctaattcaatttaaactcataaaattaagtcttgaacagaccgaaccttgtaatcttataaattgtaaataatacatcgtgtatggcattgatataaaattaatggtaatgagtttagcaaacaagcacgcttaatcgagtgaatattcgttaagaaaactttctattcctaactttattaaatttactattgttttaaattagatagttgcaatttatagacaattaaaataatttttattttttaaatccttaatttggtgcccaaacttcccggtgcccaaatttatggtgcccaagcttccgcccccccccccttctttctaaatcttttaaaagaatttttggtgaacatttttaaatttttcgaaaatgtaccacaaaaaaatcggtaaagaagagatattaaaattaatttttgaatattaaaataggattttaagcctatttagatcattttattgatttcaacctttacgaagaagtatttcaaaaaaaaactattttaaaaattttattttcacagtttgctacatattttgagttttatttatacatttgttttttttacatattttatgtaaatattttgctagagggtcgagtaaaattttctgaaaaaattattaggttcacggaaagaacaccaattccaaatactaaaagtatg

SEQ ID NO: 98329 - DNA, 803 bp, Heterodera glycines
  Promoter: Source sequence=SeqID_11021; Location=2448..3250; Strand=+; Gene=SeqID_74348
ttttaattagactgccccaaaaaagtcataaatagggaagagattttctgtgttgaaaaatggataattaaaaatttattataaattattcagaaattagcatatgtccactgttcaaaaaatccattgcggttcctgctgcaggattgttcgggattgggacacagaaattttgcgggacggaacccagagggattaatcccgcaccagcaattttcaaaaaaagcaggattgcggcctggcgtctcgcaaaatcccgcgggaacccgcatcttgcaattttcaaaaatgcaggattgtggactaaaaatccgcaaaatcccgcgagaatcccgtaccaagcaattttcaaaaaatgagggcttacttactgggattcccgcaaaatcccttggcacccccttctcgcattaacctctcgtcttcatcactaatctcatcactatccttctcttttaaattctaatgaaataaaaaatcgcttccattcttgaaattttgcacaaattatttcataaacttttttgttaattttgctggccgaaatagcggaacaaataaataacatctgacgaaaaatgaccttacctttaaattgtcattagaaaaaaatgattaattgtatgtaattacacgtcactgccgatggatggttctcttttcggtcggtcattatttgatctcctcattttcgaaacattattaaatattatttattcatttctccacgcctttaatcgcaataacaaaattcataaaataatattttttctttaaaaaaatcaaaaaaataaaataatatg

SEQ ID NO: 98330 - DNA, 1003 bp, Heterodera glycines
  Promoter: Source sequence=SeqID_4802; Location=424..1426; Strand=-; Gene=SeqID_55773
gcattttttatacatattttatttacataattcgcaaatattcttacataaaattagcagccctattaataatgcagaaatgcaaaaatgaatggataaatgagtcaattataatattttcgttttgctcttctccaattgttgagtcatcattttgccctaaattattgttgattgacctcgataaatacattaacataagcaacagcagtcagcaaatgttcatttattactacaatttttaaaatatcatatttctttattattattattatttattttttaattaaaaattcactttatttgtccaaaaaatggctctattgcactttatgagtccaatcgactttttatgaaaccaaaggtatttaatgaatccaatcaattaacaatacctggtttttataaaataattttgttcatgtttgaacaaaccctatctttttgatgtcattcgaaagtagaaagcctaaagaagtttaaatatataaaattttagcgtttaggccatgtcaaaaaaagatttgattaattaaaaaattgttgatattttcgtttgtaattaactgttagaattatcttgttttctcgtattattacattattcggactttgtgctttcgaatgatacctaaaatatagggtttgttcgaacataaacaaaacaaaattattctaaaaaaccacaggtgttgtttgttaattgattggactcataaagtgcaatagataccaaaaaaatttcaaaaggcttgttacatacaaacagtactcaaacttctctccatttctcatcatcaaacccaatttgacaattataaaaaaattgaacagaaggaaatgtcaatttcaaacgattcaacaaatagtgacgatttttcgtctgatgattgtgataacgagaaaaggggaaacggtagaaaataaaatttgggaaacagtagaaaattaatataattaaaaataaataaatgaaataaaaatgcttttctttttagaaatg

SEQ ID NO: 98331 - DNA, 67 bp, Heterodera glycines
  Promoter: Source sequence=SeqID_13487; Location=1171..1237; Strand=-; Gene=SeqID_77375
gcaaagtgcctaacaatcatttaagctaacgcgtacgcaaacgctggcccaagtggtcggcatcatg

SEQ ID NO: 98332 - DNA, 93 bp, Heterodera glycines
  Promoter: Source sequence=SeqID_1258; Location=708..800; Strand=-; Gene=SeqID_70941
atggtggaaagagagccaaaaaacgaaaaacataaatagacgaaagatgtggaaaagaagcaatttgctgtgacacatacagaaacacacatg

SEQ ID NO: 98333 - DNA, 1003 bp, Heterodera glycines
  Promoter: Source sequence=SeqID_28518; Location=230..1232; Strand=+; Gene=SeqID_59123
tttttcaattatccagcaaaatgaataaatttttttaaaaattaataaattaatgatatgaacgtacaaatgaataaaattcaacctaaaaataaatttatttttattaattttgttatgtaaaaagttgaataacattaaaattccaaaccaaatcaaaatcaataaataatttaagaaatacaaaattacttatgattcacgaatttattacaaacagtacatcaaaagccttacaataaaatataatgaatgaataataagtattgataacataaacgggttttattacccatgtttgtgtttgaggtagctgtacgtgaaaaaggatgaaaaaataatataagaaatttaataatgctaataatatattttataattgatatcttttgtaaagaaataaagttaaataaaaaagcatacaatttattctatcatttgaaacaccgctaaaatttttgtgtgttgataaagccgatttgaatcgaaaaccttgatattaaaaatcaaaaaatgggtcatagagaaattgaaagtcacatatgaaaaaatatttttaaaatttaatttatttaaaaaattattattaactataaaatattcaatgagtccgatttcgttcacggatcgcccataaaatataaaatcgaactatcttaattttgttgatttttccaatggaaatatttatttctttttccgagaaatgtgctttgttgaccgaccttgaggctggctgtactaaaaccctaaaaattggagccctactaataattttgaccaaaaaaaacacccattttaaacattttgtttaaatatttagtacacattttggtttttttccatgaaaatctattgtaataagaatcgcaaaatttggcaagtttttggacaatttaagtttttggaagaaaacgattttccaaaacaatgtttttcttctgtattttgtgaacatcaatcaatggaaaacggcaaagtgtgctaattgcaacaaaaaatg

SEQ ID NO: 98334 - DNA, 1003 bp, Heterodera glycines
  Promoter: Source sequence=SeqID_11480; Location=3613..4615; Strand=-; Gene=SeqID_74892
ctttagaccccgtggggttcattaaattttcccttattttaggagacgcaaatttaaatgactaaatatgtgtgctcaatgcacgtgatttgcattttcaatcctcctttccttcttttaattttaaatttatttatttattgtttttatttgttttttgattttaatatctttttctatctttttcaatttaattattattatttatttagtcatttatttatttatttatgattaactgattatggcttttcaaattaattgatcccctaagggttaatgaaattccgattaaaattgagcagattttaattttcgccaaaaggagcaaaacacttttttagaccccgtggggttaattaaattcaccctcatttttaagagtacctctaaaaaaatgcctaattcattcgtaattttattttttagtcttttattttgtttttgtctctctttttgagctccatgaattagttaaattccatttttgagggttttctggggtctgtccctttttcgatcaccccttttttttgactgtaaagatttttgaaccacgtatgggaggtttttttttgaaccgcaaaattccgaaaccatgcatggataatttttgaatattttatttttgaattaggattttcgaaaccatgcatggataaacttttgggtttttttttttgaaaataattatcgaaccacgcgtgggataatttttgatttgatacttcttgttgattcccagggggttgctggggcctggccaggactctaaaatgattggcgctttgcgcaacacaaaaacatcccctgaaaagtcggtctaccactcgaatccccctcttcccatggcccaagccctgtaagcatagggttggaaccatccggtgctaccagtaaagccgtgatgtcccactacccagtgcttatgagggaaattagtccaggggaccctcttacgcgtccgtaattaggcccctcagggcttggaagggaagggatg

SEQ ID NO: 98335 - DNA, 370 bp, Heterodera glycines
  Promoter: Source sequence=SeqID_19463; Location=1..370; Strand=+; Gene=SeqID_84181
attgctttatggcacacaaaaagttgcaattgctttctaccgatcactttcttccctgagagatgaacgcattttcaacgctcggcttatgatcgaacgatcaacagcaattgtaagattttatgttgcaaaaaaaattgtaattatgtaaaacgactgtaaaagttaaatttaacagttttaaagttacaagatttaaaaattatcaacttatattcgtttaaaattgtttattttgtaaaaataacaccaaaaaatccaaatttaactaatttttgtattaaaaaatcaaaagcaattttctaatgaaaaaaagataatttaaaatcatatttaattcatttgtagaaaataccaactgtggcaaatg

SEQ ID NO: 98336 - DNA, 151 bp, Heterodera glycines
  Promoter: Source sequence=SeqID_1542; Location=658..808; Strand=-; Gene=SeqID_74338
ttttgaagtctaatcggttttacattttaccatattcaataattaagtcgtgttaggaccaaatttttcttttaacattttcagaattgttatttttctgtcaaacaaatttcacaaaacaagcttaattctgcagcagaaacatccaatg

SEQ ID NO: 98337 - DNA, 497 bp, Heterodera glycines
  Promoter: Source sequence=SeqID_15132; Location=968..1464; Strand=-; Gene=SeqID_79321
accgtaattgctgcttaaacattgaatcatttttcttgacttgtttagtgagtgaggaaggcccaacaaatgctgtatcagtgtgcggagaaataaaaaaagctccgtcctcttcacatattgttgtgttgttgctgttggacatacttatttaacttatttgttctttttctgataaaaccgtgtagactttctttttttgcaagttaaaaagacatttgaagtgcaaagtaaggcggcattagcctatttacctagttggtttttcacattgatttgtcattttgcttgatgatgcaccaaacatcattatcattgtcaccctcgtcctgatcgatgccacaaccccgacccttaaccccgatgggggtcggggttaaatatacacccctaagaatggaatttttgtggggcaaaaggcaaaaaagttataagaaatttgaatttttttaaccattttgccaaattttattaaataaagtaaatttctagggatg

SEQ ID NO: 98338 - DNA, 583 bp, Heterodera glycines
  Promoter: Source sequence=SeqID_20838; Location=322..904; Strand=-; Gene=SeqID_51425
ttccgccccccccccctccccccattggaaaataatgaagaaaattgttctattgttgcatcattcattttgtgagtctctcctataaaagcggtaaagcaccaataattttcattttgggattaacaaattaaatgaattaaaaaggggttattattattaaactcaaaatcactttctattttatgcgtttttaaaataaattatatcataagttctttttaaattttacttcgacaaattcaacacaaaatagaacaaaagttctcttttcgtttttgtcttttgttctttccttccattcgccgccacttttattttcccccgagggaaaagcacaaaacacaaactctaaaataaaataaaataaaagcggagagtatttaagtgacaaattcattgggtgatgacaacatttttccttctgaattattttcaatttgtcctccttttttgatcatttaatctctctttttttaatttagcatttcatcgcttttcctaaaatatttttcatttttaaatttgcccaatttccttccaaaacgccaatttatttctgctcctccccaccctcaaaatg

SEQ ID NO: 98339 - DNA, 1003 bp, Heterodera glycines
  Promoter: Source sequence=SeqID_1858; Location=158..1160; Strand=+; Gene=SeqID_76419
cccggtcccgctcaactccagttcaaacacataattttttttttcttatttgccggtgcttttccctgggttctgttgtgccggcattcaaattctatatgtattgatggctctattgcagttcacaaggccataaaaattgaaacgagccgttttggcatatcttttgtctttgttagttcgacgaatggcactaacaaaatactcgcgcactaaatcatgtgccattgagagcacaaatcatttttgaaagggaaacaatttcttggcatttcaatttttaccttttatttttaaatttttcctaaacacttttcaaaaccaaacaatctttggcctctgttctcacggaaagtgtaatatcccccttctgccccttccctcgtcacgtttatcctttttatctctcccccttatgcactcatccgtcgtaacctctgatcacgtgaattcataagtggaggacattgaggcgaacttctggcgccggatatgcccacggcaatatttgtgttcacagcaaaaaggggatgaaaagcgtagtccccccctgaggggggggggggggggggcgctttgatcactttcccagggcaaagcagcggctgtaatcgctcaaatcactcagttcgatctctgtgcccatctccgcccatcactttacatgcataccatttcatattaataattatgcagcaaaacaacaaatacatatggacacaaattaaagagataaatgtggatttattttccattgttttatttaattaataattaaatgcattttttatattttatattattatgctaatttagcttagttaacggggcttttcctttcttttttgctgctgtcggtcatttcgcccaccccgcttttgcataatccaaacagcaaatagcaaatcgacaccaacgcatcagcataaaaaaatgtaaataaaaatgaaaataaaaataaaaagaaataaattaattatttttaattgcagcgaaattaatg

SEQ ID NO: 98340 - DNA, 85 bp, Heterodera glycines
  Promoter: Source sequence=SeqID_29485; Location=1..85; Strand=+; Gene= SeqID_59979
gcctcccctctcataactctctctgacctttacacttatataaaataaaaatttcaaaaaactcacaattttcagacacccaatg

SEQ ID NO: 98341 - DNA, 182 bp, Heterodera glycines
  Promoter: Source sequence=SeqID_37331; Location=1..182; Strand=+; Gene=SeqID_66426
ttggtggctttgtcaactccaatatacactaatagaggactttggagctatagatttataccaattttttaatttgaagcttctataaaagttatgatgcattaaatttagcgacgcgtgaagcttctcactccgccattgcgcgagcgagcggtgcctatgttccgccatatctgagaatg

SEQ ID NO: 98342 - DNA, 106 bp, Heterodera glycines
  Promoter: Source sequence=SeqID_1941; Location=3130..3235; Strand=-; Gene=SeqID_76928
aaatttacagtttcgcccgaaaaaaagtgtttttcatttcttttttttccattttcaagcaaaaataatcagatcccgtgttgaagcagtggtcagccaaagaatg

SEQ ID NO: 98343 - DNA, 181 bp, Heterodera glycines
  Promoter: Source sequence=SeqID_3158; Location=1009..1189; Strand=+; Gene=SeqID_83469
aactaaaagccggcttcttcgttttcaaccgggaaattggagaagcacgacgaatcgccaacagaatcaaacaaacgatgccggagccaatggagttagacaagagcccgggacgtcaacgtcaacaagttcagcccggcccggaacgtcaacaagtcaacaagtgatcagctcgttaatg

SEQ ID NO: 98344 - DNA, 881 bp, Heterodera glycines
  Promoter: Source sequence=SeqID_23759; Location=70..950; Strand=-; Gene=SeqID_54465
tcacgacgcactgatgcaaaattggtcaactataaaattatttaaaaaacttactcgttcaaatttatcgtggtttgccttttgatagaacaatcctagtaattctcgtttacagcggtcagaaagtttttatgcccttttcttgatgtagtgaattaatttttgtcggaattaggcatcgacagctcaaaaaggtttggtatcgaaaattgaaatgccggcaaatccctaaatgagagctcgaatcggtttccagctaaacaaagctcattatatttttcgctaaaaaaccacaatttttgagttatatgctgaccaaactaaagaatttttggtagcacaatcgaaaaagcacactagcagataagaaatgttgaacaaaatctatcctcacttttcacatattgtcagctaaaggattttgctatttttgatctgcatttaggttatattttaattatgtattaaacacagaatttaaatataagttataaaacaaaaatatttgtaataagattgataattttcaattttacttgtccattggaccactcagtttttaacgaggcgctggtttataagtttctttttaacaatttctaccacattttcagcagttcattagattaattttgatattaatatttgtgtattctacatgaatttaatttaataaaataattcttttttttaaatttcatttttcaagccaattttatgaattgtttggtcaattttttgtttatttaatgaatttttttctttaaaacatagtttgggacttattttgcttcctttaaggcatttttaattaatcaaaattttaattaagaagttttttttaaaaacttcgcctaatttacaaaaagttatcaatgatg

SEQ ID NO: 98345 - DNA, 536 bp, Heterodera glycines
  misc_feature (5)..(6): n is a, c, g, or t
  Promoter: Source sequence=SeqID_11748; Location=1147..1682; Strand=+; Gene=SeqID_75241
tgctnngaaaaattgaaattaaaacaaataagtaaaacaaatgactaaaatctaccgggttgtgatatgtgtgacgttatgggcgacgcttttgagaatggaacagtcggagaagaagaaattgagattgactgaggaattccttttgttattttctatatttaaatgaaaatggtagcaacaaaaagttttaagtttagaaattgtaactcaaaaatgaaaattgagtataaataatcggatccatcgatcccacggtgagtcaccgtcggtgtcgttttaaaaaaagttaaaacgaatcgccaatctaatgtcagattcgagattagcgtccttgaaaactccaagtttcctgttttccgaaaataacaaaagaaaacatgggagccccccccccccattttgccagatttaaattctaaattttgtcagaaaggataccctttaaataaaatatcaagaaatggaaatgctgatatgaacaacttaaaaaattaaatagattttaggatgcaagtatcttaagaattgaaatg

SEQ ID NO: 98346 - DNA, 66 bp, Heterodera glycines
  misc_feature (20)..(21): n is a, c, g, or t
  Promoter: Source sequence=SeqID_36221; Location=1..66; Strand=+; Gene= SeqID_65596
attcaaaaatgcaatggccnngcggcggcgggacgcccctaccgggaggcgcaaaaagcaaggatg

SEQ ID NO: 98347 - DNA, 1003 bp, Heterodera glycines
  Promoter: Source sequence=SeqID_2424; Location=879..1881; Strand=+; Gene=SeqID_79644
aatatatgaaaatattattgtaataatgttcatttattgtaaatgaaaagaaatgatggatgaaggtgaaaagacagtaaattttatgcagttctattagtttgacgtcatttagttattaattgatttagtttttaattgattattatatttacgcatagaaaatataaacagtaataacaattaataactgagtaaaatattgattttccaactgcttcgtgaaatctcatgctttttccaaccgttcgcatttcccaggtatttcacgtgaaaatcattgtttaagtgtggcgaagtgacaaaagtatacataggagtggtgatttttccgaggaggggtcatttcagtcccaaaaaatgatttgaataaataaaattttaaaaaaataaaaaagggccaaataaagcaattttgcttttttaataaatttccgccacccgagacacagactcgacctcgagtcttgagaactagatcgaagcttgacccgagattttccatattataagggaaatggacccaaaagccgggacagtatatcaattttcacgacccaaatgcaaaaaattcacgatcctctcgacccctggattgtttttggcgatccgcagatcagggtccatatctcgctcaaattgcaggcgagaaggaatatttgtatttgttgagctattttttcttttttttaaattgaataatacgattttccatactgacggattgtccactgacggtttgtcttggcatagtagggaaaggaaaataccgtatttcctcgattagaatccccgggacttctattattcaaccccctccaaatggggcttatatttgaggggcgggcttctaatcgaagtgtggcttagaatcttggaaatacggtattagaagaagtacggtatgtttatccggacacccttagaaggggagaagggaatattcacaaataagtacggtatgttttaattgccagcgcttcttgctgcatatcgcgcgatg

SEQ ID NO: 98348 - DNA, 1003 bp, Heterodera glycines
  Promoter: Source sequence=SeqID_1327; Location=5525..6527; Strand=+; Gene=SeqID_72641
aattcaaaagcattttgaagctttcttttggttttgaatcattttattgccctcttaaatgccctagcgaaaacacagccgaggctttgttccaacatgtcctattaaaagaagaattatattcgcttttctatcctttggatgatgtcataacgctagaagtaactataatcccagatgtcgacaatagaccaagaaattaattttataaaaaacaaaattacgagaaattggaaaatttctggaaaaatacttaaacgatcaaataatctcgaaatttttgcaaatatgatttttaaacgggtgaaaaatttctacataacagcatttagtgcacctggaatcgaaaatttatatttttcattcttagaaatgctcgaaaaaattcaaaaattacccggtcttattatgggtgaatatagaaaacaggccttatctatgcagaaactagaaattggcatcaaagaaacagatatatttaaatgtcaagaagcagagaatatatccgatgccaatttttcggagataaaaagttatcaaaaaaagatagggaattataaatttaatatcaaaatgttgtacaatgaaattagagtaactgcagtaagtcatttgtttaggcctgaaaaagaaatattttttagtccgtttcttacagaaagaaatagagaaattttttattcattatttcgacatatctaataaaatcgcaactttttttttgcaaaaacgaaacgttttcgttactaatagaatcgcatgatttttagtgtaatatttgagccttactgcacaaaagaccaaaaagttttgcaagtttgaaggtcatttactaatttcgtttgctgaatttgaactaaattagggttgcgtcagcattacaatgcaaaaagcgactatttaagaaactctaaattttcattaccgatatataattttgccttcaaacattagtttatgctatttatttttgatttaacattttttttcccattaagaaatg

SEQ ID NO: 98349 - DNA, 1003 bp, Heterodera glycines
  Promoter: Source sequence=SeqID_2129; Location=523..1525; Strand=+; Gene=SeqID_77999
atgtaatcttttgcgaaacacggatttacacttgcaaatccccggaataaatgaatactaatctccatgtttaattccacgagatcttgttggtccatcttttaggaattttactcgattttttcaaaatttacagccttttatttattgacactcccccggcgcatcacttccaattttaggcccatcatatattttttgataattttccaccaccaccgctgctgctgtttgctgtggtctcctcttcgtgttgtactttcattttgtgccggtgccttcgttgaaatttcattaaaaaaaagacatgaaaaaatcggtgcaacagtcgtgccccgagctgcgcaaggcgcactccgtcacccactcgtccaactactcgctggacaaagtcaagtcgctgcatgagcgctccgcgcgtgcaatgctccactctcacgaggttttttgatgcgttcccattccaaaaaaaggcgcgcatttttcacacattttgcacccctcgtctccgtttgattttctatgtcaattgttttttacgaaatttttaaatttctttcggtttgcagcgggtcgttgatcatgacgaatctgattatttatttgggttaattcaccttattcctaacccgaatccaaataaaatgttaaagtccaagaggggaatcggaattggtcgaaatgagtgtcagattcgagaccagagcgaccccgaaatccaaattttcataaattttcatgacaataaattgcaagctaaagggctcatctctctttggcgtatttaacaaattcaaaaaagacagtttgtaaaacaattttattctgaaattcggaattggcaaaatggatgccatattgtataccggcaaattgttattataactcgaatatatatatatatatatatatatatatatatgtatatatatgtatatagatatatatatgtcgatgcctggagcttgacgacaatcagttgcgcgaaattatggccaggatg

SEQ ID NO: 98350 - DNA, 63 bp, Heterodera glycines
  Promoter: Source sequence=SeqID_20341; Location=1..63; Strand=+; Gene= SeqID_50855
ctcccaataggaacttcaaacgacttagtctcgtgcatttgtacggcgagaagacagaatatg

SEQ ID NO: 98351 - DNA, 414 bp, Heterodera glycines
  misc_feature (13)..(13): n is a, c, g, or t
  Promoter: Source sequence=SeqID_10116; Location=2522..2935; Strand=-; Gene=SeqID_73200
ttttaatttttancattttgacgcataatttttccttactataatgaaacaatttttgaagaaatatgagaagtaatcactttttttttgaggacaaatcacaaaagtcaggacattttcgatttttattattatgcctacttcaaaatcataaatttttttagcaatatttgatggcataaattcaaattaaaatctttaaagagaaacaaataatgaaaatgactttgtgccttgtaatattttctatatttttgtttgctttaaaaattaaatccggcaaaatccgaccaaattttgacgaagtatttggcaatgaatgggataaaaaccacagagaagaacaagcgattaaaaattgaacagaacgatgaaattgaaaatatggaatttatttattttgattaacaaatg

SEQ ID NO: 98352 - DNA, 184 bp, Heterodera glycines
  misc_feature (76)..(76): n is a, c, g, or t
  misc_feature (80)..(80): n is a, c, g, or t
  Promoter: Source sequence=SeqID_40160; Location=772..955; Strand=-; Gene=SeqID_46618
tgtgagtgttcttcattaaacggctttttgtcatccccgagaggcctgttttggaaaacccataaaaattgctttnttgnttgtccaaaattcggttgcctcggacagaccctatggtttttttgtttgtttgttcatccttccattctccgcagttgactggcgtgtccgaccgttggtgatg

SEQ ID NO: 98353 - DNA, 1003 bp, Heterodera glycines
  Promoter: Source sequence=SeqID_6963; Location=3162..4164; Strand=-; Gene=SeqID_63420
acaaaatgctttacgattttagaccccctaaatttgaggatttttagagcctaaaatctacccctattttgtcaaatgtagcttgttaaattgcttttaactggtttgaaactcgaatgtgaagactagggtaggtcgggaccgggacctggacacggacaactgaataccaaggtcccgtgttgaccagttttgaccgggaccgggaaattcccggcttttttcccggttttcccagccaaaaagtcccagtttttcaaccaaaaaagtagcccggtcccgaaactttggtcaagaaaaatacaaataccgaaccaaaaaatgaaaaataattttgggaaaattttgaaaattctgagcaaatcgccaaaaaatgtgatcgcgtcaataaaaatattttttatcgcatttaaaactcaacaagtgaagaatttctaatcttttaaaacggtcaaaatacacaaaagttggtttttagctttgaaatattcccttattttttagatgatattgaacattttgcgcgtaaagccttttttaacggacaacctaggcactaatccaatcccaataatttgaatttataaaaatttttaaaaatttgccacacatagcgatagataaatttattaatccattaaaaacaatttgctcaccttttaaagtttgctctcacatttcacacgcacaaaataatattcaatgaaaatggaatttatcaatcaaatgtttgcacaatgactttaaattttatgaattctgtcagaaaatggctgctcacaaaatcatataaaatacgtttaaacgaataaataaaattcactcccaaataaaataaaattaattaaaataaatacaataatccacataaaataaaacaatgaacaaatttgtgggcatatttgtcgctgttttgctccaatttgtttcgccattttcggcattttcccgcgtgccaacgacgaccaccgaacgaccgataatttatgacccaaaagaaatg

SEQ ID NO: 98354 - DNA, 372 bp, Heterodera glycines
  Promoter: Source sequence=SeqID_178; Location=2267..2638; Strand=-; Gene=SeqID_76514
ttccacctgaaacaacggcagaaccaaatttcggacatttttcaatgctagaaaagcactggtacgacgagaagctaaataggcggacatatatttccaacatcacacgacgattgagcagagggatatagcccccccccccgaacatgtcgcggattattcgatttttaagacccgaatgccttcagaatcagataaaagaattgcgcatgaaatgagcatgattttggtaaaaaggtcaacacctaatgcaatgattagaaattttaaatttagatttatgtgttcgatgtattaaaaaagcaaaaatgggcatatgacgcaaatcagcccacctctgattttttgcctaaatccaacaaaacattaatg

SEQ ID NO: 98355 - DNA, 976 bp, Heterodera glycines
  Promoter: Source sequence=SeqID_13498; Location=1118..2093; Strand=+; Gene=SeqID_77396
taattagctaaaaaggcaacaaatccaatttacggcattttgaagaatttttttatcaaattaaaatagggcaattaattcaaagaaaaatttaaaaaaaatcgaatggaatttcttgaagacaaaagaaagaacagcaaattgagttaaagcaatgggaaagtgttggaagggatgggaacagatcaatcgcaatggaacaaacatttgttatccaaacagcggacggatttccgatcgaatggctcagctaaaacatctgccgacgaaaatgtgtgggaggagggcgaatgacagagaaaatgtttaaagctgaatcgatcggttcattaaacaattaaattttgaattaattgaaaagaaaaatattaaggttggtattgtatagaaaaggtgccctcaaaataaaataaagcacaaaaagtaattgataaaaagaaattggaaaataaattcatccatttcttcagaccgtaacttccactgaagctgaattccgtccgcattgtgaaacagaaaaagtcggaagcatttgcattttgaaagggactaaattattcacaataaaatataaatttttaaatattatttattttctctcacaatttccaactttttttttgattaatttaattattctggtttttaacatttctatttgtgaacaattgaaaaaacgcatgactaactcggattggcataacacttgaattggcatttctttcttatttatgaaagaatgaaaaaattgtgcatatgacaccaaagaaattataaatgtcaaaaaatatggccatataaattgcgattaatgcttttgggttttcaaaataaattttcaaaaataattttccgcttttaataatttcaaataattttccgcttttaataatttcaaataattttccgcttttaataatttcaaataattttccgcttttaataatttcaaataattttccgctttttccaaatg

SEQ ID NO: 98356 - DNA, 450 bp, Heterodera glycines
  Promoter: Source sequence=SeqID_21293; Location=2442..2891; Strand=-; Gene=SeqID_51891
tgatgatttatcatcattttgatgatatcaaggagtcaatgatgattttatttttgagatgatgatttgctaatttttgagaaatttgatgatttatgctgattttttggaaaaatcctcaagaatggcgatttttgtgtaaaactgctatcaaaaacttccaaattttcaaaattttggcatatattgtgttatctgtgtttgacttttattccttataaattttattgtttattttgtttattaattaattagttcatccattttactacatttatgacttcaaagagcaaaattttcaaaatttgatgatttatgctgatattttggaaaaaatcctcaaaaatggctatttagcctatcgtcacagccgacacccaaaattcccctaaaattttgtaaatttgacctatatattgccaattttcagtgaaaatctgtttaaaaatg

SEQ ID NO: 98357 - DNA, 414 bp, Heterodera glycines
  Promoter: Source sequence=SeqID_3535; Location=3615..4028; Strand=+; Gene=SeqID_85071
gtcaacaacagcaacagataaaaataggacagctaataaaagacaactcggactggctgtgtgctttggcgaggaccaaatcctctaaaaagtgtaggaagattttacgtcacgcgaacagcgatcagctattagcgctagtggaaatttgtctgaatctcgtcgcttcacgtttccgattgactacacgacagaaaaaaagattgatgccctatgttgagactgtgcgaaggatgagcagagcgagaagtgaacgcggcgcgagacgtgtgcttgttcagaaaggatcgggatttggggggttgtttgctgccctcctaacacccgtgctaattgaagtagcgaaatcatttgtgaccaaaaacgcataaataccccacaatttgttgttcacgctcacatttttgcaaaatg

SEQ ID NO: 98358 - DNA, 153 bp, Heterodera glycines
  Promoter: Source sequence=SeqID_22734; Location=1832..1984; Strand=+; Gene=SeqID_53427
tttttgctttttaattcctataataatatgatttgcttatgaatggatgaaattaattcgtatataattaccgtatcaaatttttgtcgggattgtttcacctcctccaatggatgcacaaaagttgagttaccaccagccctacaaattatg

SEQ ID NO: 98359 - DNA, 69 bp, Heterodera glycines
  Promoter: Source sequence=SeqID_4340; Location=4969..5037; Strand=-; Gene=SeqID_54106
aaggcccagtcatttgaaacgcctttttttgtcagcacaaaaaaagcggatgaattattttgggagatg

SEQ ID NO: 98360 - DNA, 841 bp, Heterodera glycines
  misc_feature (118)..(118): n is a, c, g, or t
  Promoter: Source sequence=SeqID_41024; Location=1..841; Strand=+; Gene=SeqID_69237
gatagaaaagcatcagagagccttattatctttaaattaacatttggtgcgtttcagagcacgttctaaaaaatatttatgaattaattttgcaaaataataaataattaatgaaaangtcagaatttcgacaaattttaaaaacaacaagcgttggcattttttcaggttaagttagtcctttacaatggagaaggcctgcaaaatttggagagattatatcgattttagtgcgctaggttcgatgaaacttttaaaatatacgcctaaactttttggcctgtttaaaaaggaattaaaaatttttaaaaattttattcatctcccttttgatagaaaaagcatcagagagccttatttatcttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttactttttggcctgtttaaaaaggaattaaaaatttttaaaaattttattcatctccctttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatg

SEQ ID NO: 98361 - DNA, 225 bp, Heterodera glycines
  Promoter: Source sequence=SeqID_969; Location=1..225; Strand=+; Gene =SeqID_65141
tctgttctgccagcttcagtcaccgattttgacttctccctcacagtgcagaaactggagaagcttttcgccaaacccctgtcaatcttcatcgataggtatgaatgccttaaagcggtgaggggagagggcgaggagtttcggcacttcataaatcggcacaaaaagctgatcaacgacttcaagttcgacgatttgaagaaagagcaattttatgcattaatg

SEQ ID NO: 98362 - DNA, 182 bp, Heterodera glycines
  Promoter: Source sequence=SeqID_3582; Location=2823..3004; Strand=+; Gene=SeqID_50949
aatgttcgaatttctccatccgctatatcaatggcttttattttattcaattattttgatttttaatactcgaaataaataggttaaacaaacaaaaattggtataaaattcgaaaaaactgggatcttttttcatttaaataaaaataactcttaaaataatccattcacctgaaataatg

SEQ ID NO: 98363 - DNA, 1003 bp, Heterodera glycines
  Promoter: Source sequence=SeqID_21542; Location=360..1362; Strand=+; Gene=SeqID_45661
tgacaacagagcaactcttccgtcaattacaacatttaaaacagcggacaacaaaaagaggaagcaacaaaaaagagcagagggacaacaaatggacaataattaagagggaaggatgataaaaaagaaagaaaatgtcatcaaaaaaaaaaattaaaaaaaaacaataaaaaaaaacaaaaaataaaataaaagggacagaaaagagcaacagccatccaagctttggttgtgaattaaaaatggggggccattttcattggggagggaggtgtaacatattctaattatcacccatgagcaaagacgaacccttcacacatttccttttttggccaatcgatgttattcatcttttccacattccccccgttcaccattttattcactatttctcttttctctaactctcacaaatccccgcaaatccccgccccttttccgttcaaatgtttcccccaccaatcagtcagtcgcatcggaggagatgagagtcgcgtcggaggagatgagagtcggacgtcggagcgatcaaagacaaattaattatttattaatcatttatttattcacgcatttaatccgacataataaaagagccatacgaacgattggaccctttggacttcttggggatcagggcccgattcctaagattaagacccttcagtcctgggacaatccgtctcctcccatcccgctctggcatggatcctcacgtcttactaatagcaattgactaagctttacacgataaaagtttcaaaagtttaataagagttactgtattcctaattttttccaaaaaataattgaaaaatttttcaaaattggtttttcctgtaattttctcataaaaaatttttctaagattttttcttctgattgaaaattgtcaaaattttcagggggggggaaacgacggaaaaggggcgggctttgaaggaatgcgaccgcgcatatcaaacatttcccctttctttttcagatcaaagttttcatg

SEQ ID NO: 98364 - DNA, 83 bp, Heterodera glycines
  Promoter: Source sequence=SeqID_38470; Location=1..83; Strand=+; Gene= SeqID_67270
gaagaggtgcaacagtgattagaagaggtacaaaagtgattataagaggtacaaaagtgattagaagaggtacaaaagtgatg

SEQ ID NO: 98365 - DNA, 113 bp, Heterodera glycines
  Promoter: Source sequence=SeqID_3650; Location=1775..1887; Strand=-; Gene=SeqID_51280
gacaattttggcagaaagtttggcattgtttgtctaacgcggccattgcattctgtgcccttttggcatccgtttcgaaatttgtaattgaaaaaatgattgtttaataaatg

SEQ ID NO: 98366 - DNA, 734 bp, Heterodera glycines
  Promoter: Source sequence=SeqID_11232; Location=1..734; Strand=+; Gene=SeqID_74593
aaaatttatgagtcaacggcaaaaaaaaaaaaaaaactggataatatcagcccatgcttttatatttatttaggcaaattttgccaacaacagcaacaccactttccaaatccacgcgattcgtcaacaccaaaatcaaacagcaacggatcatcaccatcatcaatcacatccaataaaccattttcatcatcaaattgtcttggaaataaaagtattgaaaatatgaatgacatttgattattttaattgagtttaaaattaattataaaaaacaaaaccatgagaaagcattaaatttttaaaaattcaactcacaaaatattttattaaaaagcaattttgttccaaatgaattaaaagaattttgagaaaaaattaataatttaattataatttaaataacaataacactccttggatgtgaggccaatttttcaattttgaaaatctcattgatgccttaaaaagcttaataaaaaagcctcattataggtcataaaaaattttattttcggcacataaatttgggattacatataagaaatatgttattttttaagcagatcgccatcataaaacttaaaataacttattttaataaacacacatttattacagtatacagcacacagtcgtccagtaatactgtggtggccaacggtagtggtgccaacagttcaacagcgactacagcggcatttgttgccgaagatagttgttgcaaccaaatg

SEQ ID NO: 98367 - DNA, 509 bp, Heterodera glycines
  Promoter: Source sequence=SeqID_10752; Location=2553..3061; Strand=+; Gene=SeqID_74002
agtgggagaaaaggagaaatagagagagagagctaaaggggaaaagaaaaagggggtaagacacaccaaattaaaacaataataatttaaatttataaataaacatcaatggagcatcagcagagcaataaacattgataaaatggacaaaacgaagacggaagggaaatgggaaatgaaagagtgacccatcggaagaggtcaaaaacggagaaaagaggagagagaaaaagggagaggcagagagaaagggtggggggagagattattaattggtccattggaaatggtcgagagtttggacagagtcgagaaattcgcaaaattaaattcaatttactaatacatttttgtatatgtttggcgatttgatctttctttccattgtagcaaaagaaagtgcgaaaccatgggacacttttttatttctttgccaaaatattaagaaaggtaattaaagaaatgaaaggagagaaaatgagttggatgaatgaacggacgaacgaatg

SEQ ID NO: 98368 - DNA, 72 bp, Heterodera glycines
  Promoter: Source sequence=SeqID_3376; Location=2926..2997; Strand=-; Gene=SeqID_84451
ctcagctcggcctctgctgctggctgttcctccgttgccaatttgatcagttcgtcgtccgttgaggcaatg

SEQ ID NO: 98369 - DNA, 642 bp, Heterodera glycines
  Promoter: Source sequence=SeqID_41196; Location=1097..1738; Strand=-; Gene=SeqID_69379
tattgcctatttttcatcgccccaggggtaagcattcaatgtttaaaatttcactttgtatttggctttgttccctcccttctccccgctgctgatgagcaaaaaccggtcaaattgtgctcgtctgggccatcaccaccaatgaatgttgtgctcccattttaaacattttactgccgctaattacgaattaatgatgcacacattttgcgccagaagcaaaatgcggcagctttaaacactttttgcgagtaaaaaataagtaaataaacaaaaataattattattgtaaaattaaaagtcggacgacgtcggagtgctttttcattctgggacggcgtcaaattgggtggggggacagtgtggtccaacccatcgcacgatagaaattgatgagcatttcgcgtgtttatggggctaaattaattgaaaaccgaaaattagaaaatacataattcaatttattttccaaaaattcaatgtcttttaattggcaaaagatttttctaagctttacacaatttttagcctaaatttgcatttttaagttgtttatttctcaaaaatgtaattctttacaaatctgacattaatataaaaaagactgtgttctcttcgctttactgatttagcaaaattatg

SEQ ID NO: 98370 - DNA, 56 bp, Heterodera glycines
  misc_feature (13)..(13): n is a, c, g, or t
  misc_feature (20)..(20): n is a, c, g, or t
  Promoter: Source sequence=SeqID_21737; Location=1459..1514; Strand=-; Gene=SeqID_52337
tgcaggtcaaacncgaaaancattggtggaacgtatgagacttttgttcagcaatg

SEQ ID NO: 98371 - DNA, 304 bp, Heterodera glycines
  Promoter: Source sequence=SeqID_3933; Location=3915..4218; Strand=-; Gene=SeqID_52506
taaaaatttccacccactaaaaataagctataaaaatatttgttattttataaatatagccaaaaattcaattttttgtatcaaaaatatgtactcttgtcttatctccaattctactcttccacctcctcctcctcgtcgtcacttgcgtcagcagcagtcggcagcggcgtcaccagcgcagtacagatggttgggcaacaggaagagggaaaggttgctgcaaatgcacggcgtcagcagcgcaaggaattggaagctgggcccctgtactgcagtttctgccacttgttcggcacccatg

SEQ ID NO: 98372 - DNA, 329 bp, Heterodera glycines
  Promoter: Source sequence=SeqID_8800; Location=1676..2004; Strand=-; Gene=SeqID_69268
aacaattgtatgtgtacgctcctaagctgattgatgaatccataattggcgacaaaatggctccattgctgagggttgttaatgtatctacaacacctggagggacggacgtgcccgaggttatatatactaatgaaattttccattctcttcaaaacaaacgagtttctgaaatacaaattgaaattcagaacgcatttggacgacacataaagtttaactggggtacttgcatcatcacgctacatttccggcgtaaatttttttgaatcaacattgaaaaacaacgaggtgccggtcttctgaagaatttggcccgtttcctgatg

SEQ ID NO: 98373 - DNA, 61 bp, Heterodera glycines
  Promoter: Source sequence=SeqID_6309; Location=3307..3367; Strand=-; Gene=SeqID_61098
ttatgacacgctgcccgacacgcccggcgcaacggacgacgcggtgtcctgtgcgattatg

SEQ ID NO: 98374 - DNA, 308 bp, Heterodera glycines
  Promoter: Source sequence=SeqID_17110; Location=679..986; Strand=+; Gene=SeqID_81548
ggtgcgcgaaaattttaaattaaattaaaaatcattttaaaatttgcaagtttttttaaagaaaattagaaattcaaaaatttttgttttttggcgagcggggaaacggctggcgcggagggggcgggcgaatttctctccctagtcactttttttattcttcaaccaaaattaaacattcaagcaccatcccttttgccaaagttcgactcccattgagtgctgtaaccatttttggcaatttaaaaaaatatttattttaacaaattaattaatagatttgtgctaaggttttacacttttaaatg

SEQ ID NO: 98375 - DNA, 119 bp, Heterodera glycines
  Promoter: Source sequence=SeqID_30767; Location=1614..1732; Strand=-; Gene=SeqID_46230
tttacgacttgttctgtaaatccttaaatcctgttcatgatccgatactatttctgtttctagtttatacatttaccaatccatccaaatataaaaattagaaaatcttaaaagttatg

SEQ ID NO: 98376 - DNA, 533 bp, Heterodera glycines
  Promoter: Source sequence=SeqID_18014; Location=520..1052; Strand=-; Gene=SeqID_82588
tgtcccttttccgctttgatccattagccgcgcggacgggaaaatgtttcatccaaatttgagccccaaatttctcgcctcgcccgccgatggatgtgcaaacaaacagacaacaatatgtgtgaatatgtgttgacggtccaatgcacaaatgcacattcaaaaaaaaatatatagaacagcaacattcactaattagccggtaattaggcatcgtttaattaccaatggttgccatcattaatttaattaactacttaaattcctgaccgaaattttgttggaatattttactggacaaatgtttgaattcaattattttttctcattgtttattattaaaacaaaaaatagtcatatttttaaaattttattcttaatttgacaattttatatttaaattgtataaattgtttttccaaccaaatttttaatcttttttatttttttaacagaaactcaataaactattcattaaaactaatcaattgcaattaatctctttctgcctgttctgccttcaaaattgaatg

SEQ ID NO: 98377 - DNA, 168 bp, Heterodera glycines
  Promoter: Source sequence=SeqID_5126; Location=1..168; Strand=+; Gene= SeqID_57001
aagaagaggagcgaaacgcgcgtgaatatgaccagctaatgggctacgcgtacgacgacctcatcagcagcctcaataaagagtaggtacggtctaaagtggttacaacacagtcaacactccggaacacgaccacgacaaggacgggatttagcgtttcacagcatg

SEQ ID NO: 98378 - DNA, 65 bp, Heterodera glycines
  Promoter: Source sequence=SeqID_25662; Location=52..116; Strand=+; Gene=SeqID_56414
gcctacactctctcaaagcagccaaatgagcagcctttaattgacccctcacgcttcagctcatg

SEQ ID NO: 98379 - DNA, 965 bp, Heterodera glycines
  Promoter: Source sequence=SeqID_13998; Location=3926..4890; Strand=+; Gene=SeqID_77967
gaaacaaaaaatggcattttaaattgccaaaatttgtgataaatgaagtaattatagtcattaaataaatatatgaaagcgagtaaaaatgaaaattaaaaagtatatatatatttatatttaattaattttaaatattccaacatatcccaggacgggaccggccgatatagtcgagaacagcaatcgaaggattggaatggaatgtaaatatacggattgagggtggatggacgatggtgatgatgacacataaattgagcaaaactaactttttcaatgggaatgagaccaaaacggagggaacaaatgcgactttaaaagtacgtacatataatgttgtccattaaacaaatattttgaatgtttgaagagtgtgtccaattttttttaaattgtcccaaagaatgaacttttaagataaaattgaagtcagtggatcagccgaattaatcaataaattttatttccaattaatttttagtttttctaacaaatcttacaaattatgtgtgtataaataactcttttcaaaaaactgtaaatgacactcttaaaaaatattaccaccatagcatgagaggtgacatgagttttattcaaataattttaatttatttaattaaccaaacctaataataaagataaaagttaacaattagtacataaccgtattttatacatctaatacaggtaatctttaagttactaaagcaatgatggaaaaaaaagaaaaaatattattaacacgcatcgtaattaaaaaccaacaaaagttacatacacatgatgacattacagaattgatcaaatccatgtgtttaaacccgaataaaattttttttgacagataaagagagagctgcaccaaagttaacacatattgtagaagtgtggcatttgtgtggtggatgaactgctttaattcaattcattgagaaggtggcggtggaggagggtaaatg

SEQ ID NO: 98380 - DNA, 1003 bp, Heterodera glycines
  Promoter: Source sequence=SeqID_4529; Location=1861..2863; Strand=-; Gene=SeqID_54787
gccatgacagaatttccatacgaaagtccaatgatcttggtcaaattttgaaaactttgccgagggtggtgcgccggaacaccccttatgcatgtatatgattctaataaattcaacagaattctggaactaattttcttaatgaccattttgttaaaaatagtttaacaatcagatacaaaaaaaaaaatttctcgggttttgattggattcaaattaagtttttggcttataaccattttggattatcatccaatttgtaatatatatttttttaaattgtctgagatttgggacattccattcgttatttgactgctttttagaggaaggatggcacaaaattgagcacgtgttcaccgattatccgaagggcgtgcgttatttggtggtcgaatgtttgggccatgacagccaattttgggccggaaattatgggccaaaaattgccaaattcagcgtgacagcattgcctgtcaaatcgacaaaatgaaacgcgaagaaatgatggattccatttccgaaaataataaagtgatatatactaataaatagcgcggatgtgataagtaaatcattagcatttagtgagtgataactaactgattagattgacactagaaattttgtctgctcattttttaaaaatgtgttgtcactgtaataaaacattttttttcaatttttctttggttttattaataataataaatattatatattgataatttaaaatttcattgctcattcttaattttaattttttttttttttcatttttaattgtctattcgtctatttttcgggtcttgatcgcttttttctaatcactttggcgcaggtgccggaaaaaaacgaaaaatttacactagcaaatcgaccatttttttgattttaaagtgattttggccagtcataattcgatatttctcctaattagcggaaaaattactcgaaaatttttaggattcataaaaatcttagatttttttgttttaaaatg

SEQ ID NO: 98381 - DNA, 235 bp, Heterodera glycines
  Promoter: Source sequence=SeqID_912; Location=1225..1459; Strand=-; Gene=SeqID_63842
ttccgaggccccaaaaaatttcggaaaattccgaggctcaaaaatttttcgcaaatcggaattcagactccaaaaatgtcgtaaaccggaattccgtgccatccctggttcacaccgttactattcctattcgtaaccattttttttttcaaataacatacctatttgtccagcttttaacaattaaaaattgtataaataatcttttatacgacgaacgaacaaacaacaaatg

SEQ ID NO: 98382 - DNA, 813 bp, Heterodera glycines
  Promoter: Source sequence=SeqID_2369; Location=1..813; Strand=+; Gene= SeqID_79372
cggctttctgtacccggcaataccctgacccggtattcgctaaaatacccaggcccgtacccctaatttaatatacgattttgaagttttttaaattaaaaataaggctacagaaaaaattgaaaaactctcgcctctcgtcctctcgcctctcgccaactctcgtgtttttggggactctcgcctctcgccaaactctcgctctcgtctttttggggactctcgcctctcgccaaactctcgctctcgtctttttggggactctcgcctctcgccaaactctcgctctcgtcttttctgagacaagtcacacccctgtcctgtacccaaaaagatttgcaactgtggtggtggtttttgtaagacagtaaaggaaaaaagggcgaaggttcaattcctttgcgcaacatgactaggtatttatttaaaatgaacaatttttgaaattttttcataataaaaaaagagttgacccatagtgtctgtctatttaatggttcatttctctttttttgactcattttttccgaggttgggaatgaacaccctgctctgtagacatgatgcaaatttctcccatgtcatatcccattttctcccacactccgtttcctttatgcatcacaattagtgaacgacaaaacgacttttttaacgagaaaacatcgttataaattctattttttaactatgtacatactacttatattattaagaaacgaccataaagtgctgtaattcaaaatttctttcctaattaaacgaattttttcaacaatgggcaaacggctctaccgataaattcagtaaatg

SEQ ID NO: 98383 - DNA, 65 bp, Heterodera glycines
  Promoter: Source sequence=SeqID_18483; Location=1489..1553; Strand=-; Gene=SeqID_83099
tcgtgaagatcattcgttctgcgaatgacgaacggcgcctgaccgcctggaagggtaaacctatg

SEQ ID NO: 98384 - DNA, 586 bp, Heterodera glycines
  misc_feature (167)..(167): n is a, c, g, or t
  misc_feature (236)..(236): n is a, c, g, or t
  misc_feature (263)..(263): n is a, c, g, or t
  misc_feature (274)..(274): n is a, c, g, or t
  misc_feature (429)..(429): n is a, c, g, or t
  Promoter: Source sequence=SeqID_26096; Location=1539..2124; Strand=-; Gene=SeqID_56842
aaaaaaaccccctttaattatttttttttacccctaaaaagttttaagtaatccaattttttccttttaataaggacaatatttatttgttggagataaaatttccttaaatttttctcctgcaataaagcaaaataagcactttaatttgattaataaaaaatatnttatttgtttaaatataagagatttatttacagcataattaaaaaattaattttggaaaattttatcanttcaataataaaaaagaataaaaaatnatctaattatngtcaaaaataaaattaggaaagaggaaagcacaaatatttatgccaatttgaccaataaaaagcaatacaaacttaattttaaaaggatttattttaagcagtaatttatctttatttatataaaaataaaaaagcaaaaaagaataaaaaacanctgagagcctgtaaaaattgttttaataacaaattcatttttacttaaatttttctacttcaataaagcaaattaagcacttaaattgatttaataaaaattatttgatttgtttaaattttttttcatttaaatattatagaaaaattcaaatatg

SEQ ID NO: 98385 - DNA, 779 bp, Heterodera glycines
  Promoter: Source sequence=SeqID_11829; Location=1..779; Strand=+; Gene=SeqID_75331
gctcattaagcatcattaacattcattaattatgtaattgctggcaaccgcccgccgaacggagcagcacattaaagccaatcattcattcatcattcgactaatttattatgatgaacataaaagggcgcaacagaatgccaattcattaaaatttttgacaaaaaattaatttttggattttcgtgaaagtcaaatttggatttcattttttaaataaattcagaaaattgtgttattttttatttttaaattttttgctatgcaaaagagcatcttcccaccaaaatttccaattgaaaacccgtttttcaacaagtttttgcatttgaaaatgttgtttttccaccatcccctccccccccccaaatgagtgccaatttgtaagacgaccccgcccatgaaaagagaaggtgcgatcggtggtcatttttaattggcgctggagcaaagcactcctcactcactgcccaacaaaagttcattcgccaagtgccgaaaacttccattgggggtggttcaaattcaaatgaaaccccaaaattttcaaaaaattcgatttttttttaatcgctatccttcaaatttcaattttttccaaaaaaatgccaaagttgaatttataaaaaaggaaaattgatattccgctgctagaaaattcgatagtttttcgacaaaagttggaaataatttttgaatataaacccgagagtctcgaacacatttctaacaaattttaaacaatctatgatttatttagccaaaatttattaaaaatg

SEQ ID NO: 98386 - DNA, 442 bp, Heterodera glycines
  Promoter: Source sequence=SeqID_9789; Location=1903..2344; Strand=-; Gene=SeqID_72683
taccaaataaaaatggtttgttttttcataatttttttataattgattttttttgaattttatatttaaattttataatcattgcatagttgttaaacgatttttttatttaaatacaaaattggaaaatacctaaacgaatatgctttctccttaaaatttattaaattaaaaaaaaatttttggttctatcatcgacattttttttattgaatttactataaaaaacttagttttcactaaaacatttttttaataattttttaagcaattttaaaaaatctcttccattttacctttttaatttataattttttacaattttttgaaatagaattcaatccattcccattctaactaatataataataatttttaaactacgaaaaagtatgcattgaaaataaattttcaaaatttttagaattcttcaaaaccgatg

SEQ ID NO: 98387 - DNA, 159 bp, Heterodera glycines
  Promoter: Source sequence=SeqID_28762; Location=1..159; Strand=+; Gene=SeqID_59336
tgcaacctcatctacgcaaaaagccctgtcaaaccaatcaaagtggccgcacacgacggcacaattccaaagctggaacttcaagcactgactctcggagtcaaggcagtcaaattcatccaagcgcaaatcaaatttgccgatcatcaagtcatcatg

SEQ ID NO: 98388 - DNA, 346 bp, Heterodera glycines
  Promoter: Source sequence=SeqID_2933; Location=4257..4602; Strand=-; Gene=SeqID_82414
tttttggcgaaaatttcgctaaaaaattaaaattttcaatgatgcatcgaataatttgtgcacctaatttaaaatgtgagacatggaaggaaaattgcgcaaaatttggtagtcgtcttaacaaatttccgtagagataaaacatagaaaatttattagaggcgtctaaaaagactttgtgtgtaactgaaatttgtcaaaaaatcattaaaaccaatataggtattttttaaaaacaaattcaatttccgtttaaaaaattccatttccgaggctttatgaaggtcaatttcgtcattatagcttttcctaaggttttaaccaaagtttttttcgttaaaaaatg

SEQ ID NO: 98389 - DNA, 565 bp, Heterodera glycines
  Promoter: Source sequence=SeqID_18224; Location=1..565; Strand=+; Gene=SeqID_82819
accgcaagaaaagctgggaccggaccaaccaggaattttcgaagaaaaattttttttgaaaaaatccaaaaattttcattaaaatgcatagattaatgataatttagacacttttaaatatttctctatgtaaatgattgagtatttttttaattaatggtatttttctattgttttaataattgaaatatcttaaatttttgaaaatataaaaaaatttttgttcagttggggaattgaacccaatcgaaaaagaataaaaggcagaaggtttagtcaacagaccacatttgaatttgagttatccaaaaataatgttctttgattttaagacattaaggaagcagagaaagagatttatgatgtttttttgcgtaaatttgaatatttttatgactgctcaaaagttcaatctttaggggtgttttttcacctctcgtaccaaaaaacgagaggtgggagtacccaaaatggcgagagttggcgagagacgagagttgtcccacccctgtgtgggtcttttaggaaaatgccgtggtgagccgaagtgacaaaagtataaatg

SEQ ID NO: 98390 - DNA, 1003 bp, Heterodera glycines
  Promoter: Source sequence=SeqID_100; Location=9466..10468; Strand=+; Gene=SeqID_67533
tttttaaatatttttccgcaaatcaattcctgatttggtttgtgtttttccggacaactatttatgttattcccgacctcgcctctgagaaaaaattattttgaaaattgtttaattggaaaatattgtaaatattattaaatttttcaaaacatttacacggcatcacggcaccataacattctcgctactatgcttttcaaattctgaacacttctctctgattacaaaaatcgtaaaatcaactaacagccattaaaattatcctttattttttaattttcagaaaattactcaaattttgtttggtggaaaattttttttttattaaaaaacaatttatacatatactttttcatccattatttttaaattaaataattaaaaataaattgattttttccaaatttttctgcaattattaataaagatatattaaaataatatatttttaaattttttatttttaaaaaagggtttcccaatgaatattgttttctaaacatttttaaaaaggcttccaagtgattataattttttaaacattttttaaaaaggtttcccggtgactaatatttctttgaaccttttaaaaaacagtctcccagtgcaaattgcttttctgaacatttttaaaaacggtctcccaaaaaatattgttttctaaacatttttaaaaaagcgtttcccagtgattataattttttaaacatttttaaaaaagggcttcccaatgaaaattgttttcaaaacatttttaaaaaagggtttaccaatgaaaattgttttctgaacattattaaaaaagggtttcccaatgaatattgttttctaaacaattttaaaaaagggtttcccattgactattattttttgaacattttaaaaaattgtttcctgcgaaattttttgaaaattcgtttaaaatatttttgattacgttgtttacagcaatgggcagcttaaactcccttctttttaaaaaaattttcattaaaatatg

SEQ ID NO: 98391 - DNA, 850 bp, Heterodera glycines
  Promoter: Source sequence=SeqID_15618; Location=2552..3401; Strand=-; Gene=SeqID_79907
tttccgtaaccacgagtgcgctctgttcttcatgcagttgttcaatcggttggtcccaccattttttgtttggctcttttgcattctctggccacaggcccgtatccagtaaacaattcggggagagcacccgaggagctttttttgcctattcgggctaaaaaaatttctacagtattatttttcaaaatttttatcgcggcgaaaaagcaggaatttgtagggcttttgcgctaaaaataacgattttttaccgttttggggtcaaattttcaaagtataatgctccaatggggtccagcggtgtcgataggcgccgcctggaaaactttttggaaattttaatgtcatatgataagaaaatgtacaaaaaaagtgcaacagatgttttctgccctctgttcctgtaatttcttctcattttggcttccctcccccatttgaaaggtccgtcttccgcgtgttcgaccgtcgccaagtccgcgccccgttttgccacgcggatttgacgcggccggagagagtgctgcgcaactatttgcagcagatgtgcgacgagaagaacagcgcggccaacagagtggcgtttttgttaatatttgaaccaaagcacaaaagaagggtcttcggattctccctccgattttttgtttctgtttgggactgccatctccaaattgattccactgtttttggctagtttaaaattaccttttcccccacccctccgttcaactccctccccaccattcgcagcagcagtaccaacacggccgtttgctcaacgtcgccccccgctattaccacaacggcttccatttgtacagggtttgtggttggtcggtgaatg

SEQ ID NO: 98392 - DNA, 1003 bp, Heterodera glycines
  Promoter: Source sequence=SeqID_18700; Location=1318..2320; Strand=+; Gene=SeqID_83373
atgaataaaaattacaaaatgaataaaacaaagtatgaccaaaatatacggttcgtctcgcaaccgacgaagacgcaaaaaagaaatgacatgctaatggggatattagccgtggtgggttatcatcattgtggctctgattgcatgctattttggccgagcgtgtgatgagagcagttcggcatcggcatcggctggcgccagtgccaacaaatcggcaagcaaaagtgccatttcaagcacaaacgaaggagcaaaaaatgatgatcaacactctgggatatagatgctagattttagggatacattattgtcattatttggcactattttctcttcaagttcggcatattaggggaatcaattatggattaattatatagaaaaaaagacaattctataatgccaaaattggaaaaaatgaatattcaattgaattttattcgaaattatttcttttttaagagataaattttcaataaattcttccctttaaacaacaaatttgtctaacaacacaaaaagtaatttaaaaaattcaaatgtttttcaacttttggaaagtgtttttattcggctgactaattaatatccggccccaactttctgaaaatatttaaacgcttattggtttaaaatttttttcaaaattattagattttttttttaattttgtgccacagcatttttccataagttatcataagctcaccaaactttgcagggatagatacttgaaggaagaaaattagcttatattaaacgtttacatcccatatcctgaaaataggtttccttttgcttttttggcataaagttgaaaaattttttgattttaatgctcaatggttggctttttggcaacgctttctccgcttttattagaattattataaacattattttctaatgaatttatacaatttaaacattacacatttaatgaaaaaagcataaaataaataataaatataataaaatatttttatttttttagtagatg

SEQ ID NO: 98393 - DNA, 593 bp, Heterodera glycines
  Promoter: Source sequence=SeqID_5302; Location=1378..1970; Strand=+; Gene=SeqID_57612
aggtgaggttaggtcccgttgattaggatgttggtggattgagttccggtgattgaagtgctggtgggttgagtcccaatgattaaaacgcaggagaatagagtcccagtgattgaaatctggtggggttgagtcccgacgattggagaaaaagcaaaaaaaaaggatgcgaggccgcgaagcggccgagccagtcgattttatcaaacataatcttacaatacaatcgtactacctagcgggggatgcgccgaaggcgctgaccccgctaggtagtacgcacaaaacactcgtctctcatggaaaagagcttttacctgtcaaattctttggacaaaagaatggagaagaattgtagttataaggcattcataaattatttaaatgacaaaaaaacatttcgccatttaattaaaactaataattccatccagctcactgtcttgtcagttttccaatccgaccaataatccatcgcccaaaaagttggtttatttagattcattttaaaaacggctctgtttacccgttagctcttgttctttttctcgtcataacttttctcaaacgtttttgaacaggaattcgtcatg

SEQ ID NO: 98394 - DNA, 133 bp, Heterodera glycines
  Promoter: Source sequence=SeqID_13810; Location=1170..1302; Strand=-; Gene=SeqID_77746
gcgcaatgaaagcaatgagaagctttgactcgacgtcagtcggagggatcagccgggcggagggacaaatcgaaggcattgagggtacgccgggggactggtcaatcccgacggactttcacttcccaaaatg

SEQ ID NO: 98395 - DNA, 174 bp, Heterodera glycines
  Promoter: Source sequence=SeqID_33636; Location=787..960; Strand=-; Gene=SeqID_63642
ttttaattaatcgaaataaacattcgctttgaacaatcgaaattttttaagaaaataggttaaacaaacaaaaatagatataaaactcggaaaaaactgaaaatttttcattttatttaatacacaaataataataaatccattcatctgaggtaatgggcgatcaccaaaatg

SEQ ID NO: 98396 - DNA, 485 bp, Heterodera glycines
  Promoter: Source sequence=SeqID_5947; Location=521..1005; Strand=-; Gene=SeqID_59764
ttcgaaagctcttcacagtctctattagcctactaaaaattacagaaaatttttgcggttttcaactgacaacttttttgagagctgattaatcactgagaaatagcttataaatatcttctaaacatttagggctttcgaatgataccatgattgtgaagtttggccaacaaagaaaaaagttatagctttttgaacattgctgagacggagttggccagacggagttgacccctaccgtccttcccaatcgtttccttaccaaccgtttctttaccaaccgtttccttaccaccgtttccttaccaaccgtttccttaccaccgtttccttaccaaggtatttggttcatttccttaccaaaaaattttcgaaaaatctttggtaagaatttcgacaatagaagagagattttcaatggttggatgcttatcatgaattagaagtcagttgattttatgtttaatgttacagataataaaatg

SEQ ID NO: 98397 - DNA, 416 bp, Heterodera glycines
  Promoter: Source sequence=SeqID_45450; Location=1..416; Strand=+; Gene=SeqID_72745
ttatttaatgatataaaattaatcactcaatttaagataaattattttcttcgattttatgagccaaattttttaattctttctgttcattaatttgatttattactcttttaaattatgaaatataataaattcgctttcatttcatttgtgacaaaaaataaaataatttttatcaaaaatattatttatggaaaaaattaatcactcaaaattaaattaaattatttacttcgattttatcacacaaaatttttaattctttctattcattaatttgatttttattcttttaaacttaaaaaatatacgattgattataaaaaaaattaaataaaaaaattaattttcttacaaaatatttattcaaatttaatttaatttaattaagattctttattctgcaaataataatg

SEQ ID NO: 98398 - DNA, 634 bp, Heterodera glycines
  Promoter: Source sequence=SeqID_16264; Location=1..634; Strand=+; Gene=SeqID_80650
gtaacttaacgcatttttttaattttgcagtataatagaaaacacttagagctatcaaatgatataagcttttattggttgctcaaagttattttaaaaaatattttcatttgatggttttttgagtaacaaaaataattttaaataattttaagaattatttttttggtaataaaaaaatttattgaagtacataaattattttattattattacttctttaaaagtttcattttgattttcgtggattctttgagacagcgaatggtaattgaaactgaagattttttaaaataatcctgcttttctttgtctcttttctaggcgaaaaaatgagcattcctccaatttattaattagctaagcagcaaacgactaataaggattacattttttattcataatttcctaattaaatttaaaaaatcgaaactctatacacattcattaacattgttatcgtcattgcatcaaatcatcaacgtcaaaaacaattaattgattttctcgcttttagttttttaatttttgaataataatataagcattaatttaatacaacataaataaagcaattcaatacaatccaattcatatatttattttatttagagaatccttttttaaatctatg

SEQ ID NO: 98399 - DNA, 1003 bp, Heterodera glycines
  Promoter: Source sequence=SeqID_24040; Location=739..1741; Strand=-; Gene=SeqID_54738
tttatctattaactgcgatttccaaaaaaaaaaatatatatttgtcataataaactatctttacattatgtttaattaattgggaaatattaaaaaataacataaaattgtcgaattgaaaaaataattatcgaccttaatggattgtgaaaggaagagctgtgtgtatgcattaatttgtataacgtcattttccaacattttttaattttgacatcatccaaatcattttaaattattatttttttcttaataaacatatagcattttttgttttttattgtaattgccatgtaatattattggctatgttttgagtatgagaagtcggatggcacggctcgatcccatgttttcggctttttttgctgagagaaataacaataacagatgctgttcttatataacggtcatttagcaattttattcatttcagtgaatgcttttttagccgatgtccaaactcggatttaatttatttttcaaatcaatccaaaagcccaaaagagattctcgtcatacgataatgtacataaaatattttgcccgagattctcgttttcaaataatcaaaattacacggtgacatacatattctaaaatacaaaatgccatttttaattaaaatattgaacattttttgatccaaataaattaaatagaaaatgtacgggcaataatataatgtctcttaaaaaatattaatttaaaagcactcaaagaatgggagtattaaaatactttgtcatcccgctgctattgtcccaattttcatcccaaaccatttcaggagacaaaggtaaagttggaataaatcataataaaatatttgaaagaattaattttgaattttttaattaatgaataatatttaatttgttattttttccatattaatcggaaaagttttaagtacaccatttatgtagttgatcaccacaaaacgctaaatgattcgccatcgattgacataagagagaggacgacattaggccaactgatg

SEQ ID NO: 98400 - DNA, 352 bp, Heterodera glycines
  Promoter: Source sequence=SeqID_6401; Location=3862..4213; Strand=+; Gene=SeqID_61425
tgtcgttgacaagaagttgaagcagtacagggtcatagaacagcaactgactaaagccaagaaatcagtggttgaatttgtccacttttttaagtagacccatcagtttatttgagtctaactatcttgaatttaatcgatagatcatttttaaaatctcaaaaatggcagaatatgatcgggaatgatggtgcatattttgattaattttgagttattatttgattttttataaatttttgaatgaaatttttggtcggggtgacagaacttatacaacaccccaatatatagtttatacaaaagttaattttgtggggttaatcctacggtatccccccgcaaaaatatg

SEQ ID NO: 98401 - DNA, 311 bp, Heterodera glycines
  Promoter: Source sequence=SeqID_31949; Location=1334..1644; Strand=-; Gene=SeqID_62268
tcttttagaagatatatttaaaaatttttttataaaaattcttaaaaaatacaagcataaaatatgttccgaaaattgtagaaaaatgacaaatgttggcagttattgaacgctacattaatggattagtcataatattgaaaattcaatgaatgtatttttctccgaaaaaataatgtcaatttttattattcgtttaacaatttatttattttttttataaatatattaattttaaatataaatttttcgcgaaatacaaaaaaaaatcataaacttaaaaaattaattaaatgttatttattcagatg

SEQ ID NO: 98402 - DNA, 404 bp, Heterodera glycines
  Promoter: Source sequence=SeqID_35917; Location=474..877; Strand=-; Gene=SeqID_65372
ttttcccacccctttaagagcaaaaatattattaaataattaattagattaaaatatatatgcttgattttgacgggggcgttccggtgttaagataacaaaaaaaattaaaagaaaattctaacttttgaaaatttttcattttctgaaagcttccaaaatatattaattataatttactttagaccatcgggcctatctaaaccaataaatgttccacacaattttttttattgattattttgatctcagctaacaatacatttgtaggttcctttaatttttatattcatatttttataaatttgggtcttttttctatttatgtttctatataattatgttcgtatttgtttaatatttttgttatgattattttggatttctacatttaattaaagatg

SEQ ID NO: 98403 - DNA, 376 bp, Heterodera glycines
  Promoter: Source sequence=SeqID_2560; Location=1432..1807; Strand=-; Gene=SeqID_80424
accgatcttttaaattaaaaagtgaaattcaatgatggctccgcttgttttgctatgcccttaattacatttcctctgcggtcattccctttgtccaattgttttgcgattactttccctcccctttcattccctcgtttaaattggtgcggggattctccatgacgaccttttgctgcttccctgtggcaatgtctaaattactccgctgggtccgaatcccttcaggcgccttttttctccctcccccatttgtccgatagtttgtctatttttgcctttcgccgcctcttttgtcatcattttgctttgggcctttaactcctccagtgtttattgttttttccaattcaaaatgcctgtgggtggcaaaatg

SEQ ID NO: 98404 - DNA, 132 bp, Heterodera glycines
  Promoter: Source sequence=SeqID_23162; Location=783..914; Strand=+; Gene=SeqID_53866
aaaatcagcggtgccaataggcgcagcgggaagtattttcaaaattgatgctatttttaagagagattttcactaaaaaaagcaaaaaaaaaacaaacaaccatcattgaccccatgaaaagcatcaaaatg

SEQ ID NO: 98405 - DNA, 1003 bp, Heterodera glycines
  Promoter: Source sequence=SeqID_10671; Location=2960..3962; Strand=+; Gene=SeqID_73918
atttccttgctcattgactgttaatttagatgttctcactgggtcgcaatgtttgcatatggattaaagaagaaagtaatttattttgacagtctagcgctaccgataaacggatcaattgttagctcctttctcaattcatttcccggagcggtgtataaccaaaaagcctttcaaactatttcatcaaagtcatgtgctcatttttgcatttgttttgtttactttttatcatcaggttccacatttgatcaatttctaaataaatttaatcatttaaatagtcccgaattgtatgttcaacattttgttcacaattttccaataaaactttaaagaaatgactcttttttttcattgtataattaggtctatctcacaaacgaaaggaatgaaaagtaaagtaaacacaaggtaccgtctagtgtctagcaccactggctgccgaatggacctaaccaatctgcaatgacccattgaacgctgattggttgaatatccattcacccattatttatataaccctttcctcctgcacaaatttaggtgtatgttgtgaaaaggccaggagaaggacaatttactcgtatttccaatgggtgtttactttccacacagctattgcaaatgatgattggtcgtcccttctcatatgtaggtcccgctgaaatctcggcggacattgagaaaggaccggggaaggtcaatatattcgtatttccaatggatgtttaccttccactcgcaaatgatgattggtcgatgggcatttcccttttcatttgtagcttccgcagaaatgttgaacgatgattggatgaaagagtagaatggtcttatgactaatattgttggtcctttctgcataaaattgtgaaacaataattctgtttatatgtcttaatagtttccggtataaaaaagaattgaatatgctatgaattcattttattattggaaataataacaaaaagtattttagcaaaataaataaaataaaatg

SEQ ID NO: 98406 - DNA, 85 bp, Heterodera glycines
  Promoter: Source sequence=SeqID_8421; Location=116..200; Strand=+; Gene=SeqID_68001
tcccattaattccattcacatttttttgataatttttttttcagttcacttcttcaattttctctgattaccaattgaaaaaatg

SEQ ID NO: 98407 - DNA, 109 bp, Heterodera glycines
  Promoter: Source sequence=SeqID_7367; Location=4188..4296; Strand=+; Gene=SeqID_64627
agttgaattttgggaattttctgaaaaaattaccgtattagtgaaaattttgatccgtggcgaccgaaacaccggcaaaacttccctttggagtcggttgcagggaatg

SEQ ID NO: 98408 - DNA, 949 bp, Heterodera glycines
  Promoter: Source sequence=SeqID_20297; Location=716..1664; Strand=+; Gene=SeqID_85100
ttttttggcattcacgaaactgaaacaattcaattttgcaattaattaagcacaacaattttattacttatattaattataaaattaaaaaaacaaaaattgctgttaaataaacatttaaataaaataagttaataattaattcaaaaattgcaatttagagaagaatttttgggcaaattttgtaaatcaagggggagtaaaattttaaatttcggtctaaaatttgcgattgacaaatggtgggtgcacttcatttccccctcgaaaaagtttttttttaattttcaaatttagaaatttcacaaaagaaaatatttttaaaaaatgttagtaagaaaagttcaaaaaatttttgaaaaaatttggtagtgttcatcaaaaaaatcgcagaaaagtttcaaaaaatttttttcttgaaattttcttactaacaataagtttcttaagaattttttcccggcaaaacccaccaatttttgtcggatgcgctgtcgctgctccaacaattgctccaacgcgcaaattgtgccgttcaattcggccaacactccctcgagcgtcggcggaggcaataaaatgctaaaaataaatttacatttaggcattatgaaaaattggttagaaaatatgcaaaaaatattgtggaaaaacaatgaaaaccaatacatttcacgcgaattccgaaatttttgaaaaatttaaaataaaaaatgaattatttttaatatttttcgggaaggaaataaactgttcctataaataggtgtctaaaaatcggtgcactacgtttcccgcgtcgaaaaattcaaaaaaatttttactatcttagaaattttcaagaaaaaatcttattgttagagcttttttataagaaaactctaagaaaatgaatttcgaaattttttttcttagttttcttaagatttttcgtttcttcgaggggatg

SEQ ID NO: 98409 - DNA, 1003 bp, Heterodera glycines
  Promoter: Source sequence=SeqID_2048; Location=4133..5135; Strand=-; Gene=SeqID_77504
atgcatttgtcaattcggaatttaaatcaaaatttcagctttccaacatgcttattttggccctcgttttgccataccaattttggccctcctattattatgccaattttggctgaaagacagatacaataatgaaagagtggggaaatggagaggaagagaaaaacacaaaagcaaaacgaaaataatgcaaattctcgggggaacaccacccgaatagaacaaactttgtttaaaaaaaatcaattaaaaaagtcactttttatatagattctcggcgcagccacctccgcttgaatctcgagttttaaaatcgagattgacaaatttacaaatttgaattttttaaatttcattgatgtttctgaaccttccaaaaatattcaattgacgcttttttactatatagatcttttatacaataattcttaaaatgttaccgaattatattttttataaattcggacgaattttacactgacgtatttttcggtaacgaattcgcgtgatatttaattactaattctttgccaatttattattgagagatgcttcttccttgctatatttttttctaatccttctcctgcctcaaaacaatttaatgccaatcaatcattttatgttgccaatacagtcaatttaatgaattgaattttggcatttccgtcggaattccgtggcgctctccttggaagtgtatacggccactaaaactgtgctcataaataagatgattacagctaatagcaaattatttttatatactgccttttttaatttattttttagtttatgaatgttttaacgtattttagcaaaaaaaaaaattctctataatggttaccattcctcgtcgaaaagcaattcaacttttatttgttattattttatttaaatttacgcttaaaccccggtttaataaataaaggtcatttcatattaagcatcattaaaaattctccaaattttcgtatttttagcttggtttaatgcttctatg

SEQ ID NO: 98410 - DNA, 532 bp, Heterodera glycines
  Promoter: Source sequence=SeqID_24790; Location=204..735; Strand=+; Gene=SeqID_55537
tgtccggaatcccgttaaaagtctcaacgccctccccgattaatcctaaaatactatcattcatctcaccataacaataaagaattttttcaggcgatggttcaattagattcttatgatgctttaaaaaccgtaatagccaacgggtcttaccactcccagtagcccccgagagaattagagtgaacggaccgcgaaacacttttaatgcatcttatttatttgacctatttatattttcatagggaacatgtttcgcgcatttggggcatagccagaaacacttaattttatgtggacagttcattttttcagtttaattttattttcggttgctatttatagaagggttatataaagggagtgaaaggacaatttgattggtacattgtatcaaaatgcaaaacccgataatcgtaaatataattgctctcgctaatctcggtaccggaattaaactaaactctctgacgatcaccgaatgcgaatttaagtataaccctagaaaattcaatgccgcagttatataatg

SEQ ID NO: 98411 - DNA, 1003 bp, Heterodera glycines
  Promoter: Source sequence=SeqID_14466; Location=64..1066; Strand=+; Gene=SeqID_78510
cattttttcttttccctcacaaatttttttacgccgctcaatgaattatgtacggacaacagagatcaaaaccaattcgccgtaatcgtatcgactaattcattcattatacaattaaataaattgtgaattgtattttttaacgttagaaattttggtggattttctacgtgttataagttttaaaaagtgaataagtaagttattatggatgagagaatttttacgtacaaaaaatttattttatgaaatataaggaaaaaatttaaaaaaaaagaggagacttttttgctatttaatgaactttttctgcaaagtttttttttcaaaatttacaattagcacgatacaaaaagtaattattatgcgtaagacattacttaaatatatttaaaattttgaattaaaaaatattttcagaaaaacatcttgcccaaaaaattaaaaacaaaaaatttgacatttttaagatattttcaaaaattaaaacaaataccaaaaatggctaaatttggtactaaaaaaatttggcccagcgaattttttaggaatatcaaaaatacggttttttgcattttgttctgattttgaaaatttctgctttgaactatgtatgagctataaacttctcactttttgttatttttgagtttattttattttggctttttgagaaatttccttaaaatggaaataaagtaaaatttacccttaacaaataagagacttgaacaaaagtcttttgaataaaaagagcattttaatttaaatttaggttaatttgaatactttcaaataaaaatctaaaatttttaataaaaataattttatattttcacgaaaagcatacattgaggcaccaaattgattgaaatgcaatccatcttttttaaacgtgtcataattcttttcttaatttcctttctaataaacaacatttatatacattctttaggtttaattaaataatttattattatataattttatttattcagttatg

SEQ ID NO: 98412 - DNA, 379 bp, Heterodera glycines
  Promoter: Source sequence=SeqID_3910; Location=1..379; Strand=+; Gene= SeqID_52391
tatttaagtaatttcgtttacaattgaaatatttaagtttttacttgttttgttacctaaaaagcgttaataaaattttttattgcctattagaggattttgtgcctttttaattgcctatttcgcgattttttgtgcctaaaaaaggaagccctaatgattgtgcagcgaatattttgaataataaattattaaatttaaataaaataattattttggcttttaatttgtcacttgcacttttttgtccattctcctttttccttttgctttcggcttcctttttatcttgtgttaggctttttgcttcttttccaggtaatttttcaactttgtgtttcctttttactgtcattttacagaaatttcatttggcatg

SEQ ID NO: 98413 - DNA, 114 bp, Heterodera glycines
  Promoter: Source sequence=SeqID_16487; Location=1..114; Strand=+; Gene=SeqID_80889
gagcagggcatcctcctgacgggtcatttcctccactcggtcggcatttgcgacgatgtcggccttaaaaataaatatttaaaaaatataacattttttgagattttagaaatg

SEQ ID NO: 98414 - DNA, 200 bp, Heterodera glycines
  Promoter: Source sequence=SeqID_32669; Location=1..200; Strand=+; Gene=SeqID_62953
tctcattcttctccatccctccccattttccatcctctatcattcactgctttcctctccgctttcccaactcggtcactctttccctcccttacccccgttttttttatttaggtatataaaaaatattttaaattattttatattttaaattaattaatatttatttctttattttcaaagtgtaaatgccaaaaatg

SEQ ID NO: 98415 - DNA, 586 bp, Heterodera glycines
  Promoter: Source sequence=SeqID_11433; Location=1..586; Strand=+; Gene=SeqID_74828
cttttggcgtgggtttttttgttttagcacatattttcttccctgagaaattttgaatttttacaattccttttttttgactatcaaattccaggcaaaatattcccgttttgcatgattttttcaatttaaggtaaatttgattttagcaaagaaaattccgaaaataattacatctttgagagcgaaaaaaatttacgtcaaaaagcgttataatgttttttattagctttatgctaacgaaattgataaaaaataagactgttttgaaaaattcacttatttttaagcagttgttctgtaaatattttgcttataaaattcgtaatttattttatttcttgagcaaatttttgttttttaaaattgatttattttagaaagaaatgaatttaaaaatttttaatagttttaaattccctaactttagaatgttttcaaccttcttttcgtcttttttcacgatttttcacccttatttacggtcttaagttggacttttttcaccctttaaatccgatccctaatcataaggtgaacatgtctgatgataattttacacctttagagttgaaaaataaacatg

SEQ ID NO: 98416 - DNA, 1003 bp, Heterodera glycines
  Promoter: Source sequence=SeqID_820; Location=6069..7071; Strand=+; Gene=SeqID_62031
tttttgctttgggatagttaaatgagcaaattggttttgacttttttaaagcattttgccaaatttggcatgaaaaaattaatagcatttatcaagcaatttttgaaaatttagtgaaattctatttatggtgctccatatttttttaaattttttaaatctaaacacgtgaagaacaatttttataataaaattaagcaaaattattaacccattttggcacatattctcatttatccacttttttaaaaccttttctcaattttttaagcctaatttgcccttttcaagtcttaaataattagatatttctaataatcaaaatgaatttaaatatgttcaattttttgtgttaatttcggaattttatatttttaagcagaatttatatatttttccgccttttcatggtaaattttaaagaaatgagcatccctaattattggcactattaaaattatatttttcattttttttttttgtaaattttgaattcttatatatttttaattggatttacggtttacctcagttgggccccggcacgtttgggcccagaatgttttagactataaattctttctttgtcaaccaaatccaacaatcttaggtatcattcgagagcccttcacatgccctattagcatgcaaaattccaaaaaatttcgtcaattttgaacaaacttatgaccaaaagtacatcagaaaccagtttttcagtcattttaggccataagtttgttcaaaattgacggagatttacgagattttgcaggcttatagaggacactttgggatatcgaatgatatcaataacattggatttggttgacaaacaaaaaagttacagccaaaaacatggtggggggcccaaacgtgccggggctcaactgagcgagtccggtagatttaatatttttctcccttttcatagaaaaatttaagaaaattcgtatccataattattggcactgttgctcgccgcgcccctccccagaaaatg

SEQ ID NO: 98417 - DNA, 298 bp, Heterodera glycines
  Promoter: Source sequence=SeqID_17610; Location=2689..2986; Strand=-; Gene=SeqID_82121
aaaaaaatctcgcacaatccgaaagaagcaaagaaagaaatggaaaaagcgatgtaaataattaatctaaatttcaatttccatgaaatcattttgctttttcgttttcagcttcatctctgtcgattgttggctcaaagtgttcgattttctgtcgccctttcagctttgcctcgaaattgcgctgatcagtcaccgatttgactatttcgttgatgaacatttcaaaacccgcaaatggaaattggacaaattgtaaattcgaagcaaaatcggagacaatggcgcaaaggaaatg

SEQ ID NO: 98418 - DNA, 1003 bp, Heterodera glycines
  Promoter: Source sequence=SeqID_752; Location=500..1502; Strand=-; Gene=SeqID_60472
cgaaaagggaagagagttgtgaaactataaggaaaagtctaatgctattgtttcatagtgaaaagagatgaatatgcaacgaaaaccggtgaaatgagaatgaaaaggaatgatgatacaagggggatagatgaattatgtgttagtatgtggtcaaacaggcaaatgaataggtaaaactctgtgataagtcgtgaaaagcaaatgtatatggtgaaaagtgaaaaggtaaaagcaaaaatgttcactgataaatagtgaaagttggtgaaacgcagtaggcgacaagcgaaatggttagtggtaagtggtgaaaagaggtgaaaaacaatatgcgacaggtgaatgtcctgtggtaagtggtgaaaagaggtgaaaaaaacaatatgcgacaggtgaaatgtcctgtggtaagtggtgaaaagaggtgaaaaaacatttggaaataggtgaaaacaggtgaaaaaccaatatgcgacatgtgaatgtcctgtggtaagtggtgaaaagaggtgaaaaacatttggaaataggtgaaaacaggtgaaaaaccaatatgcgacatgtgaatgtcctgtggtaagtggtgaaaagaggtgaaaaaacaatatgcaacatgtgaatgtcctgtggtaagtggtgaaaagaggtgaaaaaacaatatgcgacaggtgaaatgtcctgtggtaagtggtgaaaagaggtgaaaaacaattggcaacaggtgattttcaattttaagtggtgaaaagatgtgaaaagtctaagaacattgatgaaattctagagaagtgatgaaaagaggtgaaactaaaaatggaaaagtcaaatatttcaagaacagaaaatacaacgaacgacgctgattttcgtgttaagtgatgaaaggcaaaacagaacagtagttgagatagaagctattttaaagtggtaaaaaggcaaagaaatgttcgaatatgtaaaaatataataaaagaatttaagagatttacatttaaaaatg

SEQ ID NO: 98419 - DNA, 93 bp, Heterodera glycines
  Promoter: Source sequence=SeqID_2465; Location=2854..2946; Strand=-; Gene=SeqID_79846
aaaaatgattttttgaaaatttttcgggtttgggctcaaaaaggctaatttagctgctgggggcgtttctaatagagggttttttgaaaaatg

SEQ ID NO: 98420 - DNA, 296 bp, Heterodera glycines
  misc_feature (29)..(29): n is a, c, g, or t
  Promoter: Source sequence=SeqID_27253; Location=1294..1589; Strand=-; Gene=SeqID_57942
gccgtgccattccgtgacacttccatgcntttattatgcgccttaatggtcctgccacctttcgctccctaattaggccattgtttgctttccttttctcccctccttttcccatgcactccctttgtgccggaaaaacaactttttagtttgtactcttacagaaaaacaaaaacttttctcggtttttacaatatttttcagtgtgtcccgaaatcaccgtgaaggaatcatctgtttttaagcagcaaaagttattttagcatgaattttttcagatgttaaagtgaactatg

SEQ ID NO: 98421 - DNA, 127 bp, Heterodera glycines
  Promoter: Source sequence=SeqID_44584; Location=1..127; Strand=+; Gene=SeqID_72059
cgacgcatcaaacaggtggcgaaatgaaaactctctgatcagtcaatgctttaaatgttttgatcaatttcaggaactggcggagctgaagcaggaaccgatcacgggttgcaccgcggcaccgatg

SEQ ID NO: 98422 - DNA, 1003 bp, Heterodera glycines
  Promoter: Source sequence=SeqID_6985; Location=354..1356; Strand=-; Gene=SeqID_63502
gtgaaaagagcggagaatcgttaagaaaatgaaacactcatagtagaaaggactttggtccattagtcaagcaattaggtaattttattttttttaaagaaatcttaaaccatacttttattgatgatgagccatgatttattttgcgattaagcgcctgaaaatccgtgccttttttatgacaaaataaaactatgtttacaacattaaaacaaagttttgtttctagacatccctgttgatagaataaattaatccacgtcagttttcacaccgactttcgggtattcagtcgaaatctaattatttatgtatcaataatttaatttcctatgacttcggtcaatctgtcacgttttgatgcttgattattttttgattcattccaactcaaaagtaaatcaaagtttgaggacaaacttaaggaagggtggacgtgtaaagcgcaattaatcacatccgttttatctctttcccaagcacatatccccgctctcttccattccattttccgttccataagtccaactatttaatcgggagcattctctcgataaggagtcagttgagtgggcagttaatcggcgagcgagagccgagagcaaagcgcggcggaattattattttatgtgattggccaatatttatcttatattttactccttctcgcccatccccgcacgcgtattcgatctagtgggcgcccaagggattaccaatttggggaggccatttatccagggcccggattttggcttattccgttttccccccaaatccaatcctcgttctcactcgttcccttcctcatattctgcggctggacatcagcaccttcactctatatctcctcctcttatttccacacactctttccgtctttttttctctcttcaactgccccattactctctctctctctctctctttgccattcattgctttttcggcattttcttgccttgttgcatcatcaggtggcccaccgcgtcggttggcaatg

SEQ ID NO: 98423 - DNA, 1003 bp, Heterodera glycines
  Promoter: Source sequence=SeqID_11701; Location=1696..2698; Strand=-; Gene=SeqID_75181
aatatttttttacggtcgtttgatgagaaaataaagtacgaaaagcgcaacgtcacggtcacgattcacggtaccaatacggttaattccgtgaaaaatttaaactggataaaattgaaaatttacgaattacatattatttttctagagaaatttggtcagtttttgggcaaagtttgctaagaaacagagcaaaattttcaaaaatttccccagcggcgcctatctgcaccgccggcccccttccctattcctgaaacttttttgagcaaagccaactaccaatattgtgcaaaaacaaatagcacagtttcaaggatgaccccatttaaataaaaaactcattaaattttttttaaaaattcgctcaaaataaaattattttaggcagaatcagttaacaaatcacattttcaaaaattttccactaaaacgcctatttttctttaaaaattgggtaattacatatgtctcacaaaaccattttaaaaaggtcggaatcgatatactaatttgcaaattttttcatcgttttttgcctttttaaattgattaatgttgcgaaattggctcattttacgtacaaaatctgtgcataaatgaactcaaataaaattcgccgacagagaaaaattaattcaaaaaattcacggtcacggtcacgaaaaccgtgaatttcacgagttttttggataacggtcacggttcacgggttttttcaggcacggcgcacctctataaaatgccattacttttattgccatttgcctcaattattattaaatttgcctcaattgatattatatttaaacatttaaaaaattttcaatttttaatttattaaaattttcatttttcgtttcgggggcgggggaattccctccccattcccccacctctggctacgggcctgaatgaaagtaaacaaattagagtccgataatgaacaaacaaacaaaaatgaatattattttgtaatattacagctcctataataaaaatg

SEQ ID NO: 98424 - DNA, 111 bp, Heterodera glycines
  Promoter: Source sequence=SeqID_5426; Location=2140..2250; Strand=-; Gene=SeqID_57982
cgtaattaaacggattttatttttgcttaattgtttatttttgtaaatttattttcaacattagctgtatttttctgctgctttcatttcatcaacacacgcttccctatg

SEQ ID NO: 98425 - DNA, 237 bp, Heterodera glycines
  Promoter: Source sequence=SeqID_33231; Location=751..987; Strand=-; Gene=SeqID_63358
tttattttcttccgtttatcccacagatgcggattttcttccaccactttcttccaattaatttcgcctttatggtgcaaaatgtcaatgaaaattctattgcattctgtgcaaaaaaaaggaaaagaaaattaattaaaaaaaagaaaaaaatgcaaatgttttgactctgaacaccaaataatttgtttaattgtgaaccgctggaaaacgatcgtaaggtgaaagttaaaaatg

SEQ ID NO: 98426 - DNA, 809 bp, Heterodera glycines
  Promoter: Source sequence=SeqID_4830; Location=643..1451; Strand=-; Gene=SeqID_55879
aaaaaaaaatgggattttggggttcgaaaagaaatatggaaaataataatatttttattttaaaaatatatctataaaatttgcattcgaaaacaaataaacaaatatgatgaaaccaaaattatctaatcatttaaaataataaattgcttcattattcgtcgctcgttgaaaagtcgtctgatttgaatgttattaaaaacaaaaggggtaggggggctttggtttgaattttttttttttttttttgtaaaattatttctactaaagaaaatttgttcttgaggggttttgggatccctgatcacgaatctcacatcagttttaaccaataccgacttccgaacctaaataaattttgcacatcaacagagtccctccccccttagggttttttaaaaaattcgaaatctacgattttaattaacatagcgctcattattcaaatatgaattcgaaaaagaatttaaaaaaagtaaataatttaaattttgtataaaattaaataaaattgtgtaaaaataaaatattgaaataaggaaatgaatattgaatttgcaaaaacaaaaaaaaatcaatcaaattttgttggcattaattttgtcattaaattaatacaatgaataaaaataatgctactttaaatcacaatgattcaattatttttatttgttatattaaaatttttcatttcattcgaaattattttttttacaataaaaaaatttaataaatcattttactttatataattttaattttttagataatttcgttgcaataattgtaatttcagagacataaaaatg

SEQ ID NO: 98427 - DNA, 52 bp, Heterodera glycines
  Promoter: Source sequence=SeqID_39856; Location=755..806; Strand=-; Gene=SeqID_68335
gggggcactgatcggagaaataaatttctccgatcagtgccttttgtgcatg

SEQ ID NO: 98428 - DNA, 637 bp, Heterodera glycines
  Promoter: Source sequence=SeqID_14878; Location=1..637; Strand=+; Gene=SeqID_79037
ttatgacattttggaattatggcaaaaaagttaatttaaaacttttaataaaaaatgaaaaataaaatttaggaaaaaatatttttgacgaaaatattggccattttaatgcgcaagtgatttgcataatgctgaccaaagtgtttctgttattccctggcaatgtttctgtgccatttttgttggaaaagtttttcctaatttattcaatttggtaatttgaaaagatcggataaaaatatatttaattaaataatattttattgaataattttttaacataaattattaaaatatttctaatggtttatttaaaactattgatttatttgccatttttaaatttgaatatatttatatttattaattttgaagatctatttttagacggtaaatcgaatataatttacaatttttaactaaattgtattaatattggccgaatggaaattaaatatgccaaaagttcttagtatttttggtggataattttaaaattaaattttttaaaaaagaaaacctctttcttcctgaaaatttgccaaaatttttgataaaaatttggtgctaaaacaatttaatttaagatactgatgaggataaagtgctaagaattttggacgagcttgataaaatg

SEQ ID NO: 98429 - DNA, 548 bp, Heterodera glycines
  misc_feature (34)..(34): n is a, c, g, or t
  misc_feature (157)..(157): n is a, c, g, or t
  Promoter: Source sequence=SeqID_310; Location=1..548; Strand=+; Gene =SeqID_81806
aaattccgtcacaaaaaagggtcatcaaattacngcaataaataaacaaaatgccaaacaaaaaaattttgtttgaaaagaactattatgcaatctatatataatttttgcctttggtgtcacaagtaaacaaacataatacataaaacgtggtctntcatcacttttctttgttctgtttttatgttatttggtagtaattgcacttttggttttgcttttctcttttgtttaattctattattttttccttaaatatttaatattattatctgtctttcacaattatttaatactatttttctttttataatgttaggaattttttgtcaaattgatgatatatgctattcgaattttttgatactttgaaggataaaagaattcatgttcaaagagagaacatttatttttgatcccaaactacttaatcgatttcttcctttcgtaattatttgttttcttttaacatcattttttttcactatttcacacattttaattatttcatacaccaaaattgatttagattgcttaattgtctaatg

SEQ ID NO: 98430 - DNA, 280 bp, Heterodera glycines
  Promoter: Source sequence=SeqID_4064; Location=478..757; Strand=+; Gene=SeqID_53034
acatggcattttgccctctcattgtcaggtggacatttcgcaagagaatgtgccgcccgaggacactttcaaccgacccgacttcctttggctcgatgtttctttggtctgtctgagcattccgcgcattgtaacgtgcgaacaaaggcgaaatgagttggaaaaggtcggtcggatggtcactttgtgggccgattcattcatttttcattgccttcctccacagacttttctcaaattttggcgccgttcttccgccgaccctggcaaattgcaaatg

SEQ ID NO: 98431 - DNA, 422 bp, Heterodera glycines
  Promoter: Source sequence=SeqID_15972; Location=914..1335; Strand=-; Gene=SeqID_80325
cgttatttaaatccgtgtgcaaacgtcctgaattttaaaagattttcaaaattcaaaataatatattaacatacccttgcacttgtctgacgggccatgaaactcacatcgccaaaatatcttaagtcaatctgcgctcaattgttcgaaaacatagagtgcgccgtcatgttctaacttaactttgtttctttttgttttaattttttgctgctggtccatattatataattgaaagaaccttaatttagtttataaactcacttaattataaaataaatattcgttagaaaaaagagtgaaacaaattttcgttaaataaatgtgagttatgaattctcttttatatgcaaccacgcgaaaacggccacgcgaaaactgccacgcgaaaacggccacgcgaaaacggccacgcgaaaatg

SEQ ID NO: 98432 - DNA, 208 bp, Heterodera glycines
  Promoter: Source sequence=SeqID_43445; Location=807..1014; Strand=-; Gene=SeqID_71110
acaagtgggaggaagatacaaattattctgattacatttcagtgtctaattattataagatcatcgcatttgtattttgccaactttgttttaacaaaaataaattaattgtcaatgattttgaagtttcaatatgcaagctccattacaatgtttttaacaaaatttattaattgctggttaatagccttacattatattagaaatg

SEQ ID NO: 98433 - DNA, 116 bp, Heterodera glycines
  Promoter: Source sequence=SeqID_12957; Location=1..116; Strand=+; Gene=SeqID_76714
cgtaaatatattgctctcgctaatctcggtaccggaactaaactaaactctctgacgatcaccgaatgcgaatttaagtataaccctagaaaattcaatgccgcagttatataatg

SEQ ID NO: 98434 - DNA, 110 bp, Heterodera glycines
  Promoter: Source sequence=SeqID_26599; Location=1197..1306; Strand=+; Gene=SeqID_57337
aataattattgtttaaaaatgcattaatttgatttaatttactcattttcgctttgttatttgaccccgtggtggtcactgatgttgagcctgacgcgttcaaagcaatg

SEQ ID NO: 98435 - DNA, 266 bp, Heterodera glycines
  Promoter: Source sequence=SeqID_7350; Location=1..266; Strand=+; Gene= SeqID_64563
tttcgttactaatagaatcggatgattttttgtgtaatatttcatggttacttgcgcaaaagaacaaaaagttttgcaagtttgaaggtcgttcactaatttcatttgccgaatttgggctaaattagtgtttcgtcacacattacaatgcaaaaagtgactatttaagaaactctaaattttcattaccaatataaaattttgacttcaaacattagtttatgctatttatttttgatttaacatttttttcccattaagaaatg

SEQ ID NO: 98436 - DNA, 238 bp, Heterodera glycines
  Promoter: Source sequence=SeqID_43864; Location=895..1132; Strand=-; Gene=SeqID_71444
tagcgaaacagcccataaaaaagattagcaaaatttttcaaagatacaacataagaataaaaaaaatagttcaaagaacgttgttttctttttaataatggtttcttccataaaataaaaaataaaataaaattttttttaaatattagtaataatgtttctaatttcaatatttgagaattagcttataattttaaattgtttattaaattgacccaacaatccatttcagaatatg

SEQ ID NO: 98437 - DNA, 1003 bp, Heterodera glycines
  Promoter: Source sequence=SeqID_20852; Location=836..1838; Strand=-; Gene=SeqID_51436
aagcagcacaaggcctaattagccgggcatcaaagggatcaattacaggggattacggtatattttctcgcgcctgtcattaacattctattcattcatttatttgcctgccacctgcgggcaaatactaaaaccaaattaataacaaataataataatttttgtttcgtcaccactacatgacaccaaaaatgttatgcacaaatgcataaataataagttggttggtgttgttgtttttttgagagcaatttgttagccatgattcttttgataactattttaattttttttacagttaaataaaaggaaattgtgtttttttttaatatgaaaaccttaattagcgtagcgtttgaactattaaaactcttaattagcagttcattttttccataagccagctctgtttcctaattaggccttttgtattaattcaaataccaaggggaatgaattttcggcatttttatgcctatcccagcctcaataatcgcaccccaacgagttggtgggattaatttaaataaaaattgaaaaacttgcttaaaagaattaatcacaaaattaaaatttttctttattcttagttcttcttctgatcaccctttccgccattctttgatcaaacagtgatccaattaatagcttaattagggggcaaatttgtgggaacaataaactcacatattcgccgggatttacctatctgtggttgtgttcaatcagtgaacgcacacatccgctctctcctctaaatccacatccgacccaattaaaatctttcactgatcgatgatgctgcctgcgcattcaatcatcatccatccgttacagatgatggtgatggagctgctggtcgataatcatcacaaacattttcttgatcactactactgatcagagccccgccttccctccggctgatctgatcatttgcgatcacttgaccgattccaattattcttcgcttcaacttttctgctctgatcagtagctgatg

SEQ ID NO: 98438 - DNA, 534 bp, Heterodera glycines
  Promoter: Source sequence=SeqID_27390; Location=1516..2049; Strand=-; Gene=SeqID_46041
gacagagcaccggcagagaaagcagagcaggggatcatcgtttatttttctcttttaattattttttttattaatcttttttttgaatttttttttaaatcattttttgctttgttttttttatttatttttattttaagaagaatttatattttatcttcttcccccccccccctccctttcccctctttttcgtcgtgttcgctttcgcccggcggcggtgttcgtctccccccccccccccgcccaaattagggggggggggagcaacaggtttatggggaagagccctcctccccgatcccccgtgttattttgcggggattgtcaacgactaggcaaaccgtcgagaagaaaaaatttgtgagggaacagcggatcacagcggaggaagagaagaaacatgaaggggggggggaggtcattagagtcaatcagcaaattgcgtcattagtttaagtcatttgtcagtcacatttttggtgtatttgagccgaaaatgggatgttttgatatgtgaaacattgaaatatg

SEQ ID NO: 98439 - DNA, 273 bp, Heterodera glycines
  Promoter: Source sequence=SeqID_9320; Location=403..675; Strand=-; Gene=SeqID_70986
tggtccttctctccgcccttaaaattgtcccaatttgcccattaccctcagattctcttcgcttctttggtggccgttggccttgtctatgcgcgccgtcgttacgtggccaaatacggcggagacgttcgtccgccccattttcttgggggtcctttttcggcacttttctccactgatcggtgccattctccgctctttaaggttcttccgaattcgctcgctcccatcagatgggttacagcgaaaacggtggcaatatttttgaggatg

SEQ ID NO: 98440 - DNA, 310 bp, Heterodera glycines
  Promoter: Source sequence=SeqID_4437; Location=1705..2014; Strand=+; Gene=SeqID_54458
tttttgttattctgtgtattggaaccattttttgtttcataaatgcgagtttcgactttctgatccgggttcggggtccaacctaagtagaaatggatgtcagatttaagttccacaactcttaaaaccaataaaataagcacttctcgaaaaaacgttggctttttttgaaaaaggacgattagcatttgtagacttcaattttaccgtgcgccttttggcttttcacgtggcacctaaactgtcaatgatcatttaaagcctacaatttgatcaaatttcgatttaagcggaattattattttcaatg

SEQ ID NO: 98441 - DNA, 473 bp, Heterodera glycines
  Promoter: Source sequence=SeqID_29496; Location=149..621; Strand=+; Gene=SeqID_59988
tgtaagtaaaaatcgtaactacgctcaaaaagcttctcaaccaattttagcgcatccaattccttctacaatcgcctttatacatcccattatgaacgctaaaattatcagagtgccgaaaatcgcatttgatctaagcctagaaaaaatggtctaagtaaaaatcgtaattacgctcaaaaagcttctcaatcaattttagcgcttccaattccttctacaatcgcctttatacatcccattatgagcgctaaaattatcagagtgccgaaaatcgcatgtgatctaagcctagcaaaaaatggtgtaagtaaaaatcgtaattacgctcaaaaagcttctcaaacaattttagcgcatccaattccttctacaatcgcctttatacatcccattatgaacgctaaaattatcagagtgccgaaaatcgcatgtgatctaagcctagaaaaaaatggtcaagtaaaaatatg

SEQ ID NO: 98442 - DNA, 172 bp, Heterodera glycines
  Promoter: Source sequence=SeqID_8831; Location=1645..1816; Strand=-; Gene=SeqID_46650
ggtctgttttggagcaaaacccaaaaattcggaaagcaatgacacaacatttttaggcctcgataaattgtcggaccgctgtgccgagtacaaaaagggcggctgtgactttgccaagtggcgttgtgtgctgaacatcggtgcccacaaaccgtcccatttggcattgatg

SEQ ID NO: 98443 - DNA, 82 bp, Heterodera glycines
  Promoter: Source sequence=SeqID_4419; Location=4051..4132; Strand=-; Gene=SeqID_54381
acaacaacagacaacctcctccctttgctgcaatgacccgtccaagcagtgcggcaacaatgccgtgactggaacatctatg

SEQ ID NO: 98444 - DNA, 480 bp, Heterodera glycines
  Promoter: Source sequence=SeqID_3201; Location=3226..3705; Strand=-; Gene=SeqID_83659
agtaaatgtcatttgaaaatttgtcgactgatcattaacatatttagtctaaataaataaatttaaaaaaatattttatcgtagaatgaattaaatttttatgataagcttaaaaattataccttgaaaaaaattaaaaaattccaaaaaataaaaaatcgtcattaacttaattaatgaagacaaattttagggagggatttggcacggattagcgaccatcaattagcaacaaaaagtgccatcaaagaaaatccaaatcattttcgtcaacgaaacgaagatttatacataaagccagttgaaagttcaacattattgcttgtaataattaataaaataaattaatagcctaattaaattgttaagcgacaaaaatatgtggatgcaattaatcgcggattattgtcaaaggatgaatttggcgatttcattcggcatgaaaaaattgcttcatcatgggatattcagaatcggatg

SEQ ID NO: 98445 - DNA, 1003 bp, Heterodera glycines
  Promoter: Source sequence=SeqID_12603; Location=351..1353; Strand=+; Gene=SeqID_76267
aattaggataaataaatgtgtctgaatgactttttgtaaaatttttaatgatcgcataaaatccaattaattattaaaaaaacaaaattattttcatcactttttatggctaatttgtaagcggtctcgggccctgtaattttaaccgggctaaaacgggcataaatttcgccagtgaaaatgccccaattaaaatggtgtaaaactgcaaaatttttccgccggccccaaagggtcgggttaaaattggaatttttagggaattaaatattattttaaatacattattacattaatataaaataattaaataaattattttacctcgaaaaatgcatatataaattattcaatcggcttaatttaatgaatataaacataaaaatgctttttttctgctttcacagcagtgccatcgtcaaaacaattttaaataagcttatatacatgtttattgattaattaattttaaattaaaattatcattttttatttttttaggaaattaattgacgtaatcgtgccaggcatttgcatttaatcggcctaacatttaattaaaaatggataaattaaaaaaaattaaaaattagagacaaattttgtctgcgtcaatgacttcaatgacaaaacaacatttttttatgtaaacatacatatcagggatgtgccgagccagacaaaatccgattccgattaaatcgccgattccgattatggccaaaaatccgatacggttttaaaaccgattacgattatggcccaaaatccgattaattgcgattccgattacgattccgatttttttaaaataattttttcccaaaaattttattcataatcaaaatcataaaaataaaagtttgtccacattctgaggcaataaacgttttctcagatctgtcacaatcaacccagcggtggagaaaagccgttcgctttcagtcgatgtagctggggctgagaaatatttttttgatagcttagattcggaaacgaaatg

SEQ ID NO: 98446 - DNA, 163 bp, Heterodera glycines
  Promoter: Source sequence=SeqID_13199; Location=452..614; Strand=-; Gene=SeqID_77027
ttttcattaaaactttaacattcaaattccatggatgaaaatatcctatttacgaccgtttaggcgccgtttcgtgtcgcctaaacgcttaatgcataaaattatgcacttaaaattttatcagcttttattctctttctcattttaacagcagcaatcgatg

SEQ ID NO: 98447 - DNA, 752 bp, Heterodera glycines
  Promoter: Source sequence=SeqID_1709; Location=860..1611; Strand=-; Gene=SeqID_75438
tttgcgcgaagacaactcagggcaacccaaagttgccagggacaatttacagtgcagcggaggaaattgaaaaagtgccattttttttgggggggggattagcggaatgtttagtaattaaaccgtataatgggatgacactcaaaggccccgttttttttttttggccccgacggttttggcgccagcccaagtttttggggtataacttttttttgttgttaaccaaatccagcaatcttggtatcaatcgaaagcttaacatgtttagaagatatttctaagctattgcttcgcgattagacaattaccaaaaaagttatatcatgaaattgcaaaaaagtcgaaatttttcaagttttttcttaataactttttttagaagctaaaatttttgtttgttttttgtaaggctaatagagcttgtgaagggctttcgaatgataccaagattgttagatttggtcaacaagaaaaaaagttataataaaaaaactgatgctggcgccaaaacgtcggcgccaaaacgacccagtcccatttgcgccaatacacaaaatcagtttataattttggtcaattttttaacggcaatctttagtgcctgttttgcgatttttgtgcttaaaaatcccagccttagtcatcatatttatttgcgcactttttagaaaccaattccctccgttaacaataacaataataatactgatacaaataacaatgctaactttgtggcggcgcaaacaatg

SEQ ID NO: 98448 - DNA, 491 bp, Heterodera glycines
  Promoter: Source sequence=SeqID_20352; Location=1184..1674; Strand=-; Gene=SeqID_50870
tctcccgataagggtagaagaggaatattatagaaatatgattgcactttaataaaattcttaaaaatttttcaaaaattcaaaaattagtccgctggttttcatagtgcaatctgttaaaaatcaatccaaaaattccattttttcttgcggtggatcctatcagcactgcaagacccaaaaagctccttttttgaatagaatttcattaaagtaaatattattaataatgaggaaagaattgtgcaggaaagaattgcgcaaaaatacatttatgaaatgaattttcattaaatcaataagtaatttataaatgtttttataaaaaatgaatattaaaatatttttattcatattacaactacaaaatttaaaaaatatgcacaaaatacataaatcatcataatatttgagttggaaaagaattgttataaacgaaataaaagcaaataattcaaatggatttctaatcattcattttatgaaaaatg

SEQ ID NO: 98449 - DNA, 327 bp, Heterodera glycines
  Promoter: Source sequence=SeqID_22276; Location=1524..1850; Strand=-; Gene=SeqID_52948
gcttaaaatggtatttgagaataattgcaattttaaattatatgattttttaatgtataaaaacagtattcgcttgctttatattttttggctcggttctcatgtgtaacccggttttggtcataaatgcgaatttttaaatgatttacgactttttgtctcaattcggttccggggttcagaattaattcgacaagtctttgtaaaatccgagattagtgacccaaaaaagccacaaaaccacttttcacgattctttaattcttaaggtccatacaaaaaataaataaacttttggcacctgacaaatggaaagtcactgtaatg

SEQ ID NO: 98450 - DNA, 214 bp, Heterodera glycines
  Promoter: Source sequence=SeqID_30463; Location=1333..1546; Strand=-; Gene=SeqID_60868
tgatggagctagccggacgaaacggcaggtcacagacctattttttcatgaaaatccagtggattattgggaaaagattggcgaattacgcaccaaacaagagcagtttgaaaaggaggtaaaacaggaggagagtgaactttcggcagacattacggatgtggagaggaaaaaactactacaaagcgagcttccactcaaacggattcgtatg

SEQ ID NO: 98451 - DNA, 1003 bp, Heterodera glycines
  misc_feature (22)..(22): n is a, c, g, or t
  Promoter: Source sequence=SeqID_10918; Location=63..1065; Strand=+; Gene=SeqID_74221
attagaggaaagagctgctttntaaaaaagattcatttatggtcggtcatatgttcatctacatcaatttaattgttttgtttaattgtaaattataaaattaaattaagttttaaataatttatgttatttggaagcagaaatctgaaaaaaaattcttgttatcttttcgatagctcataattttgaaataataatttaaatgtttggtcattattcttcttgttataacaatttaaaagtggtgaaatttttaaaaattacatatccaaatagagaattagagctattttctaatcatttggcggattataaaaagcccaccagaaacagcataacattttctaccgaatttcttttcagttcattcgccgaccgggaaaagagttgacaaattagcatatttctttattcatttttaagctttagcttatcaaacacaaccaaatgcacaaaatgcaatgaaaaagacaaaatgaatggaaatgtgtgaagattggcagaaaagggaaaggacaacaaatcggacaaataaatcataaaatgaaaaaatgtaaaattaataaaataaaaaagtgaaaaaattcaaaattaaataaaaaaatatatgtataaataataaatgaaaagcaaaaggattttacgttatgaagaaggcgtttcaatgaatgttaatgaaagattttgaagaaattccggcgataaaaaagggaaaagagtgagcaatatgagagaaagttagagaagaagacagacgcgaaaagagaattgagaaaacagagaaagtaaaaagagggaaaagggtgaaaaagagagagccatggcaagaagagagaaagagagaaatcaaaaatggaggacaatggacaaaaattgacggagatggcactgccacacccaatggtcgtcgtatcaccgcacaaacgaagtttcggtgccacccgacgccgccgaaccattggaaggccaccgcaccttaaaggggggggggggtgagaagatg

SEQ ID NO: 98452 - DNA, 1003 bp, Heterodera glycines
  misc_feature (43)..(43): n is a, c, g, or t
  Promoter: Source sequence=SeqID_15362; Location=38..1040; Strand=+; Gene=SeqID_79621
gatgtgaaaatcaaatctgaatttctattaatattcgatgatntagtccaaaaatgattaattgtttgaaataattgaagaaaatttgtttgaaaattttcattaatttaatttattaaataaaaaaccaaataattttgtattattttacttgatataaattaaaatttgaatttttttttaatttttaaaatttttttgaatttttaaaatttcccggttggtcccggttcccggtttttcttgcggtcccggtcccggtcccgaaaaaaaatcgaggtcccggtcccggtcccgaaaaaaaatcgaggtcccggtcccggtcccggcttctcaggtcccggcaagtcccggtcccggttttggcaaaaattcccggtcccgtggcactctaatattaatcaatcataaataataatattcacatgaaattgtattcccggacttcctttgccatgtcatcataattacatagtccaaatgattggagccggaaattatggcaaaacattaagtctacaatttggcatataaaagtgccaaaaaatcagggaaaaaacacaaattattaatttaattaatttaaatattcatattttatattttgaagtatataaaaaatgaacttctacaattggtacatcaccgtttttctggtgatatttgctttgactggcatttgcaaatttggtaattattaaatataaattttaaatccacgaaaaataaaaaataattttattcacaggcactatcgcttcacctgttcacaatgaagaagatgaaataaaaaatgctcagccacgctttgaaattggtttgagaacaaaaaagaaattaataaaaataacaaaaaaaaaaatccaattttttatttatttaaatttaaaaaaattaagaaaattctcttttctgaaaatttaaattaattttccatttttaattaagtaataaattgcataatcaaaaaaaaaaaatattaggtgaatcatcaagcaaaatg

SEQ ID NO: 98453 - DNA, 127 bp, Heterodera glycines
  Promoter: Source sequence=SeqID_25351; Location=1..127; Strand=+; Gene=SeqID_45925
tgatcgcgacaactcttaactgcccgtcccctgaacagttcatccatgatgtgaggcgccgcaaatttttttttttggcattttttcacattgctaattgtgtttttcaacggcacaggtgagcatg

SEQ ID NO: 98454 - DNA, 130 bp, Heterodera glycines
  Promoter: Source sequence=SeqID_14296; Location=2265..2394; Strand=-; Gene=SeqID_78321
ggtgtggcgaagttttctaattgctatttattaaaccaaattaataatcaactaaagaatttcatccgtccttttatggaagccaactcaagaaaaaatttaatcatttacaggccattccaacttaatg

SEQ ID NO: 98455 - DNA, 1003 bp, Heterodera glycines
  Promoter: Source sequence=SeqID_4375; Location=2075..3077; Strand=+; Gene=SeqID_54211
ggctttttgtccactgtgttattcatttccaaaataattgttttctccccccttttgttgctctccattcttcactccgttgatcgccgcttggacctttctctgctgaccaattgatcaccacttggaccgttctccgttgaccaactgatcaccactcggacctctcttcgcctctgtccgagcatcaccaggtccggtgttcaccaatcgctgtcgccaactgatcgctgcacacaccagtcgaggaccaattgacgccgttggatcaggtcaagcacagctaactgtccaattagccggttatttaaccgctatccctcgcgtgtcaattagtcgattgtttaatcggctaacaatctgttctcaaattactatctcccaacggcctattcattcacagttccgcaggcaaccgccgcttaagtctcattccaagcggtttgcgttagtggcgacctggaccccacagggacgaccgcagctatcagttactaaccctaaagaccaaaacctattgtacggtccgacacgtccaatcatagaattttaattctttctttttgtttgctcatatttattttttataacaaccttttcggtcaagttttgaacctatttttttttgtgaaccagttttgacttcacacatttattctgattaattttgatcagtcttgatcaaatatttgtctattcatattaaattttgattgcgcatttaatatttatttttgttgagttgctgtcagttttgaacttactaattttattttttttttggggagagcgttgcttagtcagttttgactaaacaatttcaatttttgaagttcaattagtgcatttacaatttgttattcaacattttattgtttaattcatattattaaccaagggctgccgaattaccaagttgatacattttttttttacgaatcaaatcgtgactatttagtcaaattaaataaatctgaattaaacttaaaaagggatcataatg

SEQ ID NO: 98456 - DNA, 170 bp, Heterodera glycines
  misc_feature (39)..(39): n is a, c, g, or t
  misc_feature (53)..(53): n is a, c, g, or t
  misc_feature (88)..(88): n is a, c, g, or t
  misc_feature (122)..(122): n is a, c, g, or t
  Promoter: Source sequence=SeqID_26665; Location=1..170; Strand=+; Gene=SeqID_57418
aaaaacgaaaagttttcaaagcctgtaaaaaatttattnaagaaaaaacttcnaaaaatttcgacttttcgcaattttcatgcatacntgttttgataattgtctaatcgcaaagcaatacnttagaaaaagcttctaaatagattaagctttcgaacgacatcaacatg

SEQ ID NO: 98457 - DNA, 286 bp, Heterodera glycines
  Promoter: Source sequence=SeqID_32365; Location=1..286; Strand=+; Gene=SeqID_62681
ttgtcttatgattatcatcatgctgtttgactctctcacatttattttgtacctaaataatcaacaatttactgataattaatgcattaatttcctggtccatcaacggttttttgtgcaccgcaaaccctacgaatttcatcaaaatgtaaagaatctttatcaaaatcacacacaaattatttatcattttttgtctgtctgcttatcctttggcgtgcctcgccaaaaaatttttgtgtgatcgatcacaatttaatgtgtgcgtcagaaaggtgatcagatg

SEQ ID NO: 98458 - DNA, 529 bp, Heterodera glycines
  Promoter: Source sequence=SeqID_11251; Location=1174..1702; Strand=-; Gene=SeqID_74617
tcatttttaaattttttatagatttttaaatgtttgccttttaagggggcttaccaaaacttcatcgaacctggttcttccttttctctttcaaatcgccccaaattttttttacagcttaactaggcccaattaagcttatttccagaaaatctctcatgaattctcatttttaaattttttatagatttttaaatgtttggatttttttttggcttaacaaaacttcatcgaacctggttctttctattctctttcaaatcgccccaaattttttttacagcttaactaggccctattaagcttatttccagaaaatctcgcatgaattctcatttttaaattttttatagatttttaaatatttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatg

SEQ ID NO: 98459 - DNA, 1003 bp, Heterodera glycines
  Promoter: Source sequence=SeqID_8017; Location=5283..6285; Strand=-; Gene=SeqID_66703
gcaagaagcaattgatttcaattgcagtcttggagttcaggcatgcactgattgcatacctgaccattcatcaggtttagtgaactgcaattgccgttcacataaccttgaaaagttaatggaaagtccagagaggagacttccattaaacatcaaaaattaccaactcagaaatactgggagaaaagtaattgccttgacaggattcagtcctgtccaattaaaccttcaaatcgaaggtcttcaaatggctttggaacttcaccaaagcctttgcaccattttgccgttgaacatatctggctgttacagatgttcaacgggagcacaattccgttatgtgtgctcgactaattttggcaattctcttgccgaaattaaatgcgatgatggtacacatttttcaacaaaatgtgattccaatgcatccatttaccaaacaatcttggcttttgacaaagccagaattgacacaaaatgccaaacaaaatgtttggctggaaacacttcttttgttctcagcgggacattacattatgtcccgcccgaacaaatagaaaactacaatccaaatcactccgaaagagtgataaacagtcaatccagttggcctaactggaattttgattggaaggcgaccctttggtctttgattggcctccaatcatcactcatcttcataatgattatttgtgtaggcattgtttgcctaacaattttcattaaactttctcctttctatagactttggaaatttatttcctggtctataacgagaaaggggtacagtaatgtgcctacagtattggcaatactgtacttggccgggggaggatccttcggatgtggtgttgaatcacgtcctatcctctcggcagtcaaaaaattttgtgagtcacccctcgttcaggggaatgattcatctcttccattgaatggtggtataaaagggtggcggatttgccacccaaccaccactttcaaatcatccttccacggaatg

SEQ ID NO: 98460 - DNA, 892 bp, Heterodera glycines
  Promoter: Source sequence=SeqID_2110; Location=1272..2163; Strand=+; Gene=SeqID_77905
tgttagactgcaattttatgtcaattatttttgttgttttttagattatttttatcgcttttttgggactttatatatttacaattaatatctaaactttttgtaggtctccggaatgtttgtccattgcgcgctagaaaatctttgaaaattttaaataaatgcagaaactggaaatatcaaataggtaacacttttactttttttccttttattctttcaattttattttttaaaattcttttcattttgtacgattttctattaatgattattatttttgttcgtttattttttataaaattaatttattcattcgcttttttatctctttttctatcagtggaatttgcacagtttttccaatttgtcatcaccaccatttttccgctgttatcaaaaaaccatccggcaaaaatcgactctgattttgctaatgaatcatttttcatccattataatgaataaaattgtggatgcaaaaaaattatgttaattcatactaaattatcgaaaataaaaatgataaaataataaatggaaaattaaaaagatatacaatatacaaagaaatggtgtaattcgttctcggcctcgagaatcggtaaataggcgaaatgcccatgcagcttaaaagttacaaacccaattttaatcttagtcaaataacttcctaatttttgtttgccattacatagttttttccgtcttttggcacaaaatgccaatgcaagaaattctcattccacaaaacccaaacactaattttttgttattatttttcttttctcctaattttgcaaatggattcaattaaaatgcattaatgagcctaaacgcataaaataaccttttttaaatttgatttattgattgcttcgtgtgcacaatg

SEQ ID NO: 98461 - DNA, 1003 bp, Heterodera glycines
  Promoter: Source sequence=SeqID_9542; Location=139..1141; Strand=+; Gene=SeqID_71809
ttaacaaaggacacacaatttttcaatatttttcccggcggtgtatatcggcaccgcctgatccccccccccccccaacatttccctattttgtcaacaacgacaaatcggtaaaaaacagcatataatttttaatttatataaaaatgaatggtttaataagcaaatttaaatttgaatgcagattttatttaataattagccatttgttggcgcaaaataacaatattattattgtgtttttttattttaatttacaaatatttgcttttttttctcttttttcaaattaaaaaagttcaatataattcagaaatctttttgtgtagaattaaaataatatattaaaatttgcttttttattgagctatataatttaaataaatttattttttcaataaagttattatttctaattaatatctatacagggaatttataaaaaattgttatttagcttgtattattttttcgtaaggatagttaatttttattaacaatgatcgattggtcgaaaaatggttgaattaagtgtgcttaagagtcgcaaataatcactctcgggggtgcttgcgcgttttataaaaaccgccacctagtcgcgttttataaatccgccagtcgcgttttataaatccgccacctaacaattcgcgttttataaaaccgccagtcgcgttttataaatccgccaaaatggaaaggcgcgttttataaatccgccagtcgcgttttataaatccgccaaaatgggtttgcgcgttttataaatttgtcaatatgcaaataaccaacaaaaatactaaatttattttttttaatactaaatagatcgataaaaatatttttatgtgacaatatgtgccagtcagactgcaataatatttgccaatattacagctgaataaaaacaaaaatatttgttagtattgcaattaaattctataaaagcattaaattttaaattaatacccatttcattttattttttattttataaatg

SEQ ID NO: 98462 - DNA, 803 bp, Heterodera glycines
  Promoter: Source sequence=SeqID_17787; Location=261..1063; Strand=+; Gene=SeqID_82324
tgtgaagtgcgaaaaatttagagagagagagagagagagaggatagagagagagatgaaatggacggagggggaggggtagagggtaaagaatttttggaaaatttttgttttttaagagggcttcctagaaatttttatttaattttttaccgagatggtccttctgtgatatgcgactctctcaaactaatgaagagagctttctttcccctaaagttgggattgaaaggagtgcaaagggcgccctgtgtagctcagtggttagagcattccacggaaaggaagggacgtgggttcgaatcccaccgcaggctgatcttttgcacttacgccatccgccaataataccacacttcgagtttttgttttgggatggattttcaatgggatagggatttaaatttaaaaaaattgtaaactttttatgtattcaaaatgataaagtttttcgtgttttactgaaatcagacatcataagaaaatttaaaaaataaacatgtagaagcatgaattttttaagaaattaattttaattttttgaatgaaaatttttcttaagcataagtgtttaaaaatttatttttttaaattttagatgaagtatttttgaatatagatttttgcataaaaaacttttcatttaaaaacaaaaatttagaatttttgatttaagaaaatatattattagacggtaattacaaatttaattgatcgcctaatttgctaaattaatagcattttaatggacacacttttacccactaaaattccgtcgccgccggcggaggtagcgaactaatg

SEQ ID NO: 98463 - DNA, 342 bp, Heterodera glycines
  Promoter: Source sequence=SeqID_23806; Location=1705..2046; Strand=-; Gene=SeqID_54509
acattagaataattatcagaccacaatcactttctatcacttatctatatataatgctgtttaggctaccagggattgaaaaaacttgtggttgaacccgacattggatataggcgcaaatgttggagcgcaaatgtccggggcacaaatgtccgaggccaaatgtttggggcgctaatgtccggggcacaaatgtccgaggccaaatgtttggggcgctaatgtccggggcacaaatgtccgaggtgtaaatatggagtgaccaatttgagcccattcatgcctcacctattatgtgcaacagtcggcgcaacattgttgttattgttattattaatgatg

SEQ ID NO: 98464 - DNA, 341 bp, Heterodera glycines
  Promoter: Source sequence=SeqID_6952; Location=2162..2502; Strand=-; Gene=SeqID_63385
atcacaaactttaatcaattttgcaaaatagttcaataaatttgaatcaccatttcataataaattaaaatatttattcgtttaaatttatttaatcccctttggtttttaatatacccgtaaatgtgacaagcgcatcgccggtagcggcatgatgcattagtttctcttttgtgccggttcagaaatgctgcacatccctttgttatttgaatttgaccccgttcgcatcggtcgccgaagcgtcggaccttcgatacacagatggccacgatcccgcctcatacaaaagggcaaacgggaaagtcgcttttttgttcctccattcaacaccaaaaatg

SEQ ID NO: 98465 - DNA, 441 bp, Heterodera glycines
  Promoter: Source sequence=SeqID_5499; Location=1642..2082; Strand=-; Gene=SeqID_58254
aatgatgtttgtttatcattcctcttttccatgtcctttgtactattgattttgcccattctgctcattaagtctcttcccctcttttccccaattcattctctttttggttctcctttggactcgcttaaatattgtgctccgctaaatattgaccccaaattattctccaaattctgctttttattttgttgttgttttaataaatattttgtattcaacaacatttgtttgtgaccctaaaggcacaacattggcgacgcccgaactcatcaattttcaagcaattctcgtgttgaattgcttgttttgggaaatttaaaaatctcgtgctgatttttaaatttcgcggaatcatcaaaaaaccaagatacctatgcggttgcggttccactatctgtggttttaattcgtcacaatttcaaatcgtcaatcaagatg

SEQ ID NO: 98466 - DNA, 586 bp, Heterodera glycines
  Promoter: Source sequence=SeqID_15751; Location=657..1242; Strand=+; Gene=SeqID_80079
tattttgcgattttatatatcctacatataattacaggccctaattattattgtttttttattaattttaaattaattctaatttttggaatttaaaaaaccaagcactcctgcacggcatcccgcaaattttaagtgcgagatttggtgggattaatacccgagtgatcccgccccgaaacaaataaattttgagttcatatcctgcagcaggatccgcaaatttgaaaaaattaaatgtcatttcgtcataaattcaatttatgctctttctttttgcttttgttggttggaaattcgaaaaaaattagttttttaggcttttcactgcgtacattttattatctttgcttacataaataattctaagcgtacatattttttgcagtaaaagatttttgtttttgccttttttgttccatttaaaatactcataaaattgcaatttttcaactgtcccattttaggagtgccttagaagtcaaaaaattcacttttatttttgtttttgtgccgtcatttcccattttgtgccaccgcgctccgttcgcttcgttttgtgccgtccaatgcaaaagggaggatg

SEQ ID NO: 98467 - DNA, 200 bp, Heterodera glycines
  Promoter: Source sequence=SeqID_30778; Location=1..200; Strand=+; Gene=SeqID_61171
agagagagacaataggcaaaatgtggaaaaatttgcaattagggaggaccagtttgagacaattagagcttttgtgggacaaagcatggcttattaaattggatgacgaagagcgagaaaaactgctgacgacggcattttttagaaacgaatttgaattggagaaatttaatgagtttttcagccactttttgctaatg

SEQ ID NO: 98468 - DNA, 250 bp, Heterodera glycines
  Promoter: Source sequence=SeqID_11763; Location=856..1105; Strand=+; Gene=SeqID_75262
attgtatttaagattaaaatttaacattatataattaataaagatgattgatgaaaaattttttcacttgaacgatttgaaattaaaacttccttttggaatggtgataagtggaccatctagtagtggcaaaacaacatttttactaaattttttgagagaaagagatgaattgattagcccacacccaaaatcggtgctctattgttatggtcaatttaatgatagtattcctgtactacaaaaaatg

SEQ ID NO: 98469 - DNA, 171 bp, Heterodera glycines
  Promoter: Source sequence=SeqID_206; Location=2967..3137; Strand=-; Gene=SeqID_77579
aataagcgataatgaacctatcacatacctatttaatcgccgtagataaaattttaagaatttcataattccgttttcaattggtttttttggcaatgtttatttcattaatgactaatcaacaacctttaaagagcaattgaaggacaagaaattagcagtgacaacatg

SEQ ID NO: 98470 - DNA, 324 bp, Heterodera glycines
  Promoter: Source sequence=SeqID_11530; Location=321..644; Strand=-; Gene=SeqID_74958
tgtgaattgtcgtccatcatagacggtgacgggacgttagtcaaaaaacccatcaaaatgaaaaatatcgatttttgggcgttagtcaaaaaaccatcaaaatgggcgttagtcaaaaaaccatcaaaataattatacactatacgattatggcctatatgcatgcaacactcaattaatgccaaccacttccaaaatatttgccgcactgattattaattaatgccaaactatcatcaacaaaacaaaaccaaaaatggaagatgtcagttaaataaaaataattaaaaattcttcaaaaagattggggagatttggaaaatg

SEQ ID NO: 98471 - DNA, 273 bp, Heterodera glycines
  Promoter: Source sequence=SeqID_42174; Location=813..1085; Strand=-; Gene=SeqID_70130
aaaaaaaagttaagcctaaaatttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataagtaatgaaaaagtcagaatttcgaaaaattttaaaaacaacaagcgttggcattttttcaggttaagttagtcctttacaatg

SEQ ID NO: 98472 - DNA, 1003 bp, Heterodera glycines
  Promoter: Source sequence=SeqID_5156; Location=2397..3399; Strand=-; Gene=SeqID_57102
ccaccacatcaaatgagagaagaatgaatgtgagaaaagcgcgccatggcattttaaaattcatatttattgcaaaaaaaaaatcactaaaataaattttcccaaatgaaaaaccgaaaatttgagaggggaggaaatgccgacaatttaaaatgccaaaaataattgtcacattagcgcatttaattgccgtatcataatatactcaaaattcacgccccctcattagcactgacaccaacagctaattagtatgatggtgtggtctactaaactttaatgaaatgccatgagaaaatgccaaaatggcatgggaacaacctgccaacagagtgtcaaatacaaaaatctgttttttttttggtttgtaaatgccgtgccattttaagtgctgtcgaccgtaatagaaggcgtgttccatttggctacgaatggcattttcatttccattctttgtgcttgctgctttcagaaaatgagtaagttaatcttcctgctcaaattttggccaaattattttaccgtaccaaacattacgacgtcatggacaaattactgtactaaatatcttgacaattttacagtattcaatcagatctcccatcgctgataaattttacacagtactaaatcccgacgtcaaatttacagatacttgaactgagacatatattttaccatgccaaattttggcgttatggcaaactactgtattcgatcttttgaaaattataccgtgcaagtcccgacagagatttactgtatcctagacaaataatattttaccttatacaactcaaattatcccttcgctgattaatcttacacagtacaaaatctcagcaacttaccgtactcgatcccgacatatttttaccacgccaaaaatatgatttgtgatcaaataattaattaataattttttttcattacaggggcaattcaatttaatttatttttgtttgtttgtttttaaattattttcgtcatgagtctgaacatg

SEQ ID NO: 98473 - DNA, 488 bp, Heterodera glycines
  Promoter: Source sequence=SeqID_4715; Location=1935..2422; Strand=+; Gene=SeqID_55484
ttctctccaattaaaaagcgacatcgaagtcaaagggccaatgctggcctcctcttcctccttggattctgggcagttcggccgtggagtcgtccatcggctacaccttcattagcaccattctttccaatatcgcttctcgctctccagctgtgcaaacatttgttgcagttgctgcacctgcacactaagacgctaaaatttattgaaattaaaaatgatttaaaagtaaatgaaaatttttaagtaaattacattgatcatgggtgtggcggggttcggacgtacaaaacttttattgcgtttgtagattgtaaaaattttttaggtgaatttttgttgcagatttcgtaaactcattttaatcgaaattaaacaaaattattaataattaataaattaaagaaacccaaatgcatttaaattatacatattactaatgtttattaatgttttgaccaaattaggtttttataattactaaaatg

SEQ ID NO: 98474 - DNA, 311 bp, Heterodera glycines
  misc_feature (11)..(11): n is a, c, g, or t
  Promoter: Source sequence=SeqID_4567; Location=1..311; Strand=+; Gene= SeqID_54916
ttttatctttntcgttaataattaaaaagattgtctggaatttgtcttgcgccacaccgctgtgccattcatttatgtaatttgacaccagtctgataataatttcgccaaaatttatttattatttgtccatttattacgaattattttgcatctatcactccaaattttgttaaaaaaatttttttattgtcccaatttttaccatttcacaaggagtgggttttgttttgaattatttaaattttttaatttttccattttggcttatgctaattgttgattttgtttagggaatttgccaagccatg

SEQ ID NO: 98475 - DNA, 232 bp, Heterodera glycines
  Promoter: Source sequence=SeqID_33504; Location=1..232; Strand=+; Gene=SeqID_63550
cgaaaataggattcctccctaattcacactataggctgtttataaaccgataaattaattttcttccccgacactctgtccccgattgtcggggaacaatccaagcttaaaattaaaagaaagatactaaattactttttttttttacaatagatggcttgacatagatcctcctccggcctcagcctattattacgcatttggcggcggtcctcgcatttgcattggcatg

SEQ ID NO: 98476 - DNA, 209 bp, Heterodera glycines
  Promoter: Source sequence=SeqID_944; Location=3725..3933; Strand=-; Gene=SeqID_64681
tttcagaaaaacgcatagctgcgattctgaataaataacgcattgttgcgcttttcttcgagttgaatttgtgtcccacaaataacgcattgttgcgataagtgtggacatcgacaaatcaccgacaaatcgggccgttttcgaggatcgccgtttaactttgtttttgttttgttgagtagtacctctgcggtagctcaaacaaaatg

SEQ ID NO: 98477 - DNA, 602 bp, Heterodera glycines
  Promoter: Source sequence=SeqID_10620; Location=1..602; Strand=+; Gene=SeqID_46890
aataaactattttttaaatttttatttaactttgaaatattcttcagaattttcccttcaaaatgagcacaaaatggttttatttggtctattattgaaaaagttataagctaaaaaaaattcataaaatcaagggtaaaataaaatgtttaccttttattgtttgtatttgttcttttggcgttctgtatttattattattttatttatttgctttaaaaaattgaaatttatacacaaacacaaggaggaattgaacttagagcccctttttggtgactaactcacagaccactaagacgaaaaaaccaacttaattgtacttggagcccaaaattgactcgccgtgtctatctaaaaaatacaaaaaaaaaatcgacaaaattataaaacaacaaaaaaattgacaaaacaacaaaaaactacctaaaatacacacatccaactttgttcctcgcgtttctctctgataaaagggtttggtttttctttttgctttaataaagttattcgaattaatccgtcataatcgtttgtttcttccttgttttcgttttcttctctaccaacattttcacactttaagaaaataaaagaaaatg

SEQ ID NO: 98478 - DNA, 242 bp, Heterodera glycines
  Promoter: Source sequence=SeqID_8170; Location=5115..5356; Strand=-; Gene=SeqID_67195
ggtgctgctccatccccccacggcacccctcccgtggactgcgccggaaaacaacaccttccgggggctgctgcttgtccgggtgctggcgccacgcaccatccgtgtgcctctgctcggctaccgcacaaaggatgagcgcttcaccttccctttgtgtgggtggtgtgccgaccgaagacagcagcgaccgtgccgtcacggtgacgacaagcgttcgtgggtgacggcctacacgcatg

SEQ ID NO: 98479 - DNA, 516 bp, Heterodera glycines
  Promoter: Source sequence=SeqID_32680; Location=314..829; Strand=-; Gene=SeqID_62958
aaaaaaaattcaatcgttcccggaatttacctttaattttttattggctataatttttcctcatttttgaaaaaatttttccttttttattaaatttttataataaaatatatccttatataattttcctccacagattctcaattccacaataatactttattattacatccatttggccatacaaatcccagcccttttcttttttggccaaattttggctttgtccacctgccgtaaatttgtgaatgaaacagcagcacgaaagacaacaaaaattgaaaatttgatcaaacttggagaaatcactggccgatcaattagttggctctgccgccagtagctgatcctccgaccgatcaagttttggccctgtcttcaattgccaatcacttttttgcccagccaccgatcaattgctgactgatcactggccaatcactttgataataatcaataaaaacaaccacactattaatggcaacggtgggagcagcaggtggtagtggcaaaatg

SEQ ID NO: 98480 - DNA, 174 bp, Heterodera glycines
  Promoter: Source sequence=SeqID_8786; Location=1043..1216; Strand=+; Gene=SeqID_69219
cctaaataaagaatgttgctgctagctattcgtttttttaatcgtaaaacagaaaatgtcaatttaatgggccaaattctttcggtctccgaacaaattgtggggggggggggggaggccacctggtcaagccgttcttcctccgccacgtcaattggagaattggcaaagatg

SEQ ID NO: 98481 - DNA, 136 bp, Heterodera glycines
  Promoter: Source sequence=SeqID_9975; Location=584..719; Strand=-; Gene=SeqID_73018
ttttttccacgtatcggatccgttagtgtctttttcgatttgcggtccgcctctgttgctgctcgtcccccgctgggtttgaacgtcttcaaattggaccctttttataggccaagtggtcgcctatgaaattatg

SEQ ID NO: 98482 - DNA, 1003 bp, Heterodera glycines
  Promoter: Source sequence=SeqID_19894; Location=1251..2253; Strand=-; Gene=SeqID_84651
catcgatttgttgtagtttcctcccgttccatgaatattgtttattgcagggttaccctttgtacttatttggagggtgcaaaacttacaaatttaaaatgtacttatttgtaagtattgtacttaaaaataactcctttccatcgcgccttccattttattctctcctattcttattttctctctttccactctctctccctccttctccctttttttctcccactctttctttctctctctaactcactcactccctctccatcttctcttctatcctttcttctcttctctctcctcactctctatattttatctctctctctctcacccactctttttttttctttctttttctctctaattcactctcctctctctgtctttctcttcctttccctctttgtctttctttctttctctcactctcttactcactccctctccattttcttttatatcctttcttctctttctctctctgtattttttttgtttctcttctattcaatccttctctttttctttctttccctcatcactaattctctctttctttctttctacccctctctctctctctctgcctttctttctctctctctctctctcttactatccccctctccatctcctcttctatccttccttctcttctttctccatatctcttttttctctctctctctgcctttctttctttctctctcattcactctcctctctcagtctttctctcctctctctatttgtttttctttctttctctctcccatatcctttattctcttctctctccatctctatttctctctctctctctcttgaaatgactatgtgatgactgataatttcaattcgccttaaattccaatcgatgcctcagaccgaaaagcgttcttcctcccacctctctccccccacagacaacacaaaaagactcgccattgacaactcatacaacatcttgggagaaaagctagctaacattggtaggcttatg

SEQ ID NO: 98483 - DNA, 93 bp, Heterodera glycines
  Promoter: Source sequence=SeqID_2975; Location=2381..2473; Strand=+; Gene=SeqID_82599
gctttttctttcgcaacacattctgtttttataagaattattaatttttatataaaatttataataattttagacttattccaaataataatg

SEQ ID NO: 98484 - DNA, 203 bp, Heterodera glycines
  Promoter: Source sequence=SeqID_7105; Location=355..557; Strand=+; Gene=SeqID_63851
tgcgtttgtcgacattgttcgaaacgagggaatggtggcactgttcagagtaagtcggagaggatggcacggcacatgcggggggggggggagggtgaatgaggttgggtcggtggttttgaaatgggtttagtggagtgtctgtccatcgtttgaattaattagccatttttgacccctaatagggcttttgggtaacaatg

SEQ ID NO: 98485 - DNA, 1003 bp, Heterodera glycines
  Promoter: Source sequence=SeqID_18414; Location=1484..2486; Strand=+; Gene=SeqID_83010
gtagcgcaaactgtccgaattatgaattaaaattaaatttatttgcataaaatatgtttttatggattaaatctgacattttattatgataattaaataaattgttattgactcgataggcgtagtctccgattagagtcggcaccagttccacgaccagcgcattttcagctgcacaaccgctgatgagtgctagcaatacgacaacgaaaggagcgaaaatagcgaaatttggcggataggggagcataaatatgtgtattttgaggctaattacaataaattaatcgtaataataagaaataatttaaatggttggggaaagattttaatacaaacattaactaaaattgattatattaaggcgattgacgtggattttattggaattgttttttacaatatcaaaatacaaaataattaaaataattatttcctttccaaaataattcttattcgaaattttgcaaatttatgaaaaataaatttattattggtggccgtggtctcatcactttgtcaaactctgatttttgcactttcgttttattttacggttagcgttgccgaaaaatcgaatttacaggacactatttgcacgtaccgctcaggctggctcggatgcagaatttccgggttcctttctctgtaagtcgacagagataagaaagagaaggagaacagcacaaatcaaaataagcattttagcaaattattaaaattttgtcaagaatgaaaaagaatttattgttttgaaaaataacaaattttagagtaaatttgggtatttaaagccattaaattaggcaatgaataaattattgtgtttattcaccatcgcttattgttaatctgtcaaataaatcattttcactttttatttattctaatatttaatttttattttataaattaatttcttataatttgtcgcttcaaatgactttttcttttgctgtgcttcttttgcttttgattcctccgctgacattggcaaaaaatg

SEQ ID NO: 98486 - DNA, 733 bp, Heterodera glycines
  Promoter: Source sequence=SeqID_2006; Location=811..1543; Strand=-; Gene=SeqID_77296
aggtgcttgctttgaatactttgggtggtgctgctgccggaggctcttcggccacgcggggccgggacgcgtctttggatggtgcggtgggttccgctgtgctcggaccctcttccgcctctcgttctccggtccgccgtcgcggtgccgccgttccgcgtccgtcgttggccccttccacctcttctcactttgccagcagcgactgttcaatggcggacccctcttctccggacggtccctctcctccttccactcactgtcctacttctccaccggaaatggcatatccaaattttccggcaaagtctcgcgcttccatcagtccgcatgtccttcgtccgccttccccgcgagccaccctaaagaataggcggtcatcatcgccacgaaagctgagcatgaccaagttcagaaagttcggtgacaccgtcacacatcccgtggtacgtggcacggactcgaaagaataagcaaagaagcggcggatgggagacgagctcagccaacccatcgaagagcttctttcttctcagcactgactttgttggctttatcgcttttcaccacttctatttaccattccttttttacgataaaattgtcgacatttttcgctgttggagtttttccaaggcgcccaatttttggagagagtgtcacaaattgccttttttgccatttgcccactttacgttttcttagatgccactcaattctgtccatccaaatg

SEQ ID NO: 98487 - DNA, 764 bp, Heterodera glycines
  Promoter: Source sequence=SeqID_18714; Location=1..764; Strand=+; Gene=SeqID_83386
aaatttggaaggtgccgctccgttcagagcaaccggcgactgtcgcgcatgtccaaatgccggtaaaaaaggggttcaacacgtaaaacaacaatttctaaaactcaaatattttatgcattaccgaaaaaatgggcatttttaggcttacatagcgaaaaaaaaagacattttatatttggtaaatttttgaacagatttgtagcgaaagtttgtccagaaaattacatgaaaataaatttaattaaaaaaatacactctctaaaatcaatttaatttactaaaattccttttttttaaaaaaaaagtcctaaattttatataattttaatcataataattaaaagcctaatatagcatatttaacaaaaatttgtgccttacttatttagaacactgaaaaactgacaatttttggccaaattttgctatattttatccttgaccaattaacaatttttttgtgtttagtctcaacaaaaccaaatgaattatggcaatgccaatccggcacagtttaatttttatccaacggcgcctccagtgcaacgcggagcaccatgaaaagcggagaatggagcatgtacacggatttttagttgaagaaaaggattcacgaacggggggacatatagaagactattgtagctaaattttgtgtggatttccttatttctgcataaaatttttttgttgatgtttaattggtgcctgttgtgacagaagaccccagacaaaagactcactccgacaaaagacctatg

SEQ ID NO: 98488 - DNA, 115 bp, Heterodera glycines
  Promoter: Source sequence=SeqID_1809; Location=4139..4253; Strand=-; Gene=SeqID_76102
agtgcctcatgaggcactttcgacacatcacctcaagcgagatcagctcgcgattgtgcccgagtgcggctacgacactacaaacacacaaagccttgtagcgctcaaattcatg

SEQ ID NO: 98489 - DNA, 477 bp, Heterodera glycines
  Promoter: Source sequence=SeqID_1653; Location=5832..6308; Strand=-; Gene=SeqID_75081
tgagggttagagaatacacacattgaaaatttaaaaaaaaagaatttgaaatttagtggataatattaattttttaaaaattcaatgatttgaaatttcagaaaattttcgaggcttttttgctcttcattctcgtgctgttcttttcaccaaacaccaacagcgaagatcgtcagtttttttggtttttgaaaaatgacaaatttttatcattctggggccaaactgtacaatggagtccgtccggtgttgccgataggcatcgccgggaaattttttgaaaatttaagaaatgtgataagaaaattaaattttataccaatttttcttgaaatttttttcatttttcttttcaagcgggggcgggagggggcaccatcctcccccacctccggatacgggcattgaagaattacagtaggatgtgtataatttcaatttatcatctcttttatacgttcagcaatggtcattatg

SEQ ID NO: 98490 - DNA, 68 bp, Heterodera glycines
  Promoter: Source sequence=SeqID_1920; Location=935..1002; Strand=+; Gene=SeqID_76805
tttgtcagagtcttctattagttgatcccgaaaaattctccggaaacgcacttcgccaaaatcgaatg

SEQ ID NO: 98491 - DNA, 469 bp, Heterodera glycines
  Promoter: Source sequence=SeqID_23806; Location=369..837; Strand=+; Gene=SeqID_54510
aaatattttaataaaggctttgcgtaatcaatcctgttttatcccgcaccacaatataagccaaaagtcaagaaattacaaattattctttaacgaggattctagaaaatttcatgaaatttttttttgtaaaattaagctttttttgttgaaaaatttgttcaaaaaaattaaaattttttattctcgaaattagtttggattttttaaagaattaactaaaaaatattattttttaaaatttttctgcggacacggtaagcgggagggcgggaaacgagctgcttccggtttaatcaatcacacacaacatttatttaatgctagtcaaaaaaaataaataaaaatctataccgtaatttctcacatttaattttgattggataattttataaaataaataaattgtccgtcccctttcaaggctccccatcagcagcaagatggtcagccgacagactttggcatg

SEQ ID NO: 98492 - DNA, 316 bp, Heterodera glycines
  Promoter: Source sequence=SeqID_43313; Location=1..316; Strand=+; Gene=SeqID_71011
cccccccccgaaatgaaaatttttaaaaattttccagcaaataatggaaaattttttcgaattccccccccccccaaacgaaaatttaaaaattttatagacaattttcgtaacaaatagcactcaaattttccgtaaaacggccaaaattgggtcctttttagtgaaaaagtggagtttttacccagcagcgggaattttttttaagcagccgccgccgactaccaaacagtagaaaagtctacaagtggaaaattgcagttatttgcagatcgtaaacaacttttatcaattttattcagcaaaaaaaattatg

SEQ ID NO: 98493 - DNA, 510 bp, Heterodera glycines
  Promoter: Source sequence=SeqID_17575; Location=1..510; Strand=+; Gene=SeqID_82082
ttactgcaccattctatttcgcttttgtctcttccagtcttttattacaccattctatttcgtattgtgccattctatttgttggcatctcttccgttttctcattgtttcattctatttcgcttgtatctcttctagtctctcattaccaattctattcgttggcatctcttccggtctcttactgcaccattctattttctattgtgccattctatttcacttttgtctcttccagtctctcattacaccattctatttcgtattatgccattctatttcgttgggtatcgacgtaattcgcgcatgtgtttgtataatattatgaaaactcattttacatgtttttatgcacgaatgtttgtttatacattatataaaatggaaataaaaaattttgctttaattttaaattttgctcacatttatttttttaataattaaataaaatttctttaatttttataataatttttgagtttgaattttttgtttaattaggaaaatatg

SEQ ID NO: 98494 - DNA, 168 bp, Heterodera glycines
  Promoter: Source sequence=SeqID_2735; Location=1..168; Strand=+; Gene= SeqID_81346
cggtctgcccaatggtcaattggtgaggctaacgtccattaactggctaccgccttgatggattagtcacacgtgaaccccctcaacgcaaccttgccattgaatacatggggtgcttttatcatggtaaaaaaaaaggtcgcccttttcaaccgaacaaaaaaaatg

SEQ ID NO: 98495 - DNA, 234 bp, Heterodera glycines
  Promoter: Source sequence=SeqID_5260; Location=2395..2628; Strand=+; Gene=SeqID_57494
agtttggtaaaacggaggacaatttcaattttaaattaaagaccgcgttaattagggggttgatccactaattaattaattcactaattgacttatttgctcttttgctgaacagccgccccagcagaagcagcctcaagaaaagccgggggcgcaacaggacgacacggagacggaggaggacagcaaagaagacaagcggaagccgataaagtgtcaggaggagaggaaatg

SEQ ID NO: 98496 - DNA, 413 bp, Heterodera glycines
  misc_feature (26)..(26): n is a, c, g, or t
  Promoter: Source sequence=SeqID_18469; Location=1..413; Strand=+; Gene=SeqID_83070
cggtacggaaacgcgtccttcggtgnccgcacaatgtttggctgcgattgcttgcgtcgaattgccatccaatgtgatttttttgtctaattctcatgtccttggctgcgttttgtcctttgttaaatgattgaatgaggtccaaaatgtatttaatcaaaatttagtcatttttagacagagtattttaagcaattacaattataattcttaaaagttgctctttgttttgtttgctaaatttcccttcccttttttcgtccctttggccatttattcttttgtcccctcttcgtcagcaatggcccgaccttttggaccgtttggttgccaatgtaacgactgatggtgcggacaacgctttgctgcgcgaagcttccctggaggcactcggttacatcggcttggacatg

SEQ ID NO: 98497 - DNA, 550 bp, Heterodera glycines
  Promoter: Source sequence=SeqID_5802; Location=232..781; Strand=+; Gene=SeqID_59274
ttgagttataacataacgcctgaggcgaaaaaaatgaaaacacttatttttattttcataaattaaaccaaataaatccttttaatgaattttttccaacattttctatcagcaaattgttaaatttcacatattaatgacgaataacagttttttttaactatacgtcttttctatattaattttttttgtcaatttttatatagatttttttcaatttttcttgcaattttcatattaagcatttatttattttacataaaaaaatttttcaatgattaaatttaatatgttcaaattgaattgcgttttaatgaaaaaaacgattgatttaatatttttcaattaattacaaaaatttatcatttcttggagaattaaattaataatagaataatttgcttttctctattgaaggtgaaacgaaaagaaatattcaataattaattgtcatgtctgacccataaaattgcataattattaattaaattatttttcatttttgtcgctattcgcccactctttggccctttgtccgccattcccaatg

SEQ ID NO: 98498 - DNA, 375 bp, Heterodera glycines
  Promoter: Source sequence=SeqID_23175; Location=434..808; Strand=-; Gene=SeqID_53878
ttttcttcaatattttaacagatagtgagaattttaaaatctgatctaaaggaacaaaaatcggttatggaggagattattggtcccgaaaactttttttagtttaaggaaaattatttttaggggtaatctgaggtgctaatattgctaaggcattgatgttgatctatacaacaatatgagtaaacagaaggattcagatgtcattcacggagtaaaatgggaatatgatcgatagggcgtcaaattatatggaaatccatattttttcctggactgtgggaggcctgaagcgtacgaaaaaatgtttttagcgtgatttgaagcctttgactaaaaattcttaaattttagctttatctgtcttcaaaaatg

SEQ ID NO: 98499 - DNA, 1003 bp, Heterodera glycines
  Promoter: Source sequence=SeqID_5453; Location=25..1027; Strand=+; Gene=SeqID_58106
cgacgggggatgataaggccccgctttttaacagtaattaatttttttaggaccagcgaggcgcgggcagttcacattggatgttgccttaatttgcttttaatttttaattttttaaatttaatttttattcgtctgtttccatcctttttgattggatgcgacaactaaaaatgggttgagaatgagctttcattttatcatcggtcataattgttttttttaaatttattattatgcgaataaaatgtaattaaaagtaacaaaaattaaaaagtttaatttctgcgtaagagcccagcaaaaatattcatggagtttatgtaaatagtaaatattatttatatttaatattaattttttacttttcgaattttaaattattttgtcgctttgtttttctaattttccgtttcctcaattttagtatttatttgcttccataattccccaacgaaagaattcttttccatgtcaatgaaaatggcaaattttgttgtccttttttgcccctccgtcgtccctttctttctttttttgtctctttaaaaatgcaattctgtcaagcacaaatctgtgccaacgccgtcaaatgccgtcccggaaagatgggacatcattcccttgggggaattacggaggcaaagggcacacatcgccggaggggcgggcggcacagagtttggcccaaaaaggcagcagagatttctcgcctcacccctcgaccagttccatctgtgccattcgctgttccaaaaatattttttgtcttcatttgaaataatttgttgataaaagcgttttatatattcttgaatttatttatttaaaactaaaattttaggccaaaaaaacaacgactaattaacctcaaatttattgctatggccgagaagaaaaatggcattagccacgaatgctgtggtgaatgataattaaaaaataataattttcatttattttgatcttttttcattttcagtatcaaataattcatcagatg

SEQ ID NO: 98500 - DNA, 56 bp, Heterodera glycines
  Promoter: Source sequence=SeqID_15414; Location=3374..3429; Strand=-; Gene=SeqID_79682
agaagcaaaagaaccgggaacccaaacattgtgttctcttctcattcaacttgatg

SEQ ID NO: 98501 - DNA, 56 bp, Heterodera glycines
  Promoter: Source sequence=SeqID_2080; Location=1118..1173; Strand=-; Gene=SeqID_77742
tgtttggttttccacaaatatcttgtctgattttttccattttagggcggcagatg

SEQ ID NO: 98502 - DNA, 152 bp, Heterodera glycines
  Promoter: Source sequence=SeqID_22820; Location=263..414; Strand=-; Gene=SeqID_53528
tagcctgacacgaatgacgatacttaaaaaaacaaaaataattcaaaggcaacaaaaattgtcgaaaagtcggaccacaaatatacgattggcttggaccgcatgggacgtaatgtgagagtaaccgtctgggttatgaattaaccggaatg

SEQ ID NO: 98503 - DNA, 187 bp, Heterodera glycines
  Promoter: Source sequence=SeqID_19934; Location=1478..1664; Strand=+; Gene=SeqID_84696
agagagagagagcgagtgaggagagagagtgagagagagagggaggggtgatagagaatgaaatgaaaaaaagttgtgggagtatatgcagatggtcagtggataattgcacttcctgtttatttgttaggtggccgattcgctgacttctacgaaggacactgtgaccggcaagtcggcggagatg

SEQ ID NO: 98504 - DNA, 77 bp, Heterodera glycines
  Promoter: Source sequence=SeqID_17372; Location=1713..1789; Strand=+; Gene=SeqID_81857
tcactttgaacactgccacttcaacatcagtgacctccacggggcaattagcagaggctaattgagaaataattatg

SEQ ID NO: 98505 - DNA, 56 bp, Heterodera glycines; identical to SEQ ID NO: 98501
  Promoter: Source sequence=SeqID_16504; Location=1312..1367; Strand=+; Gene=SeqID_80906

SEQ ID NO: 98506 - DNA, 489 bp, Heterodera glycines
  Promoter: Source sequence=SeqID_24199; Location=719..1207; Strand=-; Gene=SeqID_54911
attgtgaaaaatatacgaaaattattttagcttttaattatgcagtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttgtcttttgaaataaattgtgaaaaatatacgaaaattattttcggttttaattatgctgtacaatgcttttaagccccgccgtgcggcggctccccttttgtgcactattttagtttttaaaattggttccggactttttggctttttgaaataaattgtgaaaaatatacgaaaattattttagcttttaattatg

SEQ ID NO: 98507 - DNA, 1003 bp, Heterodera glycines
  Promoter: Source sequence=SeqID_5066; Location=1796..2798; Strand=-; Gene=SeqID_56778
cttggcaaaaatttttaatttttaaaaattatttattaggtaactattttggttttttggccttaaaaatcccagtcctactcatttgcaactgcaattagtaaataataaatttttggctcaatttttgttcgattcttaaaagtgtatttttcgcttttattgcatttgtgttgcgaaattttccaaaaaatgtcgaaatagtaaaaaaatattgacaaaacgccaaaatagtaaattttcactattttaagtagagtgccacgggaccgggattttcggtgtcaaggcagttcgtacaatttcaaatgggaatggccataatttttttgttcgtcatttaatttcttcaaaatttgtttcaacgaaagctcaacgtgtttagaagctatcattaagcagaagctaagcgattaatcatctcaccaaaaagttgatttatagtttacaaaaaattaggattttcttgaatttttaagtcttataaatcatagctttttggtgagatgattcatctcttagcttctgcttaatgattacttctaatcttccaataattaagaaaaaattcatccaggtttcattgcctttttatcgaccgaaaattttattttttggcattttcttctgtaaaactcaaactttgcctcaataagtcaaaaaaatcacgaacaaaagtcgcaaaaactcaaaaaagtcataaaaatccgaaaaagtgtaaaaagtcaaaaaaagtctcaaaaaatgcatgttagaagtagggatcggatttttagtggcaaaaatcccaaaataattaactaaatagtggcaaaaatagtggcgaaaaagttccaaataattacttttaataaaaaacttttaagctctgatggggttttgaacaagcccaatttcgagaaagaattactcgattgagtaaatttcggcataaatttgaagagaaaaaaaggattttcgatgagagacctattttgattttggcagcaaatgtccgaaaatg

SEQ ID NO: 98508 - DNA, 1003 bp, Heterodera glycines
  Promoter: Source sequence=SeqID_1888; Location=466..1468; Strand=+; Gene=SeqID_76576
attttcggcccattttcgttctgctcaatttcgccactttttgttcaattttgctcgtatttaatgcgacaaatccccaccaattcctacaatcagaagcaccagcaaaggcaagcaatgcctcttccgtccctctctcagtccccctcatttcattgtccttttcccccggcccaattgtccgttccatttctgtcattcacccggtccctatcattgaattttgtgatttttccatttgccccatttctgaaatttctgtcccatcccggtgcccaattccatttgtgataattccccggtgatggcttttttcctgtgatcaatttgtgataattttgttcaccatttcaaatatttggtttaattacccaagtttgaggtcatttcccggaataaattttttattaattctgtgtctcgtccctgcctgcccctgaaccccgcaccgtggaattcatttggcccgaccccagagcaagtcgggacaaattggcgctcctggggtggatttgctgtgaaccacggactgaaatcgacggatcccggtgacaaagggggaagggaaaaagcaaattagagagcctagacaagaccctccgaggcttgtctagtgttcatagtttcgtgtagttactgtcctccgaggcataacttcacgagggacatagcagacttagtgtttaccctctgaggaagcacttcgtccgaacagagggttgaaaggtgttgtgtagtggacgaagtacttgccctccgaggaagtacttcgtgcaaaagggtgttcaagcgcgcacaaggccactgacaaataaggaaaaaggcaaactaacagtcctccgaggctttagtttagccataaggcaaaaggcaaacaccttgtcctccgaggcaggtgtttagtcacagaggtccatcaaaggccccagggccgagaccagactgatcccggcaaaagacacaaaacaacacacacacatacgcacaatcaaacagcacaatg

SEQ ID NO: 98509 - DNA, 149 bp, Heterodera glycines
  Promoter: Source sequence=SeqID_11455; Location=1..149; Strand=+; Gene=SeqID_74851
atttgttaaggtgaactttgcgcgctatttgctcacccacggtgcaaacgttggacgcttggacaacaccggtggatttttgtcaaatttctgaattttttgtccaataatttattgttcccgtttcaggaagcgttttcgcactgatg

SEQ ID NO: 98510 - DNA, 1003 bp, Heterodera glycines
  Promoter: Source sequence=SeqID_19045; Location=787..1789; Strand=-; Gene=SeqID_83785
ttttttgttttgttaaaaatgggtttttgggccatgggttcaaatccacatgcctgcaacatttttaaaaaattatttttggggtttcgagttcggatcaaggctttggaattgggcaaaatggatgccaagttcttgattagtggtcccaaaaaccctaaaaaacatttttacaggcaagtggatctgaacccatggcacaaaaaaaccatttgcttccatctatgatcccgaattccaaaatcagtttatttttgtactttttttcaaaagtcttataaaaatatagaataaacagaagtttatagaggaagaatttcgtgtttttcaaaaaacctttttagaacagcgctattaattttttttttctcaaaaaacgaatttttccaaaatttatgtaataacttcttcgttttgaagatagaaaattctaaaaaagtataaaatgctccagatttttctctatttttaatgcttttttgcactttaattgattcatttagaagtgaattatgaattttcaaacattcgcctaaatttccaagggccaaaaaatgaaaaatcttttcaattcaaaaatttcagattaagatttaaattgtaccattatgcagaaagcaaaaaattttaagaatttatatagggaaaggggttgaacaataaaagcccccccctcgattggaagctcccccttgaatataagccccctttggaggggggttgaacaatagaagccccggggcttataatcgaggaaatacggtattttagttaactatttcgggattttttcgtcactaaaagtatcgtccctaattattagcttattattcaattataaattccatacttttttcgcttcggctcaccacggtcgggaacacctgggttttcgttcccgccgatttagtttttttttgcttcatttttgtttatggataactgagtccctgttaaaagttgagcgtgcccctaatttgcatttttctcattattttaaatg

SEQ ID NO: 98511 - DNA, 762 bp, Heterodera glycines
  Promoter: Source sequence=SeqID_23876; Location=658..1419; Strand=-; Gene=SeqID_54567
atccaattgttgtaactgagggaactcaagatttaagctcaaacacacaccaatcaatcccaaaaaatcgccggaccggatttcgggtccagaaaaatccggtaccgggtccagtccggttcgctctctaattataagtttaggtgtccctgtggtaggggtttcttgagttaaaaaacgcggttgggtctgaacagattctgtaaaacccaatgatttaactatgatgtttaacaaatatgattttttttaacgtttttcaagcaacaaattataaaaaatggaaaatttttctgtgcgcattatgtacaacggtgacttgttatggtatcccatcgggataagtgaaaacatcgcatcactcaaagggcgtctgtcgcatgctctcaaccaaccagcgcatcaaatgtttttgcgtttcgccggtagagtccatttgtcatagaaagtcataatttttttcatttagggcaaattttgccaaacaatttgatcatcatcggtggtgggcccatacacattcacaatggtgcccaactcgaacttttttttggtgccgccgccggtcgctggacagatcaattgatgaataggaggaattgcccgatctccaatttttgttttttctgttgatacgatgtttttttgttttgtttctgtaaacaataggatcccaaattctttttttttgttcgtttatggcatttgacagtctctgatttttgtaccatttcaaactttttgtgctgtcttttaaaaatg

SEQ ID NO: 98512 - DNA, 485 bp, Heterodera glycines
  Promoter: Source sequence=SeqID_6729; Location=934..1418; Strand=-; Gene=SeqID_62655
ttcccaaaaagtttttttggaaaaagcgcgcctcaaaaaagcgttttattgattttttaatttggaataaaattttaaaaaatgatttttgctttatgattttaactattaaaaagttgtagaaaaaatttcgcttttcgcatttcgcattttcgcatattttggcttttcgcatttcgcttttttttcatttcgcatttttcagtttcgcaaatttcgcttttcgcatttcgctttttatcttttaatttggcccatccctggaatacacccccaaaaatagcgccttggcctatttgattgaggccaagttaacccccaccgtaattgaggactcagggttggcaaattgacaaatttttcaaaaaaaaaattaagccttacgaggaggccaagcactcagtgcttttctccgattgttgaatggtcgtggcggttggcattggattcagtgccgtctgtgtactacaaacacaagccgaatg

SEQ ID NO: 98513 - DNA, 567 bp, Heterodera glycines
  Promoter: Source sequence=SeqID_12181; Location=738..1304; Strand=+; Gene=SeqID_75757
aaatattaaaaaaataacatgaaaaataatgcggcttaatctctgcgaatcattggttttttagtgaaaaattttttgaaattagaaatttgattaaatttcccattttttgggagtttatgtcaccgaacttaagtttcgtaatcgtataaatctaaatgttccaatcgaaatttttttgcattaccggttttttgatttttcaaaagaataacaaataaggtacaaaattaaatccaagaatgaattacctacactcgcggcccgataaagatatattttcttgtaaaatgccttttttgaaaaattcgggatacggtatgccattaagcaactgctgaattttgcttatcatagtttgttaaaaaaaccaatatgaagatttagttaagaatttaaaactaaaggtgaatcagttatcataaccattctcacgccatgaaaatttttgaaatttttaaaatgtgcgatgcgatttaagcaacgaatggtcacattcaaatggaagggagcatctccaaatacagcttcaatatcctccactcacttacacaatgatggacgatg

SEQ ID NO: 98514 - DNA, 1003 bp, Heterodera glycines
  Promoter: Source sequence=SeqID_6592; Location=33..1035; Strand=+; Gene=SeqID_62125
tatttactacataatagtacgagttgggtttcgtccgttttatgtcagcatttggacaatcacaattatgcacttgttttattattaaatcgggcttcatttatgaatttataaactataaaatagaatgaaattatttgattatattttttaaatattaagaatttataaatataaatcacaattataatattgaattgggcttcatttatgattttataaaataaaaatcacaatgatcaatcttttgggtaggggtatcataaatttcaaatcacaaaaattgcatataaaaaggctggatagagccttaaaaatcataattttccaacaacttcaatcattctggacacttaaaatatttcgaaaaccaaattcattaatccattcataaattttgtttcgatttgtccctaattttcttccgatttttctttcaattttattccgttcttttggtgagtattttctttctttttgcttgattttctcctttattttataatatttttcaatatttctcttttttcattcaaattttcttcttccttttgttcccatttttctccaaatattcatcaaatgaattttgtttaatttttttatttgctggttctgtttattaaacacaaaaaaaactgccacataaacaaagtttccaattaaaacaaattacaacacattaaaaatactcgtctgagctctcggaaaaaaacatttaaagaatttttttttttttgcgatttttcattttttaattaattctaatccgaatgccatttagaatttgatcatttaaaatttttaaaaatttaaaaattctctatgcaaggatcggatttttggcacttttttctcccttttaccagaatgcctagaattccggcccatattgggtagaagagattaaaaagacaaaatttatgtatggcataacagaaaaagaaaaataagaatttttctgttaaaatgctgtgggagcaaaagcaacaggggccaaatg

SEQ ID NO: 98515 - DNA, 172 bp, Heterodera glycines
  Promoter: Source sequence=SeqID_17931; Location=775..946; Strand=-; Gene=SeqID_82488
catgcgcgggtagcggtgcttgacggcgatgcgactccgctacgatacgtcacaatcataccaaaaagtggtgccttaggagaggtaaaaataattattctttagaagaattaaatattgattttgtttttctatttagtcgtatgggctgcccaaactcgacgaagtgatg

SEQ ID NO: 98516 - DNA, 972 bp, Heterodera glycines
  misc_feature (19)..(19): n is a, c, g, or t
  misc_feature (95)..(95): n is a, c, g, or t
  misc_feature (101)..(101): n is a, c, g, or t
  misc_feature (185)..(185): n is a, c, g, or t
  Promoter: Source sequence=SeqID_25188; Location=1..972; Strand=+; Gene=SeqID_55926
ggttagtaagttagaatgngtatatgtaggttcgtgatcaaggaccaaaaaaacttcgtgaacaattttcattactagacaaaccaaaatggtancccttnggttttaataaatttcaaaatcggtagacttttataatagtgccacattttcccataatgcaaaatttgaatgaaattaaactntaaaaagctagtaaaaattgaacattgtatttttgtgccacaccaaccaacacctttaaactgtctaaaaattacaataataaataaaaaaataaagtttttggtttaattttgcaagattaaaccgaaaattatttgaatattcggaaaataaactattataataattaaatttatctagttgatacttttgtaatttcggcttaccacggaataccatatggttcaattgttttttgggtatattttcatttgggaagcggcggtacaaaaaggcgccgccaggtgaatttggaattttgtatcaatttgtgtagagtttgaaccaaaaagccgaattttcgagcaatatagaaattcttgaaaatttcttttggaaatattaaaatattaagtttttgagtaaaatcatttataaattgcactaaattaaaaaaatatgtatggcgcctaaccttatcttacttaatatatgtgtgtatacgagaaaataaatgccatgtgctgttcatgtgaatcgtttaggaaattggctctaacaaatcaattatattcaatgacaacaaataaatattgatgaattttaattttttcagacatttattgaaaaatttatttaatataatataaattatctttttgaaaagtttcgcaaatttggaaaattcttttagtttaatggcccctttttgtgtattattattgtttttattgtcagtttacctaaaagaagcagaatttgacgtaattacatgcttaaaacaaaataagttggccaaaggaaatg

SEQ ID NO: 98517 - DNA, 292 bp, Heterodera glycines
  Promoter: Source sequence=SeqID_13221; Location=386..677; Strand=+; Gene=SeqID_77048
tgtaattaattggttcaccattcccaagaattttacctttttaagtttcaatttcgctgaggccgctttgctcatccacgggacgacgacagtttatgcgcgaaaagtcgactacgtattgcaaaaagcccaaaacttttttgatcaattgagggaggacgaaaacattcaccaccagcagcagcaaaaaggaaaacgaaggaaaggttttgaaattaacaatcgaattgactcttttcttgcattagatgatccattggaagaaggtgctgaagcgacaggggaagagatg

SEQ ID NO: 98518 - DNA, 561 bp, Heterodera glycines
  Promoter: Source sequence=SeqID_539; Location=4344..4904; Strand=-; Gene=SeqID_55810
tttatttttggtaattaattgaattatcttaaatatttgggaaaattaattgttttattttattttattattgttttgactaataaatggtaaatgaatgaatgcttttcacttttttgttcactttcctttttcctttttttagtgaatcattcactttccatcccacaaatgcttctttctgctgctaatgtgctgatgactaattgaaaatgatcaaaaaaaaatatttttatgataattatttactgggaaaatggacaaataaaaatgatttatgttaattaaatgtgcaaattattttttaattaaataaataaaaaagcaataaaaatgatttggtgccatattaattaattaattaataatggtttggggtgccaattttgttattttttgcttttctgtccatcttttcgctatttccaatgccaatggcacaatgtaatcaaaataaaatatattattatcaaatattaaattatcttttactaatctgtaagcaattaagcaaagtgccgttggaatttaagccattttgcacattaaaagttaaatatg

SEQ ID NO: 98519 - DNA, 1003 bp, Heterodera glycines
  Promoter: Source sequence=SeqID_18948; Location=1373..2375; Strand=+; Gene=SeqID_83681
taatggaacccccgcctcctcccggcccttacccgcttagtaaaattaagcgtttacccacttgccaaattaaccaataattgcccatttgatttcttttattatgatgctatgtcatgttttggtgaattaattattgatgataaatactgctgattatttaacaattaaaaaattaacctataattaatatttgagtaaaaaaaagattaattggtaattatttaaatgtttaagtggacttagctaaaagtcttttggtaacatattttgcaataaaagttgaaaattcggttatccttgtagtcctatgttaatcttttattaaaaattttaaattattcttttataaatattttgttttataaaacttttggaaatttagtaatttctaaattttttgattaattattaagatgctgtaccttcttattttgaacatttttataaatcatcggtttttaatttattaatgtttttgttttttttaaatgctaattctttttaacttattttttaaatcaatgataataaatttgttctttaaaaatggaacttgttgattattgttaagtattaaaaaagtaaatttaaacaaatatgaattttttaatattttgaatgctttttttgaattaaatctcaaaaatgaataatatttctttcttaacatgtacacttttgctaataaaatgtgttatttattattattagcaaagttcccaaaataaatcagctttttaaaagttttttgctgtttatttttgaaattatgattgttttaaaattgggcattgtgtaaaaacattactatttaaaaatctgatataaacaaacttttggctttcttattaggttgtacacttatttttcttggaagtttaatttttttcattaaagatggtgcgtcaaatgtaaacgaatgctttgtccttgaaagaacgacaacaatgagaaatgttatgcgcaatacgagggagaaatttgtgaactacggtttatg

SEQ ID NO: 98520 - DNA, 769 bp, Heterodera glycines
  misc_feature (62)..(62): n is a, c, g, or t
  Promoter: Source sequence=SeqID_7015; Location=1..769; Strand=+; Gene= SeqID_63574
aaaaatataatcatatgcatatatcaaagtccactgaaaaatgtaaaactccacatgaaaanataaataaataattatcatttcgagactaccattgtcatcgcatatgtcaaattagccgactggcattaatccctactttgacttaattgaaaaatttaggattggaattttccaaaattaagtgacaaaaaattaaagacgcatcttcaaatattaaaatattatttgttagttctttcggtgctgtaagttttctacagtaaaattttgttttcaaaacttgttctaaatgataagtgttgttgacttttttcaaaattaaaataatatgatttttgaattctgccacaaatcctgcaggtttgcatcttggcattaaaacccccgcattttcctaaagcgattcgggaattgtatcttttttttttgcaaaaaacctaggattaatttttccaaaattaagttacatttcaaggcaggctcgaaagtcagctggtatacacttgtcatagatgtcggttcaaaatcggcctgccaaattgttttttccttaaagtcaaaagcttccccaactccttcatatactcaatggtactcaaatggctgccctccttattttgtctgcccaattgtctatcttcaatcgcccacccataaacactctcgcatttgccctcttccattctatttattgactgaaatttgttaaaacttggtcccggcgaagaacatagcgaaaaatggtgagacttaaatcttattaatg

SEQ ID NO: 98521 - DNA, 138 bp, Heterodera glycines
  Promoter: Source sequence=SeqID_21049; Location=1..138; Strand=+; Gene=SeqID_51636
aatttagggacaaaactctaggcggaggcagctctgtccctctggtcagatcagatgagatggctctttgtgagcatcctggtctatggccagccgagtaatgccatagaattgtggaacaagtacaaagaccaaatg

SEQ ID NO: 98522 - DNA, 728 bp, Heterodera glycines
  Promoter: Source sequence=SeqID_1542; Location=830..1557; Strand=+; Gene=SeqID_74339
ggtgtgtgagtttttgcataatacattttggcatcgattttttgtatacaatatgtaaatgcgggattttttgtatacaatatgtaaatatggagataagagacataaaccaaaaaatcgaagattaaaaccgaaggaaagaaagaaaactgcaaaagactgagataaggattggaagaaaacggccgttattgagaatgattaagaaaaaaaatcttttgtcattgtaaatttcgaccagaaaataggtatgtactgtctgtatacatacacaccaagatccgctccccatgtttcgagaaattgcttggtatcaataacagaccaaagggttcggaaattatttcgtttatcggaaatcaatataatcgtaatacatacgctacatatttttccggaaaattgaaccgccgttagtttaaactttgtgtttagttggttggggcccttaaacgataaaaattgatgaaacccgagtccgccattggcttaattcaaaatgattatttatcaattaaaaatttggctttccgtcactatagccacgcagaaacaaattggtgttggtgtgagctaatgagctgttggatttggttctatctgacttttgctgaacaaaaccctttgttttcaattaccggttcgggtacaaattactaaatttactttttaacaaattttcttgtttattcaaggaaattcagccaacttttgcatcaaaagtgatg

SEQ ID NO: 98523 - DNA, 113 bp, Heterodera glycines
  Promoter: Source sequence=SeqID_33819; Location=1..113; Strand=+; Gene=SeqID_63760
ggggcggggcggtgggcgatcagttcaatttgggtaatgggcaaacgctgaaggcatttccacgcaccgccgctcatttggaagtgcgacgcggcgaattggtggaacaaatg

SEQ ID NO: 98524 - DNA, 1003 bp, Heterodera glycines
  Promoter: Source sequence=SeqID_10437; Location=1031..2033; Strand=-; Gene=SeqID_73635
ttgtgcgattaaaatttaaaatttttaagccttttggccgctgttccatgccgcgcctttggtttggcaccgaaaagccccaccagcagcagagggagaaaatgtgtgtaattgtgaacaacctgagatttttattttatttggaaaataattcattttgtctctgccacgtaaaccccattttggcggatcgtagccatttttgctcttcagcaagcattcaattttaaaatcacaaaacaattttttgtctgcttatctcatttttgatcaaaagaatctgcacacatcgtttaagtgatatgttgttcaaaagggatgggaaagtggaggagaaaagggatggaaatgggggaatgaagcgggacaactcggctcggccgctttggtcccagccaagttcaggcgattgatcatacgatccttctcaacgttggccaaatgtattggatttggctgggaccgagttttgcgagactgagttgtgccaacctcggtgggaaatgttacttgtaatggttacctaagtgtgatttttgttcgttgttttaaagatggataatgcggaggaagggaggaggggagcggggtggaaattccgtcgggggtaggagtgatggcaaatttaaatgtcgaacgaatgagtgttagtcatttttatttgctgtgggatatttgtttttttttaagaaaattggaaaccaatttattaatttttgaattccaattttggccgtgcactttcaatttccaatggcacaacaaccgcaacaggagggggacaaaaaattctatgtaagtttttttagagttcaattattaataattttgaaatgccattgtaaagcagtctcataattactttcccaccaccataaatattatttataacttttggggtcaattatttttgtcatgccaattggatatgaatctctcggccctgcgctcaaaaaaagaaactttcaagggaaacatgccaaaacattaccaaaaaaaaatg

SEQ ID NO: 98525 - DNA, 238 bp, Heterodera glycines
  misc_feature (29)..(29): n is a, c, g, or t
  Promoter: Source sequence=SeqID_43771; Location=900..1137; Strand=-; Gene=SeqID_71366
cattaatcatgagacaagagatttatttnttgaaaaaaaacagttaatgagcttatgctgaattacgctaaaataaatcgttagtaaaattatgaatacttttgataccaaaacaaaagattaaaatttataacttacaaaattttatttatagaaaaagcatctaacacattaataattaatattatttattcattaaaaagtaacataaatcagggctcccatccgtcattgaatg

SEQ ID NO: 98526 - DNA, 77 bp, Heterodera glycines
  Promoter: Source sequence=SeqID_16556; Location=1972..2048; Strand=-; Gene=SeqID_80964
cccctcaggtttttattcgatttgaaaaattgttttaaccaagccagccacttattttcaatggtggtggctggatg

SEQ ID NO: 98527 - DNA, 960 bp, Heterodera glycines
  Promoter: Source sequence=SeqID_14896; Location=700..1659; Strand=-; Gene=SeqID_79059
tcggttcaaaaaacgggtttatacttggtcggatcaaccttcccccaccccttagatcgatctgtcttcaccgagagcttttcgatttggtaaccatattcttggggattgggccgcgagaaaaaaaccccgtataagtcaagatattcttttttctcaaatcttccagatattttgtccaaattcttctgttgttatgcttcggatggcctttccatacacaattattcatgcgcaagctgatgtatgtttaaattacatatttttgcattgtttatggtcaattagtcaatttcacgtatttatttatatctttcaatctcaacctctacgatactattcttgtcaataattcagttccagaaaatgaacttggatttgcttattttcgatcatcgatccagaattcaaagaaaaattgatttttttccaaagaatatttttctggggaaaagttcgaatcatttacctaaaactttattttgatgcaaaacaatacttaagttattaaaagtgaataaaaagtacgcaatttgcgcaaaaatttggtcgattttaacgcgtgttttgaaaaaaaataattttttgctggaattcgggtttggggtttggaattgggcaaatctaagtttagattcgtaataagcaccctcgaaaacccccggaaactgattatgagcccaaaatgaatagaaaaaatgtggcgattaaatgttatttttccgaataatgaaaatattagatagtacgctaaaaggagaggaaaaattagagaaaaaatgctttttgttttctctgatttcgtttttgggatggtgtgaacaatgagtgtgatcattgatcaatttgtttgtttgtttattcattcgttccttttcttatgtattttttcggctttacgcatataaagaaattgaaaatttctctaaaattgttttgtgcaaatgttttctaaaaatg

SEQ ID NO: 98528 - DNA, 117 bp, Heterodera glycines
  Promoter: Source sequence=SeqID_1328; Location=2705..2821; Strand=+; Gene=SeqID_72716
cgatcaatgagaatgaattttcatttttcatttacaaacaattgtttgtatcattttattgatccatttgtttccttaagttttttgtaattttttatatgcacagattgaaaaatg

SEQ ID NO: 98529 - DNA, 110 bp, Heterodera glycines
  Promoter: Source sequence=SeqID_9771; Location=2756..2865; Strand=-; Gene=SeqID_72643
ggtaaaagtgtattttcccgctagaaatatccattggcattggcaaatttctcattattccgtaggatttacggacggtgtccaagaccaattcgttatgggctcacatg

SEQ ID NO: 98530 - DNA, 710 bp, Heterodera glycines
  Promoter: Source sequence=SeqID_29335; Location=423..1132; Strand=-; Gene=SeqID_59847
aataaaagtcccggtttttgttcacaaacacaaaaaaaagtgtttttccttctatttagagcaaggagaagccaggaaaaaaatatgtatttacataaaattggcagccctagtaattagttaatggaaaattaaatgtaattaatggatgggaaatgaatttttaaacttattttacattagtcattctgttattgacaaattcgttttctttctttcctatttctcatcaattagcacaattatttagtaaaatttcacttattttttgatttatggctgcacatttaaaaaataataattgggcaagatggtgcgaacaaaaactaatgcattaaaaaaattcacattctatttcataattgttttaatttaattacttcctgggcccttagaaaaagaacgagttacgggtaaggttactctcagctgcgggtaaccttacccgttacccgtagtaaaagagcaaccccgagttgggggtaaggttatccgggtaacctaacccctcgctgcggggcatttacaaaatatttatgtgttaaaaaccgggaatatttttgggtcaacagcaacaccagcagagcttgagtgggtcagttcaatgggtttgaaatcccgaattaggggtgtatttttacaaaattttagctgttttttaccaaaaatattgactttttctaaatttggtctacttctttttaaatatg

SEQ ID NO: 98531 - DNA, 197 bp, Heterodera glycines
  Promoter: Source sequence=SeqID_30093; Location=505..701; Strand=+; Gene=SeqID_60536
aaatattggagttcagctttttccgcgtcaactcgattttttccttgacgcctaccgcaaggcaaccgcccgcccctatggctatttgctaatcgatatgcacgcatcatctgatccggcgcttcgcctccgcaccaacatatttaaagaggagcaggaggaggacgagggaacagttgtgttcatccccaaaaatg

SEQ ID NO: 98532 - DNA, 597 bp, Heterodera glycines
  Promoter: Source sequence=SeqID_45562; Location=495..1091; Strand=-; Gene=SeqID_72835
taagcctaaaatttttggcaagtttaaaaagcaattaaaaatttttagattatttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacgttttgtgcgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatg

SEQ ID NO: 98533 - DNA, 164 bp, Heterodera glycines
  Promoter: Source sequence=SeqID_4167; Location=3264..3427; Strand=-; Gene=SeqID_45734
agtaagtatttatgtttaccaaatatgctacaacatttcctcgtcctttataaaatttcctaaatcccgaccggtttttaaatcaacactctaactttatgcattctcaggttttcattggacatgttgatgccggcaaatcaacaattggaggccaattaatg

SEQ ID NO: 98534 - DNA, 173 bp, Heterodera glycines
  Promoter: Source sequence=SeqID_19497; Location=1627..1799; Strand=-; Gene=SeqID_84214
aagtggaaacagcctacgtggtggacgaccctctgacggccttcaccaagtggctcctgcacttcgaagccgatgtcctcggcatcgaccctgcggagaagcgccgcaaacggaagcgtggtgacaacaacaacaacggtcggaatcctgctgcaaatgccttcctcgacatg

SEQ ID NO: 98535 - DNA, 369 bp, Heterodera glycines
  Promoter: Source sequence=SeqID_38177; Location=427..795; Strand=+; Gene=SeqID_67072
gctgaactaacaaagaaaaatggaaatggcaaaacattggtggacacaaaaagggggtttcctgttctgggaaaccaaaatttaaaaaataaaaaaaccaacaaaagaccgcgcagaaacaataataatttggaggcaaaaatgccaaaaatgaaccaagattaaaattgtcttttttaatttgtcgaaaattttttatttttgcacgggccttttgttggcttttttatattttaaattgtgacccaaaacagtaaagtatccaaaaaagtacaattatcagccaaatttctgctaaaaaaaattggatttaaaaaagcacacccacctatttttatccacattcagcatgtgtttgaattcctcatg

SEQ ID NO: 98536 - DNA, 76 bp, Heterodera glycines
  Promoter: Source sequence=SeqID_44738; Location=1..76; Strand=+; Gene= SeqID_72178
caaaaaaacccccctattttttcatcagattgccctaatgggcgctgtggtcggtcctgtcgatttacaccaaatg

SEQ ID NO: 98537 - DNA, 344 bp, Heterodera glycines
  Promoter: Source sequence=SeqID_15164; Location=1..344; Strand=+; Gene=SeqID_79362
tcccgggatggaaattttgggcaaataaaccccgtgaaagaacaaaatcgttactctcagagtaaccaagtcgaccccaacatcgataatcggcgcagaccattaaaagtctcgacaatttctcgtactcaacgacgctacaccattcgccagagctaagaggaaacgccggagcggacgaagtgaacgccttttttcgccagtcggacgcagttagcgaagattggcccaacgaaaagcgcttaagcgcattaaaatcgaaatgttcgggtagggcagaacgcgcatacaattccgccgttgccaataatcccttccggtatgaaaatatccgaagagcgatg

SEQ ID NO: 98538 - DNA, 91 bp, Heterodera glycines
  Promoter: Source sequence=SeqID_39798; Location=900..990; Strand=+; Gene=SeqID_68281
ttttgagagctggaattaccgcggctgctggcaccagacttgccctctcatagatactcgttaaagggtttaaattgtacccattccgatg

SEQ ID NO: 98539 - DNA, 361 bp, Heterodera glycines
  Promoter: Source sequence=SeqID_5727; Location=378..738; Strand=-; Gene=SeqID_59046
tctccaacttttaataatttcccttcttattttttttagtaattggttaatcaaatagactgaagtaatacataaacagcattcattgaccataaatattctgtgaattcctagaattgtatagttgtaacatctgtatcttaatttgcgccttttagacagccataaaattcatctcatttttttctggtttcttgattcataaagtttacttaggattatatatcaatcatatcgaatgaatctaaaaagatattatggttttatttttgtttgggtaaactatatcaaatcgaattttcatggtccatttccaatctacgttatctattacttaagcttattgttttaatttaaaatg

SEQ ID NO: 98540 - DNA, 286 bp, Heterodera glycines
  Promoter: Source sequence=SeqID_9153; Location=1622..1907; Strand=-; Gene=SeqID_46704
ttccttttaaatattagcggagtgagtaatgtaacagcggacttcctgaaaataatttttacattttttggtgattttttattatttgatttgaaaaagggtttttttgaaaaacgtgaaaacccttccattgtacggaagacgaaggatactcataatttttttgttataccaaaacaccaacaaaaaaagtttggtttaaaaaaaattcgaattttagtttagctaatcgtcttaacaagaacacctaatgaatttttttaggtttatttgtttactggaaatg

SEQ ID NO: 98541 - DNA, 124 bp, Heterodera glycines
  Promoter: Source sequence=SeqID_16023; Location=1..124; Strand=+; Gene=SeqID_80379
ggggacctctagagtcttggtcacattgtaccaacatctgagagaccaacaagtgctccatcaggtgcatttgaattattttccatggaaataatagaaatatcctgtcaaggctcaacaaatg

SEQ ID NO: 98542 - DNA, 78 bp, Heterodera glycines
  Promoter: Source sequence=SeqID_34381; Location=1..78; Strand=+; Gene= SeqID_64190
acaatggcatgaaaagtgatcagggcaaagtcaaacaattctttgaaaagtgatcggacaaagccaaacaatggcatg

SEQ ID NO: 98543 - DNA, 805 bp, Heterodera glycines
  Promoter: Source sequence=SeqID_7783; Location=2365..3169; Strand=+; Gene=SeqID_65947
atttgtaaattccaatcgctttgcaaataaatgagtgaatgaaaggtcgaatatcaaaaagcgacgtaaaaaattggcggaaattgtgctgactgatcagccctcccctcaacgaatggcatggcgagagacgtccaaggtgccaagaaaggtcaaaattataatcggtgcagcagattaggcacttctcagggtttgcaaatgctgatgcgaatttcgaatttcggcattggcggttgttttttgctgagtcataggcaggcaggcacaatgaacatgattgccgtccgagagggcaatcgaggtggttggcaccggtgccatttgtaaattgtatttcgttcgggataacattagggattttttggagaaaaattaaagaaattcaaaaaaaaccgaaaaatcgaaataaaccgaaaaattttcttcggttttttcgatttcggttttttcggttttttaaccgaaaccgttcgaccgaccctcttgtccggtctttacaagaaattccttttaaatttgtgatttaaccatttttttgttcatttttccttgagaaaatgttttttttattaaaaaattatttttcgtccatattttcgtcttttggcatttttgttaactaaaaacccgtatcctattctagctattgttttatataaattcttttaatttctaatgattatttcatcttttattataatccattttaccattattttatataaatgttacaaaatttgctgacggattgtccggaagccttcctaaatccaacaggacattccaattaagataaaaaatg

SEQ ID NO: 98544 - DNA, 987 bp, Heterodera glycines
  Promoter: Source sequence=SeqID_5190; Location=1..987; Strand=+; Gene= SeqID_57217
tcaatttaagaagcttcaaattggataaaggaaagaataaaatccgctttaaaatgttttttttttgataatatacgttttaaataaaaaaaaaattactttttaaaataaaaaaagctttttggcttttttagttttgtagaatttgacaaaaatcttcagcagttattgcgtcccagtaatggatgttccaataatatatttcaattttattttttaaatcaaccaaaaaagcaaaatattttaaaattatatattaatttgagctaacaagggggctgaataagctaataaccaaaacaaatgtactacgtctattttatttagttgggaacggattttcagttgctaaaccccaaaataactaaaataattgcgaaaaatagaatagaaaatgcaaaaagttcaaactaaacatttttctctaaaaaagtactaaaatatgcttcaaaattattctcattataaatagatttgctaaatttttatatggaaaatcatttgaccttatcttaacatcttttacagaaaaaaaaaccgtattttgccccatttatgctctacataatttcaataatttcgataaatttcgataagattcataaaagttatgtccagaagaattcaaatatctcaaattttacaactttttttggctcgaactttttttgaacttgtcgagattttttggaattttgcaggctaatagagcatctaaagagctttcgaatgataccaacaatgttggatttggttggcaaagaaaaaagttatagtccaaaaacatgtgttcgtacgataacggcctgacccctttaattttactttattatgcttatgttcctaatttcaaattaaaaaactaatgatttttttgtaaaatgatgccaataattttatttcaatgaagtacaaattaaaataatgactaaaattttttgtatttagtacaaaaaacaattaataaactcttgtacttagtcaatg

SEQ ID NO: 98545 - DNA, 156 bp, Heterodera glycines
  Promoter: Source sequence=SeqID_16661; Location=1..156; Strand=+; Gene=SeqID_81068
taggaatttgccacacattaatgaaaacagaaaaggtgaataaaatggagcttttaaagtttctttgcagtttttcaaaagaatgcttggtataccgtcaatagaagtattgtttttatccttaagtttacataatgaaaaataattttcagcatg

SEQ ID NO: 98546 - DNA, 149 bp, Heterodera glycines
  Promoter: Source sequence=SeqID_11187; Location=665..813; Strand=+; Gene=SeqID_74539
tttcatcagttttagttttttacttaagtttattcccacaacttccaaaagaaagacaacaagcaattcttaaggaggatgtcgccgcatttgcgaaaggtttcatcaaaaaaaaattaaataaaaaaagggatttagcgttcgaaatg

SEQ ID NO: 98547 - DNA, 356 bp, Heterodera glycines
  misc_feature (40)..(40): n is a, c, g, or t
  misc_feature (116)..(116): n is a, c, g, or t
  Promoter: Source sequence=SeqID_30474; Location=1..356; Strand=+; Gene=SeqID_60879
cgccgatgctgtttttaatgattaatttaaaaaatctcanatatataaatattcatgaaagattacaatttactcctttaattgaagctgtatagttaataattgcaataatatgnaaagaatatattgattaagttttaatttatataagatacaatttttgcatttactagaaaattcataattcatatttttgtcagctaccaattctgtcggagaggttgtaaagaagacctttggacgaatgattgttgtatgcaataataattattgatctgaattatttttgcttaaaaaacttctaattaatgaacaaaaataataataaaaaaaattattagtatcgcaaaatgatg

SEQ ID NO: 98548 - DNA, 1003 bp, Heterodera glycines
  Promoter: Source sequence=SeqID_15380; Location=649..1651; Strand=+; Gene=SeqID_79636
cgcatccctcactttatgacgtgccaaagtttttagttttttataattaaagaaaaggaacaactatttcctttcttcaaagaaattgttagtgtagaggtaattcgttagtcaaaattttttttgggtcaaaagttcgaatcccctatgtgtaaattcattttgtaatttttatttttgctttttgtgagcaattcaattatcaaattttatttctttatcaaaatatttattttaattttattccattaaaaatcaaaaattgcattaaacattccaatgcgaaattatacacattaaattactttttaaaaaaccaattcaaattataaatatatatcgtccaccgaattgtaccgttcagaatactaaaaagctattcaaatttatttcggatcaaagcgattccgaaaatatcatatactgtggggattttaacatcccaaacattttatgggatgaaaataaggtaaaacatataaatgatcctatgtcaaatatgctgattgagtttatgaaccaaaaacaattgaaacagcatgttaaagaaccgaccagagaaaatacgattttagacttagtaatgactagcgaatcagaattaattaatgaattaattgtattggaacatttttcaacttccgatcataaaatggtcggatttcaaaaaagaaaaattccggcgtaataatcccagtgtttatagaagagattttaaaaatattaatttttcgaaattaagtcgggcgattcttgaaaatcgtattgatttatcaataaactcagtgtacaccgttgatcaaaaatataaagaattcttaaataaagtactgaaattatatgatacttttataccaaatagacctcatcgataataaaacaatcgtatcctcaaaaaataagagatttattttcagagaaattactgttacataagcttgtaagaaaatttcctgaaaaaagtgaaatcattttaaattacaaaattatttctagggaaatg

SEQ ID NO: 98549 - DNA, 190 bp, Heterodera glycines
  misc_feature (48)..(48): n is a, c, g, or t
  misc_feature (55)..(56): n is a, c, g, or t
  Promoter: Source sequence=SeqID_4296; Location=2054..2243; Strand=-; Gene=SeqID_53937
gctaatttgtctattcagctgctaattggtgttcctctcataagttgnggttttnnaatggaattgaggagaattaccatgacacccccaaaatgggcactcccctgaaaagtgtggacagtgccgtggactcaatggaggtttcctcgagatttgctcggtgattttgcaacgaatgaaaatctcaatg

SEQ ID NO: 98550 - DNA, 556 bp, Heterodera glycines
  Promoter: Source sequence=SeqID_6095; Location=161..716; Strand=+; Gene=SeqID_60315
tttcgccctaccatgaaagaatttttataaaaaaataaaaaatagaaatttttctagtgattttcccaggtttatggcgaactacttttctaaaaaaattaaaaacgtatttttctgattttcaaagagaaatccttgtttttcgtacctaaaagaagtttttaacttcttttcaaaaattatatgcaaacaaataacaatttcaaaagaccaataaatccatttccaccctatcagcaccaccggcttcttttgatcccaagtgcactaaaaaaaattatgatttgcttatttcctacccaaaattgttaaaatcgataataggaggtgaaaatataatatttaaatttattttttatcgaattaattgtataaataactgtttggaagcaatttcgcaaaatgttcttatttttttacccatcttattttttggcccttgatgttcttatttgaaaaatttcagatcacatccctctgatttatccccctcccttccactacatttaagccgttcatttttcgtcttcaccacggcgaagtgatcgccggaatg

SEQ ID NO: 98551 - DNA, 1003 bp, Heterodera glycines
  Promoter: Source sequence=SeqID_1248; Location=7029..8031; Strand=-; Gene=SeqID_70716
atgctctacaagtttacaacaaaatctcagaaaatttcattaagtttcaaaaacgttatggctatatgaactcaataaaccttgttttctactttattttcatttgtatttgaatttaatttttaattttatttaatttaatttccttgtgacaatgtggggtatgatcaaagatgttcaaacctacggagtttatcagaaactctatccaattcatatggatcggaactgttccaccctttggggaagagaataattgaattgataggataaatattagttaaataaaaggtccgtcctttgttgtccctctaatttccgttggaaatgtccagctcctctcctaaaggccattttacctgtcaacgcggcacaaaaggacagtttaaccgtgcaccgtttagcctttgcattatacccgcaccattttcaaaaattttgattgttttaattgtttatttctctgagatttatctttatattttatttttattaatcttttatttagtttaaatcctaccataattttaatcttattttaatattattttaattaatcctattttgaattttatttaattttaatctttttaattaattttatttaattttaattataatcctattttgattttaattttcttaagttattttttatttggattaatttgaaattttatttcaacattaaattaacctgaattttaatcgctcaaattatcacaagcgggctctcaaatggcccctgcgtgtgctcaaattgcacacgcgagcgctcagatggcctggcgttccttcccctcccccatgggcacgacagctgactccctccccttcgcctccctttcccttctccaataggatttggctttgggttttatttatttttaattacatttatttattttaatttaatttttaatcttatttattattttaatttttcttaattttaatttttatttgaattaattcttttaattaataataaaattaatagatg

SEQ ID NO: 98552 - DNA, 86 bp, Heterodera glycines
  Promoter: Source sequence=SeqID_3667; Location=1..86; Strand=+; Gene =SeqID_51362
ttataaatacaattataagataataccccttaagaattatttcaaaaaaaatttttttgttcagaaataattttgctgaagaaatg

SEQ ID NO: 98553 - DNA, 820 bp, Heterodera glycines
  Promoter: Source sequence=SeqID_35348; Location=331..1150; Strand=-; Gene=SeqID_64921
tctgctggaagacagttttaaaaagccagaattgtttgtgagtattactgaagtagttaaaatcaattaaaaatgacgcttttgcgtgtaagcatcaaattaacacttttttttatattaaaaatagggatcaaaaaattaaagtaaaaatacagcttacgcttacatacatttgttgtactcacaaatgaaaattacattgacaactggcacatagcagaattgcaattcgtcattaactaacaaaaaaatatgtattgcaattcgcacctttcttttccttagagtccaacgactaataaaaggcagcggtagatctaataaacagcaacagcgaaatggtatgcacatacacacggaaaggaggagaggagagggattaagattaataaaagaacagagagagttaatacgatcaaactaatgaaaatgactcctcagaatttatgaagtccagtgcaaagccctctaaagaatatagattaaaaagtatccaccttattgtgtatcgttagattacatgggtgggtctccgatatttcgactaaaactcaaatggtacgattttgactcattttggaaagcctaaaagcaaaacacataaatttgttgtgacatttgtcatttaaatcaaattcattaattaatgaataattaatgcttatgtatgtacatataggtatgtaattaattacgacgttcccatgtcatttggaatttgcccactgtttaattgaaatgcatttcataggaatccattaaattgttaatcgattaattatcaacgcatctttttttttaggacaaggccttaagtatg

SEQ ID NO: 98554 - DNA, 144 bp, Heterodera glycines
  misc_feature (19)..(19): n is a, c, g, or t
  misc_feature (39)..(39): n is a, c, g, or t
  misc_feature (72)..(72): n is a, c, g, or t
  Promoter: Source sequence=SeqID_7663; Location=1..144; Strand=+; Gene= SeqID_65547
aatgggtcaacaacttcanagaggtgtctcgccatgttntcgtcaaattgtttttttaccaatttttgtgtntagaaatttctccgtgccaccacttcagtcagttacaaaattaaacttttcatttatatgacgccaacaatg

SEQ ID NO: 98555 - DNA, 126 bp, Heterodera glycines
  Promoter: Source sequence=SeqID_1558; Location=671..796; Strand=-; Gene=SeqID_74448
ttttccccatttagcaaatttctcaatcggattttggacgtccataaagccgaccaaagccccgccaccgtaacggagcagccaaaacttgagccgactgaacagtttgatgctgacctgaacatg

SEQ ID NO: 98556 - DNA, 379 bp, Heterodera glycines
  misc_feature (50)..(50): n is a, c, g, or t
  Promoter: Source sequence=SeqID_23228; Location=1..379; Strand=+; Gene=SeqID_53941
ttttggatgatgtttttgatagtattataaaataaaaattttcacttctnttctctttttttgatagtggtttcgaccctataatatttgtatgataattttctaaatgattaggtttttaagagtaatgcaatcggttggtcttttgagtgggtattttcaaaaagcgtttaaaaaggtatgtgcgcaactaagtttttataatatacttttttaggaattttttctgtgaattaaatgacgatcaaattaaaaaaaattggaaagtctggaaaactataccgtggctgtttacgttgagagcaatttcccctatgcacaatggctcacagaaatcaaagattatttgttttcttttgtatattacgaaagaaatatg

SEQ ID NO: 98557 - DNA, 275 bp, Heterodera glycines
  Promoter: Source sequence=SeqID_23628; Location=1..275; Strand=+; Gene=SeqID_54327
aatttaattttaattttaaatttactttattttttagttttgaaattgctgacaatcaaagttctatcgccgtaaaatatttctattggatttcattccgcgataatgttaaagtacgccacgcctgtaatggtggggaggtagtatttggtggactaaaggttgactgtatcataggggcacaaaaaaaaattatcgaattccacggctgtgcatttcacggacatccaaaatgttataggcctcagacggtcggaccaaacggtaagaccatg

SEQ ID NO: 98558 - DNA, 1003 bp, Heterodera glycines
  Promoter: Source sequence=SeqID_5365; Location=2903..3905; Strand=-; Gene=SeqID_57797
tccaactgttaagcagtgatccaatttggtgaagcattgcaacaaatcgttcattcccaattggacaccgttacaaaaggccaaattcaaacaaaagggcaacggcgcatttcgaattcgaatgaattcaaaattttccgacaaattttagaatcaattgaagacaaagaaaattgtgcaagaattcggaattatttgcaaaaatttaacaaaaaattgtcatttgccgagaaaatctctgcattggaagaactggtcaatattttgggccaaatcattcgagattataaaggttgcacaaagaaggcgtggccggatgtcgtggggggaaatttttttcagaatttaatgggttttttcgaattattaaatttaaatttttttcaccgaaagataaacggaaatctggaaaattggagagagacctgccaaataatattaaaataaaatataagataaagacactagggatcgagaccaagatagacgagcattttgtcgagtcgagacttgacagcgagactatagaccttcaatagagaacacatgagacaaaaattagatgctttatagtaaacaatatagagcttattatagatttgaatactagaaaatatgtgaaatgccgcctacttttatttaaattgcattactttattttattagtaataaaattttaaattttttgtaataaattttacatagaattaatagaaatataaaatcagatatgttttaatcaatataattgaatttcctttgtgtttctccagaaaaagaaagtgaatataatagcgattagttttcttaaatatttattttctttttaggatttttttttactttttttttgtaatttatgtcccttaattaaaacgctgattatttattattacttatgttatttttgaacaaattttgtgtctttcttccattaattttatatttgacgaaagaaacatgttcagaaaaattaaaaattcgcgttatttacgagacgatg

SEQ ID NO: 98559 - DNA, 610 bp, Heterodera glycines
  Promoter: Source sequence=SeqID_13845; Location=3466..4075; Strand=-; Gene=SeqID_77786
tctgaaaatgttagagaaaagtgaagggcagatcccttggatatgtttacctttaattaattaattaattagcgacaagtcacaggaaaatggccagccagctaaagtacagtatggaatattgttaaagattaaaaaacaaattcttttaaaaattgattacttaaaattggtcaaaatacttaatattcatattaaaattttaagttaaaataaataaattataaatacaatatgcttgactcattcattttttaatgatttaaaaaatatttttattttctttttaatgtaccaaaatttagctatgagtttgagtaataagtgatcgaaaccactttttataaccatatagttttccagtcaatttaaattaatttattttttgccaaacttttttaaaattaattttcctcttatccttaatgattaaatttttgcgtttatggcatggtgaggaaccaaatataactcacggcaattgttttccgtccaattcctagggctatagctgtgacacgccaaacagattaggcgctgtgcccggttgctaattaattaattaattaacggtcattaacagcaactgttgctgcacactggcaaaatg

SEQ ID NO: 98560 - DNA, 184 bp, Heterodera glycines
  Promoter: Source sequence=SeqID_3454; Location=1..184; Strand=+; Gene= SeqID_84741
actgtacattttgatcatgcttattctcggcattatcaaagtgacaaaaaaaatcgggtgtgtgtttttattttttggctcggaaataaaaaagcaattttaaaatgattttttagtcgcatttgttaatgatcaccgaaattcgtcaaatgtgacgagacatgacgaatcatcagcggcgatg

SEQ ID NO: 98561 - DNA, 1003 bp, Heterodera glycines
  Promoter: Source sequence=SeqID_11911; Location=1309..2311; Strand=-; Gene=SeqID_75424
gatattacccacagagatggcacggaattccgacatttttggggtcggaattacgatttccaaaaacattttggacaatcatcggaattccgaaatttttgataaaattggaatttttaaaaaaaaaatttttttgaaattccggttgttttcgaggtcgctgatcacgaatctgactcattttgactaattccgaattcgaatagaaatcaaaatcatttaaaaactgttgctacaattttcaagggcttcggcgaaccgaaaataattgtcgaacgcaaatcggaagaatttccattgcccgaccgtccgctgcccagcaaaattcactttaaggaccttcacattcggtattcaaaaacaaaaaagcatataagcaattgaaatgggtaataatagtacagatggtaccccctcccccaacccttttcgaaaaaatgaaaattttttccgaaataaaattattttatggcttttcagggtcggaaattcggattctgacattgatttcgaccaaatttgaacccagaatccttgattcgaacaaaaattcgaaaaatcagatcggaaaaaacctataatgtgtttttatagtttttgatatcagtgccaataatcattagtaggtttgtaagttgaatgcactaaaaaatgccaaataaccctaaaaagccgagaaatccttcaaatatgcccaaaaaactcgaaaaatgcccaaatatgcactaaaatatgctttaaaaactgccttgcactaaagaccttcaccaaatcaaaaaatttaacgtagaaatgctatttttgagcccctttcttaaaatttggaaaatcatagtatttacaaccctaattatcattagtaaattttgttaagtaccatccgtactattagcctaaacattatccgctcccgcttttcagcaacatttgctctcctgtctgtgaatttctccgttccaatcggcacatttttgacaaaggcatcaatttgcgtttggatatg

SEQ ID NO: 98562 - DNA, 1003 bp, Heterodera glycines
  Promoter: Source sequence=SeqID_855; Location=744..1746; Strand=-; Gene=SeqID_62726
gataaatattggccaatcacataaaataataattccgctgcgctttgctctcgctcgccgattaactgcacactcaactgactctttatcgagagaatgctcccgattaaatagttggacttatggaacggaaaatgaaaatggaatagagcggagatatgtgcttgggaaagagattaaacggatatgattaattgcgctttacattattaagtatattcatttttgtacgaaagatttacaacagaattataaagttgattctttttaaaaggattttatttaagaattaattataaacaacaacttaactaaataagattattattattattattataacatcagttttaaaaaaatatcattaagaccatctttccataaaaactcataaattatttatattactctgggctattttaattataattaaattttgaattaaaaatataaaaaattatatagtcttttcgtaaatattctttgatcatatcatctatattttttatatatcatgtttgatattatgcgtttgtaagcaaatatttatatattctatgatcgattttttgaatttgtttggccaatttcattattgtttgagttgaaaatttatttcatgtgatattaaagctactgtctatttttttcttgaaaacaccggctaatttttaatggcaatgaagtgcttattactttatatatatattttttttgcattataatatctaaaacataacattgataaaagttattttagcatgagagtatcacgttggacattttttgcaaattaaaaatatttaaatactttattcatttaaataattattgattatttttccacaaattcagttctttcaatgttacatatttatgtccaaatttatgggatgaatttaaatataactagagtcatctaattagaatttttaaaaattttaataaagcactttaattctaaaaagaaaatttaatttaattgtgcaattaagtcaaaatg

SEQ ID NO: 98563 - DNA, 248 bp, Heterodera glycines
  Promoter: Source sequence=SeqID_28930; Location=180..427; Strand=+; Gene=SeqID_59498
taggcaaatataataaaaatataaaaacagactaataaattagtaaaaaatgtattaaagcaataaaaatttttaaatgtgaaattgtttttcttttttttggtgttctctttttgatgagaaaaacaggaaaagccaaaatgttaaaattcttctttattcttttggattctcttgaatttttatcaaatcattctttttttcaattctgatttttcctttcccttttaatgtttttagcataaatg

SEQ ID NO: 98564 - DNA, 403 bp, Heterodera glycines
  Promoter: Source sequence=SeqID_24627; Location=929..1331; Strand=-; Gene=SeqID_55366
ggggacgctttttatttgtttttttccatttttgggttaaaaaaaacattcattcgttaattcatggaatggttattaatatcctatttgtgtcggagaactttgattccatgatccgattgggtaagggaatcgtgtttccaaatactgtcatcttttttcaagggggagaaggttgggtcaaattgaatggtttgaggaaccttggcaaattcggtgtttttttggactcagttttagtttttttgttgttgttgacaatgtgttttacagggctgcacgcaattacggattttacggaaaaaatacggtgcttttttgggagttaaaattttactctattatcccccacataattaaaaggtatatataattaataaagtttttttcattccagcaaatg

SEQ ID NO: 98565 - DNA, 68 bp, Heterodera glycines
  Promoter: Source sequence=SeqID_17145; Location=1954..2021; Strand=-; Gene=SeqID_81582
tgtccgttttcctcatctaacttttgttctttgattgctcttcattttcagcgggcaatggtcaaatg

SEQ ID NO: 98566 - DNA, 1003 bp, Heterodera glycines
  Promoter: Source sequence=SeqID_113; Location=10603..11605; Strand=+; Gene=SeqID_71403
cctttgtctttaacatttttcaatattttgtgggccaaaattttgtaaaaatttctcctatgctaacttttgatgctgaacaaaaaaagtcttttacagcaacttgatcagatcacttcttcatgttgatctggacacccaaacaaaatacagtgaaaatcggggaaaagaaaagttgggaacagaaccaagaaacaaccaactggaccacgcaaaaaatttcgctaagtttcaaaaatatttttaaaaatatcgaatatgtcgcaaattttaaaaaatatttatttttattttgctcttaatgaaaatctgttaagaaatcgtgccaagggcatctatctgcccgctagcccaattcattcttggcacataccaggctgttgtgaatcgaaaaataaaatgcgaaatacgaaaattacgaaactaaaaaataaatacgaatacgaaacgccttaaaaacatgaaattctggattgagttttaaagatttatagggattttggcttcggaggtagagcccggaaatttcaaatttgcggatcccgctgcgggactggaactcaaaattttttgcgggacgggatcccgcgggattaatcccgcaaatcccgcaatcccgcaaatcccgcatttaaaatttgcaggatcccgtgcgggattgcgggattttggaaaattcgaaaaaatttcaattaaatttaaaaaatttccaaaaatcaaaaaatgctgaaaaataaatttttaggggctgtcgggatgcattaaaaggggctgatgggtcgactaaggtttttcgattggatccgacggtaaaaagttgatcggaaatcaaattattaacgttcataaatttgactattttttttttcttcaaaaccacttttttgcggtgcaagaaatcgggaatttttcaaaaaatatacaatataataaaaaaatttctaaatattttaataggctaaattttttaattcttaaccaagtaaaaggtatttcacaaatg

SEQ ID NO: 98567 - DNA, 76 bp, Heterodera glycines
  Promoter: Source sequence=SeqID_13751; Location=522..597; Strand=+; Gene=SeqID_77673
atttgtttaattgcccgcagcgatcattcagccgagcatcgaattgtacggggaggacgagaaccccttcggcatg

SEQ ID NO: 98568 - DNA, 1003 bp, Heterodera glycines
  Promoter: Source sequence=SeqID_12237; Location=413..1415; Strand=-; Gene=SeqID_75808
gaaccggccaaaaacaatcatgagattattattttttgttcatttatctattcattattaggtcacaattttgctgaaataaattgggaaattcaaattatgaatattctctatgggtcatcattttgccgcaatttattcttaattgactctaaaaataattaggcaaatcagcagaagaatgaatgctcatttcattattcgataccattttaacaaaataataagtcgggtccttaaatgtcaggtcctcatatgtcgggtagccaaattaatgcctgtttggccgaaatgctaatcgccgggttaatttgaaaagtgatccataccattccaacacaaaatttattttcacttaacttttgcattcctctaaataacaattaaacgattgattaaaaatttttaatgacctttgttataaattttacaataaaattcatcaatttttaaatatttggcaaaaaataaataaattttttcaaaaattattggccaaaattaataaaaaaaaaatccaaatttgaaaaataattttttcccttataaaaatacaattcttcggaatgtataactttcgccgacctcgactcaaggggtgagttcagtaatttttttatagacacattttcacaaaattaatcatttttgttgcaaagcaaaacgagtcgaaggcaaaaaaggaaacaaaggacaatcagaggagattttctctgattgtcctttacttggtttatatttttcatttttatttattcttttcattcatccattcaattattaggtcacaatttttaatggcaaatttaaatatgaataattcctatgggtcatcattttgcctcaatttattcttaattgaccctaaaaaatatttaaaaaatcagcagaaaaataaatgctcatttctttattctttgaaattttaacgaaataataattatatattaaaaaacatctgaaaatgatttaaggatttgaattttcaatacctttaaaaatg

SEQ ID NO: 98569 - DNA, 336 bp, Heterodera glycines
  misc_feature (42)..(42): n is a, c, g, or t
  Promoter: Source sequence=SeqID_10240; Location=1..336; Strand=+; Gene=SeqID_73386
tagaaatggatgtcagattcgtgatcagagacctcgaaaacnccagaaaaggcgttttacacgattttttaaatttttgtttttgtttcgcaaaatggcggggggggggagacaaagcacattattagcgacgacaactcagttcaaaaaatttcacgtaacacacttaaaattcataagagctaaaaacgaacatcatattcgtgtccagcgcacaaaattacacaagaaaatattatttttcaaaaaatttcgggggatgacaaaaagcccgaacataaatttattgaataattaaataaattaaaataataattattttaaatccaaagtatg

SEQ ID NO: 98570 - DNA, 395 bp, Heterodera glycines
  Promoter: Source sequence=SeqID_33515; Location=759..1153; Strand=-; Gene=SeqID_63556
atgcttctgttgttttttaagaaattttaccaactctttaaagaattacggaaaacggttttttagtaaaaattcgttgaaaatttttctctggcgatgcctatgacatattatttgaatttacttccccttaccccgcaaaaaacttttataagaaatttcaagaaaaaaattaaaatttattcaatgattttttcaaatttttaagaattcttaaattttttttttaaattttaccataaagaattataaaagttttaaccggttttttacttgcaatttttctcattaaattttctagttaaaattttttgagcacacccttcggggttccccttccgaattttttttctggccacgaacctgtgcagggttagaatttctaactaccaatg

SEQ ID NO: 98571 - DNA, 464 bp, Heterodera glycines
  Promoter: Source sequence=SeqID_10647; Location=1632..2095; Strand=-; Gene=SeqID_73885
tgcctgcaattagcgctacctagaagatgtatattaatgtctaattgaaaaaaataaaagataaagtgcgggagaggaaagtaaaacgttttgaatttatacgaagtcaagttgtccatccagttgtaagtgtattaggctacgagatcgctaaaatgttaatgagcaacaaataaatgagcggatttgaagacggaatgaaaaaaattctatttgacttcatttctctctacccttcgttaattttactacacactactcgattggtaaaccaatgtacatgtgctgaatgaataagtcgagttaaatacccggaagataaacactaccccttgacaatactcaaagttttggatgatttctttagaaaattcgatattctgttttgcccgtcaaagtgaatggtaggctctgattctctttatttatgaagtgcaccaaaaacaatcaaaaaaaaggaaatg

SEQ ID NO: 98572 - DNA, 999 bp, Heterodera glycines
  misc_feature (13)..(14): n is a, c, g, or t
  misc_feature (16)..(16): n is a, c, g, or t
  misc_feature (47)..(47): n is a, c, g, or t
  misc_feature (66)..(66): n is a, c, g, or t
  misc_feature (73)..(73): n is a, c, g, or t
  misc_feature (154)..(154): n is a, c, g, or t
  Promoter: Source sequence=SeqID_8194; Location=2911..3909; Strand=-; Gene=SeqID_67273
tttttttctaagnncngttataaacataaaaaaattgaattttctantttctttttaaatataganaacctantaaaaagtataattctgtatattttctcttttatagctttcgcatttataattgatccacaatgaagtaagttatgaattntaagaattttaaaccgaatacgattttgaagctatgagcattttgggaacaacatgtctccaaatttgccaaaaatttcaaaaaaaaaaatcgataaagccaaataacgaaaacacgcaaatttttgtgtttttttggggagtgtattttttaaaaatttccagaccgatccttaggggtgttttttcgcttctttttttttcatttttttcaatatatggaccaaaaatcttaaccaaaccaaatttttttttttagtctaagtagcatatgcgcaaaaaaccaaccctagcaatgagtaaaaaaagagtttaatgagtaaagagagatttgtttttgttctccggaattcaagactcgaaaattttttttttgccacttattcattcatttattcattcaattcaattcaattatacttgtattaaaaataaatatatataatatatatatatttttttttttgcctttttatttcacccattggaaaaatcagatgaatttatgttaatgaacacacaaagtgaacaaacagtcaccattgatcattttatgtccagaaaaatatttcactgatgttgactagcattcattagtaatctcatttggtcgcttttatgaattagaactaaaataacaaagaaaaataataatttttatcaaatttttggttctaatcacaccacaccaatccaaattttagtaaagggtgattaatgagaatttaaaaatgaatcgtccgttaaatcccttttaatgaaaaaaacttttcaattttctggttgctttacaaaacctttttagactgccaatcttggcattcaattgaaattgaaaaccaaatg

SEQ ID NO: 98573 - DNA, 1003 bp, Heterodera glycines
  Promoter: Source sequence=SeqID_11871; Location=651..1653; Strand=+; Gene=SeqID_75369
attcataggagtatattttttgaaaaaattttatagtgttttttatttgctaaaaataaaaaactagaaaatagttgctaataactcaaaaagggtgctagtgcatttcgtaaaaaccgccacccatgagcgtttcgtaaaaccgccaaatgggtattttgttaaagcccccacccatgcgcgtttcgtaaatccgccaatgggttcgaaacaaaaaattataataaataaaaattcataacttggcccaagttcaaccaaattaatattttatggtattttttaatagctttaagtgttctctatcagaatataattttaaaaatttgttatcttatgtataaaaaagttatcgtcataaaatttcgaaaagtcttatgtcagaattttgtgtacagaacttttttgaaattcaattaaattttctgaaatttaaaggtaaatagagaattcttagagctatcgaatatataaattaatttggctcaattgcattttatagatttaaaacattgtgtttataattatatatgcttgaccattgcaaaaaacctagaatgttcaatgatttataaatttttttatacttaagataaaaattttgtaatattatattctgaaagaatacacccatagctattaaaaaataccatgaaatattaatttggttgaacttgggccaagttatgaatttttatttgttacatattttttgtttcgaatccattggcggatggatttacgaaacgcgcatgggtggcggtttttacgaaatgcactagcacccttagcaattgcactgacctttggcccattttcccggccaccgttgccaatgacaactttctttctatcgggattcccttcaataaaaaaaggaaaacatgcttcagttctaagaaataaaggaccattccaaaaataattttcttaaagattttcttggctctatcttttttgtttttccgttttctcaaaaatataaatcttttttttgcatatg

SEQ ID NO: 98574 - DNA, 607 bp, Heterodera glycines
  misc_feature (54)..(56): n is a, c, g, or t
  misc_feature (59)..(61): n is a, c, g, or t
  misc_feature (64)..(64): n is a, c, g, or t
  misc_feature (67)..(67): n is a, c, g, or t
  misc_feature (78)..(78): n is a, c, g, or t
  misc_feature (94)..(94): n is a, c, g, or t
  misc_feature (108)..(108): n is a, c, g, or t
  misc_feature (121)..(121): n is a, c, g, or t
  misc_feature (141)..(142): n is a, c, g, or t
  misc_feature (144)..(145): n is a, c, g, or t
  misc_feature (167)..(167): n is a, c, g, or t
  misc_feature (187)..(188): n is a, c, g, or t
  misc_feature (196)..(197): n is a, c, g, or t
  misc_feature (203)..(203): n is a, c, g, or t
  misc_feature (219)..(219): n is a, c, g, or t
  misc_feature (223)..(223): n is a, c, g, or t
  misc_feature (236)..(236): n is a, c, g, or t
  misc_feature (258)..(258): n is a, c, g, or t
  misc_feature (307)..(307): n is a, c, g, or t
  misc_feature (310)..(310): n is a, c, g, or t
  Promoter: Source sequence=SeqID_19363; Location=1388..1994; Strand=-; Gene=SeqID_84094
tttgcgcgctaattcaaaatttacactgggtaaatgttttctttataggccaannnatnnngangancagccagaacncgcttcttacccaacnaaaccgaacaaagnggagagcgaaaanaaaggggggaaaaggagaanngnngccaaagcgaacgccaagcaanccgacatcccagaaaaaagnngcaggagnnccaaancccgaaccaaaaaacngaancaaaaaagcgacnaaaagccaacgagaccggaaancggacacaaacacaccaccaacaaacgagccaggaaaacgaaacaacgnggncaacaaggcccaccaggaaacgcccaaaaatgttgattgttcgtctttcgtatttttcaaaaaattcgtctcaattttcaccgtttcattgccccccccccccttaaatttcattattccaccgcttccacattctcttgttggttatttgtttgtttgtttgtttgttctgcttatggggttgggctgattcgacgccgccgtgggcacctaaccaaatgaggggggaggaaagaaacgaacggcctctgatggggggggggagagggggtgaataaatgcatagataagggaatg

SEQ ID NO: 98575 - DNA, 305 bp, Heterodera glycines
  Promoter: Source sequence=SeqID_17339; Location=1..305; Strand=+; Gene=SeqID_47435
aaacaattaattttaaccaaaaaatacatttcaaaagtgttacacaccgccagatttttattttatttttcagtcgtcatttcagtcctatggtataataaatttcagtaccgtctcgaagatagacatttttcggaattatcttcactaaaagtcaaaaaaaaggtgtgataccaactaaactattaccgctgtttattattaaatgtactctccccggctttaaatcttccatgacgccttgtttttttttgttaattctcttttaaccattggtctcgtagataattattaacattaaaatg

SEQ ID NO: 98576 - DNA, 288 bp, Heterodera glycines
  Promoter: Source sequence=SeqID_7136; Location=391..678; Strand=-; Gene=SeqID_63942
tcatctaatctatgatttttcatcaagcttttttcatttttaaaattatagtcataaaaaatgtttcatggggttatcggggtcgctaatcacaaatatttcatccatttcgaccaattcctaaacgctgaagttgaacaaaaatcgaaagttcacattttaacgaatttcgaatttttcgtcttaaaaatgcttattggattaaaatggcccggcaaaggattgctaaacaaaatgtgttaaaattaatttatgtttttgatagtaatttttgctttatctcagatg

SEQ ID NO: 98577 - DNA, 1003 bp, Heterodera glycines
  Promoter: Source sequence=SeqID_15017; Location=88..1090; Strand=+; Gene=SeqID_79179
aacaccacgtcatcttcatattttgctttgcatattaattttttcatccaatttattttttggctcagtgtattgcagtttacacccggaatcagatcgaaaattttaaaaatcagattatcaagtaaaccaaaaatcagatttcggagtcaaacaattttcaaaaagtttaaaattagttatttgaataatttacttgttcaaaattttttcacttttatttttcgcctcccttatcgatcgattataacaactttttggtgccgcgtttttcacaaaaaaatcttcgtgacaagggagggagacggattttatccaaaaactatccaaattttatgtaaaagttaatagagataaagtattgacattatggcataagattttaaaataaaaataattataagaaatcagaaaaaaatttagtcagtattcaaaaaaacaactgacgttttgtttttatgtattaaaaagtcgcgtacaaattttgattaaatagacttcagattcaaataaaatgaccaacacttatctcattaataaaaatttaattattattacgcatttatttttacttggttatttatttaataaagagcgggtaactcaaaacctcaacgttattgaattgaatttcgttaaaattttatgaaattctatttaatttttttcccaatttgtaatcttaaagaatgaatttagtttttcaatagtagtaaggggtgggcccgccggacagttgcaagacaatgggtacgggaaacttttctttatttttttgctgttaaccagggcggttgtctttttatataagcatcgtttattctggcagcaattgccttttagggcttgaggtcgttcgtttgacttgactaattttctgagtcgtttaggtgccctgtcgtcttctgcttcatggatggcagtgcgctgctcttcaggtcaagatgggtttctataccgaatattcagaatataattaataatattattattattattgatg

SEQ ID NO: 98578 - DNA, 238 bp, Heterodera glycines
  Promoter: Source sequence=SeqID_12501; Location=1114..1351; Strand=-; Gene=SeqID_76139
ttctgtcaaacatcggatccaattcaagcaaatttgagcaaggaattgtgttgtttcatcaaacaattgactcactgaaaccaggttaacaacacccacaaatgaaaattaatcccgaaagtttttgagccggaattcgggaattttatcggagtatccgcttttatcttggcaaattaaaacccatttttgtcgatcagaaactgtaccagtgaccggactgttgcagcatacaatg

SEQ ID NO: 98579 - DNA, 322 bp, Heterodera glycines
  Promoter: Source sequence=SeqID_8075; Location=976..1297; Strand=+; Gene=SeqID_66901
actgtaggaaggggaatcaattactggtaattaattggagattaaaattatgtaaaaaattaccaataaagattgacattaaattgctaaaaagcacttatagatacttaatttagccgtttttaattcatttagcctaattttgtgagttggacgattcagcttcaatttttccaaaaaatgtaaaattaccaacaaaagaatcttgaaagtaagcgaaagttttgaaaaaattacaatatcttgaagcgactttcctttcttattttatgacgtgccaaaatgtgtgccattattttcagccttcaaataattggcaatg

SEQ ID NO: 98580 - DNA, 1003 bp, Heterodera glycines
  Promoter: Source sequence=SeqID_9095; Location=931..1933; Strand=-; Gene=SeqID_70229
ctacatatcgacaaaatgattaattgtttgaaataactgacgtaaattcgtttaaaaatttcattaatttaatttagctttaacttttagattttataaaataaatagcaaaataaaaattaattttgtgttattttcacttgaaataaattaaaatttgaattttttttttaattaaaaaattcccggaaaaccaaggtcccgtcccggcttctcaggtcccggtcccggttttgcccaacattcccggtccgctcaactctacggtagtaccataaaaataaagtttccaacgcaattaattctctgcaatttgtgttatgtgccaaaaaacccccaaaatatgtgctaaaacccaaaaaaaggccaaaatatgtgccaaaaattgaaaaaaactgctcaaaaaataagttaatttctcaaaaaagtctcattttttatcaatttcgctagcttaatgtaatgctttttggcgtaaattttttttcgctctcaaagatttactcatttttcggaatttcttcgctaaaaatcaaattttgccttaaaagtgaaaaagtcatgaaaagggtcaaaaaaatacaaaaaaaaagaaaattttgaaaaattattgggcatttatttgaccacgaatttgagtgccaaaaaagacatttttgtaaaaaaaacctaatttttccaaaaaatcgccaaaatatgtgtcaaaaactgccgaaaccccaaaatatgtttttattcctaaaaagtccaaaatatgttttttatatgtgctaaaaactcgctctgattgaaaggaaaacaggtaaaaatgctatttttgagattttcatgcgatagataaaaaaatatataaaaacatataaatccgttccctgataatatacgtcaagaaataggaaaaccctaaaaatccaagctttacccaactcaattaattcttctgctatatattgtgtgacatcattcagaatttggccaaattgtgctaattgcctcaaaaatg

SEQ ID NO: 98581 - DNA, 1003 bp, Heterodera glycines
  Promoter: Source sequence=SeqID_2772; Location=2603..3605; Strand=+; Gene=SeqID_81507
ttcgaattgcgcttttccttttgatcagttcccacatttttttgatcttagtgcgaacatttcttttggtcaatgccattctccattttattgtttgatcaaaattgcgcgcaatccttctaattatttacatccattcccaaatttatttaagatcagtccaaccctgaggggcccacaaatggtacctttcggtcaatcagtgccatccctttttctgatcaaatggcgcacattctcttttgatcagtgccatttccccattcttctcttcatcaaattgccccaaattattttggtcaatcgtcttttggctatttcttttgatcagtgtcacccctccccatttatattgatcaattgacgcatatttcggctgatcagtcccatcgccatctttgatcaaattgtgcaaatttatttgatctgtcccattttccccatttctatttgatcatttgtaccatttttcattgctcaaattgcgcacatttcttttgatcagtgccacgtctccccatctttcattgatcaggtacattgatcagtgccatttccccttttgatcaattggcacatattatctgttgatcagtgccattcctcaatttaattggcacatactatcttttgatcaataccattccccaatttttctttgatcattaggcacacattctcttttgatcagtgccattctccttttagtcaattggcacacatttttttttgatgctcctcttacccatgccaattgtcaatcatgagtctatcgtgtatggcctctccattcattcattagtcaacaaacattcattcaattacgcattaattcattcatacatgtagaaaagcacgcatgttcactcatgcttgccacattcattcacttattcatgccatgtgctttcatagagtcatgtgttcataaattattcatccattatttatatatgtgttaatattataaaatggtccaaaataagtttatctcattcagatg

SEQ ID NO: 98582 - DNA, 467 bp, Heterodera glycines
  Promoter: Source sequence=SeqID_8516; Location=3313..3779; Strand=-; Gene=SeqID_68359
ttgggactgaacaaaatgtcggcttttactgaaactgatggaccaacacttgcaacttacaatattctttttaaaatattaaattattaggtaaaaataaccaataaactaatatgtaataagaatcagtttttaatggcaaaaacaaatgaaaaatgttgacaacttaacggaatttgagtaaaatgacaaagtgcacgaaaaaatgaccagtaagaattaaaaatgcacagattcaaacaaaaacattgttgttttaggcttcttcaagtgaaggcgggtcttcttttgttgtcgaaccggtgtccgaggcggaattccggccgataaaacgatttgtgatgatgaaacagaataaggcaaaaatctaaaaaaaaacataatttagctaactgtctttcaataatttaaaataagaagtttaaactattttaattattacaaaaattatgttaatgccagcaatg

SEQ ID NO: 98583 - DNA, 72 bp, Heterodera glycines
  Promoter: Source sequence=SeqID_39459; Location=1..72; Strand=+; Gene= SeqID_68022
ataacgttacaaagtctaatttagatgagtgtttttatcatttttaaaaccctgttcttggtcgctttcatg

SEQ ID NO: 98584 - DNA, 513 bp, Heterodera glycines
  Promoter: Source sequence=SeqID_45157; Location=1..513; Strand=+; Gene=SeqID_72517
agcaaaaatcattttttaaaattttattccaaatttaaaaatcaataaaacgcttttttgaggcgcgctttttccaaaaaaactttttgggaagggggggaggcaggcgccgccgtgaaaatttttgaaaatttgattaaaatttgttgacagattttcaccaaaaaatcatcaaattttgtgatttttgtatcatttttctaatgagaaataagagttttggcgcgccgctgagaacagtttttcatcaaattactaaattttgcgattttgggccattttctaagaaaaaataggagttttgggggcgcggcggtgccgataggcgccgccgtggaaaaaaattggaaattttgatcatttataaacagtttttcactgaaaattagccaatttataggtaaaattttgaaaaattttatgggactttaatccaattcttaggggtgtaaaagtcgcatttcgcgccaaaaagcgaaatgcgaaaagcgaaatgcgaaacgccaaaaaatg

SEQ ID NO: 98585 - DNA, 147 bp, Heterodera glycines
  Promoter: Source sequence=SeqID_14201; Location=2856..3002; Strand=-; Gene=SeqID_78215
ggtgatcaaatggctaaaaatgtcctaattacgctaattgctttaatgcctttaagaagcatagcggcagtttggacagaggccattacacatcggttgtggttaatctgacaagcactgatcagcaatggctgagatttaacgatg

SEQ ID NO: 98586 - DNA, 397 bp, Heterodera glycines
  Promoter: Source sequence=SeqID_11141; Location=1..397; Strand=+; Gene=SeqID_74488
ctgcttcaacttctgctgctgctctcccgttggctggtgctgtcgctgctgctggagaccatcgccacaacaatttgtgtgtgattttggagaaaacgcgctcaaaactggacaccaccgtggagtgtgttgcggaactgtggcgcaccacggatggcacggcacaggaagtaggacaaaaaacaaaaaaaaaacaaatgccgacagttgatggcttacaattagcaatgttgttatatgatttttgtgtccggacccctgctaaaatcggggatatctgcggccgagttttaagggccatttccaattactaacggcaaaaaaatttgggacttgacatttcgaatttaatcaattttcgtcatagttttgttgacgtgtctagacaaatacaatg

SEQ ID NO: 98587 - DNA, 312 bp, Heterodera glycines
  Promoter: Source sequence=SeqID_20662; Location=504..815; Strand=-; Gene=SeqID_51220
tttgtgtaatttgacaacgcttcttttatcttttcgttaaaaattaaaaagattgtctggaatttgtcttgcgccacaccgctgtgccattcatttatgtaatttgacaccagtctgataataatttcgccaaaatttatttattatttgtccatttattacgaattattttgcatctatcactccaaattttgttaaaaaaattttttttattgtcccaatttttaccattttgtgttttttcaacaaaataaatatttgttcaaatttaaagaattatttttaaaattttagacacaaaaacaaatcatg

SEQ ID NO: 98588 - DNA, 311 bp, Heterodera glycines
  Promoter: Source sequence=SeqID_27240; Location=1134..1444; Strand=-; Gene=SeqID_57931
tggtcgaaatggatgacatattaatgattaacgaccccgataacctcataaaacaattttatgactataaatttaaaaaatgaaaaaaaacttgacgaaaaatcatagattagatgatgtcatatgacaattctgatgtcatattcgtgatcagcggccccggcaacccccgagtagaacgaataatcgtaaaaaacagcatttttatttttgaacattttgaaagtccgtttttcttcattttgtcataatttcgtcaatttatcttgcccccccccctcccaattcagcaaaacttttccgcacaaatg

SEQ ID NO: 98589 - DNA, 312 bp, Heterodera glycines
  Promoter: Source sequence=SeqID_4600; Location=1..312; Strand=+; Gene= SeqID_55043
acgggtttcgattcccgtctcctcctgtggatgctccggctggcgggagactgactccggcgatgcgcgcttctccggctggtgggattagcggcgacgaacgggcctgcccttcggtggacggtttggcaccgctcggctcttccttccttctctgccctgcttggtttcgtcgacgacgggaattcgccccgtccctacggctgctccggctggcgggagactgacaccgatccgcgagactccggctgcgggagtctgaactgcttgaaattcgctgacgctccgggccaactcccggattctccaatg

SEQ ID NO: 98590 - DNA, 203 bp, Heterodera glycines
  Promoter: Source sequence=SeqID_9798; Location=1379..1581; Strand=-; Gene=SeqID_72732
ttctctcatcattcacttccccataatatgccaagaaattcgggactcctccgtccccctcccattttaaatatgcttaatgtattagctgacaaaatgcgttggaaatgggttggggaattggatgaaatcttttttgcccttctcaacacttttggtccaatttgcttaaggcaatgaggggaaaaagtgaagaaaggatg

SEQ ID NO: 98591 - DNA, 153 bp, Heterodera glycines
  Promoter: Source sequence=SeqID_13873; Location=1003..1155; Strand=-; Gene=SeqID_77816
ggttaacttaaaaatggggaggagaatttgaatttttataaaacgaatttttaaggttgcttgggtgaccaaggccggaaactccgacttggccgttccaattgccattcggccgaccagtgaaacggtgatgtacccaacctttgccaaatg

SEQ ID NO: 98592 - DNA, 52 bp, Heterodera glycines
  Promoter: Source sequence=SeqID_11881; Location=1028..1079; Strand=+; Gene=SeqID_75393
tagttgcacttatagcggaaaacaaagtaatgaataccattagaaaaatatg

SEQ ID NO: 98593 - DNA, 539 bp, Heterodera glycines
  Promoter: Source sequence=SeqID_14500; Location=1470..2008; Strand=+; Gene=SeqID_78544
atattcccgaagtttccccatttttcatttcctttcaggtgtgttttagaattttccctccctgtccaaatctcatatataaacccgaatatttccctttagaatcgctctcgaaaaatcattattccatcctttgattgtgcgctattccgacaaataaactacttcttgtctaagaagttttttgttccgaaggtgttcctttttctctacggtttcgacattcccggaactcagagttccgtgtttgcatttgtctaagctcgattgtcccgaagtccaccaggacagttcaactaagtctaaaggggctgtccatcccacaagtccattccaagagtgaaaaccccgtcccattcgctaagttcaataacattgtcgcggagcgtgtgcaaaccgacagccgaagcgcaaccgaccagtccagcaaacccgcacctcactcgcttcctcgacaagtggcgctcctgggaacgcgataactggcgctcctgtaaaacgaccacacaacaagtggacctcccgaaaagaccatcatg

SEQ ID NO: 98594 - DNA, 857 bp, Heterodera glycines
  Promoter: Source sequence=SeqID_7902; Location=3723..4579; Strand=-; Gene=SeqID_46499
ggcggggaattatatggatataaatcgcaaaatatggccataaaatatcgaccaaaaatcgcgaaatatggacataaaatggcaaaaatatggacataaattttttaaattgagggtataatttcccaaaatttctttaaatttgttaatatagcccttcaaaaatggctaaatatggtattaaaaatcattttagaagaaaaaaacatgataaaactaaaatttactcatttttagcgaaaaatcaaccagaaaagtgaaattttatcttttttgcttatttttgacataaacttattaatttttatgaaaatttaaatttattcaatattcccgagaaaatttggcgaaaaaatgattttttggaaaattttccggtttttgggctcaaaaaggccaatttagctactgggggccgttctaatagaggttttttggaaaaatgccaaaatatggacataaaatatgtatggataaaaatgccataatatggacaaatatggacataaatcgcgaaatatggaaaatattgatatggaactccatcctagaagcttcaaaccaagctaaaaacatgtttttcgtgcatttcaggcccccacagtccaggaaaaaaaatatggatttccatataattccccgccctaatttttacactcctatgagactttataaagcctattttccattccggaccttttgtcactattttggcatttttcctcattaattatgttaatatttcgagatttttcataactaaaaattgcgaccttttatttagataagcaaagtcaaaaggattttaaatgggaagcgattctttggagttctccaatatttttcaggaagagatg

SEQ ID NO: 98595 - DNA, 161 bp, Heterodera glycines
  Promoter: Source sequence=SeqID_1926; Location=1..161; Strand=+; Gene= SeqID_76829
attttatttgtcttacaatggatcgaaaaaagatttaaattcttcaaaaatgtcgtgaacacaaatttttggatacaatgacagcgaaaacgaagggaattctgagcaccacgaataaaacgccaaaatgatggatgtgacgataattttgaagaagaatg

SEQ ID NO: 98596 - DNA, 418 bp, Heterodera glycines
  Promoter: Source sequence=SeqID_12891; Location=2321..2738; Strand=+; Gene=SeqID_76627
aactaagaacccagcaggactcaagttatttgtccttgaaaacaccaaggatgtccttgcgatacacttttatccttgaaattcgtaaaaggatggatcttgcagatcatcatttcatatttcttttccattttctttgatatttgttgacttttttcgtttgaaacagctaataacaaatcacggctaatttttgattgttggcaaattgattttagctgaattgtcgtcaaataatttgcattgattttttttattggatgtatgaagacgcaattttttttttatattaattttatgaaaaacataaaaatattatagaattttattaattccaaaaaataatacattaattataatattcattaaattatttttataacaattaataaaaaaaaacatctattaagaaagtatg

SEQ ID NO: 98597 - DNA, 51 bp, Heterodera glycines
  Promoter: Source sequence=SeqID_19062; Location=1..51; Strand=+; Gene= SeqID_83806
gagaaaaaaacattctctgtaaaaaataaattaaagaaaataactataatg

SEQ ID NO: 98598 - DNA, 482 bp, Heterodera glycines
  Promoter: Source sequence=SeqID_353; Location=4676..5157; Strand=+; Gene=SeqID_83882
aactgttcatggcatttttggggtcgctgatcacgaatcaccgacatttatttcgactaattccgagcccatgattcaaaatccgaacaaaaatgttgaattttttaattttgtctttttgctcaaatttgggttcgggattcagaattcggtaatcaaaattggttttgcctcgtgttgtcaccgacgccgaaaatatgttttcaacgaatagaaatcgtattaaaaatgttttcaaatcagggtcccctatggttttaataattttcaaatttaattattttatttcttgcgccgatacaaagtgacaacatgcctcattaattatcaatttaatgtttaacctaattattcaccatatttgtacaatttaattcctccaatagaacaccccgctctctcaattagtgataaagaaagcttgcaaaattaattcggctttttaaaaatatttgaatttggcatcttttcagtacggcatg

SEQ ID NO: 98599 - DNA, 441 bp, Heterodera glycines
  Promoter: Source sequence=SeqID_17949; Location=1509..1949; Strand=-; Gene=SeqID_82505
caaaaatgtacgacctgtgactaagcgacaacgccaccggtaaggacgagtacaagatcaaattgcgagggatcacgcaggacttggggcaatcacgaataactgacaaagaaatttgtatgatgaatacccctggcgcatgtattcgtctgtacacaccttccctcgatatgaaccttctctcagacgaagagcacgatcccgaaattattccataacctccccccccccctcctacgcccttggtttggatgaggagattatgcttaactaacaacaaggcactgttatttttgtgacaaatttcagtttattattttttcaataataaatttttaattaaaattgattaaattttcagaatatttaaaatgcccaaaattttgctaggcccaagacttggccattgcccactatgtgtccgccaattttggcaaaatg

SEQ ID NO: 98600 - DNA, 163 bp, Heterodera glycines
  Promoter: Source sequence=SeqID_41462; Location=1..163; Strand=+; Gene=SeqID_69574
atttttcttacatatttatgtacatatttggaccactttttgtacatatttttggcagccataattataaacatgttaataagggggaataaattttattttaataaaaaatcaaactaattttttctttaattgatttgtaggttcataattttttaaaatg

SEQ ID NO: 98601 - DNA, 438 bp, Heterodera glycines
  Promoter: Source sequence=SeqID_6453; Location=282..719; Strand=+; Gene=SeqID_61641
tttatttggtcattaaatgttggccaattaattaatcggctgacaatttctggcaattttcttggatgggtatatggggagcaggatgaaaggtcgccgccgaagcatctccaggacaaaatgttgtcgcagttttttttcaaaaatataaaaaaaatatgtcaaaaatttttttgttacctagcctaattctaaaaatttttattaagaaaattgaacgaaataaaaaatttattttttctggaaattcagcaaattttgttttcggtaacactaggttttcaacaaaaaggttttaacaatttaattaatttattttttgtgatgtttatgccggcgacgttttggggtgttcccgggtctatgacatgacaattatttcttgtttttgcttattttagtgaggacaaaatttgggacgatttggatgacgcgatg

SEQ ID NO: 98602 - DNA, 70 bp, Heterodera glycines
  Promoter: Source sequence=SeqID_15729; Location=722..791; Strand=-; Gene=SeqID_80054
acgattttatttttattttttggtcaggccattgaatttctggagaagtcaatgatcattttgaacaatg

SEQ ID NO: 98603 - DNA, 489 bp, Heterodera glycines
  Promoter: Source sequence=SeqID_2577; Location=2331..2819; Strand=+; Gene=SeqID_80510
aatcactctgatgctgatgattgaaaaataaatgattttggacacatgtatcaattgttctatcgattgttaattattctgcaatgtgcttatgttggataaaatcatcagaatattataatgataacaatcttaatgttgatttatttgttgtaatattccggtccactatcttaaactccgttccgtaaaaagagaattgcggcgctctaaacattcgtacggttccgatgatattttgggacaacgtatccccccaaatagcttaataattaaattttcaaaagattttgaccagcatcaaaagtaaattgacaggaattcgaaattatttctccacttaaaattgagtttttcatcgattgaatgtttgggggtcattcctttgcacttgactgtaagaaagaatgagcttatccgctggcatctctcaacacctttgtcggtgtctcagccaagtcggctctgagtcaactgaacagtggaatg

SEQ ID NO: 98604 - DNA, 256 bp, Heterodera glycines
  Promoter: Source sequence=SeqID_21063; Location=412..667; Strand=-; Gene=SeqID_51652
tttttgaaaaactagcgtaggaatcctacgctgactaatgacctagcgtaggattcctacactagcctttcctacactaggctaatgtagttatcctactcgagctcaaagtctataaaagggagtggaaaatcgcttcctcggatcatttttgaaaaacctagcgtaggattcctacgctgactaatgacctagcgtaggattcctacactagccattgggattgtggtgaaccaagcaagacctgccccttatg

SEQ ID NO: 98605 - DNA, 414 bp, Heterodera glycines
  Promoter: Source sequence=SeqID_4323; Location=783..1196; Strand=-; Gene=SeqID_54057
ttgaaaaatttcaatgaaatttccaaaaaaaaaaaaacctgacaagaaattttaggggctggcgggatgcattaagggcgactaagatgtttcgaatgggtcagacggtaaaaagagatcggaaatcaaatctgttaatggtcaataaatttgactattttttgcttttcaaaaatgcttttttttcggcgcctattttttcaaaaactaggaacaaaggggtccgcctatgcagataggcgccgtctgaatttttttttttgaaaattttatcaattaattaactgattttgaccaaaaaatgaccaaatgtcacaccttttgactcaattctacaggattaatgtcgatccagtggtgttgataagcgccgccaggaaatttttttgcaaattctaggtgaaatttgagatg

SEQ ID NO: 98606 - DNA, 303 bp, Heterodera glycines
  Promoter: Source sequence=SeqID_18199; Location=1..303; Strand=+; Gene=SeqID_82784
cccatggaatttttgattttaattttccgtctaaattagtccgtgatgatgacattccgtgccgatatttcgcacgcgcgggacgaggccaaaatggcacagtgggaaatgcgggtgtacgaattttcgcgccagctcaacaattcgttgattgaggtaattaactgcctagttaattaattgcgggtaattagttaacagtgtaattattcccaattaattaatacacattacgacatttttaaaaatgtgtagttacattaggcgctcgtgttgggcagcgaaattgtcgaccgcgagatg

SEQ ID NO: 98607 - DNA, 225 bp, Heterodera glycines
  Promoter: Source sequence=SeqID_25374; Location=1..225; Strand=+; Gene=SeqID_56120
cgacagatattataattacatttaggcacagatttttcttccgttttattataatatgtaattatttactgtattttctcttaaaattgaccatttcttaaaggaaactgataatttgaaaagccaaccgtaaaattaaattagcaatttctaaaggaaagttttacgacactaattcacattaatccgacaataaaatatcattaacggagaatataaaaaatg

SEQ ID NO: 98608 - DNA, 51 bp, Heterodera glycines
  Promoter: Source sequence=SeqID_618; Location=1..51; Strand=+; Gene =SeqID_57572
gggattggggagacttatcagaaaaggaagaaaatatcgtttgaaaaaatg

SEQ ID NO: 98609 - DNA, 1003 bp, Heterodera glycines
  Promoter: Source sequence=SeqID_2120; Location=962..1964; Strand=-; Gene=SeqID_77955
ttaaattgcacattagtaacaagaatgatagcgatcactccgtttctctcattaccctcctctaaaactgtcagatgccccgggcaaaattagaaaatgaactaggcaaatgctgtaagctagctggatttgtaattgaattcaaattcatgcgagtcagccgattagccgccggagaatttgtgaagttgaatctgcgcgtcgataagtcagactgatcgctatcttcatgttcatttttccttttccttctccatttcttaacaccctgccacctcccccccccctcctcctgcttcggctatcgccaattatggaattctgcttccagctaagggttctgctcccttactcatttgagccggttaaatatttgaattaagtaattaattatgtcaggcagacacataattaaatgaatgttgcgagtttgccggtgccaactggccatgccgattaccatcttaggaattaacttgttgcgattgctaaggtgtgacagcgaaaaatagcgaataaatatgcaaatgaaaaattggatttagaaaaatgtggcaattagccagacgactacaacattgtaatgagtataaaatggtctaataatttcagtcaaattaagcatcaaaattgcattttctgatcagtttttatcagtccaattaaacaatttttaatggtaacccagtcatttacgccgccctcctttcctcgatcatttcggagcacctctgccgatcaaaccaaatcaaaaaatcatccgagctgagcaagttgcggcaactgtatctcagagtgcacgatgctaggggagggcggcggatcgaaacaacgcaacatcccaagatttttggcaaagggcatcgatttcctttaggttatttaaggatataacgaaattaggaatagaattatgttttgtagtttgtaaattttaatcaatttaagcgctctccgttaattgaaaccctaaacatcttaagtgccgttgaccagcgaaatg

SEQ ID NO: 98610 - DNA, 302 bp, Heterodera glycines
  Promoter: Source sequence=SeqID_10456; Location=481..782; Strand=-; Gene=SeqID_73659
ttgctgacccgcaaaccgttgctgggcaatgtataaataaatctatttaaaataaaaataattaatttttttttacacattccctaacccatattatttcttcaatttctaatgttacacattatacaattttagtgattcatttgacttttttaattaatttttgagttttttaaggcataggaccatcagtgccgaacaggcgctgccgaatcaaatttgggaatatttccttgttaaaaaataattctaaccaacttctaattacaaattacttctttacataacaggtgatgcgaatg

SEQ ID NO: 98611 - DNA, 1003 bp, Heterodera glycines
  Promoter: Source sequence=SeqID_16574; Location=1068..2070; Strand=+; Gene=SeqID_80982
attatttttttcgaaaattcctttcaaaataagatatattcattcatttgtctagacaattatcctaaaaagagtgagcggaatttccgagcttgcgacggcttatgaaaaagtatcatagtgcgccgccgggaagtgttgagtcggaacgactattcagctgcgcaggatttatttttaatgatcttcgaaagaacctatcgcatgaaaatctcgaaaagcttatttttcttcatcataatcttatcctttacaattttgattattgattaaatggaaatttttttgaattatctggaactccttgcaattccccccccccccccattcagtcttcccaaatttgtatgcatcggaattttaattaattttttatataagaaaaaataaaaaaaagtgtaaaaaatggtttaaaaataggaaaaaaatgcgcgaccgcgatctgcgattcgcagtcatttttttgcgcgatccacgatccgcgaccgcggcaaattgaatccgcgatgcgcgaccgcgggatttttctgtgcgcgctccacccctgatgtagactctttcagaaaagaatttaatatttaaagcaaaaaatatttgtcgtttggatattttatttaatattgcaataatttttttttaaatttcattaaaatagtatctatttcattcaaatattcatttattaattattacctataattatgaattagtatcaattaattcaaaataaacatttggaaccatgaaaaataaataatttataattatggaaaaaaatttatgttaaaaattcattggttatttatttcttattaaaaattaatagaaaaactagcttaatcaaaaatattatttatatttccaattaagcaatattttttattttacaggaaatcaattgaaaggcgattttaacatcaataaatagccaaaataataatcaaaaattatattttacaagaaaaaataaaatttattatttttttaatttgtgaagaagatg

SEQ ID NO: 98612 - DNA, 273 bp, Heterodera glycines
  Promoter: Source sequence=SeqID_14913; Location=1..273; Strand=+; Gene=SeqID_79077
tccccgtaattgggttttttgagttttaattccctggcccccccccatttcctttccccaatcgtccaaaatacagtcagtcccccccctttttcttatcccgcccccgggagaggtacgacttggcgctcctgggttgcgacgtaaacccatccttttggacagcgttttaaaggcgctgacgcggacaaaagcatctaactgtgtgataatttcggaaagtctcgactcatatttttcaggtttttgtaccattttgcagtaaaatgaatg

SEQ ID NO: 98613 - DNA, 1003 bp, Heterodera glycines
  Promoter: Source sequence=SeqID_6563; Location=1056..2058; Strand=+; Gene=SeqID_62014
tttttcttgataaaatttttggtttaaaatcagggctcggatcgaaaaattttcaaaatcagaacatcgggcctaaaaaatcagattttggggtcgaaaatcagaacattttgcaaaattgcttcaaatctgttatttttacatttttgtttcacttattatatttttcccctcctattatcgaatttaacaattttgagtggaaataagcatattttaaatcagtgtatttaggatcaaaaaatcagattttaaaaattttttgcggcgcattttccaaaaaattgtaaaatagtgacattatgccataaaatttctaaattatgaggatttaggaaatcagaacaaaataagaacaatagcccaaaatcagaacatttctgataaatcagaacagatccgagccctgtttaaaatgtcaatatttgccaagaattattagaaagtaaatttacttcagttgcaactgccaggaaaaaaatttttttttttacttatttttggctgaaaattatgtcactattttgtcacttttttggcacttttcgtcactattttagtaactattttggaattttcgtcactaaaagttgcatccatatttatgagatatttgaatattttaaagtggtgcaagacttatttgtcactctgtaaaagcatcgtgtgtgagaatttccccactatttataggcaattctataacaacaaataaaggggaggtgctctgatttggtaaaaatggatttggtacaaatgttgaaatgatgagtagtataaaaggaagttggttcatcctttccggccattctattccaaataggcattaattaattcctgcgtattattgcggctgctgttctctgtccgtgccatcatcaaatcaaatcaacgaaagctgagccatcggaagtgtgcacaaatcgactaccaaacgaaactgggcaccacaaaacaacaaaatcatcatcagcagtaaaagtggtgcagaaggaaacgcatg

SEQ ID NO: 98614 - DNA, 59 bp, Heterodera glycines
  Promoter: Source sequence=SeqID_9331; Location=1..59; Strand=+; Gene =SeqID_71023
atgaaaacgaaaaaacaacagttgactcacgtacaattgaaaaaaatggacgaaaaatg

SEQ ID NO: 98615 - DNA, 259 bp, Heterodera glycines
  Promoter: Source sequence=SeqID_2720; Location=1921..2179; Strand=-; Gene=SeqID_81259
ataattaacaattggatgatgaaacagtggcatttttagaaaaaataattgatgtaaattttcaatttgctttttattttatggctttcgcttctttaaagcagtgataattcgattttatgcatttttatgtgtttttatgatttaacctttcaaaataaaagaataaaacaacaaatacaactgaataaaaggttttcatcaaaaatattttaggcattcatttttgaaaagtattcttatccaaattttataaatg

SEQ ID NO: 98616 - DNA, 343 bp, Heterodera glycines
  Promoter: Source sequence=SeqID_12342; Location=1..343; Strand=+; Gene=SeqID_75938
agattaaaattttgaaaagcctcatttggcaagcaaaaaagcctcattttgactcgaaaagcctcatttctacaaatttattcaaaacacatttaaaatgttcaaatcttatatttttgattgtccatgaccaattttagcagttttttgctagctttttgtgaaattctgagcatgaaaaatcgaagttgatttttgcagcgctttttccaattttttgggggaacaggggggtccggttagcagattttcattaaaaatttcagccgtcaatttgccgccctcggcggtgccaaacgcgagcattttggacaaaattgtgccaaagccgggccaacgcatg

SEQ ID NO: 98617 - DNA, 190 bp, Heterodera glycines
  Promoter: Source sequence=SeqID_38188; Location=406..595; Strand=-; Gene=SeqID_67083
tcctgacaaaaacggctctaatattgctgagatgacagcgaaatttcagcgcttaaaaaacgcaaacgatgagctcaagaaagagctgcttaaaccgaaggcaattttattttaagcacataagcagggcaccctttaaatttgttattgaaaccattttaagtacaaagtttcgttttttctcgaaatg

SEQ ID NO: 98618 - DNA, 784 bp, Heterodera glycines
  Promoter: Source sequence=SeqID_44749; Location=181..964; Strand=-; Gene=SeqID_72185
actcattgtattattttaattaactgatcagaaatgaagaagtgtattaaacaattattcaaatatatgcaagtaaaattcaatgtgtttatttgtgcatatttaaaagtagaaataagccaattatttaattttatttttttaccatgtgcaaatacaactcgaattataaattttttcattatgttgtattataaattgaaaaaattatgccttcaaataatttttaaataattattttttctgctattaagcaaagaaaaaatattcaaacaattcgtaaattagttttttattaattaattataatttttatatatattattttcagctattaacacacatatatatatatatatatatatatatatatatatatatatatatatatatatatatatatatatatatatatatatatatatatatatatatatatatatgagctggaatcgtttgctgctgctctcttttaaaatgatctatattttaaatttattttataaataattattttaaatgaaaaaaattgattaacctttctattaaataaataaatcgaaaagaatttagaagaatcaatattaataaaaatgaattaaaaaaataataaaattttaacatgtgatgccagaaggaacggagtgtgggagaaagtgggataaaggacctgagagaacctctaaaagaggcgcccgtagctcagttggttagagcacggcacggattgctggggtcgtgggttcgagtcccaccgggcgagttaccttttatgttctacatg

SEQ ID NO: 98619 - DNA, 183 bp, Heterodera glycines
  Promoter: Source sequence=SeqID_43886; Location=1..183; Strand=+; Gene=SeqID_46757
tacatttatatgtttttttctaacgtaaacagtttatggcttagggtaatactttttcttttgggtttttctagttgtgtaaacttgtgtatggatgagtggggtttacctcaatagttcttcatcattatcatctccatattatcttgagcaatactccctttttcccaaatcttacaaatg

SEQ ID NO: 98620 - DNA, 404 bp, Heterodera glycines
  Promoter: Source sequence=SeqID_4741; Location=1..404; Strand=+; Gene= SeqID_55580
aaagtatcaaaatagctgtctaaaaatcgttagtaatgaaaaaatgtcactaacaaagatatatttaattcattgattggagtgaatttatcgctttttgaactaaagaaaatttatagagctttttcttttttaagtcactttaaaaaaagaaatagactttttgccatagaactaattgaaactttccaaatttggattcttttaagggtatattttaatttttcattcgtttctcatcaaatctgattaaaaatccccactcttttgtcagattctgcctgttacaattgctacgatttttgtctccccgacttcgccgtccttcggcgacaaaaatacgaagacaaaatgtcattgggaattcgaagactgaactgtttccgattgtttgtgcccgaatg

SEQ ID NO: 98621 - DNA, 412 bp, Heterodera glycines
  misc_feature (33)..(33): n is a, c, g, or t
  Promoter: Source sequence=SeqID_22380; Location=1454..1865; Strand=-; Gene=SeqID_53050
agagaaataaatgggacgagaatggtgacaaanaagtaatatgtaaatgttatttgaccatctgttgtgtctatgtatgttattttttcgtgtcgtttcataatatttctaaataaatatcatatttaatacatcaagtttcaggcacttttcttatttagtggattaagggaaccttttgaattgcaaaagaatcgctgggcacaaaacaaagaaacgccgcctttgatttttttttttcaaaaaaagcatttggtcaattaaacgaaaaaagtgccaaatttaaaattaggtaattgctttttactggccaaaaacaatattgaaaaattgtctttgattattttatgtcatgtgaagttgaactcaatttgtattctttgccgtttgtgtattataacaccagtcaatg

SEQ ID NO: 98622 - DNA, 589 bp, Heterodera glycines
  Promoter: Source sequence=SeqID_4549; Location=3964..4552; Strand=-; Gene=SeqID_54856
tacttttccattaacatgaaaataaaaaacaatgtgaaaatttatgttgggaattcttaatacaattttattttaaaatttttttccccatttcaaatgtaaaaaaattttttaaacattttcaaaaaatgaaattgaatttttatattttatgcttcatttgggataattaattaatcatcacaattttcttcaacaacaagaaagcgtgtaatttgtgaattaattattttaataataagtctgcacctctatattaaatcatattttcttctcaataacaaaggcgtcaattttatttaattaacggttaaataatatattaaatcacattttcttcttaataacaaaggcgtcaattttatttaattaacggccaaatgttttttactgaattttaaccgaattgtgaaaattttttaattatagcgataatgcgtttgctgtttgttttcaattttacggcgcatattattttggtagttgaagtcatttcctcttttctcgagtcggccgaaaaacgagaattctattctctaattgcaccaattacccaattaagcctattcaaagcctaatcaacccaatg

SEQ ID NO: 98623 - DNA, 217 bp, Heterodera glycines
  Promoter: Source sequence=SeqID_421; Location=509..725; Strand=+; Gene=SeqID_52035
cctcaaaatgtgcttgtacagctccgtgaacatgtcgaagttggcgccgttttgttgctgcgcattttgcccaattttcgccgagggcaatgcgcgaaaaaggcgcgcattttccttcagcagtagcaactgctcggcgtaagcggtgtacgtgtcgcaaaactgtgccggatgatcacgctgatggacacagcaaaatgcgatgcgtgccaaaatg

SEQ ID NO: 98624 - DNA, 389 bp, Heterodera glycines
  Promoter: Source sequence=SeqID_22031; Location=1183..1571; Strand=-; Gene=SeqID_52667
tctttaggggtgtatttttcgtattttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctaataattaggtatatcattttctatcccgtcattagttagccaagaccctggctttctcgagtccccccccccaatggcaattagtcaaatgaggacaaccattgggcacataaaacatttaaaggtgcaaatatg

SEQ ID NO: 98625 - DNA, 160 bp, Heterodera glycines
  misc_feature (66)..(66): n is a, c, g, or t
  Promoter: Source sequence=SeqID_44853; Location=1..160; Strand=+; Gene=SeqID_72267
ttatataaaattgtgaaataaaaattttatataattaagatttgctggatttttcttttttttttnaaaaggttaattaatgcaaaaatctaaaaaagcgcttaaaaaattttaagctaaaaaagaaaatatctaaataaactttcagaacaaataaatg

SEQ ID NO: 98626 - DNA, 68 bp, Heterodera glycines
  Promoter: Source sequence=SeqID_30485; Location=1..68; Strand=+; Gene= SeqID_60891
tccaattattttatgggagaacattcccgcaaattgccaattttatgtgttcggaaatttgcaaaatg

SEQ ID NO: 98627 - DNA, 117 bp, Heterodera glycines
  Promoter: Source sequence=SeqID_59; Location=13693..13809; Strand=+; Gene=SeqID_58486
ccttaaatacagtaagaaatttatgaattaattattgcttcgattttcactttattataaatttacgaattttttaatattgttatttaagcaattttattaccctttatagatatg

SEQ ID NO: 98628 - DNA, 337 bp, Heterodera glycines
  Promoter: Source sequence=SeqID_10966; Location=399..735; Strand=-; Gene=SeqID_74275
ggcgcccagatttttcgctttttctgttaataaaaatggtttattgcttttttggaaaaaataaacaaattcaaaaaaaaaccgaaaaatcgaaataaaccgaaaaattttcttcggttttttgatttcggtttttttcgggtttttaaccgaaaccgttcgaccgagaattttttgagtttttcggtttttttcggtttcggttttttttcggtttttaaccgaaaccgttcgaccgaccctcttgtccggtctctagtataaacctaattttgaattttctaggtgaattatacttcaaactacttagaaaaccaaacattttgtttccggtatg

SEQ ID NO: 98629 - DNA, 340 bp, Heterodera glycines
  misc_feature (21)..(21): n is a, c, g, or t
  misc_feature (58)..(58): n is a, c, g, or t
  misc_feature (88)..(88): n is a, c, g, or t
  misc_feature (96)..(96): n is a, c, g, or t
  Promoter: Source sequence=SeqID_27513; Location=1220..1559; Strand=-; Gene=SeqID_58207
aatttaggcaaaacttgttgnacaaggattctagatcgaaatgatcaaactctttaanaataatgatccactgattatgctttggttntaaattgngctcacaatctgtttgaacaggattcagatttaagcataaatccaactaattgctgggcagtacttgatttcgattgggcattgaaaataattagtattcccatcagccatttatcatgatttgaaattgtactattctttacaaattctgatcaacattatagactaacaatgaactttaagctgtggcataaaaattaattctagtcaatttaaattaattgcaggcaaattgccccaaatg

SEQ ID NO: 98630 - DNA, 215 bp, Heterodera glycines
  Promoter: Source sequence=SeqID_13554; Location=458..672; Strand=+; Gene=SeqID_77459
ggtgagtttattcaaatataattaaattattaattaaaataaataaatcatttgtgaataaattcagttaaggccaaatctcgggtcgattatgttacttgtgcgtgtgacaatggtcactaggattgaaggtaatcattaaatttataaataaggaaaattgggttttttcaaaaaaaaaattaaaattttatgcaaaatttacagtgtccatg

SEQ ID NO: 98631 - DNA, 260 bp, Heterodera glycines
  Promoter: Source sequence=SeqID_24788; Location=528..787; Strand=+; Gene=SeqID_55529
ttggaagaatttgcagaaaaaatgtaaaaagaaatgaatgagaagggcattctcgtcgtcgttgacggcatatgtttgctcttctccgttcgcgtctcgatctactcacaatatttattacgctgataagaaaaaggggccatctcaaaaaattatgcaaattatataaagctaaaaaaggatgaacggtcggcccggtatataaatggggacaaacaaatttagtttcattttgatcagattttcaaaaaaaaaatatg

SEQ ID NO: 98632 - DNA, 96 bp, Heterodera glycines
  Promoter: Source sequence=SeqID_3698; Location=1716..1811; Strand=-; Gene=SeqID_51509
tgtgggggagggacctaggggaattcaattttctcgtttcattttaagttcccatgacatttaaaaataattttaaataattttctaggaaaaatg

SEQ ID NO: 98633 - DNA, 523 bp, Heterodera glycines
  Promoter: Source sequence=SeqID_2917; Location=2249..2771; Strand=-; Gene=SeqID_82332
attttttcccaatttttttcaaaaagcaacaaaaatattggtttaaaaagtttgaaacgaaaatagtgcacaaaaaggggagggatgcttagacgaaaaaaaggaatttttaggatgggacgcacccccatctgatattcgcatttttctgtttcacaactggccaacggtgactgtgctcattgacacgtagttgtccaattaaggtacttggactttccacagtaaaatgtggtgcaaattttggaactgtcccgcctcacggcggggcttaaaagcatttgtagctcaataaaagttttttgttttgaatttttcacaatttatttaaaaaagccaaaaaatccggatccaattttaaaaacgaaaatagtgcacaaaaaggagccgcctcacggcggggcagcaccaaaagtccacacattttaaaaaggaaacggccgatttcacataattttttcatctttgctaagccaattgaagtccgacgaaaactgtcttaattatttgcctcaataaaatg

SEQ ID NO: 98634 - DNA, 116 bp, Heterodera glycines
  Promoter: Source sequence=SeqID_14338; Location=964..1079; Strand=-; Gene=SeqID_78369
cggattccccccccccgaaatttttctctggttacggacctataaaaatgtattatacatatatgcaaactttcgtcttctcattttgtagaatgaacaatttttgctgcgcgatg

SEQ ID NO: 98635 - DNA, 308 bp, Heterodera glycines
  Promoter: Source sequence=SeqID_26687; Location=626..933; Strand=-; Gene=SeqID_57445
ttgttaggccgtttattaggccttattttatttcttaaaatgaatatatcgggatagctgaataaaaaacaagacgaatttcaaaacgctttccaaataaattaaacgattttcttaacaatttcagataattgttgagaaatgtttgttcaaaaataatctgggatttagtctcaaaattaatcacatttatccatcgggaatactcaaggcaattggagtgatttttaaaagtaaaaaaatagaaaagctttaaggaattaatctcaaaattttatctggtttaatataattttcttcagggcatg

SEQ ID NO: 98636 - DNA, 737 bp, Heterodera glycines
  Promoter: Source sequence=SeqID_21578; Location=1135..1871; Strand=-; Gene=SeqID_52186
tttttgggcaagatttgttaataaattgtaaatttccaaaaatctttccggacttttttaaaaagcacgacaaagaaaagcagactagaaaaaaagccggagaaaaatttggaactcccgcccttgtctcaatcatccccgtcctatggtccttgacctaagtcgcccgttgtaaagaaaattagccaaatttttttggaccccaccctccccactttcatgtatggtcagggattgcggacttggaccccgtaaatcccgcgcgagaccttttggcatgcatttaaaaataatttttacatttttttaccaacccaaatatttttttttattttgaaccaaacccaaaaatctttgtatcattcgaaagcctttgacatgcactattagccttacaaaaaatacaaaaattttcaggttgaatttgtttaacgacaaaaaaagttaaattcaaaaaatttggtctggtgcgccgaaacgttacagaatcaaatatttggcatccttattgaaatttttaaaaatttataaagacagaatgccaaaaaattttgtcataaaaatagacatttttacgtgcaaaaatatccaagcatggaagccgaaatacatgcacatactttgtatccaagtacggatcacaaccttggattataacaaatgctttagttttttttatagcttttcatggatttcgaattttgattttttaaatgtttacatattgtctgtcaatg

SEQ ID NO: 98637 - DNA, 547 bp, Heterodera glycines
  Promoter: Source sequence=SeqID_32387; Location=250..796; Strand=-; Gene=SeqID_62699
ccccccccccgcccttcatcagaacacttcaaaaaacaaatttttttttttaataaaaaaatttgactagaccaatcgaaagctaacggtcgacctaatggaaaaaaatccccgaaggcgagaatttaattaattccattccttcgggggtccgtgccgggtgccgcggggtaagcagtgctggtttcgtttcatcacggcccccatccttttgactagtcagccagcgttgcttaacttgtcagatcggacgggtacgcatgattccaattttccaagcaccccaccgaaagtagaacgaaataaccaaaatataaggaaaatattttaaaaagatgttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatg

SEQ ID NO: 98638 - DNA, 289 bp, Heterodera glycines
  Promoter: Source sequence=SeqID_18441; Location=1271..1559; Strand=+; Gene=SeqID_83038
ttttgttgaggggaaatgatttagacagttttcgtcagatttcaattggcttagcaaagatgaaaaattatgtgaaatcggccgtttcttttttttaaatgtgtgggcttttgttgaatggcactttttcccggatggtttatgggtctctgatcgcgaaacagatacatatccattttgaccaattctaatccccaaaacacgaaatgtaatttttgactcgattcattaatacaaaaacatcctacagaccaaaagaaaattaaaggggaatggaaaatgaaaaatg

SEQ ID NO: 98639 - DNA, 808 bp, Heterodera glycines
  Promoter: Source sequence=SeqID_39012; Location=351..1158; Strand=-; Gene=SeqID_67682
ggaactttatacaaattttaaaaaagtaatattttgtatatgcatttaatcaaatttctactttctttataaatgttagctaattagtcagcgtctatttattttctgtaaaaatttgcctctttatttaaaattaaattatatataatttcatgaaataagacactaaatgtatagagaatgaattaacgtggtcgattggaataaatggacaaaaaagcaaagtcaaagacaaaaccttaaagcactagtcgattggaataaatggacaaaaaagcaaagtcaaagacaaaaccttaaagcactagtcgattggaataaatggacaaaaagtcaaagacaaaaccttaaagcaataggcgattggaataaatggacaaaaaagcaaagtcaaagacaaaaccttaaagcaataggcgattggaataaatggacaaaaaggtcaaagacaaaaccttaaagcactaggcgattggaataaatggacaaaaaagcaaagtcaaagacaaaaccttaaagcaataggcgattggaataaatggacaaaaaagcaaagtcaagaacttatcctacctaatttcatggtggcaacgaggcatttgactcccttaagagagccttccttctcatgtacttgtacctaaaatgttgttggcacaaaaagtaaagggggaaaaagaagacaaatcatccgatcaaaggctaagtctcaacagatcgcagtgtaaaagctgctctactgctaacaaccccctgaccagtagtcaagtcgtatacaagtgattttgcgccccgacgttccaccatg

SEQ ID NO: 98640 - DNA, 284 bp, Heterodera glycines
  Promoter: Source sequence=SeqID_20087; Location=355..638; Strand=-; Gene=SeqID_84874
ttctcacaccctccgattggcactcacaaaatcaaactccaaattggaaaaaaggagcccggccattgcaaaaactttcgaaacttaaagggaggaaaagctgtaactcaaccaaatatatttccaattatctttagacgcttcgttaaataataatagttttttgttaggaaaatcacaaaacttatcacaataaggcttcacaagaattcaatgatttggcctattgtatattaatattattcttttattattttaggtcattggtaaactgttgaataatg

SEQ ID NO: 98641 - DNA, 904 bp, Heterodera glycines
  Promoter: Source sequence=SeqID_23640; Location=594..1497; Strand=-; Gene=SeqID_54336
ggtaacaaagtggaaaaccaaaataaacagatcaaccaaaaataaaattctcagttttaataatatttttgaatgctaaatagaaaaaaaattaattggttcgtattaattagggcgaggattttagtttttaatttttctgaaaaattaattggttcgtattaattagggcgaggattttagtttttaatttttctgcgggtttttgcctattaaaatatgatagcaccaaagtaggcggtttggagtggccgtggaaaatatattttttggaaaaaaaaatttttatttgtctgaggctaggacaaatgaagaaggggactcattcttcctctagctgtgctccgtgataaataaacaaaattggatagaacagaaaacgaaattgttcaaatcttcaaaaaaaaatccgtctttttgcatgttactaattagtgcccctaattaaagaaagccccccccccccaaaaaatctttcaaatacccgttcttcagtttcattttaattgcattttataaatttaaatattgttttcgaaaggtaaaaacattttctaattaggtatgtaaattattttgaatttttggatgagtggagagagaaagagggcgataaaacgaatggacacttaattaccccaaaatgtaatttatccaacacaatagaatagtgaaagcgctgaatacacatatataatgagatggtatatagcagccatctgcctgctggacaaaaaaaagggaaaaactgattttggcgggccaattaaatttggaccacccaaaaatgaacgaattcaaaatccaatcctatcagcagtagcagcaggtgtcaaatagttcgattaaacttgaatgaatttaaaagtcattacacatttttagcaaaattttggcgaccatg

SEQ ID NO: 98642 - DNA, 260 bp, Heterodera glycines
  Promoter: Source sequence=SeqID_22417; Location=909..1168; Strand=+; Gene=SeqID_53083
tttcaatcaacggaaagcttgtgaaaattgaaattaaatgggaataaatgggaaacccgagacgaattaatgcggtggtggtgttggcgaaacgcccacataaaacacaattttttaaaacaattagccacgagaatgggcccaaaaaacggaacggcacgccgacggggcacggcacttgttgttaattatgttgaattggtgcagctgctgttgctgttaccataccaacacaaaggaaaagccgccccgaagcaatg

SEQ ID NO: 98643 - DNA, 179 bp, Heterodera glycines
  Promoter: Source sequence=SeqID_3494; Location=3549..3727; Strand=-; Gene=SeqID_84903
attttttgattgggtttctctaggttatgtggcttggttaccccggcacttcgggcgcccctttcatggattacatcataaccgatgagactacttcgcccattgagcttgcttatgcatacagcgaaaaattggcctatatgccacacacttttttcatcggtgaccactcacaaatg

SEQ ID NO: 98644 - DNA, 110 bp, Heterodera glycines
  Promoter: Source sequence=SeqID_11929; Location=1..110; Strand=+; Gene=SeqID_75447
tggaatttgtcagccaagaattgatggacaaacgcaacgtcttggagatgaaagtgcgtgcaaataacagaaacaaattcgattgggacacacttatcaaatacaacatg

SEQ ID NO: 98645 - DNA, 94 bp, Heterodera glycines
  Promoter: Source sequence=SeqID_27656; Location=1..94; Strand=+; Gene= SeqID_58335
tttttgtttttttgtgcacacaacctattgtcagacgcataactatttcccatttttagcttttttacatttcccaaatgccccaccaaaaatg

SEQ ID NO: 98646 - DNA, 347 bp, Heterodera glycines
  misc_feature (35)..(35): n is a, c, g, or t
  Promoter: Source sequence=SeqID_22657; Location=1..347; Strand=+; Gene=SeqID_53338
attgagagaatgagttgagagaaatgaagagcganagttgagaccaaattgatgaaacaatacaaagattgatgaattctgaattattattttttcttacatgattttcttcgcatgatttaatttgttaacaatgctaaatcaataaattaaaaatggaaaataaattgacaaattggcttaatgttagttgcctccggtcccctcctcttccccctttgtatttttctctggttatctcccttgttgacgcactatttcactgcccccaaagtgtataaatagcgcgagttttcgtctgccaccctcacttttcaaaccattcgaaaaaaattcaacaaaaaatg

SEQ ID NO: 98647 - DNA, 759 bp, Heterodera glycines
  Promoter: Source sequence=SeqID_549; Location=336..1094; Strand=+; Gene=SeqID_55918
aaaggaataaattttaattgacttgtctaatttgataattagttttttaatgattgattcttatttaaaaaaaaacttaaacacacggaaatatttccacaaataatccttctatttaattgtatataaatattacgaaaattgtccattttaaaataaattatttgtgaatattttttttcgtaccacttgacggatttaagctaatttaaaaatgcgctagcattctctttaagttaaatattaatttttataattttcacatgcagcaaatttcgacattaagcaattttaaaacgccaccttaaatctaatcattggcgcttcgaaaagcctcaactttcaaaacccgatacaaaacttaaaccttagacgcgagaatctcgagcacattttatttaatcaaagtattattccatctatggtttttgacatttcatttatttatttgccgaatttagtcaaccaaaaccgaacgtgggcatattttgtacagctcataaaaaggccaatttctcctttctccaacaaatcaacatgttttttcttctccttcgatgttattttatttgccattttcagcaaatcatccaaagattgcgcaattaccaaaattgcccattcggaaataaaaaattcaatcccaaaaactggtcgagagcgcgcggccaccaaagaccgaccggcaacgagcaaacaatgaaaacaattaaacgccttttaagggtccaattccgaaaataatttcttgaaaaaatg

SEQ ID NO: 98648 - DNA, 316 bp, Heterodera glycines
  Promoter: Source sequence=SeqID_28941; Location=126..441; Strand=+; Gene=SeqID_59515
tttctttggcaagttcgagattttcaccttaaaaactcaatttcatgataaattaaaaaatggataattataagttaagttctgagtccaaaaaatgttaattatataaaattattgatataaaaatcaattcttaagaaaatgaatctaatgattccttactttctgcaaatcaccaaaattaatttccattttcacgattcctcaaattaggtaaaaaattacaaatatttaaagtcaggatttattataagaatactcacgacgctttaaaaaatgaatcgaaatcgttaccttcgcgatttttttaagcatg

SEQ ID NO: 98649 - DNA, 803 bp, Heterodera glycines
  Promoter: Source sequence=SeqID_39470; Location=1..803; Strand=+; Gene=SeqID_68038
tttttttggaaaaagcacgccgcaaaaaaaacatttttattgattttttaaatttgaatatatttcttcaaaatgctgatttttgaccccaaatgaagattttttgtcggccaaatgcagattttgaaagttttccgttgaaggccttgtttttacgctaataaaatattgttttaagtcgatttttcatgtttttattacgtttcattcgcgctactatcagttttagaaaaaatcttatttttggggtccgagtcttagttttagcctcatctgtccttattttgaaaaaaaaaacttgcgaaccctgcttgtattttattttccttttcgcaacgtccctgcttcctctcccacttctcccatctcccctcattctttctttttgtctctccttattttattccgtcttaatctcttccttcacctctcctcccttctctcctctcttcctctctctcatttcctattttttttctctctctctctctcttgctttctttttccagtctgggcctattcagtttggcgcactttgacgctttataacttctcttgcaaacaaataaatttttaatttatatataattcgatagcctaagtgacctctattaccctgtaaataatataggaaacttagggctatgaatgattttaagaattaaaaatttagacgcttcaaagagaagttataaagcgtcaaaatgcggtcctattgaaacggcccatattgaaatgacccgcaccccaaattctgtcctttaagttccatgcccccaattaaaaaatatatagataagatg

SEQ ID NO: 98650 - DNA, 1003 bp, Heterodera glycines
  Promoter: Source sequence=SeqID_5170; Location=512..1514; Strand=+; Gene=SeqID_57151
gtttttcccactaaaaatttatgggccaaaaatttcgcgcggataaaacgaaaaatgaaaaacgaatgaatcattcgcccactcaaaggggggggggaagaagtgatcgacggacgcgcaaagtgatcaaaccaaacgatgaataaacatttcttatttatttaagtgtttgtcaaccacaaatcctttaattgttttatttttgtttttaaaaatgtcatcactttttttaattttcgccatttttggcacaattttttgagtcgatgtcgttttttcggggcttagtttaattggcgtgccattaatttcatagccaatcaattaaatttcagtccaattttgaaaaatacgggtcggacttgatacaggtttttactgacccgtagccagtaacccgtacttatccgtacattccaaaaattcgatctccagttcgaattaactccatttttttcaacttcaaaaggaatggctaattaatgctaatggctaataattactcttaattggtccctttctttttcactggtcttttctgatcatagtttctctgtcgtttcgagcttactaatttgtcatgttcaaaaggaatggtttgattaaatggaattagagcctccgctgaattatgaccgcccccctgaaataaagcccccctttcgataaaataatttcaaataaatatttattttcgtttttaaaatatatttccatttttaattttaattttggttgaccaaaacttttcctgtaaacaatcatcccaatgttttcttctgttccgatcacttcttccattttctaattttcctttactaatcgaatttcgcgcttcgttccctccaaatttcaacttttgtttttcgtctgtcaccaaaatcagcgcccttttcttctctttttcgtgcgttgttttaacccactaaatttttacacttttttttgtcgcacgtcgaaacgccaaaaggcgacacaaattgcccccaggggcctggcgatg

SEQ ID NO: 98651 - DNA, 506 bp, Heterodera glycines
  Promoter: Source sequence=SeqID_10324; Location=1054..1559; Strand=+; Gene=SeqID_73503
attgtcttgggtgaattcgaccaaatgattatggttgattataatcggcacattgtgaccgactcaaagcttggataaaatataaataaataaaaatgaaaaatattattatataatgttaaaatgaataacaccaatacaacaaaacccaacatacaaattttgaattccccagaagagcctaatgaaactcttttacatgtactacttttttcgcattatcttcttgcatttccggtgtttttgcttatttggttcgttttaattcggtggcttaaaagtcacggtcacttaacgcccagcgaggcagagacagtaatgcatgagatgaaaaatatcccccgacacccaccaatatttttcgcaacaaaatgatgcaagattagagaaaactgacagtgaactctctctctctctcttcagtatgaccaaatcgataatgagtcatgctggcggaggattctcaaagcgactcattttttttcatctttcattttacaaaaatg

SEQ ID NO: 98652 - DNA, 120 bp, Heterodera glycines
  Promoter: Source sequence=SeqID_15451; Location=3064..3183; Strand=-; Gene=SeqID_79714
tgcaggtatttggacgtccaagtgatcaatttcctgcgccgaaatcgccgcctgttcagcaccaacatctcgctgcagttcaaccatctgattacggaatttcgcgcttggcaagcgatg

SEQ ID NO: 98653 - DNA, 165 bp, Heterodera glycines
  Promoter: Source sequence=SeqID_3304; Location=1..165; Strand=+; Gene= SeqID_84142
gaggagctgttttcgggtgcacaaaatgaagagcagcggaggccatggcacaaaaagcagcaaaaagcgaattttcggggccaaaaagacaaagggcggcggcggaaaggaagggggacgagtgggcaaaatggtcgactggtggatgggacgaggagaccaatg

SEQ ID NO: 98654 - DNA, 91 bp, Heterodera glycines
  Promoter: Source sequence=SeqID_28623; Location=1..91; Strand=+; Gene= SeqID_59225
gtccattttcctaaatgtgctcttgctgtgacagaaaaaaagtaacatttggaaatggtaagcccatcaacagtccaagcatggcataatg

SEQ ID NO: 98655 - DNA, 107 bp, Heterodera glycines
  Promoter: Source sequence=SeqID_4632; Location=1444..1550; Strand=-; Gene=SeqID_55167
cgtcattcgggaaattgtgccggtcattttagtgcaaagaaaatttttcgtcaattatcggaaaaatatttttggcctaatatgttcgccgactgcgttaagacatg

SEQ ID NO: 98656 - DNA, 687 bp, Heterodera glycines
  Promoter: Source sequence=SeqID_40437; Location=1..687; Strand=+; Gene=SeqID_68773
cgggaatagcttccctatagtctgtactttaattctgcgttggagttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtaccccaaacggacacttgaaaaaatcgatttttttatttcataaatattttttcagaaaatgctctgaaacgcaccaaattttatttacatgttagtttaggcactctgatgctttttctatcaaaaagggagatgaataaaatttttaaaaatttttaattcctttttaaacaggccaaaaagtttaggcttaacttttttttcagaaactgatcagaagcgccccaaactttgcagggatactgaaaggaaaagaattaacctgttttatcacattagcttgtcatcagtttttataaaaaattttcaaaattctgcgtctcctattattttatttttttttcaaaattttgaagggcggggggggggggcggttgggcaggaaaaggccaattttgccaaatcggatggccaaaaaggtgacaacataagtgatgcaactctgaataatg

SEQ ID NO: 98657 - DNA, 283 bp, Heterodera glycines
  Promoter: Source sequence=SeqID_18525; Location=1832..2114; Strand=-; Gene=SeqID_83152
ttccataagtggtcattttgcctttgtctcatcaatttcaaaattcccctccttttcagtgtatttgtcctccctcggcgtttgctgtgccgcgttgactgttcagtacgctctgctcaccttgtccctgttagacgtgttcagctccgcctggtcccccactcagttcatcttctggaccggcctcgtccccggctcgctgatccccgccacgcccatttgcgttttctttctgtccgccgatcggctgctgatcattctgctgccgtcaatttacaacatg

SEQ ID NO: 98658 - DNA, 64 bp, Heterodera glycines
  Promoter: Source sequence=SeqID_2423; Location=2002..2065; Strand=-; Gene=SeqID_79641
aggcttttcgggtctatgttttcatacatgtgcatatatgaagaaaaaatcttttataggtatg

SEQ ID NO: 98659 - DNA, 906 bp, Heterodera glycines
  Promoter: Source sequence=SeqID_5572; Location=366..1271; Strand=-; Gene=SeqID_58526
agaaatgactggaagaataatagaaagaccaataaacaaaatatactcacttgaagtgaataattccttagaaacaaaaagttatgatgaaaataaaaaagaagaaaatataaaagaaaaggaaatttgtgaagttcaaaagaaaaatacacatcaaatgacaacaagatcaaaaacaagaaattatttattaaaaggaggcataggattacttatgacaatattattaatgagttcaaatttatttggattaacaaacacaaaggaaaataacaaaacaaaaagcatagtcaaattaaaatgcaaagattgtgaaattaaatgcggatcaaaaggaatagaattaaatacacccacaaaaataaataaatttgaaatttgttgtatgggtcattgccgatcaccgacttttagaaataattatctatttgaattaagcaaagaaatattgattacagaacactattgtaccgtaaattactggacaaagaaaggaaaatcttatagaaatgaaattatttgcccaccaatagaaatatgcaaattaattaaatgtttattttgcctagaaaaattggcaaatcctgaatgcatgttgaccgaaacgctcatattaataggaatcggcctaacttgtattatttcttttattatttgcaagcaagttttatcataaagtttatcataaaaatatggtggattattaaaatttgtttttatgggccatatttggcgttaaaatgggtcttgaaccaaaaattagacaaaaaatttaacgatgagatacagaaaagtttattaaatgaatttgaaaaaagagaaaaagaaaaaattcaaaaaagaaaaaacagaagactatatagacttgtaagcattgtaatattactatttttatgtttgacaatg

SEQ ID NO: 98660 - DNA, 485 bp, Heterodera glycines
  Promoter: Source sequence=SeqID_17353; Location=731..1215; Strand=-; Gene=SeqID_81833
tggttaagaattttaaaatttagcctaataaaacatttaaaaatttttattatatttaaaatttttgaaaaatttcgactttcgaaaatttttggtgcctcggaattccctccctttcgtcgaagatttccatcttcatcatatgtttgtgtttgcgtctctttttcctttgttttcccaattgtcctttttatctgataaaatattctcccccccccccccccaatttcgccactttccctcattttccctattttttaactttcactcatatttcatttttaaaaaatgggatagctttcacccaataataatttgcaacattttagaaattatataaaaaatatcatctaaaataataaaacatcagatattttgtaacaattagcccaaatttaaagaaagtcgaggcgatttacagaaaattagtgggagagagaaaaggaaagaatttaggcgagaaaacgccaaaacaacaacaaatg

SEQ ID NO: 98661 - DNA, 63 bp, Heterodera glycines
  Promoter: Source sequence=SeqID_15675; Location=3886..3948; Strand=-; Gene=SeqID_79983
ctttaggttaggatcgaaatttatataaattatgtttaatctgcagagaatttcggaaaaatg

SEQ ID NO: 98662 - DNA, 734 bp, Heterodera glycines
  Promoter: Source sequence=SeqID_23899; Location=1452..2185; Strand=-; Gene=SeqID_54591
ctgccatttttttgaatcgatgccgaaatgagagacaaaagagaaggaaagaaaatgatttgatggaggaatgccataggcaacaaaagttttttttgaaagagaattggcactttttgggaaagacttagtgagaaagtgtaaaattttccaataattaaatacaaaatattcaaaagcgaaaaagtgaatatttaaaataaattgcagtattatctcaaaataagccgtagagtgaatatttatttatatctatgaaaaattatgaaatatttaaaatgattttttataattagaaagtaattagattatcccatccatttaatactccaaaaaattttttaatttatatacactttacaaatgtttgttctttggctacttaactgtgtactcagttcagttttggccacgaaactcaaagtcattttgtgagaatatttttggtgagtggtttctgaagaagccaccatttgctttttcaagcagcagcaggtcctttcaatgcttaagcatttgggccgagacggagggcggggggcctaatgggcaaaaattcttaataaaatgcaataaatggaaaaatggttcgatcgaattaattcccagtgatcccagtgatatatacactggaccagggatttaacccggtcccgaattaccgtattcccgacttttttgaaggttatactcccgaatttccatattcccgtacaattttggggttagacatg

SEQ ID NO: 98663 - DNA, 362 bp, Heterodera glycines
  Promoter: Source sequence=SeqID_44201; Location=273..634; Strand=+; Gene=SeqID_71722
gttgcgtgaaacaggcggcttttgcccgtggctgcgtgctgttctttcggggatggtgcgtggactagtggtgagagctgcttgtggagcgcttcagctgcgtgtatgctcgtcagggtatgcacttcggttggcgctgaacgaccagtttagaactggcacgaactcggggaatccgactgtctaattaaaacagaggagacggatggtccttgtggacgttgaccgtgtctgatttctgcccagtgctctgaatgttaagccaaggaaacttgattaagcgcgggtaaacggcgggagtaactatgactctcttaaggtagccaaatgcctcgtcggctaaatatagacgcgcacgaatg

SEQ ID NO: 98664 - DNA, 1003 bp, Heterodera glycines
  Promoter: Source sequence=SeqID_19835; Location=455..1457; Strand=-; Gene=SeqID_84588
tcatgagaagccagaccgagacaataacttgaaaccaaaaccaatgactgaaacatttcttaagtcgagactaatttgtaaggttaggcgaaacttcgtgaagcggaatatgtgacaaatgaatatgcgacactgtgtcgccaaaagcgacacaaatttcttggaaattttcatttattttttaatccttttcatcgatcaattttgcattcgctcgctcgttaattatgagtcatcttctctcttcctcatatttttatggatttttttccatttgtttgtgcacatttttcacgtgcctggccccgcccccattgatttgtgagggtataaaagcccggcccattctccattttcctcacttcttgcttcttgcttcttacttctcacttcttgattcacttcatcttgtgagatttctacaagcacttctgcttgatcagcattaagtcgggacagttttctgtccaagcatttgcattaaattgtaattgtgcaattgaattgaataaagattaagaaagagtcttagtcttatcattttctgtaaaagggacacccaggagccctttaatacagaccattaagccgttgacccccgttgggtcacaaaaggcttatcaaaggaaaggagaaggatttctccttccaaattgtcccttcgtttaaaggagaggaatttcctcctttaatttgtccctttggacattcagtgaatttctgtcttttggacagaaattcgctttgcttaaaagactccccccttctgccgggagagtctgcttccccttctgccgggaagtgcaaatttttgtggccttttgcccacaaaattggagccccgtaggggtcggcttccagtcgtaagcctaccctccaaccaaaccaatccaaagcgcggccttagcgcttggatcaaacacacaacccaaaggggtttattgtgttttcattaagcgtaagagcaatgagtgagctcttgcgcatctccattgcaccaatg

SEQ ID NO: 98665 - DNA, 203 bp, Heterodera glycines
  Promoter: Source sequence=SeqID_10549; Location=332..534; Strand=-; Gene=SeqID_73785
ttcccttttccgaatgattcggtttcgattggtaaattaaaatggataatccccccgctccccatcggttcggttcgatttaatcgtcgtctcattttccaaagaatgtttatgaattgtacgaggatgagcaagtgcattaccaaaaggagcaggacttgaaggaggaggaggagctattcgaccggcagaagaacagaatg

SEQ ID NO: 98666 - DNA, 275 bp, Heterodera glycines
  Promoter: Source sequence=SeqID_8955; Location=306..580; Strand=+; Gene=SeqID_69796
aataatcaaagatggatgggattgacaatcagtgtgacaactgtcatatttattttcattctttgcagtttgtaccaccattatttgttttattggtaaatgttagaaattgttcaattgcttttattatttggtaacctccattttcaaataacaaagaatcttatatgaagtgatgaattgtttcaattcaattttggggtttaaataggtagccaaagcctgattctgattctaatttccaattttcgaatacattcctttcttcagtgatg

SEQ ID NO: 98667 - DNA, 477 bp, Heterodera glycines
  Promoter: Source sequence=SeqID_16906; Location=164..640; Strand=-; Gene=SeqID_81337
ttccccttggaatttgtcattgtaatattcgggatggctaaacctttagttgtatttagttttcaggttcgctaacacaaaattggcactattctgtctaatttcaaaccggacccgaaatcgaacaacaaaaaacttactttcctttaagcacaccttatcgtgtgcttgtttaaaagtgtttgattttaattaagggagacacttttggtttggaattttttttgattacactttgtcttaaaaattgttgtcggttttttcgggtcgctgatcagtgacatcaattttgactagttccgaatccctaatctaactgaacaaaatttgaattttcaaattttcgggtttgggatataagaaattgtcaaacaaaagggcccctttggttttttaagtaaaaaaactacttttaagagacctttttggttgtttttccatttaaattatttgctttagaccgcaaaaaacattatg

SEQ ID NO: 98668 - DNA, 1003 bp, Heterodera glycines
  Promoter: Source sequence=SeqID_10396; Location=2434..3436; Strand=+; Gene=SeqID_73592
tcttactatacctgcaatctttgtattaatggaatatacatattgaaatttaaaattttcttagataacacattgccaaaaacttttgctgaagagccattacaaagaaaacggcgagcaccagaaaaatatgggacaggaaagaataagcaggcgcaaaaggacaagtaattagtaggggtgccaaaaatatgtacaaaatatgtaagaaaaatcgcgaaatatgtacaaaaaaccacaaataccgaaaatggaaaaatttttcaaaatattaaaaaattcaaaattttgaaacgcaaaatatcatatttctatttcaacattttgggcttttataaatttctttgtaaatattttggcatttttcgaatttttcatgtaaaatttcagaaactttttaacaaaaatgcaataaaaatgcttttttattgacgcgatgacattttttggagaaatgttcaaaataaatttcaaaaattttccactaaataaatctgtcgaaaaataatctccctgtctccattagtctgaccgtctctaataatctacccctttctgtgggggttgaaaaataatatacctgggcatataaaaagagcaaatacggtatgtatcaaatatgtaaataaaatttttaaaatggttattttttggaaaaaaaatccctcgtaaatgatgaaataggcacaaaatgcaataaaaattacttaaatatgcttagaatcaccttttaatattttaaatcactttttttagtatttttcaggggtacattttcaaaatatgtaaaaaaaaatgaaaaaatgtacaaaaatattttccgaaattttggatttattttttaggattttcaaaaattttcgtaaaaaatccttaaaaatgtaaaaaattaaaatatttaaaaaaaatccaaaatatgaaccaaatatgtaagaaaatctcgaaatattaaaaatattaaataaaaattcccaatttttagtaaaaaaaataaaaagttatg

SEQ ID NO: 98669 - DNA, 1003 bp, Heterodera glycines
  Promoter: Source sequence=SeqID_23011; Location=456..1458; Strand=+; Gene=SeqID_53713
attcatcgttcattttatagacaattttcctctttgtaatttagaccaaatgaccaacgaaaaagactctatttggttttattttggcaaaattcacaattcttcttattttacaaatgtgcgatccgcggcgttttttgcgcgatccgcgaccgcggcaaattgaatccgcgatgcgcgatccgcgactgcgggattttttttgcgcgatacgcgatccgcgaccgcggcaaattgaatccgcgatgcgcgatccgcgaccgcgggatttttctgtgcgcgccccacccctgttaggcaggtgtgactgattattaatttgctattcttgtcatttttgaactttttaagtgaaaccccgaagataaatttttgaacagccaattcaaatgcatttcgtaaaaaaaatatcgttaaaattacgaaagtgctctaaattttactggaagatttattttgtttattacgaaattatcaagcaaaaaatctcggaaaggggtagagactatgcacatatttctgaatttttcatcaattttcacaaaattttgcaattataagatactcaatttcgcattaatcatgtccataattttttattaataaacgtaaaattcatatttatttgaaattattaaattaaattatttctttgacaatttacccatttttaattatttcacaaaatttcaaaacatcgcccgccacaaaatgaaaaaaatatttcgaaatgttaaatgtttggaagaaatcgtatttcgaaatttttgcgaaattttgctgaaagataaaccaaacaaaacaaacaagcatttaaatggcgcacattcaaacattgaattcattcattcttttgccatttatagcttaatgcctttttttgtaatttttcatcaaatttaaataaatatttttattttaaaataatatcattattttaaattaaaagaaagtaaatttactacaaaaattgattaatttagcttaaaattcaccaaaaatg

SEQ ID NO: 98670 - DNA, 595 bp, Heterodera glycines
  Promoter: Source sequence=SeqID_5035; Location=321..915; Strand=-; Gene=SeqID_56661
atctttttgcacacggaaattgaatgacaaaaacaggatcttgtatttgaaaaaaaaagaattttttttttaagtttaacaattaaaagagacgattttatttatttatttatttttaaatgaatcggattcaagccgatctttcagtaaaaaaatatacgaaaaattatttttgaaacaaaataattttttatcaataaaacatttatttattctttttttagcataaccatcattttcattctctttttaacacccaaattgctgcttgaattgttaatgatttttttttcctatttccgaattatatttttgccaggaaaaatactttggataaataaatgaacaattaatcatcacttttagcattaaaaagtgaattaatttatagggcaattgatggacagattgttaatgggagaataaatattaatgaaaatggataaaatttctctgaatcacctctgatcagcaaagtgctgcttctattcgtgcattcatttggcttttgcctataccacaaaaataacttctcaactttttggccaggcgatattcactattaaaaaaaattttcattaaatttaaaacaatg

SEQ ID NO: 98671 - DNA, 213 bp, Heterodera glycines
  Promoter: Source sequence=SeqID_9907; Location=1332..1544; Strand=-; Gene=SeqID_72936
ttctgcgagaggacggcaaaagcaaaggtggcgaatggtaacggcccaaattcgcattgacttttccttatccgtcgtcactgtcatttgtgcctctttttagcccatttgtgcctcgcggatttatgttttacttttcacggcttacccaaaaacgctaaatgaagcgaaatctgtcgcgcttttcccattttatttttatcattgtaaatg

SEQ ID NO: 98672 - DNA, 65 bp, Heterodera glycines
  Promoter: Source sequence=SeqID_2202; Location=65..129; Strand=+; Gene=SeqID_78464
ggcaaagccaaagaccaaagaaaggccaaaaatgattctgataagtttaaggcatgaccaaaatg

SEQ ID NO: 98673 - DNA, 825 bp, Heterodera glycines
  Promoter: Source sequence=SeqID_45; Location=1..825; Strand=+; Gene =SeqID_56540
tgggggggggggaaaattcctttttcccccccccccccccccccccgcttcgcctccccttttttgggctggctctcttcgtgacctgttttgggggtgtcgggggatggggaggggagggatgcgattgaatgggtggggtccgtccgtgggctataaggggaaaatggttggtgaataataacaatgtgttgttaaagtgtgtggtgctgtgatgggaatgattcagcaacagaagaacgcccctctcccctccccaatcaaaaattgggaattgtttttgtatttttttgtactgattgaattgcatccctttactcagtttatttcagtgtgtgtggtgccccccccccccccattagaagatggcgaatgttttgataatgcattcgcggtgccatttgtttgcattacaaattgcctatttatggcacaccaaaattttgatggcacctttttaatgttgtatgtaaggtgtgcccatttattggtactttttaatagcttatatatggtgtaaaaagaaattttacaccatttcttatgtgacaaattgcgactttatggcatgccattaaatttatggcaatttatttgatgcaaatttcgtcttaaaaataataaattttccctctaaaaatattttttcaatatattagtgatattcttagataagtgtaccaccgctgttttacacatgtatttatttgtaaatgttctttttccattaaatgtcttatgagtatgcgtcttggcattgagaaattatcctatttttctaatatataatttttttttaatttaagcaaaaaaaacaaaataatg

SEQ ID NO: 98674 - DNA, 497 bp, Heterodera glycines
  Promoter: Source sequence=SeqID_4167; Location=3462..3958; Strand=+; Gene=SeqID_45735
ttctgtgaagacgacactgctctatatataatatagaaatgaaaatagacaatattaacctaaaaaatattaaaatttattttttcttagcatctttagtagagggtgaaaaagattcagccttggatggggtaaataatgtaaatgtgagaaagaaagtttgtcattttttgaaactcctattcatggattttccaagaacttgattttattccataaaatccaatcaatgtgtataaaaaaaaactcaggtccttgtaggcactaaaaacctggattttttgagatatttttaattacctattattgtcagttagatatttagataaaattaggtaattaaatacataatttttttaaactatttaaaatccaagtcgaggccaggtcccacatgggattcttgtccaggctttctcaaaccaccgaattctagttacatacataaaagtttttaagctctttgttcatttattttgtttgaatgcgattctatg

SEQ ID NO: 98675 - DNA, 188 bp, Heterodera glycines
  Promoter: Source sequence=SeqID_17158; Location=810..997; Strand=-; Gene=SeqID_81596
tgtgaaaactttggtttttttagcttaataagtaaaattcaatttttatttttatttttagtctaatggaaatttgtggcatattttaatataagtaacaataagcatttgtctgaatatatcttttcatttcatatgcatttttcttttatcttctgatcagctccaccctagtttgggcaaaaatg

SEQ ID NO: 98676 - DNA, 103 bp, Heterodera glycines
  Promoter: Source sequence=SeqID_9987; Location=2263..2365; Strand=-; Gene=SeqID_73032
ccttcaaaaggacagctccaaccaaattacggcttcatttgcttctgttcatcaccaatgggtctttggatgagtctttttgggaggtgacgaaccaataatg

SEQ ID NO: 98677 - DNA, 1003 bp, Heterodera glycines
  Promoter: Source sequence=SeqID_20038; Location=1271..2273; Strand=+; Gene=SeqID_84812
aagaagtggagaaatgtgtgggtgtgctaatctgagatgtgtgtacatgcacccctgtgaaattctgttgctggctgggaaagtttagaaataaaatgggattaggtgaaagagaagcgaaaaatgcgtggtaatacacacagagggaagttgcagcaccagcggcccgctttatactcccaccggctggtcgtacgcgcctttccccacctttctcttcatctcttaaatctctatgcaaacaattttcacttgggctcgattcaatttactctttctcgcattgcttcagatgacaacattattatatccaactgacttatagatcggggaactagagaccgcgctttgtagattaaaaaacaccaaatatgatagccattgtctaattgaccaaaatactacaagaaatggatcaaaaaatggcaaaataatctcatatactatgtgtatgtattgccaaaacattactgtaattaaattttatttttttcacgccatttggattttaagactcactccaaactggctagtagaatgaatttttaaattttccacgtaaagtattaactaattctacataagacagatttaaaagacgacaacaattaatacataatctcactatcgttaacaacttcatcggttctgctagcatttattttcatcgtcttccacacacagtgctacaggctttctcaacaacaaacgactgtaatcgttccttcgacttctcatagtcaggataatctttagctagttaaataatctcgcttccgcagatatcctcctaaaacattgttctcagaacattattccaaaaaaacaaccacggacaaatcacagcaacttgatcatcgtccgcaacacgaaacgcggaagttttcaactttgggtcgaagcagcgctgcaaacgcttcaactacgcctctggctggacttagttaaaacatttatttgatttcgatcatctcaacttttaggttcaccgagtaacacaatg

SEQ ID NO: 98678 - DNA, 555 bp, Heterodera glycines
  Promoter: Source sequence=SeqID_2161; Location=607..1161; Strand=-; Gene=SeqID_78183
tttgcctgaaaaattttcaaaaactactttgctttgggtacagtatatgtatgatatactgaaaaaaaaagttaattttaaactttcgatcccgtcgccgaaatgttcaggggaaaaatgcgtaaatttttcttgcacattaaataatgttgatgtgcaataaaattgtcaaaaatcaaatttaaatcgcaaaaaatgccaaaaaaagttcgatctttcattgttgttaatttcaaaagtcaaaacttaaagcgacaaaagaaagaaaagatataaatttaatgaattttttggttaaaaatcagaacaatttgcaaaatagctttatcgactaatcaatttttcgttgaaaaaagcgctgagcagagtgcgatggtgggtgggaaattggttggggtacaactcggagttggcacgacggtccgcgtgggcgtgggtcaggaagacgccgaccaactcgtcactggtcaacacgccggatggcactaacaaaaataggaattttaaaataaatattatttaaaatattgtattgacggacgacctaccaacatg

SEQ ID NO: 98679 - DNA, 100 bp, Heterodera glycines
  Promoter: Source sequence=SeqID_8378; Location=2548..2647; Strand=-; Gene=SeqID_67855
tgagaaactgaaatatttgttagattatgatacatggcaattaattgtccaaataagatcgcaaaaaacaacaaattttctttcctaattaatcgacatg

SEQ ID NO: 98680 - DNA, 727 bp, Heterodera glycines
  Promoter: Source sequence=SeqID_5895; Location=607..1333; Strand=-; Gene=SeqID_59603
tagtagggtcgcaatttttagtgttatactattttttcgattctgatgttactatgagtcactagaaatcactattttggcgttttttcattaaaatattgaaaataattcactattttggcgttttatcactatttttcactatttcgacacttttttggaaaattccttaacaaaaatgcaataaaaccaaaaaatatacccctacgaatcgacctaaaatttttttctaaaataccactaaaattggaaaattttcttaaaaattgttcccccaattttgacaaattttggtttaaaaatgtttaatatttgctaaggaaatagttcaaaggaaaatgtacctcatttgcaactgcaataagtgaataaaaattatttttgcttaattttagactgatcactattcgtcactatttcgtactttttgccactattttgtcacttttttggcatttttccccaccgttttaagttaactattttgagatttttcgtacctaaaagttgcgaccctattaattagtaatatttgattttttaataataaatattgtttcttaaggtgaaaacgctgaattagcttatcatgtgccagcggtgaagccaatatttacggttgacaatggaaatcgtaattcattagtttctgttgtaaaaaatatgagagaaattttgaattttttttttgaaaactgatgaaaataaattacaattttatgaaatg

SEQ ID NO: 98681 - DNA, 1003 bp, Heterodera glycines
  Promoter: Source sequence=SeqID_18931; Location=500..1502; Strand=+; Gene=SeqID_83655
aataaacaaataataatagtaattataataaattccaaatttgatcattaaacatcacaaattgttacatagataaaccctagaagtgccacgggaaccgggacctggaagcggacaactgagtaccaaggtcccggttttgaccgggaccgggactagtcccggttttttcccggttttcccagcctaaaattcccggtttttcaaaccgaaaaggtcccggtccagggtctgcccaaaattcccggtccccgtggcactctagaataaacacaagtagttatcccacggtacccgtccgcgtccggtgtgaagtttcacacctttggtgtgaaaccggcaccgtccgtagggtttaggacgtggttttcgcgcacttagcggacggtaattaatctcccaattaaaaccaaaaggtttgggaccaatttttcgcgcacttcttgggggagggggctaccgtaataaaaaatttaaaaaaaaccaaaaggtgtggagccgaattttaagggggttaccgtaatcaattcgaattaaaataaaaagattcggaccaaattgcaaaaatgtaaaaatattaataaaaaataactaataaattataataatttaaatttattgccctcagcaatttttcggcaaatgattatcccccgtttcccattcacagcgtctctttttttgaatgtgttggaggatcaatgatgaagagaatggggataaggggcaacgaagggggggacgaaggggggagggggggggcaaatgagggagagggcagaaggggcacaggattacaaaatcaattaataaacgaagtaaaagtaacatttattttctttacaattatgagtgttttaatgaattattttaattttcatttcaattttcaattattaattttttcccttttgattaaaagacaattcatttccaaacaaattgttcgcttccaaattgttcgcttccaattgttcgcttccaagttttcaacaggatcatg

SEQ ID NO: 98682 - DNA, 163 bp, Heterodera glycines
  Promoter: Source sequence=SeqID_11162; Location=1..163; Strand=+; Gene=SeqID_74512
tacaaaattacccatattttgcccatttccaaatggccttaaagccgtacaacgaatgtgccgaattcaattttccaaatttccaccccctcccactaataaatgttgaaattcgccttagtccggtcacctcgagattgtaacgcatcacggactgctcatg

SEQ ID NO: 98683 - DNA, 977 bp, Heterodera glycines
  misc_feature (40)..(40): n is a, c, g, or t
  Promoter: Source sequence=SeqID_8988; Location=1..977; Strand=+; Gene= SeqID_69920
cttcgaattcgccaatcgacttagtgcggatactgattcntggagaaaaaccaatgccagcaaattttctttcataaattttcattcatttaagatttaatgctaatttatgtatttaatgagaagctctcatacataaatttatatttttacacacaagaaatacatctgttaattatataattaaatgagatagggagagaaataagcttatgggagcaaattaagtcactgaacgcaaaaaccggtgaaattatcggcgagtaaataatagacgatgtgataccgggaatttttttggaatttatgatcaagtccccacaacaattctactacagtacacttcatttaccgtctgatgctttgtccgctgatcaacatcataaaaacacaaatttgaaagttaaataaatttcaatgataggaattgtttaagaaataatttatataaatatttttttaaatgtaaatataacatattttaccgcatttaggagagaaagctagagatgagaacatagtgagagaggagagagtgcgataaggaaagaaagtgtgggagaaagcgagagtaagagaaagatttatataaagaataaaaaattaattaagttatgcaatgattttttattaatattatacagagaaaaaaataaatcgttaattttaataaagtgagaagagagtgaggagagatggaaaactaattgatttttttagttgtttaaaaggcaaagcaaaatgataaaaaatccattttaatattttttttacaaaaaactacaactaattgctagggatatttgtaggaatttacatttatttgttgctccaaggctatgtatatgtaggaagaaaggaggccaaaaatagtatctctgtgaacaaatttttggaatatgtgaaagtttttggtgcttttgtggatttttgagaataattcatatttagttatttttaaaaatatagaaaaaatg

SEQ ID NO: 98684 - DNA, 362 bp, Heterodera glycines
  misc_feature (32)..(32): n is a, c, g, or t
  misc_feature (45)..(45): n is a, c, g, or t
  misc_feature (81)..(81): n is a, c, g, or t
  misc_feature (106)..(106): n is a, c, g, or t
  misc_feature (214)..(214): n is a, c, g, or t
  Promoter: Source sequence=SeqID_27251; Location=1..362; Strand=+; Gene=SeqID_57936
aaaaaaaaaattttttgatttcgctgttttgncgctaatttcaanaatgatgaaaagtgctttttgtgttgtctgcttttntatcgccacatacagtatggacaanagtataataatagtaatcaaacagtatcacagatttttttttaatcgagataaggttattttaggggttacagggtcggagaatacgattcagatatccatttcgacncaattccgaacccctgacgaacaaaaatcgaaaattcaaattttcatattcgcatttttggtctaaaactggtttaaattttttattgaaacatagatgaataatttagtttgtttcctcacatttaaaccatttcagaccaaaaatg

SEQ ID NO: 98685 - DNA, 156 bp, Heterodera glycines
  Promoter: Source sequence=SeqID_25064; Location=1..156; Strand=+; Gene=SeqID_55797
cggcttttagtaaagaataaaacaaataaatattgtctattttatagtgtaatattgagccaattgtatcaattgattaatagtgacggatcggatagaattacatataaacaattcacattaatatatcaaaatgaaaaaagacaacaaaaaatg

SEQ ID NO: 98686 - DNA, 1003 bp, Heterodera glycines
  Promoter: Source sequence=SeqID_9819; Location=1071..2073; Strand=+; Gene=SeqID_72820
caatcgagccaattttttttaatactttattttcattcaaatttagaattttgcctgccattgtttattttacattgacgaaaatgccgacactttgatcgaatcggagggatttttgcaaattgaccaaaaaatgttgtgcgaaattttggaatgcgacgaattgcaaatccgtgaagaaatttcaatgtggaatgcagtaaatttttttaaatttaaaaatgttacaaatttatttttaaaataagtccgaatctttttcggactattttataaaattattatattcaccagcctttccatatttacagttttcaactctccctcaaattggcactgtttcggcccgtttcgaagcgctggtggacaaacattttgatgacaggacgattttttttataattccggcaagttttttttgttttttttgtttttttctgttcttttttgtttttgtttttgggttatggtcccaaaagccttaacagccccaaattttcaaaattcttaataaaataaaaatttttggaaattcaagaaagtttatttgtaaaagtgaatagttttttatgtgtttttttgaaggattttatgcgtaaaatatttaatggcctccaagtaggcaagtttttttgtttttttttgtgtgtaaaaatgagaatgtttcaattttttaaattatttttttaggatttttttccaaaaaacgaacttcaattttcagaatatcaaagtggtggacattctaccctttttgaccgtccatatcttaagagaacattttttcttaaaattaaaaaatcttttttttttggaaattttacatttttaatttaattttttggccctttttattcattaaaaaatcttttttttggaaattttacatttttaatttaattttttggccctttttattcaattaagcctaaaaatgcattttctatgaacaaatttacatatttaactaacattttttcaaaatttcagctgggtttgcatg

SEQ ID NO: 98687 - DNA, 808 bp, Heterodera glycines
  Promoter: Source sequence=SeqID_1024; Location=4872..5679; Strand=-; Gene=SeqID_66344
ttgtttaggcatttctccgtgccaccacttctgcctgctacaaaattcgaattgaactttttgatttaatggaatttgagccatttgaattggtgaacgaacggactaaagaaatgctgatactggagaaagaagccgattatgaacaattcatttgtagtgattggctgttgaaacgatgccaaattggggagacggcggcgattcagtgggagtataaaagtcggcacaatttgaactatgtcaacttttggctttttaaggattgcattgggtgagtttgatgagagaaacagtttttgctttaataattgttggatagtgaataatttgaatttatggcgatctgacttattgactttatttgttatttctatgtccatccgccccctccctcgtccataaaagtggacacctcctcccactttttgttctttcctttcatcattcatttatattttatttcccaatttgccctccgaccgaatcaataaaattatttatttatttctttttctttgtgtgttctaagtggaagaacacaacaaattggcgcagtcagcagccattcttcatcactgaggacaaggacagctgcaaattcaacaaaaaccaatagcacccaggtggtgtgaggtctgctaagaagcagtttaactcaacaaaaaaaccaatagacctaagaagggtgaggttccgcaagaagcggtttttcaacaaattcgtcagcttagcaccaagacggtgtaagcatccaccaggtgtggattttgtggactttttcaacaatttcaattgacggacaatg

SEQ ID NO: 98688 - DNA, 180 bp, Heterodera glycines
  Promoter: Source sequence=SeqID_36917; Location=1..180; Strand=+; Gene=SeqID_66111
aaaaaaatttattaaaattggaatctggagtagagatttactctcgacggtaattatatggaaaaggctcaaaaatgctcgggacagggtcattgacataaaaaatcggatcaacccctaatttttaatttaatttatttagttagaatttttatgtaaaaacctttagacaatccgatg

SEQ ID NO: 98689 - DNA, 157 bp, Heterodera glycines
  Promoter: Source sequence=SeqID_14518; Location=639..795; Strand=+; Gene=SeqID_78570
attgggtcaacaaattcaaggaggtgtggccataatttcggcaaatcactgattttgattgcctctatttttgttttccagcgtttagcaatttctccgtgccaccatttcttctgtcagttacgaaattgattttgctgttcatgtgccgtcaatg

SEQ ID NO: 98690 - DNA, 140 bp, Heterodera glycines
  Promoter: Source sequence=SeqID_24221; Location=1..140; Strand=+; Gene=SeqID_54935
aaataaataataatttttttagcatttttagtgccaaattttttaaaaatagtgaaacattgccaattattcccgagagtgggtttgaaccgaaggacagtcagagcaacatagcgataaaatattttgaatggattatg

SEQ ID NO: 98691 - DNA, 84 bp, Heterodera glycines
  Promoter: Source sequence=SeqID_37465; Location=641..724; Strand=-; Gene=SeqID_66532
tgtgagtttaatggtcatacttgataattgcttcacgccttacccccccccccccagattaaagacaaaggtcatgtgcacatg

SEQ ID NO: 98692 - DNA, 216 bp, Heterodera glycines
  Promoter: Source sequence=SeqID_14816; Location=405..620; Strand=+; Gene=SeqID_78968
atagttagtccttttgttgaatttttagaaattttatccgtcaaatcagcttttggaattttaatgagtaaatcaggaaccgtaaatgacattctatgcttctcttgtttgatacaccggaagaaataatagttagtccttttgttgaatttttagaaattttatccgtcaaatcggcttttggaattttaatgagtaaatcaggaaccgtaaatg

SEQ ID NO: 98693 - DNA, 1003 bp, Heterodera glycines
  Promoter: Source sequence=SeqID_2128; Location=3804..4806; Strand=+; Gene=SeqID_77998
ttgttttggttacagttgagacacttcgttttttaatttgaatattggcattttgtttatttacgccaaataccaatttttaccgaccatgcctatggctgtactttttctggggccaccaactggaattgtccccaaaattgtgtttatatgagcaccaaatgttaatggagtccaaaaaatgttttttttttcacgttcattcgtttagaattgagcttttactgctaatttgctcaatgtctgccgaatcgttgttggaatttattgccaaattaacgacattgtcaatgacactgacagaggaagaaagcaagaaattggttgaattgacgaagaaatggacagaacaattagacaacatcattgggtaaattaattcaaatgtttgtaattttatggcaatggcaaagttttgtggtttctccgaaaaataaatttaagaagcacatttcctatgctaaaaaatgcgctgatcgcgaatctgagctcggatttcccaatttcggacccgaattcggaccctaacaaaaagaattggattttttccaaaatatgcattaaaaatcaatcaattttgacgaaaattgttcattttttggccttccgctgcctcaactgtaacaccgaccatggcaaataatcggcagtcctcgccgccgcccttctcgtccgccccggtgccgtcgtcgtcaaattctgtccaatcattgccatgtgccaccaccactgccacaaaaaatgccgacccaattgttctgacaccgaagacgacgatgccgacgacgacggcattccctgctgttctgccgatggtcccgcaaaacggattgccaggttttttaaaatatgcacggtctaggctcacattggcaaaaatttacgccgaaaatagacagatttaggcattttgaagggaagggtcccgcaaaacggattgccaggtttattttaataaatgtccatagtctccaaaatgtaatccaaaatttgcatagggatg

SEQ ID NO: 98694 - DNA, 455 bp, Heterodera glycines
  Promoter: Source sequence=SeqID_20891; Location=1415..1869; Strand=-; Gene=SeqID_51475
ttatgtgtaaataaacaaaaaaatttatcaaaaaaaaaagtttgaaaaaattttcaaaagtggtgactttttaactagcgccgaaatttttttgaagaaattttgaagtgaaaaattttaaaaaattcggtgtgggcggagcacgaacgacatgggaggggaaatgaaatgtttcgcttattttagtcaattttagactaacaataagtagcaagaagagttcggaaatgttttgttccacccaccactttttttgttgttgttgttccaattgggtcctgctgggttcggattcacaattagccaatgtttatgccatattcgtggtcaatgaaccccgaaaatgcgcattataatgagtttttggaacaaaaaattttaatttttttattatgatgctaacaatacaatacaacaaattgcagtgtcttggaatttaccccgcaaaagcaatg

SEQ ID NO: 98695 - DNA, 66 bp, Heterodera glycines
  Promoter: Source sequence=SeqID_3183; Location=1233..1298; Strand=-; Gene=SeqID_83572
ggttacggtttgcacattgtttaattgcgattggttgaaagtaagtcatatccatttcaggggatg

SEQ ID NO: 98696 - DNA, 68 bp, Heterodera glycines
  Promoter: Source sequence=SeqID_11495; Location=2318..2385; Strand=-; Gene=SeqID_74911
ataaaaaattaatattttaaggctgttcttggcacgccttttagaaatgttatccaatcgataacatg

SEQ ID NO: 98697 - DNA, 156 bp, Heterodera glycines
  misc_feature (14)..(14): n is a, c, g, or t
  misc_feature (60)..(60): n is a, c, g, or t
  misc_feature (62)..(62): n is a, c, g, or t
  misc_feature (69)..(69): n is a, c, g, or t
  Promoter: Source sequence=SeqID_19077; Location=1..156; Strand=+; Gene=SeqID_83822
attttttaatcctnaatttttagtcatttgtttttattacctctgcgtacccgggaagancncgctacngctcatcaatgattgaaaatttatgatttaaagtacaaaactcgaagaaacatcaaagctgattggagagactcatgtttattgatg

SEQ ID NO: 98698 - DNA, 461 bp, Heterodera glycines
  Promoter: Source sequence=SeqID_18750; Location=1122..1582; Strand=+; Gene=SeqID_83425
gtgattcggcaagcgatcaaccaccatttaaccaattgatcgatttttcactttaaaataaaattttttaatgtttgaaaataggattacaaataaaataggaggaattcataaaaagattaaaaataggtacaacgcatcaaataaaaaattctaaaaaaggatttagaagcatttgaaaaatgtgggtgggcgctcgctctatataaataagtgtgcgtgtccccgtcggcccatttcaatttattcctgtcaaacatttcgccgtcagttttttgtcagcagcatgtcggataaaaaaagcattgtttaagcgtgttatcgcagaggtggacctcactataagcacggtcggcataactttgagcggcccccgtctgtctgttccccgtttcattccgtttgaggaaaacgggcgttgccgcgcatgtaaaggaactgaggctgaggtggacacaatg

SEQ ID NO: 98699 - DNA, 158 bp, Heterodera glycines
  Promoter: Source sequence=SeqID_40609; Location=1..158; Strand=+; Gene=SeqID_68883
taattaaaactcgttgatttttatttgatgaatgttgttgtttatttttgtttttacttcatcttgaatagttttctagtctctttttgtttattgtcaatttacatatttcaatttgtattgtaattgttgcactataaaagactcacttagcgatg

SEQ ID NO: 98700 - DNA, 449 bp, Heterodera glycines
  Promoter: Source sequence=SeqID_2989; Location=1628..2076; Strand=+; Gene=SeqID_82655
aattatcacttattaaaagttatttttgtaaaggatatttattatatgagctaagaatattttatttaattaaaaattttcatttaaaaattgtttagatggccaacagacggaattttatgccaaaataaacaccgacaaagacatggtaatccaatattatttagttgaagtaccggtaaattaagtgggtggttgttgtattaacaataaaaaaaattatttttattctaaataaattattttttggtctgtaagcttcgagaagcgtttgaacatatttgccttgtccgtttctgactgtttaaaaagtagaaattgcgacaaaaaattataaaaaattaattaactatttttggccatctatcgtaccattcattaccataccaatttgttaattgtctttttttgattcatttgagtctttgccattttcagaggtcaaaatg

SEQ ID NO: 98701 - DNA, 121 bp, Heterodera glycines
  Promoter: Source sequence=SeqID_5959; Location=3529..3649; Strand=+; Gene=SeqID_46157
agtggggaacattatcatcaaatttagattatgttctgttgcgtaaaaccgagttttaataaaataaatatttttttaagcttttatctttgcttttttgaatttctttcactcaaaaatg

SEQ ID NO: 98702 - DNA, 229 bp, Heterodera glycines
  Promoter: Source sequence=SeqID_14691; Location=2035..2263; Strand=-; Gene=SeqID_78806
ttttgccaattccctgctccaccgttacgcattttattttctctttagccaattttaagtgctgttccaacaaaatgcccaaattcagttctttgatgacaaattcattggcgagattttcttgaacccgttgagccggtgaagggttgtgaaacaaaagcttaaaacactccgtgctgactttgccgtcatcgttgtcttcgccaattatgtcaatgtaaaaataatg

SEQ ID NO: 98703 - DNA, 1003 bp, Heterodera glycines
  Promoter: Source sequence=SeqID_17964; Location=2333..3335; Strand=-; Gene=SeqID_82526
tatcatttgaaagcccttcacatgctctattaacctgcaaaatttcgaaaaatttcgttaaggttcaaaaaagttaaggccaaaaaagctgaaaaacccggtttctgatgtacttttggtcataagtttgttgaaaattaacgaaattttttgatattttgtaggctaatagaggatacttagggctattgaatgatgccaagaaagttggatttggttggcaatgaaaaaacttatagttcaaaaactaggctggcgcgaaaacgacccggtacgaaaacgtcctggcccgtgaaatgcgtaccatctttaaaaaaacaaattctgcattaaaaataaacaaaaaaaattgaccaaaaaaaaagtgaaaaaatttcaaaagtttactcattttaaatagcgccaaaatttttattttaaataaaagtgatcaggagagaagaaattgtaattaaatcagtttttattttaatacccttttcttattataagtagagcatgaattgggccatgaaagaaaaagcagcaacaaaaaaacatttgatgaatatttggagaaaaatggaaagaaaaaggagaaaaagaaagtatgaggagaataaaagagaaaaaattagaaaatattagagatcggaattctcaaatttgccgggcagggccgggctgactttttcagaagcaaccgggttccgggcccggcctctcaaaacccggtcaacccggattttcccaaaaatcgccgggccgggttgccgggcccgggaaaacccggtacccggcccggcccggtccggactctagacaatataataaaataaaagaaaaaattaaacaaaatggaagaaaatatttaaaaaaagaatgaaataaaaatagcaaaaatcttagggatggtaattatatttaaaaatggagcaaagaattggggcttaatcaaaagaaattttattaatcaaaaaccgactaacaaaaatttgaaattgtacaaaaattcattgaaatg

SEQ ID NO: 98704 - DNA, 1003 bp, Heterodera glycines
  Promoter: Source sequence=SeqID_25210; Location=389..1391; Strand=+; Gene=SeqID_55953
gacccccgcccccatgttccacatttttttgggaaaagcacgccgcgaaaaaagctgttttaaaaataaaaaaggtcggcaatttacatacccgggacccctttacaaatgattcccaaaatgaaccccaaaaatttaaaaagaatggattttacgtcacaaattataattttttcctttcggaaccgccaaaccaagacaatctttttaattttttttaaatgggtttcttaaaggatgagattattgaaatttaatttgaaaattttgaaaattttcgaccagagttcagaatctgccatttttcctatttttgctatttttctcccgcggcccatattttgggattttttgcctcaaaaaacatgcaaagcttttattctgatcataaattactcttaaccaatttttagattggatttttttaaataaaaattttcaaaattaaaaaaaaaatttttttttgaatacggattgcggattacgggaaattgcggggttttttgacccccgcaattgcggattgcggatttccgcaactgagaaaatcgccgcaattgcggatggcggatttccgtaattgaaaatccagttgcgcccagccctgctctaaatggcatataacacacattcatggaaacactaatatttcttgaacatttttgttttatttttaataatgaaatttcaactcaaaccacagtaaaacagtcgttaaaaagaaatttaattaatttttattatgtcacaaaagcaaataatttaattgtaaacaaatttcaagcaaaaaacggataattaaattgcaacttcattaagtgaaacgtactgaaaccaaagtaaaaattagattattaatagaaagagacagttaaactaattctgcaaattgaatttcgaacgttctttcggtagcgtttaaagtaaaaaaaaaaaaaaattccaatcagaaattgtgaattcattttaaaattattggcacaaacaatggcaacaaagaatg

SEQ ID NO: 98705 - DNA, 387 bp, Heterodera glycines
  Promoter: Source sequence=SeqID_2961; Location=3764..4150; Strand=+; Gene=SeqID_82517
ataaaaagttgttaaaaacaaagattttttttactctaatttttgtgaataaattttagtaaacaacttttgattttttcttaaatttatatttatttattttgtgaatttctctttttctcctttaaaaaattctttggcaaaaaatttcaggccataggaaaattgggttaagataaagaaaaacaaaaaacacacatacccaaaagcaagaagcattgtccatcccattttatcagttaagcaaaagaatttataacaatgattaatgattaataattaataattctaaaatgataaaagtcaattattgtcacagcatttatcacaaaataatggcaataataatattaatgattgacaacaaagacaacttcttaaaaaatg

SEQ ID NO: 98706 - DNA, 1003 bp, Heterodera glycines
  Promoter: Source sequence=SeqID_968; Location=2414..3416; Strand=+; Gene=SeqID_65140
tctcttcattttaattatgtaaaaaacaacatttacttttctatgtgtaactttttttctttatgttaaatccgtaccaaattttgcatagcgatagagaaaaaaattctgcatcgattaataaggaaatttaatacaaaaataaggctcactcaaaagttatttggtgaaaaattttgtgaatttctttttctctctttttggcgtactattttcacatctctaacacacaaaaaacatcaaattcgtaaatgctaataattttggttgtaaaggaacaaaatcactttgagcatttagaatcaatagaaaaaagaataaatttagcattttggttagaaagagctgcctaggacttgagttataacatgataaaagtttgaaattccgacaacttttttctgagatgacaaattgttcgggtgatgaccccgagagagacatttaatttattttatttatgtaattccctctctctgtctcccgcactatttctctcatttaattgtgtctgcactccctttgtaaaggtcagacacatcatccctcccccatattgtgacccccgctcatttccaatattcattctgttttcttgttgtattcccacattttcctccgattgtcctccgccccaaatatttatttatttgtttccaataaataattgattatttattggactgtttaagctcggttaggtaagaccgaacaattggcgacgcctctcttcgactcaagccgggttggctgagcatcatcatcaaaagccgagtcggcaatcaacaattttgaaattctaaagccgggttggctatcatcgaatttcttaagccgagtcggccatcatccaatttgaaattctaaagccgggttggctatcatcgaatttcacaaagcctggctggcattcgtcgaaaagcagaaaaccaaaactgcaaaattcttcaaagccgagttggcattcgtcataaattgctgaaagcgaacacaactcaaaatg

SEQ ID NO: 98707 - DNA, 117 bp, Heterodera glycines
  misc_feature (42)..(42): n is a, c, g, or t
  misc_feature (52)..(52): n is a, c, g, or t
  misc_feature (60)..(60): n is a, c, g, or t
  Promoter: Source sequence=SeqID_2566; Location=1..117; Strand=+; Gene= SeqID_80434
aaataaaattaagcttttacagagcgcaggtcggttgagtcncgcgcacaanctgagtcnctgttgtgaattttgaactcatttttttgcggggggcgggggtggtactgaaaaatg

SEQ ID NO: 98708 - DNA, 181 bp, Heterodera glycines
  Promoter: Source sequence=SeqID_17028; Location=1956..2136; Strand=-; Gene=SeqID_81453
tcgatcagatgtgatcagcaacttttcactgaattcccttttaagtggtcttttcggctattctttggactcccaaaattttttgttttgcgaactttggtttgaactttcgcttttatatgggaaaatttggtcgtattttgtggatcatataaaggacgaaaatttaaaagaaaaaatg

SEQ ID NO: 98709 - DNA, 164 bp, Heterodera glycines
  misc_feature (32)..(32): n is a, c, g, or t
  Promoter: Source sequence=SeqID_22042; Location=1130..1293; Strand=-; Gene=SeqID_52681
caacacaacaaaaacaaatacaaacacaaacncaacaacaacaacaaaatcaacaacaaaaacatcatcaacaacagccatcacaaactcaacctacacaaacacaaataacacaacaacatcaacaacaacaacaaattctacgcccaataccgctgaaaatg

SEQ ID NO: 98710 - DNA, 183 bp, Heterodera glycines
  misc_feature (67)..(67): n is a, c, g, or t
  Promoter: Source sequence=SeqID_44617; Location=1..183; Strand=+; Gene=SeqID_72084
aattttgagaagtgagatagaaatgataactttcacgattcaaccaaattttcggtgctctaattanccgcgataaaaacattcgaatcaattaaatagcttctgagataataaggtttatcataaaatttcatttaaaaataaaccctcaattattggtatgaacgatactttccaaacatg

SEQ ID NO: 98711 - DNA, 156 bp, Heterodera glycines
  Promoter: Source sequence=SeqID_14221; Location=1489..1644; Strand=-; Gene=SeqID_78237
gccctaattagagaaaccattttaaattttcttcaataatgaaaattgtacaatttttttggggaaatgcttttgctttttgcccgaattccgctgtgccacttcacaggttgcagcttgaccctaacgacttcactttgcgtttgaccgccgatg

SEQ ID NO: 98712 - DNA, 272 bp, Heterodera glycines
  Promoter: Source sequence=SeqID_17500; Location=1677..1948; Strand=-; Gene=SeqID_82009
gagcgacttttaaacaattattatgacttgtgaaatttttaaaaaacttttaaatatttctgcttttcaacagaaacattattatgaaaaagcaataaaaaacaaaacaaaaaattgacgttaatttttttcaaaaagcaaaggggtcggggtcactttggcgcgggacattttggcgccgcaaaataggtctaagtgttctctaatagcctgcaagatgctagaaaaatatattcgttttaacaaaagatatggcgtgctgcgccaaaatg

SEQ ID NO: 98713 - DNA, 1003 bp, Heterodera glycines
  Promoter: Source sequence=SeqID_7065; Location=3567..4569; Strand=-; Gene=SeqID_63726
gaaaagagcaaatactgacactaggaaaaatttcaacgagaaaatacgaaattcatctttttcgagtatattcaagaataatctttgtctattgttattaccccagaatctacttatactcaaaactttaatagacttcaagctttcgtttgtttacaagaatgtaagcattgaccaaagtaagaagaaaatgattggacgcataaaacgaatataatatttaggaataaattatttacattaattgattgaattgattttcccttcgatttttttactcctgacttcacatttctccctgtttaagaatttccaccaatctctcattctctctgtctgcccgaattggacacccatttcgaaccccatacccggattctgaaaaaatcgctcagataagcagggtaaaattgaagaatacttgtacctcaccaaattcgacaaatgatatgtcatccgacgcctctatgtatctaatgcatgaatccgaatgaatttattgatggaaaacatttctggtcgagttatggaccaatcttgaatccgaaagaatttttggacaaaaaaaattgacataagctatggccatcaaaaacctctgaaaatgactgtgataaaaaaataattgttgactgcgtgggcacaaagggcctccgccaatcagtcagccgcctgcggatcacgcgttgacttcttccgtaacgttgttaatttcttttttgaccaaaaattctttcggattcatgcattagagactaataggtgtcgaatgatgtatcattggtcatctgctgaggtacaaatattcttcacttttttcgatatgcagaattcaaacgattttttctatctttttttattaaataaggccagtagaatgtcacattatatttggtagattgtggacattgaggcacaagctctaactggggttcgaattcttttatggaatagatggaaaaataaaataatgcaaaaataataaagtattacagcttttatg

SEQ ID NO: 98714 - DNA, 1003 bp, Heterodera glycines
  Promoter: Source sequence=SeqID_25386; Location=672..1674; Strand=+; Gene=SeqID_56125
cgcttgctggggttgtgctgtagagtgtaaggcgtatttaaatgttattttaaatgtaaatagatattttgttttctaaaatttaaataaataaaataaatgcaaatgtgaattttcgcgtggatgtctgcggggagggacgcgagctgggaggagagggctgtaaaatcaattaacgtgtgcgaattgtttatcggtggaaaagtaaaggataagcggaaatggtataatttaggaggtaattaagagcacattggttggtgtttgatcggatagaaagacataggaatggtgtgatgagtgggagtattggaattgattgtggggagggaggtcatttcaaaaattgctcgcacgcctgacagctcgggtcgcatttttgtccaacgtgacggattatttctatcattttttttttctctgtctgatcgcttcccggacgtggacgatgtcctggaaaaggaagacgacgacgacgacgacgaggaacacgaactggcggttccaggccgcgacaactcacaacgcgcttgcacctttcgttcggtgctgatcagtttgtatgctcggcggacgcaatcgcggggcacacgcaacgaggtggaggaggagcacggttggtccgcggccgtcttattagggaaagttttttacatttctagttaaaaaaggggggaggggcaaccgtaagcacaacatcgcacaacggctgaggtgccggggcatcgtcaatcgggacaggcccaatttggagtgccggaggcgcaaattgctgctgctgctgctggtgttgcagatacggttgaaaagcgaactgtagcggaggaagtaccaaaggcattgcgaatggtgggaagacgggcagtggtggcatgcgcatttgcaaagtgctgatcgcctgttggacggcagctgaaagcatcggcggcggttgttggtgctgtgttgccggtacgcaatgtgtcaattgttggtgttgctggtgctgctcctcctcgacatg

SEQ ID NO: 98715 - DNA, 1003 bp, Heterodera glycines
  Promoter: Source sequence=SeqID_666; Location=2054..3056; Strand=-; Gene=SeqID_58582
aaacgaatcttttcttcatttttgatcactatcgattcgttctcattgatttgtcgaccttcgagaattagtgccttgtaagtagagaatggcaaatcaacctttttattagtttttgcggggtatcaatttaaatgttgatatttaattaaatcaactaacattacgccatcaacgcaaatatcaatttaatttttaaaatttgcgctaattttttaaaatttatttgagcggcttataattttatggagagagacaacgcaaaaatgagggagtgctgaatttcaattccagtcatacaaacatttttgatcaaggagggtagagaaaataattccaatagagagcgcaatgggaaggtagttcatgtcgggtcgcggcagaaggaccctccgaatagctcatcaattgtttgggcctgaattttaacataacaattaattaactttaaatataatttttaaatttattaaaataattattaaaattaattgtaaaaaaatttaaaaaatatatttattcataaatatttatttcctaaaatattccttccacaaattaattaattttcaaagttaataaagtaaaaattaaataaattataatttttagtaaatttaattaaaaaattaacaattaataaattcaaattaaaataatataaaaattatacttaaatttattcattaaatttaattagaaaaatatttttaatttaaaaataatatttaaatttttgaaaatttctttcgcctttttttaaattttacccttgataatataaaatttatttttacatcctttgccccgaatttgacacaataatccaatttaagtaaaatcaaaagaaattggacacttttcgcgtccgtccgatgtttgcgcgacagaaagacactgacaattgggcggattatccgtcgcaacggattagcgcgattagcgcgtaaatttgcatttttgggggtggattttcgcagccaatttggaaatgggcaaaatg

SEQ ID NO: 98716 - DNA, 402 bp, Heterodera glycines
  Promoter: Source sequence=SeqID_10475; Location=1..402; Strand=+; Gene=SeqID_73682
ggaaatatggtaatggaggaaggggaaatacagtaatagagggaatatcaagggaaatatggtaatggaggaagagggaatacggtaatgggccctatttaaaacgaccagaaatattctgaaaataattttaattatttaagcttccatcgaccaattcacgcagctgcaaaatgaacagaagacacttttggaaaaagtggaacaaatggtgaaagaatgggagaggaagggcaaaatgccaattaagacaatgccaaaaaatgaaaaaatgttttttttataacactttgtcttagactttttgtaattttagtaaagaaaatccaattttcttatatttccttttttgtctctgcgcagggatcgaaaaatgactccgatttggtcaatttaatcatg

SEQ ID NO: 98717 - DNA, 223 bp, Heterodera glycines
  Promoter: Source sequence=SeqID_31116; Location=1..223; Strand=+; Gene=SeqID_61495
ttaattcctagggtgtaacttaagtttccgcacactttttttaaagaatttttttaagaatataaatttaaaaaaccacaatcatgatccgaaatatctgacattattattgagaatgagtttgctatttatcgggcaagggataaatcccattagaaaagtatttaaggagttagagttgataatgtaaaaatggtcattttcgaggtatgtatttttgatg

SEQ ID NO: 98718 - DNA, 817 bp, Heterodera glycines
  misc_feature (69)..(69): n is a, c, g, or t
  Promoter: Source sequence=SeqID_18409; Location=1..817; Strand=+; Gene=SeqID_83006
agcagatccagaaaataaataacataccaccataaacctgaaatatttctgtaaaataaagtattactntcaaatgaatgtttcataaattgggcgtgatttttaaaaaattatataaaaagcattattttataaactgtatttatttatgaaaaagaaagttattttgaaatttaggctaattgattcaaaaaatataatatttaataaaacaaaaataaaaactttaacaacgaaaaaaaatgaaaaataatttgaaaggaaacatgttttttagactcaattataataattatgtgaaactctaaacatctaaaaatacagcaaaaagtaaaaaataaatgtacgtgccaaagcttatttgctgaataaatgacattaaactttttatttttagtcgattgttgctcgtctttctttttaaatttatttttaaaaaatttaatattaattgattcggaaattcatttattggtaatttttaaaactttatttttaatgggtaaaatttttttctcactttaaagtcatgtctcgtccaaatagcccaaccttggcttgtattctctgtcatttgttaacgcgtagtttcatttcttaaattaattttctattttttatagtagcgaaagcttttatttaggatatcgaccgcaggaaaattcttgttcttataagtagccaaatttaatttataattaagtagattctttgtcttggaaatatatttgctaacaattacttatcatttataaattcaaaaactcgaatactttaattataaaagtattccagatttatttaaactaaaaagatg

SEQ ID NO: 98719 - DNA, 100 bp, Heterodera glycines; identical to SEQ ID NO: 98679
  Promoter: Source sequence=SeqID_8378; Location=2548..2647; Strand=-; Gene=SeqID_67856

SEQ ID NO: 98720 - DNA, 404 bp, Heterodera glycines
  Promoter: Source sequence=SeqID_11162; Location=595..998; Strand=-; Gene=SeqID_74513
tctgtaatttataatttaagaaatgagctagtactgatattaagaaacaagaaaccgctaaatgcagcttttatgtaaccgaccccgtttttgggttctttttttgcccccaccccccccccccccctgttcggatttaaacactaagaaataaatgtaacagtcgtagtagcagtagcattagacgtgcataccacctactcaaattatctatttggcgctgccaaaattaaatttcttttcttacggtagtcaatcaaaagattacggttagggtcatttagtgcggtacatttcagtgcgacgtatttttataactttttagtatttcgctcttattgcaaattacaatataacctatgaatttttaaccatttaagtttgcaatttgatttttaaaaatg

SEQ ID NO: 98721 - DNA, 1003 bp, Heterodera glycines
  Promoter: Source sequence=SeqID_2754; Location=2104..3106; Strand=-; Gene=SeqID_81425
aaaacttacctaagcttgtgttttttcaaaaaacaaaatcagcctggccggagttgcgatttttgcaatcatttagtcacataatcacatcataaagaatttaattggttgatgctcgacaaaaaaagcgtcgtacaacacagagaatgccatcgagactgagatcgccgccacatccagctctcgcatttaaaaaagcatataaatttgaatttgaaagaaaaattaaatactttggctttttgttctattactcgatatcgatttgttttcgatttcatcatcacaactaaacttaggtaatccatttgcatttgccatttggagtaacacgggggtggtgtcctttttggtggtgcgtgatttttcatgtttctttattttccttaattttaaatttacagtttcctaatcaaatattcaatttatacataggtatgtgtgaccttaatggctcgtttttactttatctttatgaaaatgaagatgtatctgttggataaatctgatttatatttgtttatgggtttttgggccgatgggggggggggggctgtggagaagagcgtcaacaaactattagattggagattggacaaaaacatttaaactgaatgggtacaccatttgaattcctttgtttagcctatccatcagcaaaaggggcagcaccaccctgcattctgaatttagagaagtccctctttcaatatcactggttctcctctgtttttttggttccattagatcttcccttatatgcaaaggtggttcagtatccccgtccaacagaatcgatattattatttatttttttccaatctccagtgttaccctttctcttcaaatccattacatttataagtcggtttttttagcaaaaaaagagcaagaatgacttgcacaaaggtcaattagctgttattttaacacattatttagcttttgtattcatttaactgatttgccatttgcctctttaaaattgtgcccataaacgatg

SEQ ID NO: 98722 - DNA, 1003 bp, Heterodera glycines
  Promoter: Source sequence=SeqID_19524; Location=62..1064; Strand=+; Gene=SeqID_84255
gaattgttgagaagtgatcgatcaatttgaattatttaattattgacgtgctcataaaaattgttccttttttactgttgttggaatgatcaatcaacctatctgtctgtgtaaatcattaggataaatttagcgatttcctgaaagatttcgaaaaaaccaaggtactgaagtttccaatcgggactcagttatccattatcaatacagtttgcaaaaaaaggcaccaaaaatcgtgaaaatgcactaaaatcccaaaaaaggcatataattttttttattagtgactttagggagcaaaactcgtaaaacttaactaaaaaacttaatttggtcatttaaatgattattaaatattttacctaatacttttttcgaataagtaaaatttataaatctaaattttttatcaagaaaaaaatgaaattttggcaaccactttttgagaaaggttttcaattcttaggggcgtattttttgaaaaattttcaattcataggggcgtattttttgaaattttctcaggtcatttcttagagggtgtatttccccggttttatttcatttttaatggaatttttcggaaaaaacgccaaaaaaggcaccaaaacggcaaaatgccaaaaaaaggcatttaaggcacgaaaatcccgaaaacggcaaaaaaaggcataataaaagtcaacgtagaagcctcaaaccaagtggaaaatgcgttttttatgcttaatatatcggaactagtgcgcagaaaaaaaggcatatgcctcaaaatgcgagctctaattatcaaaaacaaagaagaaaatgaactatgtagagttgagcgggaccgggaccaaaacacgaacaactgagtaccaaagtcccgggtttttcccgggtttcccagccaaaaattcccggtacgcgaccggaattcaattttaggtaattatgcagtttacaggccctttttaacatacattttcaaatgcctataaatctgttttagaaaataatg

SEQ ID NO: 98723 - DNA, 1003 bp, Heterodera glycines
  Promoter: Source sequence=SeqID_26378; Location=85..1087; Strand=+; Gene=SeqID_57114
ctgcaaaatttggaaagattatatcgattttagtgcgctaagttcgatgaaactttttaaaatataagcctaaactttttggcctgtttaaaaaggaattaaacatttttaaaatatttattcatctcccttttgatagaaaagcatcagagtgccttaattaattttttttaaataaaaaaatttgactagaccaatcgaaagctaacggtcgacctaatggaaaaaaatccccgaaggagagaatttaattaattccattccttcgggggtccgtgccgggtgccgcggggtaagcagtgctggtttcgtttcatcacggcccccatccttttgactagtcagccagcgttgcttaacttgtcagatcggacgggtacgcatgattccaattttccaagcaccccaccgaaagtagaacgaaataaccaaaatataaggaaaatattttaaaaagatgttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaagttcgatgaaactttttaaaatataagcctaaactttttggcctgtttaaaaaggaattaaaaatttttaaaaattttattcatctcccttttgatagaaaaagcatcagagagccttatttaacttttaattaacatttggtgtgtttcagagcactttctgaaaaaatacttatgaattaattttgcaaaaaataaataattaatgaaaaagtcagaatttcgaaaaattttaaaaacaacaagcgttggcattttttcaggttaagttagtcctttacaatg

SEQ ID NO: 98724 - DNA, 219 bp, Heterodera glycines
  Promoter: Source sequence=SeqID_44760; Location=1..219; Strand=+; Gene=SeqID_72195
aaacatttccgaaataagagcaaaacatgggaaaaaccatgctatacttaaaacccattgcttttttaacgaaaaagaaaccaaaaagcaaaggcttttttccgtacggttaatttcaagaaatcaaccaaaaattttcggcgccgacggaatcagaattattatctatgtttttgtataagatttttcattaaattttccagatctattgaattcatg

SEQ ID NO: 98725 - DNA, 294 bp, Heterodera glycines
  Promoter: Source sequence=SeqID_5125; Location=2602..2895; Strand=-; Gene=SeqID_57000
tagttgcaaacggcgtcagctcctgctgccccctattttgtagtagtatagaccgccaccagcacacggtcacgcagtgctctctctcctctccttccgctatctgctatacgctctctcttttctctgtctgagctctcactgaaataaatgcagagacgctaaaattgatttaaataaatttaaatttatgtctattgtttccccatttttgttactttactcttctttgatgttctttttttgtgtaggctttaatttgttcatctttaatgttttagattgttttaaatg

SEQ ID NO: 98726 - DNA, 292 bp, Heterodera glycines
  Promoter: Source sequence=SeqID_20211; Location=531..822; Strand=-; Gene=SeqID_85007
cgttaagtcacacaaaaccatttcagagcttgccatatttttatttatttattttaccactttgaattttgttatatttgaatggtatttcttctaaaactcatttatctcttttttattgtttcatcgctttacaatgcccctgatttttgcttcatcttttatcgtgttcgtgaatctcctctctttcgccaattgaaatgtattcggtgatttttattattttaaatttttttttatttaaattcggattttctatcttttaactttacccaaaaagtagcaaaaaatg

SEQ ID NO: 98727 - DNA, 118 bp, Heterodera glycines
  Promoter: Source sequence=SeqID_25532; Location=1663..1780; Strand=-; Gene=SeqID_56273
aacattaagtttttatttaaattgaaatttcattaaagttttagaagatgtcccggcgaatcgaacattttgttgaccccacaaaatccgacatttactgaatttcggtggtacaatg

SEQ ID NO: 98728 - DNA, 1003 bp, Heterodera glycines
  Promoter: Source sequence=SeqID_8906; Location=2256..3258; Strand=-; Gene=SeqID_69594
atttttgtatcttttttaaaaatgtgataaaaaggtgaaataaaatttataaaatagggctaaatattgtggatttttgtactatttaacttttcccgaatagcttttcagaaggcagttacgaatttttttctggaaattcgaaaatttccagaaattctggaataacttttttccatttgaagataaaaaatcaaaataaaacccataaaattctgtttatggtaaaaaaaaattcagcctacatccacttaaagtattttcattcaacaatgagaaattcattttaaaataaaaataaggaaatttaagtcttccaattatttagtaaactttcgctcattttttattcataataattggatgttaaattggcgttttgacctttttaattattttcatatttgtactttattctccacgccccaaccctccttattgtgttcataaggagatcattcccctattcccctcctttttgtctcttccctcattcattcgtttttattatatttttgcattgtccaccgaccgatcaataaatatttgtttattctttgtgtgttaattggcaagaacacaacaatttggcgcagtcagcagccaatcttctccaccgaagacactgcaagtcttcgaaaacctatagcacccaggcggtgtgaggtctgctaatatagcagttaaattcaactaaaaaccaaaagacacaattgtggtgaggttccgcaatacgcggttttatcttcaaatcttcaaaaatccttaacactcagcaagtgtagggagccaccaggtgtggttatttggatttcaacaatttaaagcttattctcgatgccgttttggcaaaatccgaaaagcggattcaacaaatgatgagtgcccagcaaagtggtggaacatctgcgagcctaagccatgcaaatttggcgagctcaatcgatggacgaatttcaaaattccattacgactccgagtcgggaaataccttcgagcaatg

SEQ ID NO: 98729 - DNA, 61 bp, Heterodera glycines
  Promoter: Source sequence=SeqID_8340; Location=1505..1565; Strand=+; Gene=SeqID_67735
tgtgggtttttcaattccattaaatatttttattttttaaatttaagagcaaaaaataatg

SEQ ID NO: 98730 - DNA, 73 bp, Heterodera glycines
  Promoter: Source sequence=SeqID_16130; Location=477..549; Strand=-; Gene=SeqID_80494
tctgtcaacgaaataatggcgaaatatttaaaattaaaagataagataattaaataaataattccagttaatg

SEQ ID NO: 98731 - DNA, 75 bp, Heterodera glycines
  Promoter: Source sequence=SeqID_8645; Location=2412..2486; Strand=-; Gene=SeqID_68763
ttttgacgatttcgtcgacttcagcaaagtgagtgataaaggcataaatttgtcattcgttttattcttgaaatg

SEQ ID NO: 98732 - DNA, 209 bp, Heterodera glycines
  Promoter: Source sequence=SeqID_1825; Location=224..432; Strand=-; Gene=SeqID_76193
tattgtccaacccctcgggcccatttgcaacaatttaaggcaaacaaaattcaaaagttgtttggataaaatgtgattttcgttagaatttttggttttccgcttttctaattatataaaaataaagtttccaacgcaattaattcttctgttatttgtgtgacatcattcggaactcgtccaaattgtgcttatttctgccaaaaatg

SEQ ID NO: 98733 - DNA, 338 bp, Heterodera glycines
  Promoter: Source sequence=SeqID_36194; Location=1..338; Strand=+; Gene=SeqID_65578
ttcccctcaatgcttttcctaagatcgctccttctgccaagtgtctctcaactttgttcaccgcattaaatttgtgcaggaatcaattcgattcgagtttttgcattgtatgttcgttttttgttttttcaatctttagatggatttttgtttccatttcctataaagtaattgagagatcaaaactaattatgacacattaaaaggaatgggcggggggcgatttttcttaattatcttacgccacttacaattagcacttaggttttaaagttgcttaaaaaacagaaaaattcacctaacttgccctatgttatcattcaatttcttcaggcatg

SEQ ID NO: 98734 - DNA, 61 bp, Heterodera glycines
  Promoter: Source sequence=SeqID_42755; Location=579..639; Strand=-; Gene=SeqID_70576
ttttcacccctctttatttctctctttaaaaaattaaatattatttttaatgatgatgatg

SEQ ID NO: 98735 - DNA, 272 bp, Heterodera glycines
  Promoter: Source sequence=SeqID_41892; Location=716..987; Strand=-; Gene=SeqID_46687
gaacaggcaaaaccaatctcgccaaaaagtatcattttgtcttgcctatttatcgaggttctcgtctcactccctttgttctttttcagttgcattttcctgcccccgtcgttgatccctcgctggacactgctcctccctccgtccgttccaaattcactgtcgaagctgccaagtcgccgttgccacttgccacctttgctggctctgcgttgcctgccaaagttgtgccgaccgagtccatcgaaaatgccgtccccgttgctgaaatg

SEQ ID NO: 98736 - DNA, 74 bp, Heterodera glycines
  Promoter: Source sequence=SeqID_41068; Location=1..74; Strand=+; Gene= SeqID_69274
accctataaaaacacctgggactgaatcgtggtggacacctcccccgagacaaaacttttaaaccaatattatg

SEQ ID NO: 98737 - DNA, 564 bp, Heterodera glycines
  misc_feature (36)..(36): n is a, c, g, or t
  misc_feature (77)..(77): n is a, c, g, or t
  misc_feature (82)..(82): n is a, c, g, or t
  misc_feature (87)..(87): n is a, c, g, or t
  Promoter: Source sequence=SeqID_117; Location=6318..6881; Strand=-; Gene=SeqID_72235
ctgtgcattatatactgcgggcattgaaatttctangggttatacttaaattcgcattcggtgatcgtcagagagtntagtntaatnccggtaccgagattagcgagagcaattatatttacgattatcgggttttgcattttgatacaatgtaccaatcaaattgtcctttcactccctttatatactccttctataaatagcaaccaaaaataaaattaaattgaaaaaatgaactgtccacataaaattaagtgttgtcattactgcccctgtcattacgagatatgtaacagatgtaaaaaacacagtcttttgcatttcggtacatcattttttgataatttctggctatgccccaaatgcgcgaaacatgttccctatgaaaatataaataggtcaaataaataagatgcattaaaagtgtttcgcggtccgttcactctaattctctcggggactactgggagtggtaagacccgttggctattacggtttttaaagcatcataagaatctaattgaaccatcgcctgaaaaaattctttattgttatggtgagatg

SEQ ID NO: 98738 - DNA, 1003 bp, Heterodera glycines
  Promoter: Source sequence=SeqID_6609; Location=1145..2147; Strand=-; Gene=SeqID_62192
caatgcacaattattttatttttcctgaaaattcatctctcaattagcagaaaacattttgctattattggatgtttaatgagaatttggaaactcaaagataaaaaaaaattgtccttcctctttaattggttaaaacgaatgtgatatttgcgactagcgaccttgaaagctccccggaatcaatagaaatttcgttaaaaatgcgtttgagaaaattcaaaaattctattttgtatactaaatattaaatagtaaaatctatatataaaaatttgagttgaaacagatcaaaaatagttaaaattttatcactttaatctcggtttcacaattaaagccaaaagacgtattagctactaaaaaggattagtcataaaaaagtcgacataaaaatgaattggccaaaaaaaagaaaaatatttatgcttatccacgtcgcaaatgccgaccaaagacaacttaatttataatattttaaccagcacaacagctcgaagagaaattttatggtcggttcatataaaattcttttttaattaaacggttaattttttttaattaatgaaaaaattaataacaaataaattttatgatcatcaattctttttttcccagaaaatattaatgaatattcaatcagaaatgatagtgaacgatttgtccttttgaatctaaattatttcattcattttaaaaatctggaccagagttcctgtcccgacttatttttttcagataatttattattgctatggaatttcttttccttttccatttgttgtttggcggaattgcattttgtgtcgccagtgagttttaatgaatttttcaattaaaattgttttatttcctaattgagctcaaccctactcgcattgagtttaaatgttccatcggtgagaaaagacacaaattaaaattggaaaaattaatcattacggttggaacaagcaacgatgggctgacgctaagtttggtcagaggatgccagcaggagatg

SEQ ID NO: 98739 - DNA, 54 bp, Heterodera glycines
  Promoter: Source sequence=SeqID_21591; Location=223..276; Strand=-; Gene=SeqID_52192
ttattttaattgaaaaatgaatgattaattaatttattaatttttttagaaatg

SEQ ID NO: 98740 - DNA, 75 bp, Heterodera glycines
  Promoter: Source sequence=SeqID_29357; Location=789..863; Strand=-; Gene=SeqID_59866
ggtgccgtccctcccccccccccgccccctccgttcatttgattttccgttgccatcgctttgtcagagccaatg

SEQ ID NO: 98741 - DNA, 89 bp, Heterodera glycines
  Promoter: Source sequence=SeqID_32398; Location=218..306; Strand=+; Gene=SeqID_62709
ggtataataattattcacttgtgctactatctaatcaataggttgaagtaaattatggcgtaaattaattaggtatatttcagatcatg

SEQ ID NO: 98742 - DNA, 176 bp, Heterodera glycines
  Promoter: Source sequence=SeqID_18454; Location=2043..2218; Strand=-; Gene=SeqID_83052
gctttgattagctccaaaaaactattgaaaaaaaataaaaggaatcattacaaaaataaaagagaccaaaactgaatttgaacaatgagcgcaatatcattcctagataaacatttatttttgtaccgctgaaatctatgaaatttattaaataaaacaaataaatttttagtatg

SEQ ID NO: 98743 - DNA, 222 bp, Heterodera glycines
  Promoter: Source sequence=SeqID_20103; Location=1417..1638; Strand=-; Gene=SeqID_84891
tttttttgacaattgcggaccaaaattaatcaaaattaaatttcaattattcaaatgtgcacgtagaatactgctatggttacacgataccttcttatgtctagtaatccccggaaattgccagtatcattaatcatatgctcattgctttccaatttacaatgtattactccctcgcttatagactagaattaacacttactcaaaaacaatttgaaaatg

SEQ ID NO: 98744 - DNA, 1003 bp, Heterodera glycines
  Promoter: Source sequence=SeqID_2754; Location=2758..3760; Strand=+; Gene=SeqID_81426
aaaggacaccacccccgtgttactccaaatggcaaatgcaaatggattacctaagtttagttgtgatgatgaaatcgaaaacaaatcgatatcgagtaatagaacaaaaagccaaagtatttaatttttctttcaaattcaaatttatatgcttttttaaatgcgagagctggatgtggcggcgatctcagtctcgatggcattctctgtgttgtacgacgctttttttgtcgagcatcaaccaattaaattctttatgatgtgattatgtgactaaatgattgcaaaaatcgcaactccggccaggctgattttgttttttgaaaaaacacaagcttaggtaagttttccgtccgctgatcgtctacatacatttccgttggcaccacaatttaatttttgaactgcttaaattgtcacaatatttttgtgtccattttattattcgtcctcatcatttgtatttgttataacatattctctacgtacgactacgaaaatgtccaaagataatcaacggagcatcagcaaccatttgccatcatctcctcatttgcctcacttatgcaattcaatttcttatcagcaaaagtcggccacctgagcaccaaatgaatgaacagcggcgctgttgagggccgagcgggcggtgagggcaatggttttccatccatcgaagtgttcctttagcattcattggcctttcttcctcagctcatttccatcaaacttttgatctcctccctctctctctcacttatcctttcatcagttgggacggattttagcgccaaggggcggcgaccccacaaagggactcgttcttttattttgttgactcaaactttagtggtgaatgtttgaactttgtctccgctcaattactttcctcccgatgaactttctccgtttatttgtgaagccaagacgattaattatgcctaattctgtgtaaaatttgaaatatttttaaagaccctattttactgagttaaaaataatg

SEQ ID NO: 98745 - DNA, 813 bp, Heterodera glycines
  Promoter: Source sequence=SeqID_136; Location=1158..1970; Strand=-; Gene=SeqID_46910
tcactaaatctacaacatttggatttacaccattgccattttagggaaccaacttttctactagtcagtatgaaacggcggatgttggtgttggaaatcagaaaagcatttgtttttttgttaatgctgatactcccactattcgttcgtatatgtcttcgtttcggagacatcaaaaagaggagactttgcgcaaggaatgggggaaaaagcgagagtcaattgttaaggtccaatacatatacatattttagcgctaataatatatattttgttttcaaagactttaaaatgtttctaaaagatcatttaaactattttcatatcaaaaatacaaaatccttgtagacattcctgaattttggactttttgttctaatttatgtctggatttagtaattggtcgaaatgtacgtgaaattcctgatcggctaccccggtctctggaaattgttttaaggatttaaaattttattttaaatattaggacaattttttgcgaaacaaaagatgtcctcttttatttatttttctaatttaccttttcgtttttaagttttataaaaaagaaaggaagtctgcactccgatatttaaagaaacgggcacaagaaaagcgataattttatcagaccgatttttgtccgtgtacatgttccatgcgaggtttaagaagccacgactaaattttataaatctggtgtcatgaaaatgtattttaaatttgttgttttatgctaaatattttactttgaaatctttgcgcctacttacaattgacctttagtctgttactaaaatgaaacgcaaaatg

SEQ ID NO: 98746 - DNA, 1003 bp, Heterodera glycines
  Promoter: Source sequence=SeqID_3526; Location=1090..2092; Strand=+; Gene=SeqID_85042
ggtgtcgctgatcacgaatagagtatccatttcgatcaatttccaattcagatccaaattcgaacaaaaggtcgaaactacaatttttagaatttcgcattattgatttaaaaccggctttaaaacaaagaaaccaactaaaaacatcaatgcttcaataaaaaaaagttcaaaccatttttagaccaaaaatgcgaaattctaaaaatttgaagtttcgactttttgttcgaattcgggtccgggtttgaaattggtcgaatggcattcgcgtcaaagaacccattcctttttatacccgacaaaagcggggccaggccggttttcgcgtggggaggggtttttggactataactttttttctttgccgaccaaatccaacattcttggtatcattcgaaagcccttctgatgctctattagcatgcaaaatttcaaaaaatttcgttcagtatactggaaaatttggttttttgaactcttctgaccataacttttttgaaccttaatgaaatttttttaaattttgcaggctaatagaggacacatagggctatcgaatgatatcaagattgttggatttggttgacacagaaaaaagttatagttaaaaaactcgccccacgcgaaaacgacccgacccgacaaaagccgactccacgactttcccaccccaaattgctaggcaaatttttagtataaagatgccttttttcttctcaatcgcctcattccattcattcattcattcgtccatttccggtcattctgttcctgcaaatgtcttcagaaattctgtacgtttatttattgtttcttttttttctgattttcggcatttcttttgctcaatttttgaccatcagaattgggagatgaatgaaaatttttgaaactaattttgaaggcttagcttaatcggcttcaaaaaaatcaaaaagaattaaaatttcacatttgaattccatcattttgatacttttcctaattcatttttcagatg

SEQ ID NO: 98747 - DNA, 168 bp, Heterodera glycines
  Promoter: Source sequence=SeqID_17835; Location=1857..2024; Strand=+; Gene=SeqID_82367
ttgctgcggttctgctgtttaacgcattgctgcgaatttcaacgattttcgtcccactgcaaacgcattgctgcgataagtgaggacgtggtaccgacttattagcgcattgttgctaacttttggacttcgaaacgccaaattttattgccgccgcttagagggatg

SEQ ID NO: 98748 - DNA, 81 bp, Heterodera glycines
  Promoter: Source sequence=SeqID_20018; Location=142..222; Strand=+; Gene=SeqID_84793
ttataatccctcccttttaattttcttagtccctctggctcgggtggtgctccgctgctccattcccaactgcgaaaaatg

SEQ ID NO: 98749 - DNA, 511 bp, Heterodera glycines
  Promoter: Source sequence=SeqID_4777; Location=845..1355; Strand=-; Gene=SeqID_45899
tggtttccttcgtggaaagaatagttaagtaattatgttaattaaattttcttaatttttcggtagaaaattttttcacaatcaaagcaaagataatttagggtccacctcaaaaagttcgccatatataaaaatttatttcattttttcaaatttctatattaaacattgacttttttgattttctagcaaagggcgaaccgaatggtgggcttctcttggatacaaagaccttgacctgaagcgtggcttgacaactggtttttatcctttttttgaggaaagggacattcgttatgttgattcgaaaggtatgtattgttttattgacaaaaagaatgaaattggttttcaatatgattatccggtaatcctttattttcgggtaaattttttcgaattttctttctacattcacaaaagttcggtggggtgtaaagtacaaaaattgttcgaaaaaataacctaaattaaggaagtacccgattatgttttttttaagtgcctgatg

SEQ ID NO: 98750 - DNA, 381 bp, Heterodera glycines
  Promoter: Source sequence=SeqID_22668; Location=1366..1746; Strand=-; Gene=SeqID_53353
ttctagcttaaaaaatgctacctttatttgttatgccggccgtaccgtgcacccccccaaagaatgcggattttggacagagttagcgaattgctgctgcagaattttaattaatcggaaaattagttttatttatattattattaaagtggtccccgcccttctgatggcaatttctttatcgataaataaataaataaatcagttgagagagaaaccattcaatttgcaatttaatgaaacagtaatactatcaatatttcactttaaatttgtatgttttaaaagagaaaaacattaaatcatcatttaaggaatattaatattatttttatttctttcatattaaatgaacttctataaatgaaaaattcagcaatg

SEQ ID NO: 98751 - DNA, 184 bp, Heterodera glycines
  Promoter: Source sequence=SeqID_33365; Location=1..184; Strand=+; Gene=SeqID_63447
ttaaaaagaaacattttcttttaaggaattgatcaatgcttagtccaatcttttggtcactgaaaatttgccgagacaaattgcacattctgccgatgatgagcaacagcagcagagttcgactgtcgttcatcctcctcccctttcaccgttgaacagtgaggaccatgaattgagcggaatg

SEQ ID NO: 98752 - DNA, 546 bp, Heterodera glycines
  Promoter: Source sequence=SeqID_391; Location=1742..2287; Strand=+; Gene=SeqID_45595
attttgacgatgacctattgcgatgatttttgtaacatgcatgaatgtgtgaccatgaaataggacacctgtggtgagtgcctattaaactttcccctaatattgaccaaattatgaacaattaaggaattgtccaccccttatcaaaggggctatggtgcagcacagcggggagcgggcgttggtgacgtgtttcgaggactttgacgcttctttctgcccattttacgtcgtgttggcaccacagtagggtcagaggcgttgagcactgggaaacgagtgctggagcgcgttgggaacgatggaataccgattaaggaggcgctggtcaccgagggaaagcgaggaatagacaccgtgctggacaaaggaggactgcctaaacagtttggtactggacagaagggtataaaaagaagacgaatacgtgcgccaagtcatcaaacaataattggcggacccccaatcgccgtaaagcagacaacaagaaagcgtgttcggtcggacgcctttggactctactgattagcagcaaccagcaggatg

SEQ ID NO: 98753 - DNA, 218 bp, Heterodera glycines
  Promoter: Source sequence=SeqID_30811; Location=846..1063; Strand=-; Gene=SeqID_61190
ttaattgcttaagtgcttaaaatttagttctcagcaagtgcttcttaaataaaacttcgtttaccaacaagtaaatatataattaaaatgattaagatttttttgaatttttttaataaaaggtataaaataagtaagaatattttacgtatttgaatgaatatttaaatcggcaaatttgctgaaaggaaagacaatttaaattttcagcaaaaatg

SEQ ID NO: 98754 - DNA, 536 bp, Heterodera glycines
  Promoter: Source sequence=SeqID_11585; Location=1745..2280; Strand=-; Gene=SeqID_75026
tatatgagaggcatatgcctaaaaagtgcattcatttgctctattcataaaatattcacatttacgctatgcataaaaaggagtgatatgaggggcatgtgcataaacgtgtgtgtattcaaatgatatattcataaaaacgcatatgcatgaaacggtatgcgtgcatatgaaaagaaaattatattaataaattataaaattcagagatgggctagaaaagcataacacataatatacaacacagagactgacatatgcataaaagtaaattattgatgtgtaaaaaatattaagcatacacattgcgttgctggcaaatgcttaggcgtgcgtgcttgccatcataaatgtgcattaatctggtgaaacattgattaatatatgagggaatattcataaaaatgcgcattaatctggcgaaatgctgctatgcgctttggcgtgcgtgtgctatcattataaaagccgattgaatagcgagggaattatcacaaaatcaaaaccccaagagttgttcatattacttcagaatg

SEQ ID NO: 98755 - DNA, 59 bp, Heterodera glycines
  Promoter: Source sequence=SeqID_9669; Location=1222..1280; Strand=-; Gene=SeqID_72275
attgaattagtttaaccagggattaccgtttagacgtcacttctccctcaacctctatg

SEQ ID NO: 98756 - DNA, 812 bp, Heterodera glycines
  Promoter: Source sequence=SeqID_3965; Location=3438..4249; Strand=-; Gene=SeqID_45686
catatagcacatatttgggctattttggattttttagcacatattttggcatttttgaaaaaaatcgtaagaaaaatacaagaaaatctgaaaatgcaccctaaaaattgactactttacgtttcttaagcatttagaaaatttctttatatatttaaatgcctaaagcaggcaaatcaaacgctgtgttaaatcgtcactggatttcaaagttcccggaaggaacttattcaactgatggaaaaattaatccgggactttacaaattgattgatatcgccaaaattttgactggcggtcgggcgaaaattgataaagactgatattaaatatgattttttttgcgtaaatacacttggttttttcaatttttagcacaaatttttgcattttttaacacatatttaggccttttttttggtttttagcacatattttggggttttttagcacatattttattacatatttcaggatttttagcacataaaaatcccagccctagtcatagggtccaactcaaaaatgttcggaatcgatttgaatggcctaaaataaagaaaaaaatgcaataaaaatttgtactgaagtgtccaccttcgatggggactgaatcgttactttaataaccatgaaaaaagtcttaaatggcctaaatttattctaaaaagaatagtatcttttgcgctcctaatttgcatttttctcatcgttttaagccgttttaaatctgagcaattttgagtttgggcccttaaaaacttatttattttttatgggacaattaaaggaagcgatacccacccaaaatg

SEQ ID NO: 98757 - DNA, 108 bp, Heterodera glycines
  Promoter: Source sequence=SeqID_3012; Location=1975..2082; Strand=+; Gene=SeqID_82769
tttttttagctataaaaaatttgcaaattgagatatgaacaaaatcaatatactattttgtagacaacaattagcttaacaaaacggtatataaaacattttattatg

SEQ ID NO: 98758 - DNA, 470 bp, Heterodera glycines
  Promoter: Source sequence=SeqID_10298; Location=1..470; Strand=+; Gene=SeqID_73463
ttgagggaatttttaaatttatactctatcccagaaaaatggctatctctttttatgagaaattttatacctcacaaaagcgcttgcgtatgagacggagggctgtgcacaatcgccattttatttcacagaggatttttatatttagaggttatcccagaaaaatggctatctctttttttgataaattttatacacatacaaatgctctcgagcatgatagggagggcggtgcgcaatagaccttttatttttgagggaatttttaaatttatactctatcccagaaaaatggctatctctttttttgagaaattttatacctcacaaaagcgcttgcgtatgagacggagggctgtgcacaatcgccattttatttcacagaggatttttatatttagaggttatcccagaaactctactctaatttaaactattaattaaatgtgtaattcaaatgattaagcatg

SEQ ID NO: 98759 - DNA, 332 bp, Heterodera glycines
  Promoter: Source sequence=SeqID_26526; Location=1..332; Strand=+; Gene=SeqID_57264
acatcgaaatctgcggggaaagccaattgacggtcacccccccaggcaacggatttggtaattaattgtgaaattgaacttataattaaagtgattttttgaattaggatggcattctgtgtttgcgaaatttcccatctccaagtgttgtcgtcccttcatgttctactttgaaatgaaagtcaccaaattgggaaggtaaaatgacatttattaactaattaaattcacaaaattcgcataaaattattgtttttgtgcattttttgttaattttcatatatttacatttttatatttttgcctcgattggattcgccaccaaagaaatg

SEQ ID NO: 98760 - DNA, 336 bp, Heterodera glycines
  Promoter: Source sequence=SeqID_15375; Location=3523..3858; Strand=-; Gene=SeqID_79633
aaaaagctcagtgatgataaaataaaataaattttaaaatattaattatggaacggcaagtgtaattctgattaaattctattagatgtgtataaaaaagatttataatatttatacaaagctaaaaaaggaaaattcgcaaattaattgaagacaattgataaggtgctaattttctttgcatttcatgtaaagattttataatttcattcccgaaacagtgaattaattgataacataagaatggatagtaaaattttgagtatttaagctaatttttattaatctataaatcacaaatttaaacaaatattcactctcccaatcgctgcaatg

SEQ ID NO: 98761 - DNA, 1003 bp, Heterodera glycines
  Promoter: Source sequence=SeqID_1068; Location=546..1548; Strand=-; Gene=SeqID_67169
tcctacttggcttttgtcttaataatccatcattgatgcgaatggatgagcggggggaggggaggggcggggagtgagtgagtgtctctgtgtgctgcgcttgtcccttccggccaatcccccgggggggggggggggcttggcgagtgcttctgctgagggtgggcttttttccttctccatcatacatacgctcgcttcgattttccacccgctcgcttctgaagccgttgctttttgctgcttcccccccccttttttttccttttttggtcttttctccttttcctcattcctttccttctttacctcttccgttctgtacgtctttgatggcattttctgctatttttcatctttttccctcccccccccattcattgctccgtttcccccgcactcttttggaggcaaaaaatgccatcgtccattgtcgattagttggcaagacatcctgctcagaatggcacctctgcttttcctcccttgggctcaccatttgttttgttctgtctgggctcaccttttccttttctctctttttccattcgccgctttcggtgaaaagttaaaaggtgcgaaaaatatttaattattttaaaatatattaaaatactattctgttcatttcagtgtttttaattttttatggacctttcggcaaatccaacgacccttccggggcctttgtataaagtagagttgagcgggaccggaaccgggccgggaattcccggtcctccgaggtcccggttcccggtcccggctaaaattccaattgttctttcttttttgttagttttcgttgtttaatttgaacgaattaaaaaacggattttgttttcatatacaaaaaccaaaaacgaaaagaattccattcaaattgaccatttacgcagtttttttttctctccaatttttataaaaaaatgattgtttcaacaatttaatcagctaattaattccgtcaaaaactgtcttaatatttgccctcaccaaaatg

SEQ ID NO: 98762 - DNA, 539 bp, Heterodera glycines
  Promoter: Source sequence=SeqID_40448; Location=1129..1667; Strand=-; Gene=SeqID_68779
tgcttacagtttatttgttctgtgataccacattacaacgttatgccgacccaatatgttgtgccaaaataagacctggtggcgattgttccttttttgttggaaacagttaaacattttaaaaaagaaaattaataataattttttataaattatatatttattaaaaattaaaatgacaaaaataaaataaaattttatttttcgattagaagaagagtcgtgctacaactcgacctgtgttcaaggcatatgccagcagcagaagcagcagcaaaaaccgaatgtactacagttgcatcggcatggcacgcaaattgtagcgtcagcaatcgatgatgtgggtactgtaacattgacaccgtacataagggctgcgatggacacgacaccatcgcctactgtaagcaaattgtatttagttttaatatttttaatgtttttaattaatttgtttaacatatattttacgaacaaaaaaaaatgagcgcttaaaaatgttcaattaaatttggtacaaaagtgagcgattaaaaatg

SEQ ID NO: 98763 - DNA, 675 bp, Heterodera glycines
  Promoter: Source sequence=SeqID_3731; Location=1..675; Strand=+; Gene= SeqID_51657
tctttctgtccaattccgatctcttcggtacatttcgcaattaaaacaaaagttcaccaatctctcatttggttgtggacaatgaaaataaaataaattgtaaaattaaagaaaaattgagttaagtgttacaaatcgaaacttgagcgtcaaaatgacttgcctttttgagtttggactgtttgtgttcaaataatcttagcaatgtcaattaagatttcatatgggagtgccagcaaggtcacactttactaagtgtccgatatttgttgtcgtaaccaaccggcacaaagatgggctaggaatcctgggacacttgaacttgagaagaggaccaaatttatgaattattaagttcttcttggcatttttccaaaaattgcccaaaatgttgttgccaaaaggtcctagcccatcgcagtgtccaatttttggccccttttaacggtcactcttttcagtatggtcaacagtgcgcaacaatgggactatcccaacggatggccggtcaaatcttgcttttttattctcacaaataaaattgaccatttcgttttgctttagccattgaatcatatgatcatcgaaggattgcgccgttcagacaacaaactgtagctgttcttttttatgtaaatcaaaattaatattgacgcccctttaaccgacagaatg

SEQ ID NO: 98764 - DNA, 215 bp, Heterodera glycines
  Promoter: Source sequence=SeqID_13349; Location=872..1086; Strand=-; Gene=SeqID_77216
aaaattttcatataatgttgtatagaacattgtcttttttagaacgtcgcgaatgtttgtccaatttgggtctttctgcactgagtgctgccggcactctttcggcgaattcgtttgacccattgatattttcaggcaattaattgtttgctttttcaaattcttcgtccattaatttcctttaaattttaggtttgagtcgatcacaaaagatg

SEQ ID NO: 98765 - DNA, 54 bp, Heterodera glycines
  Promoter: Source sequence=SeqID_37476; Location=46..99; Strand=+; Gene=SeqID_66540
ggtcagtgaaggaaaagcacagaacgatcacttaaaaaccggctcagagtgatg

SEQ ID NO: 98766 - DNA, 229 bp, Heterodera glycines
  Promoter: Source sequence=SeqID_16391; Location=1..229; Strand=+; Gene=SeqID_80784
aagaaatagtgtgtgtttggtgagagagacattttctcttctcaattcttcgcttataaagagaaataaatccccagcctccgccgagggtcgtggcgggcccttgtgacccagcgagtagggggcgaaggcgggcggggggcgggcgtgcgccgattgggtgtcgcgaccaagggccgcgtcgacaggggcggcccgggggagcccgggctgtgccggtcgcacaatg

SEQ ID NO: 98767 - DNA, 1003 bp, Heterodera glycines
  Promoter: Source sequence=SeqID_10046; Location=2404..3406; Strand=-; Gene=SeqID_73108
caaagctcaacgatcgccaaattgcggaaattttaaatattacaaaaagatctttagaaagatataaatctgaattcaagagaaaaagtgaaggtgtcgcggattgactgagaatatttttaagctttcagggccattcattgttaggttttgatgaatttaaatttcttaaaaatttatatattattcggcatttcattcattttccaatttgttgcttatgtaagagttaaaagtattatgcataatgtttgaaggttgttttttttgttctattttttgttgtaattgccagggaatggatttatatgtgccaaaaaagctccaaaatatgtgctaaaaagctcaaaaaaggccaacatatgtgccaaaaattgaaaaaaaaactgtcaaaaaataagtgaatttatcaaaaaaatcacattttttatccatttcgctagtacaattctaatcaaaaacatttcaattctttgtgacgtaaatatttttctcgcttcaaatatttatttatttttctgttttcattgataaaatttaaattttgccttaaaaatgaaaaaagtcattaaaacggtcaaaaagtgcaaaaagagaaaaaactaaaatttttgaaaatttttgtacattttgacaagaatttgagtgcaaaaaaagctacttttgtaaaaaaaattaaaaaaaaaatccccagaatatgtgctaaaaactactgaaaaccaaaatatggtttcattttaatgaatatgcttgatgccattttcaaaaaagccgaaagacagccatattaatttataaattgaaacccactcgtaataattaagttaattttaaacaaaaaaatgaaaactgaaaattttcaaacaaaaaaaataaaaatataacaaagatgtaaaggttgcaatcattaatgctgtcaaaatggcatcggcatttggcatagatatgcttttagctgtccaattgcaacaacaaaggcaataagtgcgattgatgctctatg

SEQ ID NO: 98768 - DNA, 1003 bp, Heterodera glycines
  Promoter: Source sequence=SeqID_7329; Location=392..1394; Strand=+; Gene=SeqID_64490
tgaaaaggaagattaattaacaattgcattaaaacgggaattacgaatttctatttggattaattgaaataaattacaaaaaaaatcattggagtttacagattaatcccttaaaattcatttaaaaattaatagatagaattggattatctcccacaaaaaaaatgttgtttgcaaaacgccaacgcatttctttgcctttcgccattttgaacaagaaaagcggcttattttttgcgtgccaagatgagcttccctaattaattttcacaaattgacattgccctaggcgagattcattcattcgacacgaaattaattaaataaaccgcgctaatcccccacgccttccgagtccaatccctgttaaaatgtttaatgctaagtgttaattaatgccattttactcgactttttcaaacataggttttccagctcccctcatggcattttgtaatgaaagggcgggggtggggcggaagttatgcctcaaattgcttacatgaaagatgaagctgccctaaggcatacaccgatcatttctatggctttttcttcttcccaataacagcaaaaaatgttctaaaagctcttttaaaatgtggaataattttaaatatttatttttaatacaatgattatttatttttatccaaatcatggcaacattcatttgtgacctgctgtagggaatggatttaaaaaactgttacaaaaatttattcacataatacaattttttagcatatgattgtcctatcaaaaatgcacataaagtctattttgctcgtgatcattgatcattaatgattaaaatttaaaaccaaatttcaagactataattatgtatataagaaataatcctgattagtgatcaaaaattaaaaaatggctaataatttaatcgaatttatatccgattacaacctcgcaaatccttatcctcgataaaactatatttgttaaaaacaacatttttaaatttttgtatgattcagaaatg

SEQ ID NO: 98769 - DNA, 1003 bp, Heterodera glycines
  Promoter: Source sequence=SeqID_1632; Location=134..1136; Strand=+; Gene=SeqID_74969
gaagaggaagaaaaagaggacagagagcgacagggagtaagagagaagggagaaagagagcagattgagagaaagacaaagtgagagagaaggaaaagagagagcgaggtagagagagatagacagcgggagagagagacagagaaagagagagagagagagggggtgagagaaggagaaaaaagggattgaaagcgagagataaggagagagaaagaggagagaagagaggaaaagtaagtgagaaggcgaggagataagagaggaaagaaaagagagaatgaggagggacgggacaaagagagagagaggagagaacagaggaaaagagagagagagagagagagaggagatacgagagaggaaagtgaaaagaaaaagagagtgaggaggagaaagagagatgaggagagataggaggaaagaagagaggaaaggataaaatgagagaaataaaagacgaaaaatatcatatatatcgttagttgaagcaatattacaaaatgtcttggtttttgagcctaaaatctgattttttggccctgatggtctgattttgaaaaattttcgatcaacccctggttaaaggataaataagtatttggaacatgccgaagccacaaaaattttcggaaatcgtaattacagcggtaaatttttgcggaacgcggaaatacttaaaaattttaataggctaaattttaaaattattaccaaataaataatgatttaaaaaatattttcggtatatttgagtgtttgtatgtgtcactgtttgaattagtgtggcgttttgtttgagttttgcgttaaaaatgagtttgaaaagagatgaaaagaaattgttttgaaaaagaagagaatataaagaaaagagacgaaaataaatagttaagaagaagaagaaggcaaaagaaatagcacagaaaaagaaggtaaaagatttctcctcctaggatgtagaggttagagggagggatggtgggaaatagtgcactgtatg

SEQ ID NO: 98770 - DNA, 235 bp, Heterodera glycines
  Promoter: Source sequence=SeqID_23910; Location=1..235; Strand=+; Gene=SeqID_54602
aatgagtttttattttttataagtaagaactgtcagtcgacatgcgggcgatgatgggcgggggggggggatgaagtgccacaccccccaagagcgctcaaggccaagcatttacttcgccaaaaatggctgcaccataaattcgaccgcaactttattcagttgcccatttgactcatttccaccattttttagtgtttaaattacagaaaaataattttttatttttgaaatg

SEQ ID NO: 98771 - DNA, 481 bp, Heterodera glycines
  Promoter: Source sequence=SeqID_7190; Location=916..1396; Strand=-; Gene=SeqID_64093
tttggggacccgacttttagggacccgacatttgcggatcgaacgtcatttggggatccgacacttagggaacccgacatttggggattttaataaaacaaaaaatattaaaaaatttaattttatgtccaaaattggacaaattttttttaaaacgcctttcccaagggccaatggtaacagacactcgtcaaggacatttcagatggctttgctgtttaatgccgagactatcttttctgtttcttatctttcgcgtgactttgtgcggtgctttaaattcattttttaacaaattatttttttttgactcacttgcaaagcaaatctcagtccggaaacagagttattttaaaaaatattattttgtttttcttgcaatgcaatggaattaactctgactaaagcagactaaatttgtctagttttggacaaaaattaaatttttttatattttttgttttattaaaatccccaaatg

SEQ ID NO: 98772 - DNA, 116 bp, Heterodera glycines
  Promoter: Source sequence=SeqID_745; Location=6328..6443; Strand=-; Gene=SeqID_60289
ttgcgaagcagaattcgccaagcgttggattgttcacccaccaatagggaacgtgagctgggtttagaccgtcgtgagacaggttagttttaccctactaaagacctgttgctatg

SEQ ID NO: 98773 - DNA, 469 bp, Heterodera glycines
  Promoter: Source sequence=SeqID_10418; Location=3754..4222; Strand=+; Gene=SeqID_73614
tttccagaaaaggagattttggttcagtttttgagtttttccaggacattttgttcagtttttgagttttttcaaacaaaaaaaaacttgaatttctacaaagtgaactggtgaagctttatagaaaacatgcttcaaagtgatcactctcatcacaaatccggtacttttccgaaccccggaaccgaccgaaatcaaaaatgcgaaatttttaaaaatttgaattttctgatttttttgttcgaatacggatttctgcgggcgctcagaatttgtcaaaatggatggataatgactctacagaattttttgccagtggatctatgaaataatttgtcccattcaggcattactgtattcatcggaccaaatgaggtgtgtatgtacaaattagagatcgcataactggggtgggaagtgatccggcccgaatccttgtccctcaatcccaaaagattttggaaaaatg

SEQ ID NO: 98774 - DNA, 210 bp, Heterodera glycines
  Promoter: Source sequence=SeqID_23023; Location=1369..1578; Strand=-; Gene=SeqID_53720
aatttttttcaaaattgacccaaaatgtccaaaattattcaaaaataattttatgtttttcgccattcgttttttctcatttttgagtctcccccccccccaaaaaatgcacagatcgcatcgctttttccgagtggacacggcccggctggacattccatgggaagggcatttgggtggaggaatggcaccggcgccgcccacaaaatg

SEQ ID NO: 98775 - DNA, 1003 bp, Heterodera glycines
  Promoter: Source sequence=SeqID_2047; Location=600..1602; Strand=+; Gene=SeqID_77503
aaaaatcatatcacaaaatatatagcacgcaaaatttttcgtgtttcacctactagccttagtttaaagagcttagattttgatcaggcatacctaacaattaatatcaagaacaaataaaagatataaaaatatatatctttaaaaagcaaaattaaatgaattactcacattatcaatgacaatataattcttgtaaatcaggaatttataaactaatgcattgcacaagttgatcagatcactacttaaggatgatatgaagtgatcaaatttttagcaccaagaggaattgaaaaaagaactttttggaaaaactttataaatttttcatattttcattcgcattaacttgcttaactccgaaaaatcacatataaaattcaatattcagatgatcatccaatttaagaaaaaaaaatttttttaaattaaatccagaaatgatgacccgcaaaagtcggtccgcaaatgtcgcactacgcctcaaaaagtttctttgaaaaaggcgccgcaaaaaagttttttttatcttgttttatgttttttgactataaaaagttgtagaaaaattgcacttacgtgtttagtaatttcgcgttcttgagcgggcgaaaacatagttgtaattttatgcataaagattccgatttttccaattttttgcatatatttttgcattcggcatttttattatttaaaaacatatttattatctctctttttgtgtactaatttcatattacaagcggacccccaggatcccgcatcaaaaacccaatttgcagatctgaggtatacattaagggatgggagacgacgccctcaaaaaattttggcaattgaaaatcggcattccactggcttaaaaaaatttgggaaatctgctaccggaactccggctcatgtcggaaatcagaatgtccttgatttcatatatgtatgtaggagaaacgcaaatcaatgatttattattatttagcactaatttataattgttatg

SEQ ID NO: 98776 - DNA, 217 bp, Heterodera glycines
  misc_feature (107)..(107): n is a, c, g, or t
  Promoter: Source sequence=SeqID_38443; Location=1156..1372; Strand=-; Gene=SeqID_67255
cccgggactttgtgaatattgctaaatttaatatggcgtaatttttttgttatttcgctcccattttgaggggttttgggtcctaaattctacctattttggtaatntaagttgaaattagagtccctagtcccattaaaaacatttctgcccccattaaagctactgaaaaattacggactccaaagagaatgaccctcggctggcgccgatgatg

SEQ ID NO: 98777 - DNA, 1003 bp, Heterodera glycines
  Promoter: Source sequence=SeqID_2; Location=1905..2907; Strand=-; Gene=SeqID_50776
tatctgtttattacattcaatatcacttaattaaaatgaaaagctttattaaaaagcatagccaaatttttagaattcaatgaataattgtggaccaggttgacgatttttttaattttgtaaaaaaagaaactaaaaacttaatcatatacaagaatttaatttccaaatcttaatataaaaaatttttatgaatgaatgtaaacactgctcataagcaccggacaaatattaactaaaaataattttattacttttgaactaattccatccacatgagcaacattttacaaccttaaaaatttttaaaaatatttaaataaattaaatcaataaaaattagccaaaagtattgaaaaaaatattctaaagcaattggaaaataaatatattttttgggaccccccataaggcaaattaaaaaaagttccatttcgacaaatttaaacccctttccgaaccttaaagtttttaacaatttcaagtttttgcaattttttcacgcggctaattcggtttttgactaattcttaaatttcaactccagttgtgcttccggtactgttttgcacatgaataaatccggttaaggaacaatcctgaaacgttgcggaaactaccagcaatatttctaattattcagttctgatccgaataatcagaatttttgtgatttgtgttataaaagctgaataaaaataattaaatggcaaaattggccaaaaaataaataatttaaaaaacaattatattaattaaagtaaataaaaatagacccaattctctacaaaatggcacgtgtggaaaaaattcgtaccagcaaaaattttttgaaattcccggtttttttaaagaaccactaattttaaaaatacattttttctttttccttaataactttttgtgttttttatatagtgggactcgcttcgtagcaaatcgagctctacaaagattggtggaacaaaaataataaacggctaggctcggcatcctaaatatg

SEQ ID NO: 98778 - DNA, 1003 bp, Heterodera glycines
  Promoter: Source sequence=SeqID_11953; Location=1019..2021; Strand=-; Gene=SeqID_75475
tcccaccctcttctggattaattagggcaatttcgctgacaaatcagtgagcgagtgaagggctgatgagctgatgagtgacttgtttgataatgactctcacttatcactaaataaatgatctatttatttatttttgtaaatagaaacatggggactttgttgatgaatgaatgataattcattgaaaatggtcattttaatgtccactgatcggtgaaaatgcacattttgtttaatgatcgcaaatttctccggattttaagcaaaattatttatcgaggcagtttataaaatttttatcgttttttatgaattaatgaaggcattttactattttttgttttctttttttctttaatgaaatgcattgtttgagataaaaattaattgtcgccccattctaatgaccccccccccccaaccattcccaaccaaaaaatggcatggcatggtacgtgataacaccgaacccaattgttgttgtgtttagcaactgcaaattatttttttccatcttattgtgattgtataagcgatagaaaaatttattgttcccattattttatttaattagacaaaaaaaaaaaaattaaaaattggtatgcgaaattattttaaggaatcgcacaaataagaacttgctgaattaatacaggagtaaatctcatcaaaaattttggcaccactcctatcggtcgatagctctagattccctaaagcctgtcaatttgtaaaaaattttcaaagtttaaaaagtttttccaaaaagccctaaaaccgaatgcagtagttatgtttcgtcaaatttttttccaaaaaaaaacaaacaattaaatcgtattattatcaatcagccttaagactctgttttagtattgaattatttttttttgtgatcattgaaatacttttttggattgctattttgcaattttattctttattgttcatgttacagttataggtaatatttatttgcttacagcaatttaaaaaaatg

SEQ ID NO: 98779 - DNA, 715 bp, Heterodera glycines
  Promoter: Source sequence=SeqID_2836; Location=1..715; Strand=+; Gene= SeqID_81863
acatttaatttggctctttacgagtatattattttatttcgctatttatactacaattacaatattcgttggtataaatattttcatttgataaaactaaagtaatttgacatcttaaatttttacattgtctatttgttagatattgtttttaagtgttataattacttataattgtaaataattatcaaattccatacgagtcgatttaatcattgaagtgtgtgtgcactaaatgatagtttgtaaagctaaatcaaatcatattaatcattatgaaaaatataataaaaaataaggttttgtttaaaataaatgaaaataaaaaagtggaaaaatataaattaataattaaaaataaaattctgctgaaatcaaatactttattatgttgataacactttcaaaaatatgaattttattatattaaataatatttccttcaagaataacacttttgtaatagagataaccatttgcattaaataatcatatcagcgaaaataataaacctgacaatgattataaattataaacaaagattaatataacttgatgaaataattaaatatatttaaaataatgaatgtaatttgtctccaaatgtacttaatgattacaacttaatttaaaatcaaaaaataaatattgtatgtaagtaaatcaagaaaaaacaatcttttggtctttaaatttgctgagcatttcaacgatg

SEQ ID NO: 98780 - DNA, 143 bp, Heterodera glycines
  Promoter: Source sequence=SeqID_95; Location=1..143; Strand=+; Gene =SeqID_66042
cagctgaaaaccgattggtgcagaagctctcccagctgctgatcgtcgctgaagtcatctgcgagcgttgtcttcaggctggcatcagcgtcaacgatgggcttggaagaagagcgccggattgtgtttgtctgtgtcgtatg

SEQ ID NO: 98781 - DNA, 300 bp, Heterodera glycines
  Promoter: Source sequence=SeqID_25153; Location=1159..1458; Strand=-; Gene=SeqID_55878
gggcgaaacttcgagcttcgtgcttcgagcttcgaaaacttcgggttttttgggcttcgaacttcgtgcttcgagcttcgtgaaaatgctcgaagtttcgggaaaaatgcacccctaaagattgagttttcgaagtaaaaatactcccctaattattgatcttaatgtgagtaatggtgataatgtttatgaattttataaattaaatatttcttcaatattacctattttatattctacatattgtatatctctttttaaatgctttttaacacattttacatttttagcttgaaaatg

SEQ ID NO: 98782 - DNA, 482 bp, Heterodera glycines
  misc_feature (22)..(22): n is a, c, g, or t
  misc_feature (69)..(69): n is a, c, g, or t
  misc_feature (142)..(142): n is a, c, g, or t
  Promoter: Source sequence=SeqID_14184; Location=3718..4199; Strand=-; Gene=SeqID_78200
aaaagtaattttttatacaaanagtatggacaaataaaaccaacaaaagaaaaaaacatggagtgggcncctgaaaaatgatttaccattcacaaaagtaaattattataaatcaaacaatgagaaatataaagtggaattntaattttcatatcacatttttgcacttttcgctgtatccttatgactttttggcattttttattaatacactaatccgtattatataaaatctcataatttggcctataaatgagtttgacaaaatttactcattttaattgtatgaaaaaaaattttgggttatttttagaactaattggaaaactaaatgaatatagaaaaaattgttttatttgtttaaaaggcaattaattccttattggttcagatgaaattcattttccaaatttaattattagaaatttgaaaataatgctttgtgattggtttttatctctattaattttcagctagaaatg

SEQ ID NO: 98783 - DNA, 332 bp, Heterodera glycines
  Promoter: Source sequence=SeqID_20052; Location=806..1137; Strand=-; Gene=SeqID_84829
tctgaaaaaataacgattttttaaaattataaaatgacaaaaaccagagatatcagtcttttagcaaattgcactcaaattttcaaaattctccccggcggcgcctaacgacatcgccggacccttgttctcaaaaagtttttggaaaaaaacgcgccgtaaaaaacctttttattgatttttcttcatttgaaaaaattttccaaaatgcttattttggacccccaaatgatgattttttgtttgaaaaatgatgattttgaaaatttttatctgacaacattggatatcacatttgaatatactaatatttccaattttataggcgaatg

SEQ ID NO: 98784 - DNA, 1003 bp, Heterodera glycines
  Promoter: Source sequence=SeqID_3349; Location=1198..2200; Strand=-; Gene=SeqID_84308
ttgaaggaatttttttagcgagaataccaatgaattttgaaaaaatgttttctgaaacgaatgttttaatcttattttaacataatgactgaaattaaatttttctcacaaagcagtgccggattaattctccccgatataatcaagttttttgttatttagcaaaaatgtcaaatatctgggaatattctccaccgctgggttgattgtgacagatctgagaaaacgtttattgcctgagaatgtggacaaacttttatttttgcatcacaatcttaaaatttatgattttgattatgaataaaatttttgggaaaaaattattaaaaaaaaatcggaatcgtaatcggaatcgcaattaatcggattttgggccataatcgtaatcggttttaaaaccgtatcggatttttggccataatcggaatcggcgatttaatcggaatcggattttgtctggctcggcacatccctgctgctggttgctccagcagaaaatttaccattttcttttgctacctttttctcgtatttcgtggtcaaatgaccaggtcaatcaaatcgtgccaggaaatttcgacagtggctgatttcgacagtgaccgatttcgacagaataaaattattattttattattattatatattcacatgaacaagccgtgcctcagggtcaaactgatccgaaaagtcatttttatttaaaaaatgcactatgtttaatgaaaattaataaatgcgtgtagtaaaaataaagcattttttctcttaatttcaatgtggtaaaattcagtggtactttggccgttgtagtgataagaccggtcgttcactttatctcgggtggtcaattttcttgggaggtcattttgataagagaatttggagaggaattgttttgcattcccgaatgctgatggtcattctcgagttgtaattgctggtgttcatcatttgccgtttttccctctattcgttttttttccaaattcattggctcatg

SEQ ID NO: 98785 - DNA, 811 bp, Heterodera glycines
  Promoter: Source sequence=SeqID_14553; Location=1046..1856; Strand=+; Gene=SeqID_78620
agtttgagttgttgtttattgtacatttggttttttattggtaacgaaaaaataataaatgcataggtaataatcaacagaatttgaaaaactatgactaattaaaaattgccgtcgatttttttaaatttcaaacttagaaattttttaaagaaaataaattgaggaatttttctacctttttcgaaattttttttcatgttttctttaaaaaaattttctaagatttgaaaattaacaaaaaaaaaaaaaattcagcggctagattttaccccgtccccataaatttgatcatcggcagcggcacgggggtgaaatggacagagaaattttttggaaatttgatagtaattttggcaaaaaattttcatcataaaattttgaaaaaacgctgtaaaagtgaaaattggctacataattataagatttttttcgaaaaattagcaaatttcatgctttaatccgaagcaaatatttggctaaaattcacccccccccccctttttttcttagtttgccgtccaattatgccaatgcgccgccggagccgggcagttgggcacacattttgtacacggaggacagtccgcggagcgttcggcacattgtaattcgtcaaattcgcccgctgtgccccgacagcactccgccgagcgcgctgggcgccacgctgcggtttgccatgcaaacggtgtgcccggataatacgcgtgtgtgggacgcctttttgacgctgcccgtccgggcgtgcagcgtgcaacaactgttggacaaggtggagggcagcagagagacggcgccgcaagcgatg

SEQ ID NO: 98786 - DNA, 654 bp, Heterodera glycines
  Promoter: Source sequence=SeqID_15275; Location=459..1112; Strand=-; Gene=SeqID_79490
ttcattttttgtttcaattgtttccatttttttgagtttgaagaagaaagaagcacacttgctctgtcatttgcaactccaattgggtcgaagagaatttctgacaaccgatgtgataaatataattttttcgcaaaaaaatgattaaattttaccattggttagagatgtcaaaacgttaaatttattattgtccataaattgggcagcattttgtgcatcatctcgagtggaaaattcaatcgttttgtttgaaatcttaatctacgtattttatttttatttttattttgatttaaccttattttccaatgttttgttctttataagaattttttttacagctaatttttgtggtgttatcattctgcgctttgttgaatgcgacttctataaattattaatttttagttgacaaaatgctaatttttctgaccatttttttaacaaaattttggagacaactgcttttcttttttgccgcggacacagacaaagaggttgttttttccacattgattttaagcactttgttgcaaacatttgttgttggcaggatctaaataagttgttttataattataattattttcttaaaaattattttaataaattgaaagtttttttatttttactttaattccaaacaaaatg

SEQ ID NO: 98787 - DNA, 51 bp, Heterodera glycines
  Promoter: Source sequence=SeqID_6236; Location=428..478; Strand=+; Gene=SeqID_60829
tagcccgggggtaatttggtgatcatcggcgacactcaccagtcactcatg

SEQ ID NO: 98788 - DNA, 424 bp, Heterodera glycines
  Promoter: Source sequence=SeqID_5922; Location=1..424; Strand=+; Gene= SeqID_59690
tcatgttcacagcacctattaatggaagtatatgcgatgatatcatataaaaatatgcaaatcagggcaatcgcttgaccaaatggttaggtaatgggtcctcgcccccctttcatccttggccatactttctcattttcaattccttttccacagcccaatggatgcaattcttgctgttttttaatttacttttgataggcacagttttggtcccaaaatggtcacataataccagttcttaaagaccttgtaaatttaattccttttttgagttacagttcgcgcccttatgaacaattaatccttttccattgcaaaagaaatttcgtaaaaaaagctatgaccaatactgattttctcattacagtccatttcattattaaattatctaaaaacaaagtccttctctgctttagacatg

SEQ ID NO: 98789 - DNA, 235 bp, Heterodera glycines
  misc_feature (31)..(31): n is a, c, g, or t
  Promoter: Source sequence=SeqID_18945; Location=1..235; Strand=+; Gene=SeqID_83669
tcgctgctgctgctgacgcccaatgggcatntttgccaccttctaaatttaaagcgatttgttgaaattaatagataattcattagggaggaagcgggaaacacctgctgctggggaaatctggtgtaatgctaaatatttggggacttttaataaatgtaaatcccatccctaatcatttcttatgtaattttcccaaaaattgaaaatccgagacttttgtcgagtcgagatg

SEQ ID NO: 98790 - DNA, 129 bp, Heterodera glycines
  misc_feature (125)..(125): n is a, c, g, or t
  Promoter: Source sequence=SeqID_11183; Location=2351..2479; Strand=-; Gene=SeqID_74528
gggggggggaagtccaaaaagaaaccaaagggccagattcaaaagggagaaaaatcccgaaattgagcatggcattggcacagtcgatccattccccccccccctccgtccagatgatccatccncatg

SEQ ID NO: 98791 - DNA, 69 bp, Heterodera glycines
  Promoter: Source sequence=SeqID_34828; Location=1558..1626; Strand=-; Gene=SeqID_64526
aagggaaatttttggggtaacatcatattttttaaaaaaattttctatgaacatttgttcagggagatg

SEQ ID NO: 98792 - DNA, 136 bp, Heterodera glycines
  Promoter: Source sequence=SeqID_20686; Location=1..136; Strand=+; Gene=SeqID_51244
ttgttaatttcgggattagttcgtttccccttccttttccccctccccgccgaaaattaaaaaaaattatatcaaacacagaaatttttcaaaaattaagtaaatgtttttgcatgttttgaaacaaacaaaaatg

SEQ ID NO: 98793 - DNA, 233 bp, Heterodera glycines
  Promoter: Source sequence=SeqID_4661; Location=1..233; Strand=+; Gene= SeqID_55268
ttttaaaaaaattttttttttgggggggggggggggggggggggggggggggggggggccccgcgagccaaacaaaaaaaaattttcccgattcggaataaaatttttttgaaaattttaggcccccaataggggaacaaaaaaaggaaattcgctttttaaaccaattttaaattaaaaataattcattttgaaccttgctcagtttgttccgctatttcccgtcgaaaatg

SEQ ID NO: 98794 - DNA, 218 bp, Heterodera glycines
  Promoter: Source sequence=SeqID_17418; Location=2212..2429; Strand=+; Gene=SeqID_81899
ggtgcgagaaggcggggcaatgtacaagcgcctactttaaactaaggggctgatgttagcataaataagtatgagaagccatgttaggagacaagcagtgagagtgagaaaggaaaaaaaaatttaattattcaatgtttgacaagatttattgttcgattaaatgtatttcctgacaaaatatatatatatatatataaagaaggcaaattgaaatg

SEQ ID NO: 98795 - DNA, 271 bp, Heterodera glycines
  Promoter: Source sequence=SeqID_19822; Location=1..271; Strand=+; Gene=SeqID_84561
aatccatgctcagatcatcgctcccactcacaacaggagctgtacagggcccaagaattgataggcttcctgtcccaagagtactctcatgggcaaggtgccaatgaggatatcatccatacaaattttctaattttatttttgttcgagttcgggtaaggggttcgaaattggcaaaaatgggtgctgtattcgtgatcagcgaccccaaaaaccccttaaaacttattttcattaatttataaaacacatttataggcatctgaaaatg

SEQ ID NO: 98796 - DNA, 79 bp, Heterodera glycines
  Promoter: Source sequence=SeqID_43489; Location=1..79; Strand=+; Gene= SeqID_71135
aaattcccgtctttttctttctaatctctcttcactctttaattttactgcatcaatttcgcggtttttgtttaaaatg

SEQ ID NO: 98797 - DNA, 745 bp, Heterodera glycines
  Promoter: Source sequence=SeqID_4042; Location=950..1694; Strand=+; Gene=SeqID_52936
tttttgctaccaacaaatgttggatttggttgacaaaaaaaatttctaaccttttacaaatgaaagttggataaaaattatccatcgaattgattgatttgggggtaaggtaaaacgcccggcaaatgtcatcattagggatcggatttttaagtttttgcttatttttctgcggctttaactcgacgagaaatgcacgaaaaacacattttgcgctcggaaattcttcgttttgacgcatttattcgaaaatttttcttgacgagatcacattttttgcaaattttcaaaaaattttccacataaatttattttttcattgaccaaaatttttgtaatttattttttttcttgaccaaattttggttttttcgcccttatttaaggccttagtttggactttttcgcgcttaaaaatccgttccctagtcatcattttgcaaaatattctcctctgttgcggttccctttttcttccaatccgtcgtcattttatgccaaaatgtttccgcgccttccgtttttgtcaatgggttttcgcctcccattggcaacaatttaagacgaacaaaattcaaaaattttttggataaaattgattttcgtgcttctttcatccaaagtacaatccgtaaaaaataggaaaccctaaaaatccaggctttatccaacgcaattatttttctgctatttgtgtgacatcattcgaaattcaacagcaaattttgctaattgccaaaaaatg

SEQ ID NO: 98798 - DNA, 701 bp, Heterodera glycines
  Promoter: Source sequence=SeqID_14537; Location=1364..2064; Strand=-; Gene=SeqID_78591
aagcaatttgacatctcagaaaaaagttgttggagtttcaaatttttatcacgttataactcaagtcctaggccgccgtttctaacaaaaatgctaaaattaatcatttcttattgattctaaatgcatagtgtttttgtacctttacaatcaagattattataatttgtgaatttctatttttcatgtgttagagacatgaaaatagtacaccaaaaagagagaaaaagaaattcgcaaaatttttcaccaaataacttttgagtgagccttatttttgtattaaatttccttattaatcgattcagaatttttttctctatcgatatgcaaaatttaaagaaaatctgtaaggcgaaaaaaaagttctatagagcgaagtgaatgttgttttttacatgattaaaaccgaagagatagtacgccaaagtgagagaaattacaaagaaaaagaaaacgacgagatagtactaggcttttctctgcacagtgtgcttgacccatagtgtggaaccattcttcgtcagaaaatgaattttcgaattggttctttgcgtcgttttttcttttggcacaaaattaattgtgaataaatttaaaaaaaattactaaaataaatttaagcatttttgtgtgctttcttttccttctttaatggacatgggaatcccttcaacaagcgatttgcataatcaacaatg

SEQ ID NO: 98799 - DNA, 99 bp, Heterodera glycines
  Promoter: Source sequence=SeqID_12750; Location=1..99; Strand=+; Gene= SeqID_76457
tcttttcatatagtcgccaaataatttttatctttttttaaatttactattgttttggctgatttgcacataatgcaccatttttaggttttaataatg

SEQ ID NO: 98800 - DNA, 253 bp, Heterodera glycines
  Promoter: Source sequence=SeqID_24234; Location=1138..1390; Strand=-; Gene=SeqID_54948
aacatgaatatggcatttatttaggcccatttcaactacccgaactcgaaaaaaagttaaaaattcgaatttttcaggattcgtttttttcaaaaaaattggatcgtaaatggaaaagtgccattttcgaatggaaaagtgccattttgaaatgaaaagtgccattttgaatggaaaagtgccattttgaaatgaaaagtgccattttcgaatgccatcccctctccatttttcagattgttgcctcagaatg

SEQ ID NO: 98801 - DNA, 1003 bp, Heterodera glycines
  Promoter: Source sequence=SeqID_2727; Location=999..2001; Strand=-; Gene=SeqID_81281
ccttgggcatcaatcatttcccaaattaccaattaccactgactcacccaaaaagtataaataaaagtaaaatagttgtctaataagcgataatgtttttattttaaatagaattatttactcttaaataacaaaattatttaaattggtaaatttcattttaaattttcaaattatttattttccaaaatcacttttgtagtagggctgtcaaaaatatgtacaaaaagtggtccaaatatgtacataaatatgtaagaaaaaacccaaaatatgtacaaaaaaccccaaatatgtaaataaattttttttaaatggttttttttgggaaaaaatcatcgtaaagtatgaaataggcttcaaaatgccataaaaattacttaaatagtcttacaattagaagaacttttagtattttaaaaattatttttttggtatttttcattggtattttttcactataaattttcaaaatttctcgaaatatttgaaaaaaaatatgaaaaaatgtgcaaaaaatttgccgaaattttggatttttttttaaatttccaaaaatttccgtaaaaatcctcaaaatatgttaaaaaaatgaaaatatgtaagaaaaagtccaaaatatttaccaaatatgtataaaaaccccgaaatatgtaaaaatatgtaaataaaagtcccggtttttgttcgcaaacacaaaaaagaaagtgttttcctgctattttgagcatggagaagccaggaaaaaaatatgtatttacataaaattgacagccctaataattagcttgactttttaggcattttcccacttgttttgaggcttatacattgacttttattatgcctttttttttgccttttcgggattttcatgccttaaatgccttttttggcatttttccgttttggtgccttttttggcgttttttccgaaaaattctattaaaaatgcgatttaaataaaaatatttttaaattttcaactgaaataaattaaatg

SEQ ID NO: 98802 - DNA, 106 bp, Heterodera glycines
  misc_feature (32)..(32): n is a, c, g, or t
  Promoter: Source sequence=SeqID_16778; Location=1173..1278; Strand=-; Gene=SeqID_81195
aaacccaaaataagcgcagcggatgggatggnatacaaaaacaagtgaaatagtataagaaaatgagagggaggaagcgaaagaacaaggaaacagtttatggatg

SEQ ID NO: 98803 - DNA, 415 bp, Heterodera glycines
  Promoter: Source sequence=SeqID_2012; Location=712..1126; Strand=-; Gene=SeqID_77314
ttatcaaattatttatctgtgattggatgaagtcttattggttcggattggataagagttatcaaaaaaatttaaaaaaatcttttagcaggtgaataattttgaagaaaacataatttaagttttttggagaaaaaccaaacaattttattttattttatgggaaaattttgttcaattaaatgaaacatataaatttaatgcctaatttatcactgttatgaatgagtcgttaatttttattttttataatttcttaatttattcagcggctatcgtttagcgaataagcacgaacattctgtttaaacattaataaaatttctatttttcccaaggcggcgcatatcggcaccggcgggcccaccatccctttttttataaattaaatgattttttcatttaatgaaaaatg

SEQ ID NO: 98804 - DNA, 93 bp, Heterodera glycines
  Promoter: Source sequence=SeqID_20905; Location=155..247; Strand=+; Gene=SeqID_51486
ggtagcattttggaggaacattcccaagattaatttgtatcattaaaaaggtataaacaagtggttccattgcgagacgcactttgcggcatg

SEQ ID NO: 98805 - DNA, 680 bp, Heterodera glycines
  Promoter: Source sequence=SeqID_12982; Location=405..1084; Strand=-; Gene=SeqID_76744
tttttttttaatgtataggaaatgaaagtgaacgaatgaatgctattagggattggttctagacggagaaagggatgatattggaaggcaatgccctacaccattaaggaaattttgaaaaggtgtcgaaaattatcgattgattacaaacatctgtcaccatatgcaattcccgagggaaatgcgcattgtttcgccgaaaattatcgattgatgggcggagacaacagctttaaaagcgcgtaaagacatagaatttttcatttgttccttattctcttatctaggttttaaataatttttattttcaattttgctgttaaccagggcggtagttcgacctacagagctccgtttatcctggcagcaaaattttgttaatttgtcttttagaccttgaggtcatgcttttgacatatctaatttcctgagccgtttaggtgccctgtcgtcttgtgcttcatgggtggcagtgcgctgctcatcaggtcaagatgggttgatattgtctttttttttaatcaattattcaaataattgtgtatttttctcatatatttttcatgaccaattgtatttttgatgagtattgctcatataaatactccttttcactgcatatttatcattataataatattttttaaaaaatttatggatttttattagattttaaaatg

SEQ ID NO: 98806 - DNA, 109 bp, Heterodera glycines
  Promoter: Source sequence=SeqID_34504; Location=1..109; Strand=+; Gene=SeqID_64277
attgacccttttgtggcccaattcgaaaatggctgctgctgaccaaatggggaaaaacatagcaaaaggagcattgggaaaatgaggaaggctttatatgaaggcgatg

SEQ ID NO: 98807 - DNA, 593 bp, Heterodera glycines
  Promoter: Source sequence=SeqID_40620; Location=1..593; Strand=+; Gene=SeqID_68889
tttgttgtcacgaaattattttattattgagatgatgatttgctgatttttgagaaatttgatgattttttggaaaaaatccttaaaaatggccatttttagcctatcgacatcccccgcaaattcctctaaaattttggcaaaattgccaattttcgatgaaaatctgattaaaaaatggtcaaaattttctatttttaccccggcggcgcctaactgcaccgctggaccccaaaaacttttttcttaaaaaattgactcaaaatcgcaaaaatttgtcattttttgtgaaaatctgttaacaaatcgcactcaaattttcaaaacttttactggcggcgcctactggaaccactgaacccttgtttccaaatagtttttggaaaaacgcgccgtaaaaacatttttattgatttttattcgaaaaaattttccaaaatgctgatttttggccccaaatggtgatttgttgtttgaaaaacgaagattttgaaaattttcatttggcaacactgcctataaatgattgaaaagaaaaagagaaaataagttacatggattatattttgaattctaattaatttttgattatg

SEQ ID NO: 98808 - DNA, 72 bp, Heterodera glycines
  Promoter: Source sequence=SeqID_6685; Location=3112..3183; Strand=+; Gene=SeqID_62482
tgtaaaccattcctttaaatgtattttatcaaccagttttgaaggaaatggcgcaaagactggcacaacatg

SEQ ID NO: 98809 - DNA, 95 bp, Heterodera glycines
  Promoter: Source sequence=SeqID_20513; Location=1424..1518; Strand=-; Gene=SeqID_51051
atttgagtccgaccaaagaacagctaaagtgcataatcctggtcattgcactcaacgacgagcaccacgacctgaggcaaaagtgtctcaaaatg

SEQ ID NO: 98810 - DNA, 128 bp, Heterodera glycines
  Promoter: Source sequence=SeqID_10151; Location=1175..1302; Strand=-; Gene=SeqID_73253
ccaaatatttagagagtttcaaatgaaaatttaaaccaccccccccgtttagcacgccgtcctgctccacccatgaaatgcttcaaagctcattagcacccataatgaaatttagcggcctagcaatg

SEQ ID NO: 98811 - DNA, 97 bp, Heterodera glycines
  Promoter: Source sequence=SeqID_13655; Location=2353..2449; Strand=-; Gene=SeqID_77555
ggtttgtcttttctacattaagttggatgggtggggcttatttgttttcccctttcttttttctgtctcaaaaatctcaaatttagcagtcgaaatg

SEQ ID NO: 98812 - DNA, 958 bp, Heterodera glycines
  Promoter: Source sequence=SeqID_16341; Location=1784..2741; Strand=+; Gene=SeqID_80729
tttattttatttaaattaaaatggagataatgtttaaaataattatgattattttttcttgaatgattttgcgaacaactcaataggttttataaagaaattctgtattgaattttagttgcagtgattaaatttttgagtcttaatttttaaaaatgattttttaaatttgtttagctttcaaaaatgacgaaaaatgcaaccttttgcaatttaacattcatcaatttgtcattttaaatgtgaccaaatattcgaggaaaattaacatctattcaaatggaaaatgacaattaggttattaaattgattcagaattaatttgaaaacttttataatttttgatttaaatatttttttgctgagaataattaaaatcacgctaaaaatcacttgtaatttaatgataaaaaggtacaaagaataggaaaggttattcttttttttattattcttttataatacttcagattttaatctagcatctttaattgacgtaaatttcccatttttcggcattttattttttcaataaatgccaatgtctgcgataaattgaaaagcttctgtccccctccccagtaattctattattggcctgattttctttatttttatttttttggttttttaatgaagaaaattttaggcctaatttgctcattacatacaaacaaagtcaaatttatcatgtgaaattgggttgaataagcacagccacgcattagctgagtttataaagcaatttatttacaaatcactttaaaaaatgatttttacagaattcttataaatttttcatataaaaattgtttattcaaaattacatcgataaattaattctcttacaaaaatatagcatatatcatcaccgctaatacaattaatttataattaaaaataatattttagtttatttatataataaattatcattttatttgctattaagaaaatg

SEQ ID NO: 98813 - DNA, 460 bp, Heterodera glycines
  Promoter: Source sequence=SeqID_6051; Location=1499..1958; Strand=-; Gene=SeqID_60149
tcgtggttaatattttcgtcagtgattttcgtcagcggataatttcgtcagtgaacattttcgtcagtgtactactttttatttattttgctgttttccatttttttcgtcagtgttccaattcggcagtgaatattttcgtcagtggatccataaaattaaaattttttcatttttatcaaattctttaatacagtatttatcgctttttgcgtatggtaactctagataaaataagtgattatttgtactttaataaatgatttacataaaagaaattgtactttaaaactgttgaatattattagtaaatttacttctcaaacttcttatctcgccatcgttcccatgcgttctcgagtgcctgcctatttgcatatttgtttagtccttatctagttttttcaatgcataaaaatgaacgatatgaaaattcattcgtttactgcaaccaaaaatg

SEQ ID NO: 98814 - DNA, 211 bp, Heterodera glycines
  Promoter: Source sequence=SeqID_24092; Location=2686..2896; Strand=-; Gene=SeqID_54793
atttgttaatagatttgaccaaaaaatgacgaatttttgtgattttgagctaattttttaaagaaacaaaaatattttagttgccgataggcgccgccgggaaaaaatttgaaaattgggagtttttgtagcatttaaatcagcgaaataaatcaataagcacaaaaaatttaaaaagtttgggcaagcctaaaaataagaaatagaaatg

SEQ ID NO: 98815 - DNA, 102 bp, Heterodera glycines
  Promoter: Source sequence=SeqID_10899; Location=585..686; Strand=-; Gene=SeqID_74180
atctgttcccgaaggcgattgctgatgtttttgatgcgcaaaattcaacaatttctgctggccaagcgttgtctaaatggttgaccacgccgagaaaagatg

SEQ ID NO: 98816 - DNA, 431 bp, Heterodera glycines
  Promoter: Source sequence=SeqID_30269; Location=795..1225; Strand=+; Gene=SeqID_60688
taatgatcgatcatataaaatcactgatctattagtggtagaatattgtttcttccaccttatcagcgtttctcgtgagatttccaatttagtggaaattatttcgtcactcatttgcagattggctatttttattatacaatatcgcttcatctttgtcagattgtcggcacagagttttgggttgcttgatacagttattagaattggatccatgcctgacaaagaaaattttatgggcacctatttataggacagaatacagcctaaataatcgattaattttttattttatgaattattaattttagccattaaaaaaattggatgaaaatgtaaattttagacaattttttggaatttacattttgatattgattttaaatttgtaggtacaaattaaacatgaattgcattactttttcagaatg

SEQ ID NO: 98817 - DNA, 207 bp, Heterodera glycines
  Promoter: Source sequence=SeqID_4463; Location=1400..1606; Strand=-; Gene=SeqID_54537
atgtattatctctgcagctcttgcccaagtgatttgttgtgcgtgagaccacggggctatacaaagcccgtgatttgcttgcaccgttcgatcgacaatttcacgcagctgctgcgtgaaggtgttcagccgactacaacaacgcgcgcagcaacagtgccaaatgtgacaacaatttgtccagcgacttcttcaaattgcccgatg

SEQ ID NO: 98818 - DNA, 388 bp, Heterodera glycines
  Promoter: Source sequence=SeqID_309; Location=1724..2111; Strand=-; Gene=SeqID_81803
atgagaagaaaatgtccattggaagtgcgggtcgttcacgtaaattcacacaaagcaaaaaagcccctcctcttctctcattttgtctgtccatttattcatttccttgctttttgttattgggcataaatgacggagagaacaaaaagaaccttttttagattttaaaggcttttattcactttctgcccaaaaaaccacaaatgtatgctcatcgtcagcgttttaaaaatgttttatctctttgactctcgcgcattggatgtgatttgttttaataatgcaattaaaatctttttcctccaattaaattgaaatgaaattggttgaattaaagcatcaaagtatttattttttgttactgaaatttcatttttcttttctgatg

SEQ ID NO: 98819 - DNA, 717 bp, Heterodera glycines
  Promoter: Source sequence=SeqID_811; Location=3491..4207; Strand=-; Gene=SeqID_61844
tttttcgagatttttttgtaatgaaaattataaaaaatgaatccgaatttcagctggaatttcgattatgcaaattttggttgtgcaagcacgcagggacctcaagtcgaaaaatgggcgtggcctattaccaataaccggaaaattcaactggttctaacacccgaccgatttggcaaatcatttgtaatattttattatttttggcacgccttttctttttttgttcctttctctcctcacatttttcgctcaaataaaaagttttaatttgctgttaaccagggcggttgttttaattacgcaaagcaccgtttatcctggcagcaaatttaattgccttttagaacttgaggtcttgtgcttttacataactaatattccgagctgtttaggtgccctgtcgtcttgtgcttcatgggtggcagtgtgctgctcttcaggccaagattggtttaaaatgcttaccttaccaattataaaaatgctgacaaattatattaacattttgtggtgtgattaaattcgcctgctcatataactattatcgtatccacacccgttcctccctcacttattaccatacattcaacccttccgtattgtcgattttccatcgtcattatttcgccccataaattcgcatttttttgcttctttttatcacttaatcaatattcatctctctttcttcatattagatcaaaacaaaaaatg

SEQ ID NO: 98820 - DNA, 1003 bp, Heterodera glycines
  Promoter: Source sequence=SeqID_13278; Location=760..1762; Strand=-; Gene=SeqID_77111
catcttgcctatactaaatacagagtggaaaactcttaagctctttacttaaatttgtttttccttttgttaattggggaaggtactaatcgtattactaatttgtttaatgaatttatttaacacgatttagttttttagggcttggaattaaatgaaaaatgcatgagaattggtggctttcgtcccgattaggtcctccgggttcccgaccgaattcagatcggatacccggctttttcaagagtcggtggaatttcccgtacttatgctttttcaactcggaatcaatttaagccaatcagttaattaatgttattacatatttacccgtgtccccccttctttgtactggcaatgattaaggcggactaaatatgtaatatgcattcattcaaaatgaattttttaaaaattaaatttcttagaatgaatttctaatttctttcttttttgtccttttctaatttatatgatttttcttgtgagaaatttaaggattttctgctattttacacaaatgttcgtaatttttttaaataactataaataagattaaaaatttaaaataaaattttacaaagattaattcgatggcccgtttttttgcttctcaaaattaccttttttgcacatattaaatttcaaaaatacctaagcataattcattgaaacaagcacagtttcgaaccttgttttatacagtttgcaaattgtgttaaattatttaattttttatgaaattttgggcattgtgatgcttaggggccgttttaaaagagagtgccgaagtttttctttaggggatgtaaaaagtggcatatttgcacgagtccgaggcttgaaaccccaaaacttttctcaggcagagattgacatttttatttggtccctccctgcccaacaaaaggcatttttatattattttatattattttattttaccttattactctaatctattaacctgctcgccgtttgtcactgccaccagcagacaatg

SEQ ID NO: 98821 - DNA, 88 bp, Heterodera glycines
  Promoter: Source sequence=SeqID_9459; Location=758..845; Strand=-; Gene=SeqID_71497
gcttaaaaactaatttggatatgaaaaaaaaacaaaataattatttacagggttggggaattgaactttagaagaagaaaaaagtatg

SEQ ID NO: 98822 - DNA, 230 bp, Heterodera glycines
  Promoter: Source sequence=SeqID_39725; Location=826..1055; Strand=-; Gene=SeqID_68226
cagagttccggtgggaatttctttgttgtttgctcagatcagttaacagattttgtaccaaaaattccaattctttgatttgtaagctttcacttaaaaaattgaaaaatgccaaaaatatttaataagtgaaaaacgaaaattttttagaaaaatgaccagagaacaatcaatctttagggatgcgaaattagttccaattaacaaaaagcatttagcgtattccaatg

SEQ ID NO: 98823 - DNA, 85 bp, Heterodera glycines
  Promoter: Source sequence=SeqID_45423; Location=1..85; Strand=+; Gene= SeqID_72726
aaagggatatttggaagctcaaaagccatgcgaaagagaagtgccgtcgctgatcacctgctgcaagtcgttgaacacgagaatg

SEQ ID NO: 98824 - DNA, 99 bp, Heterodera glycines
  Promoter: Source sequence=SeqID_21092; Location=855..953; Strand=-; Gene=SeqID_51678
ttttattaggaaaatgaagggagtaatcataagaatgaccgctggttgccttctcttcattcctttttatttgtttgccaaatatttttatcagaaatg

SEQ ID NO: 98825 - DNA, 592 bp, Heterodera glycines
  Promoter: Source sequence=SeqID_19298; Location=488..1079; Strand=+; Gene=SeqID_84040
cgttggaatacaccttgaacagactcacgctcaatttttctgtaaaaatgtttttaaatgcacgtaaaatctgcttgtaccgtttgaccatgtttttataagtatataattacaattaatgcattccgcttatattttcaattttaacctttgagtttgtctcatagccaagtttacttattgctcaattttcgttgttggtaaaatttctttatgatttaaaattaaaggcattattagggagcaaaacacgtaaaacttaaccaaaaacttaattttggtcatttaaatggttattaaatattttataatgtttttcgaataaggaaaatttttaaaccgagaattttttataagaaaaataatgaattttggcgattaatttttgagaaaatttttgattcataggggtgcattttctgaaagttttttcaattcttaaggatgtattttctgaaaatttttcaaatcatttcttaggggtgtgttttctcgattttattccatttttaaatgaattttccggaaaaacgccaaaaaaagtcaccaaaaacggaaaaaaacgccaaaaaggcaccaaaacggcaaaatg

SEQ ID NO: 98826 - DNA, 966 bp, Heterodera glycines
  Promoter: Source sequence=SeqID_10496; Location=610..1575; Strand=-; Gene=SeqID_73711
ttacaaaagctacaatatcattaagcataacgcacaattttttgtaaactctaatgaagatgaaagcattcttttaaattacttatttcaaatgattatttttattaattttctttttgtatttttcttgctattcccagcaaatgcttataacacatataacacatatgatgggtaatgtttataacattattataaaaataatagaaattttataatattttcacagacaaaaaaaaaaattattttaaaatgtccaaatttattattcaaattttataataattaacaaaatctaaaatcattttttaattatgctaaccatgagatcaaatataaattttgagattacaaaaatattttttttgttttaatgaaattcacgcattgatgataaattggataaatataatttttccaaaaacatatcactcgcgaaaaatagaattctgtgccaaaaataattaaattaaaaaaaacaattcaaccgataattttgcattttcattcaatagaaacaatctttttttcaaaaaataaactcaccatgttgggcgtttttgatgaggttttgacttaacaatttgtctaaaaaatgggccattttttgattttgattttttatatacaaataaagggggatttgagtccggcggagcctcggataatttggggaattggcttgatttgttgttaacagttcacacctgaaattgccaatttcttcagggatttttgcttaaaattttgaaattttcaaggaatttgtgaagagggcgggggttgagtgagggtcggcgctctattaaaacgcgaaaattttttacgcctaaattttcgttctcagttataaagtgattcgcgcaatcccaacgaatgactctcaagtgctggcattgcgtcatttcgcaaatttgatggagtcgtcaaacagtcgcaaaggcactgtccaattctggcaacatg

SEQ ID NO: 98827 - DNA, 368 bp, Heterodera glycines
  Promoter: Source sequence=SeqID_34828; Location=849..1216; Strand=-; Gene=SeqID_64527
aattgatttttaattcttgttaatgattttaatgtttattcatatttagaatatttgttcacaataatagtttgttatttattttttcaagatggcgaaaaatttccaacaagtcccaaaagaactgcgtcgttctaaaaatactcggaattatttccggaagagcccagatttgggcaagtattatgaagaagttgaaactcatgtaaaagaaaacaaaaaaatgggcatcaaacaaaatgtttcaacattttacttcaaaaacccgccaaatgaaaactctgaaaaaaatttcaaaaaaatattagcaaaactcataaatgaggcaaagaaagcggatgagcctggggtggaaaattgagaaaatg

SEQ ID NO: 98828 - DNA, 168 bp, Heterodera glycines
  Promoter: Source sequence=SeqID_14944; Location=2760..2927; Strand=-; Gene=SeqID_79108
tctctctgtctttctctcttctctccatttctctcttcctttactcttcctttatctctctttctccgtttcgctctctcctctctttcctatctctgtctctcttctgtctctctctctcactctctcctctctttcctatctctctttttgtctgttctctccatg

SEQ ID NO: 98829 - DNA, 204 bp, Heterodera glycines
  Promoter: Source sequence=SeqID_5350; Location=3603..3806; Strand=-; Gene=SeqID_57762
agtgagtggcgattcgataattggcatttttcgaatactttttaagcgacggtcctagaaatttaggattttcgaggcttttgaattgggtatttcaaaattaggcatctcgtgaaaaattcgaaaaattaaatttgtcatttattattggtctattttaattgaaaattaccattttttacagctttttcacgttcggaaatg

SEQ ID NO: 98830 - DNA, 258 bp, Heterodera glycines
  Promoter: Source sequence=SeqID_9379; Location=1..258; Strand=+; Gene= SeqID_71184
ctgaaaagtctcgtttccattccattcgatgccgaacagcgaaaagaatttggcgaatcggaaaacactgccccggggcaaacacttcagcagacggaggcaaattcggaggagaaaaatgcgccgtcggcggttgtgccgaagaccgactcggccgatgaccttttgggctgttcctctgcttttgcgaatgaatccgccgatttatgcagcagaaaaccatcggcaattgcaaaagacgaagcggtggaggaaatg

SEQ ID NO: 98831 - DNA, 97 bp, Heterodera glycines
  Promoter: Source sequence=SeqID_38793; Location=613..709; Strand=+; Gene=SeqID_67513
tttgtacaatatgttgtaacatttagctaccgtacgggttaagatacagtacgagcctgaacataaacagccttcaaattccttacatccacggatg

SEQ ID NO: 98832 - DNA, 891 bp, Heterodera glycines
  Promoter: Source sequence=SeqID_3412; Location=2709..3599; Strand=+; Gene=SeqID_84571
ttttttgactttattgattggatctatcgtccgattcggcaatgtttcagcacaaaatgtttatttggttttatcctattaacttttgtactcacattctaacagatattgttttttgaaattattgaattttctgattttttcaactaattattattattgtttttttatcactttcaattttcaatatccattttatattaatttttttttaaattaatttttgatttaaaataataaatcgatttgttagtttaccgataattatttattttgaattttaccaaaatgaggttttgtaatttaacgaaagtttatgtcagattcaaactaactcccgtagaaattaaaagcaaaaatcaaatggtctgctgatgatggatagtacactaaaccggaaaataattgcgcgtcatttaatatttgtccttgagcaatttttaattaactactgacgaatgcaattaaaaaataattgatttgcaatttaaaattgcaaaattttaattgttttttactaaataataaaatttcatttccatgatgggaggttttattttatgctgtaattaataaataattcattcatttggatgaatcaaccaatccgaccttttgccttgttcgcccaattagcgcattaattagcactcattaacattattgaagacatattagtcagccagcgactgaattaacaaaaccgaccaatgcttttttctcgcacattatttatttggcggtaattaactcgttttaaattgcattataaataggcaattaataatgaccacttcaaaccgacacattcattcattcattcattttccctctcaattttttagcatttgttaaattcgtcagctacaaaaaatttcgcaaaataaaatg

SEQ ID NO: 98833 - DNA, 106 bp, Heterodera glycines
  Promoter: Source sequence=SeqID_22212; Location=1716..1821; Strand=-; Gene=SeqID_52884
ttccgcacttccaattgtctgtgaccagtaaagctgtcacaccattttgctcagctgcttgacaaacattgtgctggctgtgaatgggccagtgctttacaaaatg

SEQ ID NO: 98834 - DNA, 1003 bp, Heterodera glycines
  misc_feature (494)..(494): n is a, c, g, or t
  misc_feature (682)..(683): n is a, c, g, or t
  misc_feature (689)..(689): n is a, c, g, or t
  misc_feature (695)..(696): n is a, c, g, or t
  misc_feature (728)..(729): n is a, c, g, or t
  misc_feature (743)..(743): n is a, c, g, or t
  misc_feature (755)..(755): n is a, c, g, or t
  misc_feature (811)..(811): n is a, c, g, or t
  Promoter: Source sequence=SeqID_7457; Location=975..1977; Strand=+; Gene=SeqID_64881
ggaaaaaatttttttccccaaaaaagtggcccccccccccccgcgcgcccaaaaaaaatttttttttttttttttttttttcccaaaaaaaaaaaaataaaaaaaaaaatattttttttttttttaaagaagaaggggggtttgttttttttttgttttttttttttttttttttctttttctctcctcctcccccacccataattttttttttttttttttttataataaaaaaaaaaaaaaaaaaaaaaaaaatttttttttttttttttttttttttttttttttttttccccccccccccccccccccaaaaaaaaaaaaaaaaaaaaaaaaaaaaaaaaaaagaaaaaccccccccccccccccctttcttttccccccccctggtctccaatccgggagggcgggggggttgggcaaaaatttggggggggggggccccaaaatttaaacccaaaatttttcccatttcggccagaatttttttggcnaattaagaaaattttattgctttttacgggggctttatccatttgtaacgaaggaaaatagtaccattctcctattttattgttttttgaataataataaaatattatttatttagtataaaattaaaattttatgttttcaatctttgctataaaaaatgaaattcaaagcgaattgatttagtcannttactnaatgtnntaaaaattagataaattttttggctaaaatcnnaattcagtgggaanaattttgcgaanatcatccattcttcgaataggtacttaatgatgcattttctatttttacccctttntaagaatttttttaaaataatggcacacaaaaatatgcaaatatccgtgtactaattaattatatttagttttaacgcttcaacaaaaatatttttatttggcatttaaatgccatttttgacgagccgatttgaaatatcgccacaaaaatattttattatttattcacccatcaccaccattttgagatg

SEQ ID NO: 98835 - DNA, 58 bp, Heterodera glycines
  Promoter: Source sequence=SeqID_1262; Location=432..489; Strand=+; Gene=SeqID_71018
agtaatctttttttttgagtttcttataataataattaaatttgaagaattgcatatg

SEQ ID NO: 98836 - DNA, 95 bp, Heterodera glycines
  Promoter: Source sequence=SeqID_31270; Location=143..237; Strand=-; Gene=SeqID_61639
tctgtatttatttattaagaattttttaataaaatttatttattcatgcaagattcagtctgattgatttattatcattttataattttagcatg

SEQ ID NO: 98837 - DNA, 776 bp, Heterodera glycines
  Promoter: Source sequence=SeqID_8930; Location=1816..2591; Strand=-; Gene=SeqID_69683
atgcttcgaagataccaaaaaaggttggatttggatgacaaagaaaaaagttatattggaaaagcttgctggtgcccaaacgtgccggcccaaccatggtgaccaagaatcagacatcatttttgaccatttctgaattcctaatctaattttgaacaaaaaaaaatagaaattccgtaataaatttacgacttttttcgaattcgggttagggactcggaattggtcaaaattgatgtcaaatttgtgatcaacaaccacgaaaagccttgcgaataagttttcacgacgatttattaggtcaaaataatttggcaaaccaaaagggtcccttcattggattttgaatagccgcaactttttaagtagctttttaagggcgaacacccaaaataaggatttctaaggtcgaataagggcgttaaaacgcaaaattttccaacaaaaaatgtgtttttcgtgcatttctcgtcgagttaaagccgcagaaaaaataaggaaaaacttataaatccgggccctattcataagcggcgcctattgttagagtctatccatcattttttttcataaattcaaattttggcgaagagtcagcaagtcctccgaaagtttatatttgcgtactgcaaactgaccaatcgtattcaatttcggccaaattccgctgcacttgtgggtgcagcgcggccaacgtggcactggcctccgccagtgttgtgccggtgtccgtcgctgcggcaccccgggctgagcaagtgccaccgctgccgatg

SEQ ID NO: 98838 - DNA, 68 bp, Heterodera glycines
  Promoter: Source sequence=SeqID_3656; Location=763..830; Strand=-; Gene=SeqID_51302
ggtaaccacaaaattcgtcaaattgttttattaatttattaatttgtagcgtttctcgaacaataatg

SEQ ID NO: 98839 - DNA, 999 bp, Heterodera glycines
  Promoter: Source sequence=SeqID_19644; Location=178..1176; Strand=+; Gene=SeqID_84382
ttgcacggaattcgagcgaattgcctttgtaccagcccaggggacagccacaaacctggcgaattatgagggggagagagagagaaataggtgacaaaaacggatgaattcttccctttaccaactccttaaaataattaccccagcccctatttgggacatttggattcaaaaaacaaaatattttatagcattagaattccgttgcttttttgttgtccacttccatacctccaacccgtactcgtcccggtagtgttccgcgcacgcgtagcgcaaccgtttgcaaaaggtgccgtcaattttgttatacgcctcgcagtacaaattgtactggttggtcggtatctaaaagaaaaaaaaatcaaaaccgtatcaggcaaagagacttattacggggacgggacgaaatctcgccgccggaatctcgccgcagaaatttcaaaaaaaaaaaaaaattcaaagttagaaatttttcaaggaaaaaattttagaaaaatttttttataagaaaattccaaaaaaaaactatgctaactttttttgaaaatttttcaaaaaaaacagtaaattttcataaaatttcaaaaaaaaattgctgaaaaatttttcaacaatttttttctttaaattttcttataaaaaaaaattttaagaattttttccttgaaaaatttctaagtttgcaaattttttttttgaaatttctgcggcgagatttcggccggcgagatttcggcggcgatattttgtctcggcgagattttggggtgcacccccatcctcccatggatacgggcctgaatctaatagtttaaaaaataaaatttttcgggctatgggcttggccctgggtgtttttcttgaaagatttccaagtttacaaaaaaattttaatttcttgtggggcgggaacatagtgttgtatctctaatttttctcattcaataatcaactttttttacattaatactttttgccccctctcgcctcagaatg

SEQ ID NO: 98840 - DNA, 693 bp, Heterodera glycines
  Promoter: Source sequence=SeqID_16146; Location=809..1501; Strand=-; Gene=SeqID_47346
tcgatttgttgtttcgcttgtccttttcctcatccgtcctctctctctctttcccttttcattcattttgctgtcccccttcctccgccggtggtttggttgaaaaattgcgatggaagaggctttcgcttccaatttcttctctctcttctgtgttaaatgatggctatttccgctccatttgttctcccccccccccccttcagtttttgaatttgaaaattccgtttctttttgcgtgactcacccatccctcaacatcatatgcatatatacacacagttacgtttataacatgcatacaacaaaatttatttgtttgttttaattttggcgagagtgcttggaattctctgggcactattcgctgttagataatcccgcgtttctctttcgcgctgtgtctctatgtgtttagtggttggttacatcgattggtttccattttaaattgcctccaattaaacagaaaattggatctcaaatgttgttaaggggacatacggggttttaaacattatatatttttcccgttactttcgagttttgcttcctcctgaatttatctataaaatctaagtgttgcaaaacgcgaaaagcataaaatgtaagcaaattggtctaccctaaacgatataaaattttcattttcccaacagattattcttctgtcattaaacctaaattgtaatg

SEQ ID NO: 98841 - DNA, 1003 bp, Heterodera glycines
  misc_feature (658)..(658): n is a, c, g, or t
  misc_feature (738)..(738): n is a, c, g, or t
  Promoter: Source sequence=SeqID_9691; Location=1083..2085; Strand=-; Gene=SeqID_72370
tcccccccccccccaaaaaggggttggggagcccccccccccaccggcgccacccttttaaaaaaaaaaactattttttttttttttttttgtgggggggacgccccccccccacaccaacgggggcccccccaaattttttttgggggaaaaaaaaacaccccccccccgggaaaaaaaaatctccctcccacaaacacccgccgcttattttttattttcgcgggggggggattattttgttctccccccccccccatttggtttgtgtggcgcaccccccccaccccccccaccccatcaaaaaaaaaaaaaaattttttttttttttttttttgttcggcgcgcccccccccccccccccccccccccccccccccccctctttttttcttttttttttttttccctcccatttttttttcccccttttatttttcgcttttcccccctttttttttttttatacttttttcttttttcctttctccattttctttttttcttttcatttttcattttttccccttctattttttttctccacctttcttttttatctatctctttttctttccttcttcattattctccctctttcctttttccttctttctcccccttttttcttcctccatctctttccccttcttcttcntattctccttacatttttcttccgttgcactttctccttcttttttgtttttgctccgacttctcttcttctctctcttncctcacatcttcttcccctctatctcgctctccccctctctttctctatctatctctattctctctcagtcttctctcttcgtccctctgtcggtctcgtttctctatccgtctctatctctctctctctcctttctcactatatctccctctttcttttttcctctttttctccccttctctctctctccctctattttctctctttgctctaactgccttctctctcctcgttctcacttctctcttttaatacagaagaatg

SEQ ID NO: 98842 - DNA, 341 bp, Heterodera glycines
  Promoter: Source sequence=SeqID_11681; Location=5896..6236; Strand=-; Gene=SeqID_75155
acccccaaatgtggccctaacccccttctttcattcaaccccccttcccttccccctcatcacccatcccttctttatcaccatcttccctccattccttccacctgccagccgccctcccccgcctcacttccttttcattctcttccaaatattttacgaccaaagttttccccgccaaaacgaccttgaaaaaacaacgcccatttttgcaccaaatcaaaattgttttcttcgcatcgattgatgtgcgagaacgaattcaccatgcattccccatttaattttagttgttaacaaaataaaattaagaaattttattttcagatttatttaaaatg

SEQ ID NO: 98843 - DNA, 1003 bp, Heterodera glycines
  Promoter: Source sequence=SeqID_1865; Location=634..1636; Strand=+; Gene=SeqID_76443
gactttatttataattgctacgatttaaaaagtttcgaatccagaaaaaaagtatttattttgttatattggtattttgaaataaagaatatgctctaaattctttccattcttttcgtgaatgtttcccattttgcataaattcatttttttaagatatttttcaacaattttagttttttatcattaatttttcgatgtttcacagaattcccattttttaattgtttcttccatttataaataaatacttgttaaattaatgcccaaatgttttgctaatattttttgacatttttctacttttcattccaatttttcatttaatttaatttttattttgtcatataattgatctaattgttttaatatttgaagtttttcctcttccgaatatttattattcattacaaattcactgttccattcaaaaatttttagccgcgaatttttgtgcaatttttatttcaattttagtccattctttttttgaaaatgtcatttccatttgcttaattctttccttaattttgttaaattttttccacaatttcttttcttttgatcaattgcttttaaaaatgatcagaattaagtccaattatttgttggcaattgttcaatttgatcactatttgttgaagtttctctttctatttccaaatttaatggttttattcagaaatatgaaaattaatataaaatgaatataatttataattacaaaaaaccttaaaaaataaattgatttccttggattttcatcaaagtatgattacaagaaagccctaagtagaattttgaaacatcattataaaaaaataagtagaatttgcttaaataattagcaaaaatttgagaataaaaccaactagaaaaagaatttttttattaattttattcagaaatatgaaaattaaaatattattttcaatattaattttcataaatgcaatttttaatatttatacgagaaagataaacgaagaaaaaagctttgatg

SEQ ID NO: 98844 - DNA, 748 bp, Heterodera glycines
  Promoter: Source sequence=SeqID_938; Location=3706..4453; Strand=-; Gene=SeqID_64518
ttagacaaagggaaagcggcggaaaaagccttttttattctttctctcatcaataataaattattcacttttttaaatttataaccctagtaaatccatcaaaatttctagcattaaaaacaattcataatttatttatattgtatatgaatgaattaggcatacaattatggcaaattggttttgctctctgttgtccacacaaaattcattgagcagcgtaaaaaatttgcgagggaaaagaaaaaatggaaggttaggttttaaaattaaattgttaagtgaaaatgtcattttcaattaaacataaaaatgttattttgatcagtgtaattaacactgatcagagtttttaaatcatcaaacaccgccaccactgatcggaaaatgccagccaataatcggcatcaaattgaagtacgtgccattatcgatgcgcgactgcatttctccagtcagcggctcgtacgtactttttgcggcccgcctaaattaaatttattcaattaaaagtttggagttcatttggaatttaagttttaatgaatatgcgcaatactttttttgtgctttatggaaatcaaaaaattctttaatactttcaataatattttttttaatttaaagttattttaaataaataatttgtcaagcatttcttttttcttaatcggccaaagcacattcttgttgtagaacggttttcttcagcttaaacgtgccggtccggtccacctgatcacagatg

SEQ ID NO: 98845 - DNA, 765 bp, Heterodera glycines
  Promoter: Source sequence=SeqID_32237; Location=1..765; Strand=+; Gene=SeqID_62559
ctgatgacaagctaatgtgataaaacaggttaattcctttcctttcagtatccctgcaaagtttggtgcgcttctgatcagtttctgaaaaaaaagttaaacctaaactttttggcctgtttaaaaaggaattaaaaatttttaaaaattttattcatctccctttttgatagaaaaagcatcagagtgcctaaactaacatgtaaataaaatttggtgcgtttcagaaccctttctgaaaaaatatttaagaattaattttgcaaaaaacaaataaataatgaactctcttccttaataattttcctgcaccgaaggtactcactcggcctcttcgcggcctcgaggtgggccttcgcgtgttgtcaaactttctaaacagctaattgtaagtcgagaatctgatttattaaaaatttaattctgagtgagtgaaaggcatcgtctgtgttcaaaacatggacaaaagcgtgaaagagacaaatgctgggagatattggaaatgatcaaatattacaaatgaaacttgcaaaaatggaacatttgtccataaggccaaaagcaagaaatactcttttcataaatggcacagaattgctcaagcaaacacaccataacaaattgacagaaataatttctgatgtcccccacgaaaatttttccaaatgtttgaaagcttaaccattttgaaaatgatgtgcgaaaagcgggcatttctgctgaaaaagtcggacgctcttttgagtaggggagggatgaaaaatg

SEQ ID NO: 98846 - DNA, 247 bp, Heterodera glycines
  Promoter: Source sequence=SeqID_11007; Location=1..247; Strand=+; Gene=SeqID_74325
atgaaaagggagggagttcaagaatttcctctactagcatgtagcatatagcgaaataagtttcatcataatgaaaattcacagcaattttgaatagttaattctcccaaaagttttttattttaaaagataataattttttattattaacttgaaattattaaaaacgggtaaaaataagaaaaaaatacataaaaaataatgtataccgcccggattcgaacttccccccctcccccaaaaaatg

SEQ ID NO: 98847 - DNA, 241 bp, Heterodera glycines
  Promoter: Source sequence=SeqID_44051; Location=604..844; Strand=-; Gene=SeqID_71598
gcctaatttggaaaagaaatttttaggggctggcggaatgcataaaaagggggtgatgggttgaccaagatttttcgaagggctctgagggttaagaaagttcggggtgtcacaacaaaaaaaatttgcggatcccgctgcggtattggggtaaccgtactttcttgagccgggattttcatcggatttctgctgtttttcaatcaattttttttcatcactttaagaggctactaggatg

SEQ ID NO: 98848 - DNA, 258 bp, Heterodera glycines
  misc_feature (55)..(55): n is a, c, g, or t
  Promoter: Source sequence=SeqID_41903; Location=749..1006; Strand=-; Gene=SeqID_69939
tttggaagcagcacacacaaaaacaaggagctgaaaaatggaaactttcactagnaattatttttatgaattttttttgaaaatttcaattttttcaaaaaaatttttcaaagaaaaagtcccggtctcgggttttcaggtcccggtttttccaaaaaatctcgatcccgcttataaattgcatttattccgaaacattggctaaattgagcccagttgctccgattcagaaagcaagaattgcttgaaataattatg

SEQ ID NO: 98849 - DNA, 90 bp, Heterodera glycines
  Promoter: Source sequence=SeqID_26212; Location=1..90; Strand=+; Gene= SeqID_56965
aaaaaagagtccgtaaaattcaaaaacaaaactttttatcaatgcttcattcagtataactccattctgcggccaccgatcagcaaaatg

SEQ ID NO: 98850 - DNA, 943 bp, Heterodera glycines
  Promoter: Source sequence=SeqID_6181; Location=3187..4129; Strand=-; Gene=SeqID_60618
ttgtgtatctaccttgcattggttcctgattatatggacgatcattgtgcgaaatcgttccactgtgctgctgatgttgagggggtagggaatttttttgaccatcgactatttaattttatttagtttttggacaaacaaattgaggaacccggtcgctcggacttcgaagagttaatggattaaatgctactgtcggtcccttaaactcatcaaattcaaaatgacaaataaataaaacaggataacccgaatcaagtgaactgaacttccaaatgcgaaagataaagtgtagttcacagattgtccaaaatcgcgcttcggtctcacattcaaatgcatgaaccggtaagtgcctccaaccaagagagtgtttgataaaagggtagccctggcctctctagcacaaatatgaacacgcaaatgttgctcattttccaacaaaaggtttatgccgtgcgcggatgtgccattgcgaaaaggaattctttccgcaaaattaaattcaagcagcttaagggttagtccactaaaaaaaaattctttttactcagacagtaatgaaagggtttacgtgatgtaagatccaatttgccaatcgaagaccaaaaaatcatttgttgtagtgccatcctgataaaattgctccagaaatgatcgaacacccgcattttgacccgttccctcattgatcattggtataatttgttgttgttggggggtgacgccatggctatggacatctgtagcaatgcgctcaaagtgttgtcgatgggtgagtgatatcccttgcggaagggaaaaagcagcaggaaacgatgtttgagcaaaacccgatgtggaaatggccctgtaagcggatgcgcaaattgattcagcaatggaagaggcgagaattgggacggcattgacattggattgatgaatgggttaagaagaaatg

SEQ ID NO: 98851 - DNA, 66 bp, Heterodera glycines
  Promoter: Source sequence=SeqID_2996; Location=308..373; Strand=+; Gene=SeqID_82691
agtaatatttttgccaatcgcttttttctattgtcttataaataaatattttcagacccaagcatg

SEQ ID NO: 98852 - DNA, 280 bp, Heterodera glycines
  Promoter: Source sequence=SeqID_40144; Location=406..685; Strand=+; Gene=SeqID_68568
ggtgaattttatggaaaaaaacaaatcctaattaggtgggtttgattaagttaattaggggaataattagcaaaattaaatgattaaatagggataggtggtgaaagagttaattggcagtttttttgtaaataaaataagaatttgagtgatttccgtcaaacacccgtataattgaattttaaatattctaacaattatttatgtttttttagattaaaaagatgagttctcgaatatttttttcttaaataaattttaatttttcgcaccaattatg

SEQ ID NO: 98853 - DNA, 174 bp, Heterodera glycines
  Promoter: Source sequence=SeqID_14683; Location=790..963; Strand=-; Gene=SeqID_78793
tatttaatcgtttaaattttattacatttgtcattggttcgaattcgcccgaccgatgttgaaatttggttgcttttcaaggtatttcccacttacaatacgcatccttttgcacttatattatttgaccgtgcccaaattgtaaaagtgatttggacactgaagttcgaaatg

SEQ ID NO: 98854 - DNA, 1003 bp, Heterodera glycines
  Promoter: Source sequence=SeqID_5350; Location=436..1438; Strand=-; Gene=SeqID_57763
tccttacatttatttattttattctgtttgttttgatcgttcaaaagtgtccttgatcagcaccgttttttttgtcgccaatctctcgctcttttgcctgcccattcattgtttttcgcacccatgaaaaattccatttttgaaaatttgaaaactttttgaaatttcttcagcgcccactcatcatcatttttgttttgtttttgtttttttgatgttgttgttattgttctcgcaagaaaaaaagaaatttagaataaatgcgtgtactcatttgtcggtgagcgctttctctcttcacaaagcgttttgatcactcgccgccaaattgacatgacgccactatttttaatgcaaagctaattagaataaaaaacaagtttttggggacgggccttccttctccatttgggaggaggagacggatgggtcgtgtggtttctctcttaaattaaacaaacggaagacaaaacaaaatttggcccctggggggggggggggcaatttgcggtaatcaaattggggacgatgaaatttgggacgggaagtgagacgatttgttcaccaaacagagggcagtctcgagcaaccgagtgattgatcaattttcaatttttgtttctccctctaagcggtgcgcgagggttttgcgcgtcattttctcccgttaatcgtttgaatttgggtcggaaattgttttttttcccgaacctaattaatgataacgttctggtccgcccgaaccaaacaaagccaacccttctcttattgtgggaaagaaactctcgtcagtttcttcacattctcgaatcgagagaattctcgggttttgagggttcccgttctcgaatttctagggacccgattctctttgcacagtctcgaaaaaatccaattactaaataatctttggtctttataccaacagcaattttaaaaagtgattgtgccaatgttgccaatccggctgctttttctgttggccgtgccgtcgtcggcaatg

SEQ ID NO: 98855 - DNA, 318 bp, Heterodera glycines
  Promoter: Source sequence=SeqID_37172; Location=747..1064; Strand=-; Gene=SeqID_66318
tcttaaaaaattactaaaaaattctatttttggttcttccttctagtttctctcttccttccaattcagcaaatgtccggaccccctctcttcgacggacccctccccaccattccgccgtccgtcggcgcggaccccctctcttagattattttttatttttagtaaatttagtattcgagtcataaaatttaaaataaattttattttatttggatatatcaccaattacttaaaaaatgtcattaacatgatttaataaaaaaatcttttctaactaattaacatattctttcagttcatcttggtcagccaatg

SEQ ID NO: 98856 - DNA, 246 bp, Heterodera glycines
  Promoter: Source sequence=SeqID_9938; Location=4877..5122; Strand=-; Gene=SeqID_72978
tttttgtcagggcggagagaacagccgacggcggcagtgctcaaaacccctcaaacgggcatcttttttgaatcatcacccgaagagactgacggaacgacgcacaatcgtttgtttgacgaaaaccgggaaatgtgcaattcggcacgactcagatcactgatccaaagggtacggcacgcactcaaaattcaattaaaggacatggcctagccgagacttctggccattttcaatttaaaaatg

SEQ ID NO: 98857 - DNA, 687 bp, Heterodera glycines
  misc_feature (97)..(97): n is a, c, g, or t
  Promoter: Source sequence=SeqID_4756; Location=1..687; Strand=+; Gene= SeqID_55628
atagtaattaatcctccctatttttgctcactgatcaactgtttgctgatcaatcccagccagaaaaatgataaattattgcattgtatattcattntaatccaactcagtctgctgatcaatgtccaagcactttcacatttcacagattttgtgctacatagaaaatctttattttaccatttacatttataatttttaaattattctaaaattacgatagaaaaattaataatattttattgaaagtttttattatttactttttgttggttaactattcactgattgtttcgccacgggttagccgattcacaaaaataagcgattcataaaatcgcaaaaatcaaaatctgacttttcctatgatttttatcaataaaattgttatagagaccggcgagggacgggatctttcgcgggattttgcgggatcccagtccgtaatcccgaatttttttttgtaaaatgcggaattgcaggcttgcgggattaatcccatgggatcccatcccgcaaaaaaatttagagttctaatcccgctgtgggaccctctgttggtctctagcttattgtattaattattataaaaatggttataatttataaaatagaggcttaaataaacattcttccaaaagtttttggcttaataattaaacttacttaatattaaataaaaccatg

SEQ ID NO: 98858 - DNA, 109 bp, Heterodera glycines
  Promoter: Source sequence=SeqID_16939; Location=1130..1238; Strand=-; Gene=SeqID_81369
ttcgtgtgaaaaacaatgcagtaaaaaaattgtgagcattttttgtcgctatgccaacaatagcaaaaatggacaattaatggcgttttaaggtgccaaattgcaaatg

SEQ ID NO: 98859 - DNA, 321 bp, Heterodera glycines
  Promoter: Source sequence=SeqID_8507; Location=285..605; Strand=-; Gene=SeqID_68333
ttttgtcgcgataattagctaaaacattcattgccctcccccctcaatttgaagaaatgcaacggcaaatgccaacgctaacggcaaaaacgccggcgaaaggagcgtaattatttctttgggccaattggatgaaagatcagagatcgccacacatcaaattgccaaattcgcaaaattcacaattcgctgacctttccttttgtgccgccactttcaatgggtcctcaaagccgaattttcggtggaagtgccggcggcagcgaattatcaaaatccatcacatttcacgatttttgtgagttgactcagcgagagatg

SEQ ID NO: 98860 - DNA, 222 bp, Heterodera glycines
  Promoter: Source sequence=SeqID_15225; Location=912..1133; Strand=+; Gene=SeqID_79431
gagttcgacatttttaaaaaagcctggacctggattccttccatgttggcctggacctttggacaaaaaccctgaaaaacgccaggtcctaagaaaaatcccggttgaaaaaaaggacatgtacctggaaacaaggaaaacccatgcctacaaactctataaccatcaaaaagcgtgttaaatacatttaggattatattccagccgcttttcgactacatg

SEQ ID NO: 98861 - DNA, 92 bp, Heterodera glycines
  Promoter: Source sequence=SeqID_2079; Location=2927..3018; Strand=-; Gene=SeqID_77738
atttttaaattttttaaatttctttattttttgttgattacaatcgttatctattagagtttttttcgttattaatttttcagttaaagatg

SEQ ID NO: 98862 - DNA, 189 bp, Heterodera glycines
  Promoter: Source sequence=SeqID_11974; Location=1..189; Strand=+; Gene=SeqID_75492
attgactaccgtaagaataaatttaattttggtagcaccaaatagtgttatttgagtaggtggtaagctcgtcgactgctattgctacgactgttattcttaaatttataaatttccaagactttaagcttttaatgtctccaactttttattgataaattatttcagattttcaagatttgcaaaatg

SEQ ID NO: 98863 - DNA, 1003 bp, Heterodera glycines
  Promoter: Source sequence=SeqID_7056; Location=963..1965; Strand=+; Gene=SeqID_63685
accacctatcttgactccctttcccttgttgtctctcacaatttctttttccctgtcgctagtcatcccaatttcccttccttttggccttttcttccacggggcgcccgacccgcccacctgttgccaatataaaaatttgggggagagatcggattgatcagtgtgatcggggactttgatcggcttgttgcgaacttttcctttttgcttttacacatatactcatcgctaaataaaccgattgttgaattaatcggagctttcaattggggaatccgcgctttgggccaatgcccctggcattggcccagggcccaacggattcacgcgcgcacccatctaacagctgcctcaaatcccttccccctcctacgaccaggcagggccccatccctggacgtttggagtttttgatcagagctcattaattaattaatcacaggggaaaaagggttggggaaaagaaatttcagctaacaaatgccagtcccgggacaagacaaaaataaacacaaatggcaaatcacgagaaaagactaacaattaacgaaacaaaaatgcgaaaacgaattcgaagaaaaaaatgaggcaacaactgacgggaaacattgcgatcacattggcaagcatcatccaatcaacgacgtccaattgtttcattatttttattacaccaatcgacgaacaattctttaattacttcatcacttaatttcccaatcaacaattactggagttcaacaaatcttttatttttctgagacacttcgacgacataatttctttaaattttaaatttctcgacacaatcaacaaaattctggatttattttctaaattctggtgttaatcagcgaaacatattccgacaattccatcaaaaacggccgacgcgcggagaagatcgaattctttagaggaagaagaacaaaacgaaggacaaaccgaaagggataaaaggctttggctcatccaccaaaaaaggcagctgcgtaatatg

SEQ ID NO: 98864 - DNA, 187 bp, Heterodera glycines
  Promoter: Source sequence=SeqID_9952; Location=1516..1702; Strand=-; Gene=SeqID_72995
ttcactcactcactgtgaccacgaagattttatggtgacgatgatgatgatgggcgatgaccttgcggcaatgtatgaaaaacaaaaaaacataaaaaagtttggcgggactcaagtggacggcactcgagcggatttggcatgagaaggggcggcgcggcgcttttgaaaaaaataaaacaaaatg

SEQ ID NO: 98865 - DNA, 153 bp, Heterodera glycines
  Promoter: Source sequence=SeqID_4806; Location=1228..1380; Strand=-; Gene=SeqID_55785
cggattgggaagaggaggttcgttttcagtgctaaacactcataatttggtggttagcaccagcacaaaacaacaacatcagtcgtccaccagtgaatgcggagatttcgccacccaaatcggtcaccttcgactcgacgaccgttttcaatg

SEQ ID NO: 98866 - DNA, 286 bp, Heterodera glycines
  Promoter: Source sequence=SeqID_4192; Location=689..974; Strand=+; Gene=SeqID_53537
aattgtgcaaaaaatcgtggaaaattttaattttttaaaagaaaaaaattaattttttaaaacgaaattttaattttgccgtacttagataaaaagacaaaaattgaaaaaaattgaattctcgccaataatacgcctcgccaacgccgaatgatgtgcaaaaaaaaattgaggaaacattaaaattgtagccaaatgaaaggccaaaaacccaagccagtataaaaattttgtttgcattcgcgtttttatctctgatcatacagcaatttatttttttacaatg

SEQ ID NO: 98867 - DNA, 105 bp, Heterodera glycines
  Promoter: Source sequence=SeqID_33376; Location=916..1020; Strand=-; Gene=SeqID_63456
tcaattttgccattttttgtacatatttcagatttttgcatattttgtcatttttcatcaaatatttcgatttaaatatcttttaggaagaattttttaattatg

SEQ ID NO: 98868 - DNA, 285 bp, Heterodera glycines
  Promoter: Source sequence=SeqID_433; Location=1164..1448; Strand=-; Gene=SeqID_52622
gtgaatacaactgaaaggcatgcacaaatcaacacagccatcatcgacttaaattgcatggaaatcaaagcagaccatccaaaatggtggaaaataccaatcaaagtgaatggctcagattatccaatgcatgttgattccggcgcacaaatcacattgttcacaatccaaacatggattcaaatgggcaaaccgcttttgaagtcagcacaaattcgcgtcaaaaattgcaatgaccaaacatttgcaattgaaggacaattttggtgcgaagttgaatacatg

SEQ ID NO: 98869 - DNA, 497 bp, Heterodera glycines
  Promoter: Source sequence=SeqID_45190; Location=1..497; Strand=+; Gene=SeqID_72533
taaaaatatatttttttttttctaaatcctttaataggggggccaattttgtgggcccaaaatttccccccggcgtccagaaaagtattttttcataaaaaattaatcaattttaatttttcggggagcccttttggccgtttttaagccttgttaagtcgccttttgggggttttttggtgactaaattccccatccccaatttattaattgagaattgaactttaaaaaaaagggtaagaaaatctttccaccaccctttgaaattaagaaacttgtgtggtgtccaggtggcaaaatccctttttaagacaagtgattaattaacaattatattttattaagctaaaagtctgaaaatagcgaaacaattgccagcggtgaagccaatatttgcagatagctttaataaatgtcttagtttaattactgccgtcgtaaaactgaatgttatttcgaaatatttttgggaaaatattgaaaatgacttggatatg

SEQ ID NO: 98870 - DNA, 300 bp, Heterodera glycines
  misc_feature (6)..(6): n is a, c, g, or t
  Promoter: Source sequence=SeqID_1801; Location=1..300; Strand=+; Gene= SeqID_76062
ctccgnctggtcaagcatagtcctcctccaacagctgcaaaacagccttctcccgtaaaaactacgcccgcgtctaagctaaagcccgcgaaaacggttccaaaaccaccaccacctcctcctaaacaaaaaacaccaccaaaaccttcaccgatacttgagtcaccgcctcggtatgaagaatcgaacagaacaattgtaaagccaccagtcatacaaccatctccacctcatcttgaagaagcgaacaaaacaattaccaaacagacgacatttgatactactgcaaaagaagtgatg

SEQ ID NO: 98871 - DNA, 222 bp, Heterodera glycines
  Promoter: Source sequence=SeqID_17188; Location=1..222; Strand=+; Gene=SeqID_81637
agtcgatactatgggtggttcaaggtattgcaacaaatactgtgcttttgtatgtgtttattagtttgagaaaaggggaggggagagtaattagcctatagaatcggggtttatataattttagtcccttctattcagtttggagcgtgacccgtacatacacaccggaaatcgactcattccaaagccttttgtgcctccaccgccgccaggcaaaaaatg

SEQ ID NO: 98872 - DNA, 106 bp, Heterodera glycines
  Promoter: Source sequence=SeqID_27363; Location=249..354; Strand=-; Gene=SeqID_58058
tcttctggatattgaaaagaattttgtgttgcatgactctgtcaagcacgatcaaatggtgactcaaaaatcattttgccatagacatacaaactgaattgaaatg

SEQ ID NO: 98873 - DNA, 81 bp, Heterodera glycines
  Promoter: Source sequence=SeqID_36520; Location=1313..1393; Strand=-; Gene=SeqID_65807
ggtatcattcgaaagctcataatatgctctattaatctgcaaaatcccaaaaaaatttcgtcaattttgaacaaatttatg

SEQ ID NO: 98874 - DNA, 164 bp, Heterodera glycines
  Promoter: Source sequence=SeqID_2232; Location=1..164; Strand=+; Gene= SeqID_47213
tctggcactctccctttattgattcatctctcgttttttgaaacgctgtctaagtgtataaatatgcaaaaatttgcagtcaatccatcattattttcttcacttacaaattctgccttctgtgattgttcatctgtgacgacgacacttcgtgaacgaacatg

SEQ ID NO: 98875 - DNA, 177 bp, Heterodera glycines
  Promoter: Source sequence=SeqID_3383; Location=1373..1549; Strand=-; Gene=SeqID_84463
ttttctcttccatctctcttcattgcgatatatctaattttgtttttatcttccatgtaatattttttaacgcgaaaatttgaaattatcgattcgaatgccaacataaaagcgctatacattcagcataatttaattcatttaatatttttccgttcctaattatattgtatgatg

SEQ ID NO: 98876 - DNA, 62 bp, Heterodera glycines
  Promoter: Source sequence=SeqID_6266; Location=2564..2625; Strand=+; Gene=SeqID_60949
tctcatcaagcggttccgctgactatgacgttgccctttcgccaacccaattgcttgcaatg

SEQ ID NO: 98877 - DNA, 88 bp, Heterodera glycines
  Promoter: Source sequence=SeqID_28645; Location=1..88; Strand=+; Gene= SeqID_59239
caatccattcgccccatcaccatcacatcccaatctgctgtctccctcccttttgccgttcaattcgcctcgtcatctcgtcccaatg

SEQ ID NO: 98878 - DNA, 729 bp, Heterodera glycines
  Promoter: Source sequence=SeqID_20321; Location=848..1576; Strand=-; Gene=SeqID_50835
atttgtgcagcaataatgaatgaatgcccttctctttccgttttacacaattaatttgaggcgtgcctttttgcacgcttttttgaaaaaatttgaaataacttcaacaacttatgttttcgatttttaataaaaatcgaacaaatgaatgttttacaattaattaactttgacaattaaaattgctaacattgacaaattattttagggtttactttattccatttgaagttcttttcaggttttccttaaattatttgtattactcttttcactattattttgttgataatttgattttaaatgcctttttttattattttagagccaaacaaacgatttacctaatttaataaacacaataaagtattgtctttcgaaataattgtcttttttaaatttatttaatttagttataccattaaataaattaaattaattttatttcactttttcatttatcaaatttcttcacatcgttttcctttcccacataaaaagtgaattgcgtcaagacaaacgaattggcatttggaaaaatttcacagaaaatatttttcctctcttttttttacttttccaacaaaattatttttacattattttattcatgaaaacgtgggaacataaatggtttttgtgtcaatttaaggaagtttatggtgaaattttgcgtaaattttctattttattataaatttagctaatttttgccattgttattaaatg

SEQ ID NO: 98879 - DNA, 311 bp, Heterodera glycines
  Promoter: Source sequence=SeqID_16993; Location=2223..2533; Strand=-; Gene=SeqID_47404
tttcgtttccgatgaacgtcaaaaaaagcttcctcgcttcttctggtcactatgcgacacgcacacacgacagcgtcgctgacgagggctttaaagctcggtgtaaaatttttgagggtgggaagcgagcccaatttctttcacgtctggactttgacctgggaaaccaagaactttatttgttgaacaatttggatcttttatttacaatttacaaagctcgtgacactttcatcatgcagacattgaaagcaaacgatactaccaaataccgcgttagagtccatgacgtaaaactgtatgccaaaatg

SEQ ID NO: 98880 - DNA, 480 bp, Heterodera glycines
  Promoter: Source sequence=SeqID_5552; Location=3509..3988; Strand=+; Gene=SeqID_58430
atgtgttcaaaacaatgccggacagaggctatgccttgttaagccttaattgccagatatgggccaaaagtttttatagtaaaggtttattttgtttgtttttttgggggtttaagggattagccaatggtatcgcccagagggccctatttataaatgcatatggattaattaatgtgcctacgttatttcgactttgaacacacgaggattcgaactgcatttttgattcaggaatatgacacgaccattttcagaattccccctccccccgtgcaaccatttttgaaaaagtttaagatttttgaataaaactgttgcaattaggggaaggaaaaatgccgaaacactgccaacactccagcaaatttggcccaaggaccgagaacaaaattgaaatattatttatattagttcaaaaaattaagagaaaaacaaggtcaaaccatggtcgaaataaatagattattttaataaatg

SEQ ID NO: 98881 - DNA, 369 bp, Heterodera glycines
  Promoter: Source sequence=SeqID_5635; Location=1243..1611; Strand=-; Gene=SeqID_58726
gcggggatttgattgattgggatttatggaatgaatgaactaacgaggagaagtaattagcggggatttgattgattgggatttatggaatgaatgaactaatgaggagaagtaattagtggggattcgactgataggaattatggaacgaatgaaagaatcaagacgggagattaaataataggggtaaaatctagtggattccactaatacattatgcgtgtttgtatttaatataaaataaatcggcgatttgtcacttttacgaaacgcccatagtggcacttttacgaaacgcccaaagtggcctttttacgaaacgccctggcacttttacgaaacgcacattttggcactttttacgaaatg

SEQ ID NO: 98882 - DNA, 94 bp, Heterodera glycines
  Promoter: Source sequence=SeqID_2318; Location=1..94; Strand=+; Gene =SeqID_79088
caattgtacgcttggtgtagcatgattgagcagtggccttggtatatttaatatatccagattaatcccccccaaatgtcttttcaggcgcatg

SEQ ID NO: 98883 - DNA, 95 bp, Heterodera glycines
  Promoter: Source sequence=SeqID_23921; Location=607..701; Strand=+; Gene=SeqID_54613
cgtaatttgggaggcggggggctgcccttttgacaggctttaatttgtaagcctatgttcagcagggacatgttgtggttggcgaattcgccatg

SEQ ID NO: 98884 - DNA, 875 bp, Heterodera glycines
  Promoter: Source sequence=SeqID_4535; Location=1..875; Strand=+; Gene= SeqID_54804
ttgttaacagattttcacaaaaaaggttggtttttgcgattattaagctcaattggtaggattttcatttaaaaaatgataaaatatgtatcaatttaaaaaaaaaactatgaggaatcatattttctttataggaaacgcacgagtatacaaaaaaaaaattgaaaataatctaatttctgtagagggattgaaccaggggaaagaagaagggaaagtcaaggagactagccattaggccatttgcacacttgggcagtgttaatttttatttttccctttgactccaattttcttcactaatttttcactcatgctggtatgcacaatgctaaggatatttatctgtagctagcgatatgtggatagggtagctgcagataaaaaaatctgcagataaaatccctatgcacaatgctagcgctaactatctgcagctgaagatttttttatctgcagatacccatccgcagcaactctctcgtcacacatctttttatcttttctatccctcaagagaaattttctaactgggggttttcgaggtcgctgatcatgaatctgacatttatttcaaccaattcctaacccgaactcgaaaggtccaattttcggtttttgttcaatcatcatgaaatgtaaatcaaaaaattttagaggtattaaaagtcatttagtacaatttttcaatttttaaacttatttttgggattttaatcgacatttctatcgaaattatcctcatatcgatgaggatagtgattttaatctgcagataggtggtagctgctaccctatctttagcattgtgcatatgtagcctagctgcagctgacgctaaggattatttgtaaaagaaactgtcattgtgcatg

SEQ ID NO: 98885 - DNA, 500 bp, Heterodera glycines
  Promoter: Source sequence=SeqID_13915; Location=1647..2146; Strand=+; Gene=SeqID_77868
tctcattgtttgtgtttgcatatgtatttacgtctatcctgcctttttgattgtttttggtgcacttcataaataaagagaatcagagcctaccattcactttgacgggcaaaacagaatatcaaattttctaaagaaatcatccaaaactttgagtattgtcaaggggtagtggttatcttccgggtatttccattcgacttattcattcagcacatgtacattggtttaccaatcgagtagtgtgtagtaaaattaacgaaggggtagagagaaatgaagtcacatagaaatttttcattccgtcttcaaatccgctcatttatttgttgctcattaacattttcgcgatctcgcagcctaatacacttacaactggatggacaacttgacttcgtataaattcataacgttttacattcctctcccgcactttagcatttatttttttcaattagacattaatatacatcttctaggtagcgctaattgcaggtatg

SEQ ID NO: 98886 - DNA, 136 bp, Heterodera glycines
  Promoter: Source sequence=SeqID_42361; Location=867..1002; Strand=-; Gene=SeqID_70272
agcatttcttgctgaaagttatgttttaaatctaacttttttcaccagattgacctgttcatactctaaactttggtctctgattagtcttaagccttagcttttggatgattattttttaatgatcactaaaatg

SEQ ID NO: 98887 - DNA, 1003 bp, Heterodera glycines
  Promoter: Source sequence=SeqID_20526; Location=384..1386; Strand=-; Gene=SeqID_51061
aatttttgaaagaaatgttttttgaagcgaattaatatgcaaaatcttaacaagattcagttaaatattcaaatttttctctcggcggtttcttattctcttaaaaaaattagctcaaaatcgtaattttgtcattttttgaacaaaatcgttgagaaatcgcattaaaaattacaaaaatttttctgtcggcgcctattagagcaggggtgtatctgttcatatttctaagaaatgttctgatttggggtagtgtcttattttcatttaaaagaggaaatttctgaaaaatttggctaattcctaacaaaattcattaaaaattcttaaaattttcccccagcggcgcctatcggcaccgccggccccccaaaactcctatttttcttaaaaattagcccaagatcgcaaattttggtcattttttggacagaacttgttaacaaattgcattaaatttttaaaaaatttccctcggcggcgcctatcggcaccgccgaactctcttccctcacccatacccaaaaatttttcggaaaaatgcgtcgacaaaattgttaaaatcttataattgattttcggaaatgtataaatttctcatttctaagccgaaatgctcagaaaatagttggcggtgagtaatgcttgattttgttgaataaaaaagcgattcaaagttttggaagcgtgttttaaaaaatgtccttatttttgaccctaaaatcttatttttgaccagcgatgctcttatttcgggaaattttcaagggtaaccctggtcttgtaccagttgcattttcatttttttcaatttgaacataaaatttttcttctttctcaacaggtcgaaggcgattacgaagaaggaacgctcagcaaattcgccgtggacagaaccaaaggcgttttccccaactttgaaaaccgttcgttggccgttccctatgtgatggaagtgccgcctgagaggctgatcagaagccacgattcgatcacaatcatg

SEQ ID NO: 98888 - DNA, 58 bp, Heterodera glycines
  Promoter: Source sequence=SeqID_1620; Location=1159..1216; Strand=-; Gene=SeqID_74886
cctgaaaataatttaaaattatttgatgaatatatgtattattaggttttatgcaatg

SEQ ID NO: 98889 - DNA, 159 bp, Heterodera glycines
  Promoter: Source sequence=SeqID_6082; Location=1..159; Strand=+; Gene= SeqID_60251
cagcaggcatcacaaccggttgccgtcacttcgtcggcggcaaaaccgctgccccaacaacactttgtgcccccgccgccctccttttacacggccggcaaccgttcgtccaacgccgccgccgccgcactgcttggcgttgtgccagcgcctccgatg

SEQ ID NO: 98890 - DNA, 366 bp, Heterodera glycines
  misc_feature (17)..(17): n is a, c, g, or t
  Promoter: Source sequence=SeqID_44152; Location=1..366; Strand=+; Gene=SeqID_71680
gagaatgagagtgatgnaattgagaggaggatcagagtaagagacatgagagagacaaagagaaagggagagatagagggaaaggaagagagagagagagaaggaagaggtgagagaaatggagagaaaaatgagagataaagagaaagggaaatgagagagagagggaagagagagaatgagggaaggagtaagagaaagaaaaaaagtatttttgatcagaaaaaatgcctaagaggatattagactgatcaaaaagagaaggaaacgaaaaaagacacgagactattttaactgagactcacaaacccaaaggaactgtccgagcagtacgcttccctccgcgaacggtctcggttggcaatg

SEQ ID NO: 98891 - DNA, 255 bp, Heterodera glycines
  Promoter: Source sequence=SeqID_2865; Location=505..759; Strand=-; Gene=SeqID_82046
cagttaggtacgacaaaaaacgttattcatttattatttaattattgaaaaatgtaaaacgtgtaatttcattaaaattggcaggtgccatgaacagaaaggcagacacaaaaaatcacaaatattatgtaaattcagaaacatttaattaaattaattgtcaggtgagctttcggttttactcaagcaaattaagtattgccatttgttgttttatcttaaaaaaaattaattaaacaaaaattcagcaaaatg

SEQ ID NO: 98892 - DNA, 82 bp, Heterodera glycines
  Promoter: Source sequence=SeqID_15590; Location=1..82; Strand=+; Gene= SeqID_79885
ttccatgtttcagttggctttgtagcgacgtttggatggtattctcccatcatttgaccatgctcaactcggcctcaaaatg

SEQ ID NO: 98893 - DNA, 419 bp, Heterodera glycines
  Promoter: Source sequence=SeqID_24066; Location=1..419; Strand=+; Gene=SeqID_54764
atttgttaaaaaattcatgatttgttaattgttattagagaaattaaataaaaaatttgctaattttggtgtttaatgtaactgaaacaaaaaataggtttccatccgcaaaagtggttgtccgcaaatgtcggctttaaaaatcaccaaatgtcggtccgcaaatgtcgggtaacctttttgagacatccattttcaacaagacgcgccttcgcggagacaagacgtagagcaatcattcaaaggccattttgtagagaattttgtgctctttctgttcgtcatattcatcttctatggaaaatttttcccaaccccctagaatttttttttcgaatttactcagattttcgtattttttcacccgcaaaaattttgtgtttaatgccttttttatggcataaaatgaataaaaaatg

SEQ ID NO: 98894 - DNA, 459 bp, Heterodera glycines
  Promoter: Source sequence=SeqID_34658; Location=188..646; Strand=-; Gene=SeqID_64388
tttttaccactatttttctctcactcatcgtctgctcgtctctcctttattataagctattttcctaagccaacgcccttttctccctcttttctgttagtcatttctcattggtgttgacgatccaacattcagtgtacaaatttgttaaacctctcaacattttaaatcaaaatcctaataaaaatttcgttgaatttctccgcctcttatttgtgcaaaattttcgaaaaagtaattttctatttaaaattaaaaaattcagaagcaaattcaagaatttttttatttttaaatgcattttttaccacatgaattatgattaaatttttgcgtttcaattcattttggaattaagaaaaataaaaattgataatcatttgatcatttttagcgcactttaagcaccgccgttaggcagcgcagttccaaaatttattccatgccacagatattatg

SEQ ID NO: 98895 - DNA, 291 bp, Heterodera glycines
  Promoter: Source sequence=SeqID_16476; Location=761..1051; Strand=+; Gene=SeqID_80883
ataaatcatttttttctcaagttctgctcgtgatcgaaactttctcgatattcgagaaagactttttcaaaatattttccatattctttcaaaatcaaataaaaataattataaattatggaagcagccttagaattttttccttgcaaattttgattatttttttcctaatttgtttaaattattcaactataaattctttaaaaaaatttgtgggtaatacgtagggtattcttcaaaacatcagcagagaaataacctattttttacagtcaaattaatgtgccaatg

SEQ ID NO: 98896 - DNA, 1003 bp, Heterodera glycines
  Promoter: Source sequence=SeqID_8427; Location=3542..4544; Strand=+; Gene=SeqID_68024
tttggcacgatttttggtttttaatggctcgcttctatctctatttccaaaggatttgccgcatttacagcatctcgacccggtatttgacgttgcctttgtatttttattctacttgcgccataagttggcaatcgaacaagttgatcatcagagagtccttctcttgacgatccaattaaattgcgcggggcagcttcaggttgatccatagcagcgtcttttagctgttcctgacgctgccttttctataatttaataaaattaaataggaaatattccaattttaacaacagatttcaccacgttagactctgggtccggcaaatggttatgatttgttcttccaattaattttgtgctgtcgataggtgaatgggccctgcctgggcatgatttcttgacacatctccatacctatttaagataaaatatttaatatatacaaatactgaaaaatagcctgggtttggcctgctgctattattctatcagtacgcatttcatagccttcaaaaacagtcatcgttttgcttttcgttgtcctcttatcgggttctaatcggtctgaaaattgatttcgattttttgtttgcttaaactacaaaacttgccttgttgtggttgaacatgacataattgaagcaaaattaaaaaaaaactttgaaatacattctataatatttataagtgggttggtaaaaaatattcaaataaaatcgtaaaaattctacataaaaacggtgtttttcttttcatttcccgctattttcctctttttgccagccgtccgcctctcttgttattgccagccgtccgcctctcttgttattgccagccgtccgcctctcttgttattgccagccgtccgcctctcttgttattgccagccgcccatttctcttgttattgccgtccgcccatttctcttgttattgccgtccgcccgcactttataactatttcttttatgaaacgtgaaaatattattgaactctaaatg

SEQ ID NO: 98897 - DNA, 53 bp, Heterodera glycines
  Promoter: Source sequence=SeqID_23381; Location=1324..1376; Strand=-; Gene=SeqID_54091
ggtcattcaatttaattattcaattctctaattgggttgtttaagctgtgatg

SEQ ID NO: 98898 - DNA, 591 bp, Heterodera glycines
  Promoter: Source sequence=SeqID_39911; Location=828..1418; Strand=-; Gene=SeqID_68366
tggcctggcaggtcatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatg

SEQ ID NO: 98899 - DNA, 798 bp, Heterodera glycines
  Promoter: Source sequence=SeqID_9041; Location=1872..2669; Strand=-; Gene=SeqID_70078
tagaaacagtgggaaaatttatcatttaattatttcatcttactaattaattattgtaatagccgcttttcttattgtttcttcgtgcgtttcaagcctcgcacagtcaggaaaaaatatggattttcataaatccctatttatcagtcagtcggccattaaattttcaaacactttttgcagaaaaaaatctatcgtcaaattacgtctatttctactcccaatcagatggcaaatgcctcgacaaacgatgggatcaaagtcatataatccgtttaaggattataatttcagtcaataaccaataaattgttttttaaatatttagtgactttcaattttgattagacatcattgacaaaaacaataaggcatgcaatttattcatttttattttttactttagtatcaaaatattcaatttcccatttgtttaaaattgtccaacataaaattccgtcgtttagtgaatcataggaataatttttatacaccacaaaacatttgaaattttccatttatccaattttgtaaaaataaaatgcctttttccatatattttttgctgctcatttattatattatctccaatgaaaaagtttttgctgaaaatggagaaaagaagtttctttgcaaaattaatcacatttaaattattattattttaagaaaattgtttttggatttaaatggcactgatcggaccattcggctgaaaaactgcggcaattgcaaagggttttaaggcttaaaaagccaataaataagtaattggggtgttaattaagcctggccatg

SEQ ID NO: 98900 - DNA, 119 bp, Heterodera glycines
  Promoter: Source sequence=SeqID_5726; Location=5592..5710; Strand=-; Gene=SeqID_46099
cgtatattctttttgaaaaataatttcgaaccccacggacatttgtaatttcatacgttaataaaagaagcattcgattaaaataaaataaaattcagctaagaaaactccgtttcatg

SEQ ID NO: 98901 - DNA, 171 bp, Heterodera glycines
  Promoter: Source sequence=SeqID_2702; Location=1..171; Strand=+; Gene= SeqID_81164
attttttttgaatcttaaaaattttttatgctctaattctatggtacacccttaagtaaaatataagattttgaagcgatttttatgaggtgattttatggtgaaatagaataatagattttttaaaaatataatcatttcttttttcagttacacgagcttaagcccatg

SEQ ID NO: 98902 - DNA, 401 bp, Heterodera glycines
  misc_feature (93)..(93): n is a, c, g, or t
  misc_feature (110)..(110): n is a, c, g, or t
  misc_feature (135)..(135): n is a, c, g, or t
  misc_feature (140)..(140): n is a, c, g, or t
  Promoter: Source sequence=SeqID_31686; Location=1..401; Strand=+; Gene=SeqID_61995
gcatcattttttgggggggggggggcgaagttcgaagcccgggcggtgtacattaattttctttgtattttttgggttaattttcatactttntaataaatttaaatgtntggttttattaataataaatttttntagtntaattaaattattttttgatgaataatgattttcatttaaattatttattatatttaattaaagaatttcagctattattttaaaatttaattgtaaaatttttttcatttcaatttaaataactattcaatcaattattatacctttcataatttgtttttcattaataaaaagtgtattatatgttaaaaaatgaaaaatataacacttcgattttttatctattttgattaaaaacaattccttaattaccataaatg

SEQ ID NO: 98903 - DNA, 409 bp, Heterodera glycines
  Promoter: Source sequence=SeqID_17435; Location=1898..2306; Strand=-; Gene=SeqID_81919
tggtgccgctaggcgccgtcgaatttttctttttgaaaatgtagtcgaaatttatgttgctaagtggtttcgtaaaaaatcactaattagggtgtttaccaaataattaccataacttttgctcaaaattaacaaaatttaatccttttgataccgtttgacagctgataatgcctgctaaaaattttcaacaactatacaaatttttgtatttgatggttgattatagcattttcgaatctggaattttatgacgattttgccaacaaaacaataaaatactgatcaaactccctccctcccccctttcattagcctaaaattttttaaatcaaattttttttagattttacgagagttagaagtacgcaaaaaactgctcgatttggttcgatatgaagaaaaaatg

SEQ ID NO: 98904 - DNA, 96 bp, Heterodera glycines
  Promoter: Source sequence=SeqID_32971; Location=208..303; Strand=+; Gene=SeqID_63176
ggtgagtaatgggaaaagcatttgggaggacaaaaagttaatttttaatgaattgggaattaattaacgaaaaaccaaccattggcatttgttatg

SEQ ID NO: 98905 - DNA, 169 bp, Heterodera glycines
  Promoter: Source sequence=SeqID_15826; Location=1..169; Strand=+; Gene=SeqID_80151
cttttccaaatttttcgctttttaaattttatcaaactgtttttttgatataaatcgaaaaagacattaaaaaaatcgaacaatatcaataaaattataatgtgaaaaatcaaattacgcccatctcggatttatcaatactatatttcgcaatttttttagaaacatg

SEQ ID NO: 98906 - DNA, 66 bp, Heterodera glycines
  Promoter: Source sequence=SeqID_24245; Location=1053..1118; Strand=-; Gene=SeqID_45849
ggtaatttttagcccatttatcttcatcaaaggaattgtttttttctttagttggcactgaggatg

SEQ ID NO: 98907 - DNA, 1003 bp, Heterodera glycines
  Promoter: Source sequence=SeqID_5431; Location=392..1394; Strand=+; Gene=SeqID_57991
agggtctaaaaatgttaatttaaaaaatctcaaaaagaaggtgctaaaagcccgaaaattaatctataagagtataggaaaaaaatttgagggagctctataattttaaatttaaattaaataataaatttaaatttttcctaattcaaatttggcctttttaaattaaaacccatttaaaaacattgaagaaatttaattcaataaaattatattcttaaattttcatttattaacctaataattaaagaaaaggaaaattattatttacatactttaattttagagaaaagtatgcctttaaaaataattattattttgtgatttggaaattataaattaattttcaggggaataatttttgtattttaaatgattttctaaatttaattttctttttttagaaattaaattaatttcatttaaagaaccaattttttaattgcctcacctttcatcacacttttattatattatttttcatttaaccttaaaaaagtaaattaaattaaaatacgcaaaagttaatcgaatcgaaaagtttatttaataaagttttttcaaaaatattacttttaaattaaaatttttttaatataaaatagtttttattaaattttattaatttaaaaaagttttccttttaaattttcttttattttccgttcattttaattttaacattcttttaaataaacgttctatcatttttctctttaatcaaaaaattattttcaaattaatataattttaattaatttttttttggattttcgtcatgacgctattttccaatcctcgatggtttggcggtgccaatgccaagccaacaaatcggaggataaaagaaatttaaattaaattacgcaatatctaaaagtgacggtttttaaactaaaatttattataaaatatttttattcagttttattgaattaaaaaaaggctttgaaacaaaaattcatttttttaatgtaacttaattttaataatttccatcatg

SEQ ID NO: 98908 - DNA, 249 bp, Heterodera glycines
  Promoter: Source sequence=SeqID_13369; Location=1..249; Strand=+; Gene=SeqID_77243
ctttttcgctgcgctgtgctaatgatgcgttcggtcagttgttgcgcctccgctggtcccccttttgcacttcccccccccattttcccaattttacatttttctctatttttcatccccccccccctcccgccggtgttgtaatttccattccattctttcatttcacacaaaatgctctcagaaaggccaaatttgtccccttcgtcccccaacggaaattggcaaaacgacacttttcaaaaaatg

SEQ ID NO: 98909 - DNA, 1003 bp, Heterodera glycines
  Promoter: Source sequence=SeqID_5189; Location=1694..2696; Strand=+; Gene=SeqID_57216
agagctaaaaccacaaaaaagtcagacttttcgcatattttatttataacttttttacatgtcgatttatatttgtgatttttgggatgccaatagagattgtaaagctttcgaatgataccaagtttgttgaatttatgttatgggctaagttcattttttatttaaatataccttagttcgattaaagccacttaaatttaaatgaaaaatctgttaactgaaaatcttatatatttacgttcccctcccccaaggtggacaaactcggcacagagacgaaccaattcgtacaaacggcaccgcttcatgagcgacaaacacgacttggtcgagtgaccatgagcattcaggtgaatgagcacaagacaataaacaggcattgtaccgtgccaaaattgtactttagttttattataccgtaatatttggcatctaactagccattttatttagttaaaatgaacttaacccgcaacatagaaaaattaaattttttccaacttaagaaatcatacaataggatttattcgttaatgtgcacagatacaccacaaccaaaattagctaatcatgaccttgacattttttgctagatgattagtttttccaaacgctgattaatcatcccaaacagatgattcatgccttccgtcaattccatttgttttaaaatgtttgtgacttatacgacaagctacacatcgggaaaattgagcagccaataattgcggcagtcaaaaattttttaaatattaaaaaaaaaattgtttacattttttaaattaatctttttgttttttaaattctcctagtaaattttttgttggtggtcccgtatggcttgtcggaacagatctcggtccgcgttttaacgggatcccgaaacatgcattcgatgggagtaaattcaagacattatactttttctttgttgattaaaaatataattttgatataattcgaaagcacatatagacttctatggccaaatttatcaatg

SEQ ID NO: 98910 - DNA, 87 bp, Heterodera glycines
  Promoter: Source sequence=SeqID_13002; Location=1259..1345; Strand=-; Gene=SeqID_76773
atccattataccttaaaaagtagttaaatttatattctaacagagaattcctcgatttaggtggcatcccgccaaattttaatcatg

SEQ ID NO: 98911 - DNA, 269 bp, Heterodera glycines
  Promoter: Source sequence=SeqID_28240; Location=1..269; Strand=+; Gene=SeqID_58880
accaaaatcatgtgactttacgaaaatataaaccaaaatcatataactttccggaaaatacaaaccgctgcgaaataaaccaaaatcagatgactttccggaaaatacaaaaggcttaggaattttaaccaaaatcatgtgactttacgaaaatacaaaccaaaatcatataactttccgtaaaacacaatcaattataatcaaaatcttgacttttcataaaacctaaaccgcttcagaattaaaaattacatttatagacagcaatg

SEQ ID NO: 98912 - DNA, 313 bp, Heterodera glycines
  misc_feature (21)..(21): n is a, c, g, or t
  misc_feature (43)..(43): n is a, c, g, or t
  misc_feature (83)..(83): n is a, c, g, or t
  Promoter: Source sequence=SeqID_44467; Location=545..857; Strand=-; Gene=SeqID_71951
ttcgggtgaaaacaaaataanttaaaaaatctaattaataatntaaaaaaataaattaataatttaaaaaataattaaaaatntaagtaataatttaaaaaataattaaaaattaaattaaacatgtgtaaaatttcattaattgattatcaaactaaatttcaaaacatttcacaattcctttatttatatatttaaaattttttgatatttaaaaagaatttcattttatattgttttttgttttaatttttatttaattttaagtttatcaaaacaaattgcatccgaaccgaccacaaccaacgaaatg

SEQ ID NO: 98913 - DNA, 815 bp, Heterodera glycines
  Promoter: Source sequence=SeqID_916; Location=2573..3387; Strand=-; Gene=SeqID_63922
aaactttgcccttacacgttgttatgccaaaagccaaaaaatataacctttactatgagtaatttttgttaaaaatcttaagaaaatttcaagaaaataaataaaactttctagcatttttttttaattttatgctgaattttacgaatttaaaattttttccaattcatacgctggaaatttttcttgaaattttctttttattaattttccctgaacatttaaaaattttctcgggtgaatctgatacgggggggggcgagcttctcgcaaaattaattttccatttagagaactcgtcggtactaattgggtttgtatccacatttttggccaaatttttcaaaagcgtaaccagacagtcagacagtgcactatttccttcttttcttccgcataaccactggagaaaggaagaattagggcacgggctgattgggtgcatacggattatcagattagggcggaacgtcattacagaaacagtggttcgaaatcctaccactcaagtcgaaaacgcacgctagtggtaacgctgtgctttcattggccctaagtcaatgataatctctccatcatcaagaaaaggttcctgtgaggaatttagatgaattataattcaaattgaaggtcaaattttaaaaatgaccaaatagaaggaaaaattacttcggtaagcccaaataaactgattcatcatgaaataaaatttgggctaaacaatttgcttcctcaaatagaagcacatgcttttcacaaattggttctactaaatctgacagacataaaaagatcatgcttttgtgagcaatatg

SEQ ID NO: 98914 - DNA, 821 bp, Heterodera glycines
  Promoter: Source sequence=SeqID_6094; Location=967..1787; Strand=+; Gene=SeqID_60314
tttctgaaacattttcttgtaataattttgttgagtagaggggtcaagcggtgcctataggcgccgcttggaaaaatttgagtgaaaaatgtaacagctttccctaaaaaaaatgatcaatatagccactaagctacaaaatgatcacttttctgctggtttttgattaaatttaaaaaattaaaaatttgaaaacatccttattttacttactaataaaaaataataattttattatgtgtggggatcgaactaatttgtaagacaaaaacaagtgaaagactggaggtttaaccgcttgactatattaatatagtttattattttttctcaactaaattttcctcttaaccaattaaaaaaaatattttctcacagcccactcccccattcttaccaatgtaaaaaatctcgtgttgaatgatctccatcaacgaagagtttggccaaaattctctatatcgacttttttgggaatttttcaaaaaataaacccttaaaaaccgaaaattttttaacttttagtaagaaatttttgaaaaaaatttatttatataaattcatgtatttggcattttttagtgtatacaacttcgaaccctacttatcatttttaacagaagttttgaagcaatattttatttaaaatagaatctatatttttaaataaattaattttttttaatttgggctcgtaggcttggtaaatgtccagcccgatgcgaccataggaagtattagaattagcaaaaaaaatctgtattctaattttgggaaagaatgtattaacaatatagatcacgatcaaagcggatgccatg

SEQ ID NO: 98915 - DNA, 111 bp, Heterodera glycines
  Promoter: Source sequence=SeqID_3914; Location=1342..1452; Strand=-; Gene=SeqID_52410
gaagttgaaaattgaattgctaaaaatgaaaaaaaaacaaattaatttaaattggaaacattaataaaattcctaataaaagagacatttatgaaatgcacaaataaaatg

SEQ ID NO: 98916 - DNA, 701 bp, Heterodera glycines
  Promoter: Source sequence=SeqID_25232; Location=1..701; Strand=+; Gene=SeqID_45916
gggttaagatttatgttatgaaaaaatagtgtgccctattctattcattttcacactttaacctgttaaaaaacggatttaagcgctttgccgcatattttttgattttacaaatctttttttaacacctaagaaaacctagaatttttggctctgggccatcaaatacaatttccgaattgggggccacagattcaaatttcgtcaaatcgtgaacactgcaaatccaaacggatccattcgatgatttttagcctaaattgttgcttttatgcctcacaaattgctgaagcgctatttttggatatttagcgaactctttattgacttttttaaagttctcgacgagctaagtctaaaaatcaaggaataagtcgaaccggcgccatttaataagcactgggacaactgagtcccagtaaaaatggaaacttcagtaccaaagaaataaaatatgaacaaaaataatttggtcaggtcaatcattttatggtacattttggtgtttttgtttcagtttatatggctaacttttcaaatcaaattgtttgaaacgacaaaactccgcgttgtgcttttgcaattcagcgaattttccctatataaatgggtaaaatgtgaaaaaatttcattgttatcaaattattatttcgttgctctgatcaaagttcaactgtcttctactgctgtacaacaaaatg

SEQ ID NO: 98917 - DNA, 1003 bp, Heterodera glycines
  Promoter: Source sequence=SeqID_3666; Location=1483..2485; Strand=+; Gene=SeqID_51360
ttccctttattatgtttaattatatttttaataattgtcaaaattgaatcagaaaagaaaacgctgcaacaaaagtcatttggcgaaatatttggagaaaaatgggaagaaaaagaagaagaaaaaagaaatgaactcaaaaaaagagaaataattgcaaaatattataaaataaaagaaaaaataaagcaaaaaggaagaaaatattcagcaaaagaatggaataaaattgacagaaaaatagcgaaaaaattgggaacaaatcgaaattatattcaaaaatggattaaagaaattggactttataaatatcacaaatcaaaaactgatgaacaaaatatgaatttttcaacgctttattgaaatgacaaatgaatataagcaaaaaagaaaatattcgccaaaagcatggcaccaaatttttgccgaaatttgtaagaaaattggagttggcattgggacaattgaaaaatggaagaaacattttggcattcgcagaaatgactgacaaagaaattgcaaaaattgtgaacacttctcaacagaatatttccaattggaaaaaacattttgtggctgaataaaatcattcgatttttagaattaacatgaaaacttttttgataaattttataaaaccatttaggtttgctgtttttttcaaatgtcgtaaatatactgaataaacagaaaactgaatacaaaaattcattaaagcgaataatgcctttttctctaatgagttaattatttttcaaaatttttccactttttccttattactccgattttaacccatttgtgctgtcttaattaatatactatacattcatgattaaatttggaagttgattccatgttggaactttcattttataaaaataattttataatcatttattcagttttttaatcagaaaaaaaatcatttatatgcctcaaaaaatgaattgcgatttaattgaataaaaaaataaaatcattttaagacgacaaaaaaatg

SEQ ID NO: 98918 - DNA, 51 bp, Heterodera glycines
  Promoter: Source sequence=SeqID_13674; Location=1..51; Strand=+; Gene= SeqID_77578
accaaggacaagaagaccaaggacaagaagaacaaagcagctccaccaatg

SEQ ID NO: 98919 - DNA, 609 bp, Heterodera glycines
  Promoter: Source sequence=SeqID_30966; Location=276..884; Strand=-; Gene=SeqID_61325
atttgcttgttttctaaatcctaatttatatctttgaattggtttgttgtcttttgactctcatcaataaatttttaatctaataatactcaaacaatgaatcattggcaaagctgaaaaattgctgacctaaaaccgtgttaaccgagcgatgcttgaagcgtgccaaaaaaattcattaacttttttaattaagataaactcaagtttaaaggcgtagtcgcgaaaaattaaaatttaatttcgcaatgtaaattaaattgattctttctatcaattgtgttattaccgaaagggctttttttttattaaaatccaaaaaatatttaatcaaattgattagtgaaaaatatgttcgagtttttgaatgcatttttccagtaatacatgattacaaaaaccaaaaattagggaaacttttcccattcttaagggtatgtttttttagttttctaatcaatccttgggggtgtacatcaggggtggagagcgcggacagaaaatcctgcggtcgcgcattttttttcaagtttgcttggcattcattttgaaaattttgggcttttcagttttatgaaaggaagtgttgaaatgggtgagggacaaatg

SEQ ID NO: 98920 - DNA, 755 bp, Heterodera glycines
  Promoter: Source sequence=SeqID_18732; Location=1061..1815; Strand=-; Gene=SeqID_83403
aagtgtcgcggcgcaaatgtctatctctttctgggcggcgaaagtgtcgcggcgcaaatgtctatttttactgggcggcgcaagtgtcgcggcgcaaatgtctatttttactgggcggcgcaagtgtcgcggcgcaaataagtgtcgcggcgcaaatgtctatttttactgggcggcgaaagtgtcgcggcgcaaatgtctatttttactgggcggcgcaagtgtcgcggcgcaaatgtctatttttactgggcggcgcaagtgtcgacgcgcaaatgtctatttttactgggcggtgcaagtgtcgaggcgcaaatgtctatttttactgggcggcgcaagtgtcgaggcgcaaaagtcggtacaccattcagggcattttattttccagatgttctgcctatccccaattaaggacaaatctaaaaaatcagtacatcagtaagctctgtttaaatgaaaggcatgacgtcaaacattttttgagtataaatgtattgagtacaatgatcagaattatatatatttttttaatttagaattaagcataaatggctaattatattattcttatttttttaaatgataaaagcatcaaaaatttcagtagcattttaaatcaaattcaaaaattttcgacgcaaatacctcatttttataaaatcatatggatttattcatttaaaaattaacatttattttttaattttatcattaaatttcagtagcattttaaattcacaaatccttcaatg

SEQ ID NO: 98921 - DNA, 179 bp, Heterodera glycines
  Promoter: Source sequence=SeqID_862; Location=1576..1754; Strand=-; Gene=SeqID_62916
agactcggctcttctgcgaattttgcaatcgaccagggcacattcaaaatgaatgttggtattgtcctcgagattttcctggtccctctaattcagaaaatagacaaaattgggaacattcagctgagaatcatgccaaaaatgattgtgctagtgaaacacaacaattgagagagatg

SEQ ID NO: 98922 - DNA, 154 bp, Heterodera glycines
  Promoter: Source sequence=SeqID_126; Location=1..154; Strand=+; Gene =SeqID_73474
agctcgttgacggaaagtcgtgtcaagagctgaatgaaatgacgcaagaccgacttcgtcaacttcgcgagctgacgcggatgggcgcagtctacaagttgaagaaatttgggaatgtgaaataaacgaccagctcaagagaaaccatgaaatg

SEQ ID NO: 98923 - DNA, 577 bp, Heterodera glycines
  Promoter: Source sequence=SeqID_1557; Location=3956..4532; Strand=-; Gene=SeqID_74447
tcgtacatatgaaaataaaagcaaattcttataaaaatttctcatatggaattcgaaaaattgacttggtttttaactaatttcatttaaaaattccaaattttaacttatgaggacaattcgtcgattgtaagagaaggaggcagaaaaatcctgaaatttggccggatactaaaaattccagttttttctacgatcgactaacctcgattttttccctttcgtttataaaaaaaaattaggtcaaattcgatcgtaagaccacttcggaacgggtacaccccaaaatatcaccgagacaaaatatcgccgcaaaaatttaaaaagaaaattttcaagaaaaaaatcttaaaaaattttatataagaaaatttcataaaaaatcattgaaaattttttttttttttgaaaaaacttcgtaatttatcataaattttcaaaaaaaaatcgcttaaaaattttcaattttttaacttacttacaaaaaaattttctaaaatttttttcttaaaaatttttgtttgaaattttttttttgtcccgtccccttcggaacccgcgtccctgcacaggtatg

SEQ ID NO: 98924 - DNA, 554 bp, Heterodera glycines
  Promoter: Source sequence=SeqID_17196; Location=983..1536; Strand=+; Gene=SeqID_81658
ttttcattattccaaagtgacaatttttacaaattggctacaaattttaaaaataaatttatttgtatatgtaaactctaaacatttttattagattccgtaagaaaatcgtgtttctgtaccctttggaaaatttaactgtgaagccaggttcgcactaccccccccctcctcctcctccacccgtttgttcccccacccccagaaaattctcaaatttcgaattttagaagatcttataatgaattactaacaaaaccttttaattttcaaatttttcttaaaattttcttatgaaaaatttaaataaaaagttttttttaattttcgaagtgggggcggaaacgaactgcttccgtgaagtccaggtcttaattagattaaaaaaatttgaggttgcgacccggcgacttcgattttttttattgttctatcctaattcttaaatgccctctaatattgcattggtttttctttagtttttcgtcactgcaacatacagaagcaattgtcccgccgacgactccttcctgtacaaatgcaggctcggcatg

SEQ ID NO: 98925 - DNA, 510 bp, Heterodera glycines
  Promoter: Source sequence=SeqID_11268; Location=1729..2238; Strand=+; Gene=SeqID_74638
tttttattggataaataatttaaattagataaaaatatattttaaattattttacttttattattaattgtttgctgcttaaatatgccataaatcggtagcggaaatggtgccaaccaaatttcgttgcaatgtcattgcaaatttataatatttcgtctatcgatgttaatgaatttcatcatctttatgtttgccaacataattgttttgaatgatatccgacaaaaaagagaatggcacctagtaatttaatgttatttattttttaattatatttttttaataaaaaatttaacattatagaggcataataaaataaataattggcaaaaaatgatgatgatgtaattaaaggaagtcgaaatgaagcaaataaattatgttggcatcttttcaggccatcaaattaaaggtgtataaaaggaattaaataaacacatacaaacatagattcggattttacaataatattaattcttaataattaattaaaaatctaaaaaaatg

SEQ ID NO: 98926 - DNA, 494 bp, Heterodera glycines
  Promoter: Source sequence=SeqID_4423; Location=808..1301; Strand=+; Gene=SeqID_54392
attgggaaaaacataggaggggggagtctgaaaaaggcattttttcgtgtgcttttccaaagacaaataaaagttttttgttgtttttagtaacgtcctctcccgccgcttttccacaatgatgatgaagccaaaaggctgtggtcggcaagcgattgatgaggggttttaaactcaaggggggagggggtcacaaaaatatgatggtattataattttgcgattgttaagagaatttttttgagggagtgaatgatcttaaaattaagtttttttttacagttggccaatgtgtgttcaacatcaacaaaaaaaagggccggagatttcagttactttaattattaattagaaaaattattgaaaaaaatccacgcattaccatatcaaatttatcgcagtgcattgggttcagccacgccgagagggtgtgacatatctcgtggatacaaattctcaccagattatattcattttcattttttgcagcaatg

SEQ ID NO: 98927 - DNA, 460 bp, Heterodera glycines
  Promoter: Source sequence=SeqID_26812; Location=1..460; Strand=+; Gene=SeqID_57562
ccccccccccccccgcaggtgaattaaaggaaagtcaacagatggagggcaataataataaggacaaattgagacgataaagcatccaacgagaaaaacaaaagccgtcaaaactaattaaatgacagtcattagtcactcattaattcactgttctttcccagcaccaccaaagcgcacttagtcatcacaaaaggggcaaaaacattgacagatgtttgagaaaggggcagaaattggccaaaaaaatgcggggaggggtggcaccgcaagggattttagtcacccggacgacgcaatgggacggacggacaaaggccgacgaaagaaaggcctttgatcagagagggccaaattcttagtcaataaagcggtaattttacctttgactttccatttttaggctaatgttctgattttgaaaagttgagcaagatacccactccaacgtgaacaaatg

SEQ ID NO: 98928 - DNA, 141 bp, Heterodera glycines
  Promoter: Source sequence=SeqID_15899; Location=1575..1715; Strand=+; Gene=SeqID_80242
ggaatcgaatgcaaaaacggccgatgctttggttgattggaagaacacgaattgtgctcggatgtgccatccgttggtcgaacgggtgcaatcgcttctcactgccattccgtttaaagtgaattttttggttgccaaatg

SEQ ID NO: 98929 - DNA, 125 bp, Heterodera glycines
  Promoter: Source sequence=SeqID_3453; Location=2119..2243; Strand=-; Gene=SeqID_84739
agtcgggacagagactgaacgtgggggagagtggggaaagggaaaagagttggattaaagggaccgcccccaaggcaacaattggttatgtcatatgtgattagggggtggtgattgggacaatg

SEQ ID NO: 98930 - DNA, 129 bp, Heterodera glycines
  Promoter: Source sequence=SeqID_12070; Location=1..129; Strand=+; Gene=SeqID_75616
aaacgcaaagacaaaaagtgaaaaatcgaatattttttaaaatgtttttttcatcatttttttgcctctgccgactgtcctcacgtaattgaagtgaccgatgttgaagcagaagcgttcaaagtgatg

SEQ ID NO: 98931 - DNA, 280 bp, Heterodera glycines
  Promoter: Source sequence=SeqID_6976; Location=2482..2761; Strand=+; Gene=SeqID_63460
tcagcagaaatttgtgtcgatcacttggatttgccccacaaggtcttgtggacaaacaaaaccttcggctcatccaccaagacttacaaattactttaaaattaaaataaaacgaacatgtttcgaaaaatcagttccaaaaatttcagcaaaatcaaaggcaaacgccaaaatttaaactctcaaattcgtggccataaaattttagaaaaaaaaaattcaattaattttctatactgatcagtcagatcatctcttccgagtttatcagccaggtatg

SEQ ID NO: 98932 - DNA, 1003 bp, Heterodera glycines
  Promoter: Source sequence=SeqID_12739; Location=2148..3150; Strand=+; Gene=SeqID_76447
atgctaataacaaaacaatagaaactatgaatataagaaacaaaaaaaaaaagaaatttttaactgtgcttttgcaaaaatcaaaaactgacaaaacaaatatgtaaaaacgaaaaccaaacatttctttttttcaaattcatttataacgcaaaacaattacaaaacgccacgccaattcaaagcatggcggatacagacactcaactttattaaataggatatttttaaactatttttttattattcaaatattaaaaaatcttggtaaataaaatctcgctggattacaaagattaaaattatttctatttaaaattattttctattattttatattaattttgcctaaattcttattcagataaattagtcgacattgacaaaagttagatattttttttgtcgaaaaacagtacaagtcggtgcagtatgagttggttataaaatttgtattaaaatttaaagaaatttcctgttcacgcacgtgaacggattcggaattggttgactgttaaataggtcaatgtggctttttttttgaaatgagtttttgaggcatttttaattttgataaattggcattatgtttttgacaatcattcaacttttctccgcgctaacaaaaatctttaattttcttttcttccaacaaaattttgtttttttttcatggaaaatgaattatgtattttatgtttgtattagagaccgagatttccaaaagtgccggaccggaccggtctgatattttcagaagcaaccggtttccgggcccggcctccgaaaaaccggtgaaacaggaattttccctaaaatcgccgaaccggtttccgggcccggtaaaaaccgggccaggtccggctcggtctctagtttttatgcacaaattttgttttgtttcatttttggggtgatttgtgcatttaattataaaaccttttattaagataaaaattgttttcatctcttatttatttccgcctcgccctccataaaaatg

SEQ ID NO: 98933 - DNA, 1003 bp, Heterodera glycines
  Promoter: Source sequence=SeqID_854; Location=2505..3507; Strand=-; Gene=SeqID_62725
tcttgctctctctaataccacataaaaatataaataataataataataaataaattaaaaaattaaatttaattaaaattaaattgttaaaataataatagttaaaaattaataaataaatttaaaataatagataaaaatttaaaaataaatgaaaaaaattttagaaattgataaattataaaaataataataataataataaacacaaattataatagtcaaataaaaaaaaagctgagagggcgctacctattgagtcctaccgtttcagtccttgactagtcaatccggggtcaaaattttgaatttggcgccaaaactttaatttttcgttatttttgaatttgagaaattggtttagttttggcggatgcctattggaatgtttttatagggcttcgctgatgtttaaaaggggaggggtgggcgtcagcttcgggagggaagcgacgccgggtcatttgagagcacgcagggccatttgagcgctcgcacgtgtcatctatgcgcccgcaggtggtcatttaaatgtccctttactgtcaccaatactccatcctaatggaggggtagaggccgtcccttatgacatctctccccaaatgaccatttcgttcgcaccatctgtcgcgaaagcgaagggttaaatatgtctctttggcaacctgccaaatgaccattttagttttagccccgcccactttaactagtataaatagccggctattaccagcaaaagtcaacttctcccattcattcgcgaaaattctacccacattcattgcttgcgcgctccgtcaaaaaatatttaaactaacaaatttgcaactaaattaccctttcatccaatattcaacttataaaaaaaaaatattttcaataattttctattacaactataaaatttacatttttctaattcaaaatattctttcatattatcttatatcacctataaatcataaatttttcattcatatattattattcaaataaaatg

SEQ ID NO: 98934 - DNA, 718 bp, Heterodera glycines
  Promoter: Source sequence=SeqID_11204; Location=1..718; Strand=+; Gene=SeqID_74558
tagataatttcgaagagaagctcggctggtaatcgcttgcgcatcatattggtcatgaaatttgaatgaatgaatgaagagtgaattaaaatatttttgtgcccggttctcatgggctcttttcattaattattcaatagttaatattgacttcaaaagacatttgaatttgccgacaatagtgaaggagataacttcaaaggaaatttgaatttgccgacaataaggaaggagagttcgagaaaattaattggtattcggatgggtacaccccgcccctaggcttcataaatactcagtccaaatcacatttcattcatatctgctcatgtctttttactcactttaataataataaaatttgtaaaaataattaaattataataaaatttttattttctgctgttaaccagagcggttgcccaattattaggctccgtttattctggcagcatttgtgtgtcttttagggcttgggattgtacgcgtgacctttactaattacccgagccgtttaggtgccctgtcgtcttgtgcttcatgggtggcagtgcgctgctcttcagggcatagttggtttaaaaaatctttaaattattattattattatccattaatttgcattcacaacgacaatttccatgcctcaaaaatatgtgtcaagattgttcattttatccattcaattcattatttttccctgtaaaattagataatg

SEQ ID NO: 98935 - DNA, 195 bp, Heterodera glycines
  Promoter: Source sequence=SeqID_26157; Location=643..837; Strand=+; Gene=SeqID_56907
tttaggtgactttatcatgaatagcttttctaattcatccacgattttaccgttgttttgaatggtttgttaaaatttgatgggacaaattttccaaattcaatgttaacatttgtgaaaatcgtcccatccgcctttcctttagctttccaccaccaccgccattttagtccaacttctccgtcttccgccatg

SEQ ID NO: 98936 - DNA, 52 bp, Heterodera glycines
  misc_feature (43)..(43): n is a, c, g, or t
  Promoter: Source sequence=SeqID_22224; Location=1..52; Strand=+; Gene= SeqID_52893
atttttttttttttttgtttacttttattatttctgataaatnttgagaatg

SEQ ID NO: 98937 - DNA, 1003 bp, Heterodera glycines
  Promoter: Source sequence=SeqID_12402; Location=366..1368; Strand=+; Gene=SeqID_76009
tccgtttccgccctcggacgacggattaaaatgtccaagtcatttcgtcaaaacatttcgtcgtctaataatttattatggagggcaaaatccgactgaatgaatgtcagcggatttggggctcaaaatcggctccgatttcaaatttacagctttttcttcttattcatatgtatatgatactggaaacaaagaaaaggatttaaaatttcaaagttttttcggtttcccatgataaattaattttaagtaataatttgctttattcatcttataattagcatatacaatgatttgagagtatctttttttctgaataaagttttccacaacagcaatactttttttttggaattattggacaaatcggaactgttaatttttttcgctttttaacaataaaatggtggtcaatgcaaaataagaaaatggaaagggattggagtgggggataatccgttgctaaattctcaaaaaaaaatcctcaaaacgatgcacaaaaaggggtaaatgccgcgcggcactttctgtaattatggcaaaatgccgacagacaaaaaaaaatgaaaaaaattgagaaaggtttagtgaaagtgtgaagaaaaaagagtgagcatttattttttgtttgctttggcactttttgtccataaaatggcaaattgcggcctttgccattcattcgttcgttctcgaaaggaaacagaaaaagaacaaaagaacgaaaaaagaacaaaaattattattatttatcaacagagtgaaggaatggcaaacattggaaaaaagggagaaaaaataagggagggggggggggggtaaaaattgaaaattcagtgagaaaaaaagatggaaattttgtagaagatgggtcagtcgacctttttgcgatttttcgtttttttccaagaattacaagcaaaagaaaattcatagaataaaaattaatgaaataatttttattttttatttaaaaatggacaatatttgagctcagcaaatg

SEQ ID NO: 98938 - DNA, 73 bp, Heterodera glycines
  Promoter: Source sequence=SeqID_16797; Location=369..441; Strand=-; Gene=SeqID_81215
ttccccagacaaccaaatttctcttgataattctgtgcggttgtcttttttaaaaaagaaatggtgagtgatg

SEQ ID NO: 98939 - DNA, 116 bp, Heterodera glycines
  Promoter: Source sequence=SeqID_7484; Location=120..235; Strand=+; Gene=SeqID_64964
atcagaaagggacaaatattgatcaagaagcagtgatattgtaaggaacagagaaaggaaaaaggatcggaatgggaagaattggaaccaaaaatagtgatcagaggaataacatg

SEQ ID NO: 98940 - DNA, 740 bp, Heterodera glycines
  Promoter: Source sequence=SeqID_4837; Location=495..1234; Strand=-; Gene=SeqID_55896
taaagctgtctgcgcagctgcaatcaaacaaaatttatacaaaaaaaaaaaaaaaattatcctcaaaagttagtaataaacatggcttcttttttatgtaagaaaaatcgcgaaatatgtaaataaaatatgtataagaaatgctaaaatatgtattaaatatgtacaaaaatccccaaatatgtaatatgtaaataaaatcttttaaaggttatttttttgaaaaaaaattcttcgtaaagagtaaatacgcataaaatgccataaaaatgacctaataaataggcttagaaatcaacatttattattttaaaaattaatttttggtatcagaattttgaaaaatatttttttgggaacattttcaagaaaaaattttaaattttcgcaagaaatttctataaattctcaaaatttttgaaaaaaattgtgtacttttagatttttttttgggcatttaataaaaaattccttaaaaattgcaaaatatgtacgaaaaatgcgaaaaagtccaaaatatgtataaaaatatgtagaaaaatcgcaaaatatgtaaataaaagtcctggtttttgttcgcaaacacaaaaaataaagtgtttttcctactaattaggctatagagaatccaggaaaaaagatgtatttacataaaaaaagaagccctggtaataaaattcttttttttttaggttattactataattttcctagttttctcatattatagctatagtatg

SEQ ID NO: 98941 - DNA, 812 bp, Heterodera glycines
  Promoter: Source sequence=SeqID_16462; Location=713..1524; Strand=-; Gene=SeqID_80868
atcagcacaatcggtggccgagtggccaatggggcggtgaacaaagcgatcagtggcggacggaggggacggaaaatggcataaaacaatggcacaactcagtgattattttcaatgctttcatatttttctatgaaagtttattctcttacttggccattgtcatgtttcacatttataataaaaaattatataagtttttctaacgatcttataaattcaatttgttcccaacaattttcccaaaaattttcaaaagtttgccgaaaatttaacaatttagcattcaatccaaattttttttcattttgatgtaaaattttttcgtcaaaactcaaaataaaacaaattaattaaatcaattaaataatttatgtcttcatttttaacttccgaaccttggcaaaatactaaaaaaaataatttaactgaaatttttatttgaaaacattgactttcttaataaataaattggcattgtcactaatttaacgtggcaaaaaccattcaatgcacatattacaagcaaaaaaaatattttctcagttattttttacaattaaaataaattaatattatattatttttataaaaaaatcataattaaatgttttacaattataattagattagcttaaaattatttttaatattaaatatgacacataaaattgaattagattttaactaattgaattgaaattaataatttaaaatttcattaattcttcaacatatttaattttttggcatttttcccacaaactttttggcactttcttaaataaatttgcttaaattaggtaaaaatg

SEQ ID NO: 98942 - DNA, 150 bp, Heterodera glycines
  Promoter: Source sequence=SeqID_26079; Location=1399..1548; Strand=-; Gene=SeqID_56827
gaggacattgtcccttttcacgacgggagagaagcgtggccaatcgagaacgattgtttgatgtatgccgatcgggtcgtgattccaaaatcacttcaaaagggagtgcttcaacgattacatcacggacacccgggcatcaaacgcatg

SEQ ID NO: 98943 - DNA, 1003 bp, Heterodera glycines
  Promoter: Source sequence=SeqID_1298; Location=645..1647; Strand=-; Gene=SeqID_71910
aaatttgcggcttcaggaaaaatgcgtcagtaataaaatatttttaaaaatcattctgtagcatgacaaattataattgctgaatttatcatttcagtttttttaattccaaagttataaaaaatttagaaaatttatgaaaagctgttaaaaataaacatactgtgaataattggccattgtaggtttattcccaattaaaataaaattttgaatcatcatactaacatttctcgtttttttcatgaatttttgattcctgacacattttccgctcacaaaatttgttacaattccaaaataattttccctttatttttacagcgaataaggcaattttttgcccaattaaaaagggaaaataaacctttttttacaataaataaaaggtgtaaaaatagcgcagaaaaaaaggaagggaaatggtaaagcgaaaaggcgaaaagaagcgcaacacgcgaaagggcggggggaattgggccaattacaattctgtgccccgatgaggaggcgatggcataaatagaaagtgccttttcaaaatgtgtacacatttgcatttaattgcctaaaatatttttttaattataattattattttgcaaaaaatttctccagagataattttttttgtttcttgaaattaaaattcgaatatttacggactgaaaattgacaaataaaaaaagaatggagcaaaaagtcaattttcatgtttaaaaaaaattataaatccatatatcatacggatgatttgttttattattgcacccaaaacaaggaattttctcaaacgatgtcaaaataaaccaaataaaaatgccaaagctttcacctcctctcaaaaaaacattcaatttttaggacagaaattctcttcaccagatcaagaatttttataaacgcaaagatttactatttttggtcttatttttctattgaagccctgctgtggtcaaccgctttattgttttttttttctcattttcacagcatcaaaatg

SEQ ID NO: 98944 - DNA, 398 bp, Heterodera glycines
  Promoter: Source sequence=SeqID_8389; Location=578..975; Strand=+; Gene=SeqID_67898
ttttaaatctaaaaaataaatttaaattttatatatattttttgaaattctatttaactaatttatttttatgcaatttgggcctcagctttctataaacataaactctcataaaggatggttttttttaacagaaattactgtagttttactgtgccttccccaaaatgtcattcgtcaacaaaaatgccacaattcgcccacaggtgccctctgtgttggctcacaaaacttggcaaaactgtgcataattaaactgtgcagcggcccggaaaaaggtcattcattcattggcgattttagtcagtcgtcaccgaattttggcagaatacaacggtgggatttgctattttcgactcactctcgacactaattattttacacccgaaaatacaatg

SEQ ID NO: 98945 - DNA, 65 bp, Heterodera glycines
  Promoter: Source sequence=SeqID_6709; Location=996..1060; Strand=-; Gene=SeqID_62578
ttccgtttgccccttttttagtagtcacaatacttatttgaccggtctccaagtgcacggcaatg

SEQ ID NO: 98946 - DNA, 264 bp, Heterodera glycines
  Promoter: Source sequence=SeqID_11398; Location=3435..3698; Strand=-; Gene=SeqID_74789
ctgctccggccgcccccgctcatccgcccgatggagcgccgggcggccgccccacaaatattatatatgatatgatcgaccattcaactgcacccagatcttccccttccccacccattacattccgtacatgaaagaccatcagaagtccttgcccccgccctcgatcttcgacctccccactctctcacccacagtggcatccacaacgatatcacgaggatgatatgacgatgcccgccacaagaaattgcaagtataatg

SEQ ID NO: 98947 - DNA, 319 bp, Heterodera glycines
  misc_feature (61)..(61): n is a, c, g, or t
  misc_feature (73)..(73): n is a, c, g, or t
  misc_feature (84)..(84): n is a, c, g, or t
  Promoter: Source sequence=SeqID_27374; Location=1006..1324; Strand=-; Gene=SeqID_58069
tctgtctcctccaccacaactgcgggaacaactggcaaaaaatgacaaatcaaacacattntaattttgattnttatttgtttntaattataattttattgcatttttttactgtgtccattccgtccattctgtccacagattgttgttcttttcgcgatcggttgattcgccttaaatttgtacaaaaaattttgatttttaatcgatgaatttcctaaaaaatgccctgttataaattgccaaaattttcaaaaaaaaaaaaatggcatccaatttgaatactgtaatttaatcaacgcgggttaccgtaccaatg

SEQ ID NO: 98948 - DNA, 95 bp, Heterodera glycines
  Promoter: Source sequence=SeqID_14101; Location=1477..1571; Strand=-; Gene=SeqID_78083
tgactctgtcaaaggaggaagtgaaatgccttattttcatcacaggtttgagcgacgcgcacaaagaactttgacaagagtgtctccgccaaatg

SEQ ID NO: 98949 - DNA, 284 bp, Heterodera glycines
  Promoter: Source sequence=SeqID_39188; Location=147..430; Strand=+; Gene=SeqID_67819
ggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 98950 - DNA, 822 bp, Heterodera glycines
  Promoter: Source sequence=SeqID_9714; Location=1..822; Strand=+; Gene= SeqID_72462
ttggaccctcaaaataaggacaatcttacaaataaggtaaacgagtaaccctagttgtgaagacttgaaagcaaggggttggtttttctaaatagtaatgaatgttattacttaaccataaaaacatataaattcgaaaacctaaaatgattttttaaatacataaaaaaattaatatttgaaaaataattaaataatttatatgaaaaaaaacaaaaaaaaacaaaaatagatgttataatcttgaaaaatactctcaaatacaagtatattgcaaatacaccaaatctgagtcagtttttaaatgcgcaagtggcaagtatattaattaaaataaaaaaaattacactcaaatatttatttagaaaaattagtcaataattgagaaaaaataaaaccgtttaggaagaaacagttactcattataaaattaacattaaaatagatgatgaatgtacttttaaattttaaaattcaaaagaaaaataatatatataaaaaaagcatcatagattggttatatggatgatataccccatgcatgtattataaataaataaaaaaaattgaaaatagttaaataaaattattaaatttgattaaataagaataaatagtaatgtaagatttaataataaatatagtactcaaatatggttgaaaaattttaatctatttccatcaccgatgtattgaatttatgagaaatgaaattgaaaaaataaacaaatacatcaaaaatgagaagatattgaagaagctgaaatttaaatcactttctatttttttgctaattgcgaattgaatgggagcttttaaatg

SEQ ID NO: 98951 - DNA, 142 bp, Heterodera glycines
  Promoter: Source sequence=SeqID_26548; Location=1301..1442; Strand=-; Gene=SeqID_57285
ttttccttcaaaatggagacgagattttcggcatttacctgctaacataattgccaaggttgaaccggaaacccggatttctgcctatccctttgacagcaactccacctgggaacaaattggatttggagagcgagtcatg

SEQ ID NO: 98952 - DNA, 298 bp, Heterodera glycines
  Promoter: Source sequence=SeqID_7135; Location=2954..3251; Strand=-; Gene=SeqID_63940
atcagtaaaaagtgcactgatcagtacaattcatgttcattactctctgtttgtctgtctgtgcctgaatttgctgagtctatcctacaaaaaatatcgccaatttggcattccgtccttctcattcactggaaatataattaccgcgactaattagccaattaaagttttcacaattaaaattttaattatatgtattagtgacagaaactagaccgggctaggcgagatttttaactaggtatccggaatctggctttttaatcgaataattttataaaaattttgaaaatcaatg

SEQ ID NO: 98953 - DNA, 879 bp, Heterodera glycines
  Promoter: Source sequence=SeqID_981; Location=3917..4795; Strand=-; Gene=SeqID_65381
tgccaatggcaacggatggcacgcgccgaaggaatggaccgactcaaatgtttacggtatgccaaagtcggagcatttgccaaatatttaaaatccttccgcaaatactcattggcattttcattagttttgttttgtctctttcttttggcatttccatcgttcgctttgcttttgcgcagattccctccgttgtgggcttttcctcaaagtcgaaacggatgaaaagcaattgcaaaatgccaaacgtttctttccgacgggcggcgaagagttttccttcagaataatggggggagagaatgttgaggagggcatttcgccatggacggcggcaatctttcgtcaaaagaaagacaaagggaggcaaatggaaatgaatttcaaaacaaattttcataaattaacgaattaaaaagacatttcgtattcgatatttattaaatttaaccagaatatgccatcatttggccttgcttttcagccacttacatttgttccggcactttaatttccaaacggcacgtcgtaacggccgcgcattgtatgttcggaggaagcgtcaacaaaatttgtttttccgaagaatttaaaagtgcggatgaggctaaaaccgatgacttgtgccggtgggtggcacttttcggatcattccgattaaattggctaaaattggcattttgaaaggcaaccgaagggctttttgagcgtccagcaaatccgagaacagatttccgtttacattgggtccatttgcctttcggagcaaaaggaaacgccgtgtgagtcgccgaaaacgcagcggaaattccgagtcaaaaagtgccaaaattaaaaatgaataaataaataaaacccaaaaaaacattcagtgccatg

SEQ ID NO: 98954 - DNA, 103 bp, Heterodera glycines
  Promoter: Source sequence=SeqID_12653; Location=1842..1944; Strand=-; Gene=SeqID_47063
ttttgagaaaaatgcgccaacaaaaccgccacaacaaatccatcaacagaccaagcagggaccgatattcatttcgagtaacagcattttgatcagaggaatg

SEQ ID NO: 98955 - DNA, 1003 bp, Heterodera glycines
  Promoter: Source sequence=SeqID_18839; Location=1113..2115; Strand=+; Gene=SeqID_83533
catttaaatatttttctatataattgtaattgcaataaaaaatataacataatttatttttaaacgttaataaataatttgcgattttctgaaaattcaaatcatttatatatatgatcaagtgatcatcagcaatttttatttctcattattgagttatattatttttatttaaatttatctcatatcagattatttttcttgcaaaattcggtttatatttatttcatattacattagaactgatttacaaaatttaaaagtaaaattaatttgttattaaattttaaaattaaacaaagtttgtgaataaatccattttcattgtgatgtaatgacgagtgagattcgaggtattcggcaagcttaacctaacccaatttttcttacttattgaaaagtgatagacttttatattgtaaaaccaattatcttattttaatttttatttacagttatctagcagtcgaatatatacaaaagcttataattagtgatagtaaatttttcaatttacttttatttttgcacattgaattttttatctgtactaggcagataattctgttattcaatatataattgatattttttaaataaatttatccctcaaatatgatgattcatattactccaaccaattaaatttattttccatataaattgcaattactataaaaaatataatttgattcatttttaaatgttaattaataaattgcgattttcttgaaaataaattgtaatttttttaattcaaaaaatatctatttgttttaattaatttttcaataaatttttttttgttgttttcttagcattttttgtgttgttgcttttttatgaaagaatttaactttttgaaatttaattactgaaatgttttgaatattttaatttacacatattttatttatttacttatattagtggctatttgaaacttattaaaaatttttgcatttgaaatttttatgtttagattgacttctttattctcatg

SEQ ID NO: 98956 - DNA, 264 bp, Heterodera glycines
  Promoter: Source sequence=SeqID_11027; Location=983..1246; Strand=-; Gene=SeqID_74352
attttttgataaataaatttaaattttcaactgatagattttaaagcgaagaattatggcaaaatattaaaataaactgtctttctcattttgtgccaaacccattggttgaacattttatttttaaaaaaatccattttaagttttgtttcacaacatgggttttgataaattataaagaaaacatcaattaataatcatttgaaacagacaaaatagtgaagccccatatatatttaaatttttttgattttaaataatatg

SEQ ID NO: 98957 - DNA, 402 bp, Heterodera glycines
  misc_feature (10)..(10): n is a, c, g, or t
  Promoter: Source sequence=SeqID_17534; Location=1..402; Strand=+; Gene=SeqID_82036
gtgatcagcnaacataaaagttgcatttttttgccattgttagcacctgttgctgacaaaagtccaaaagcgcgtccctggcctgcaattcgccctcatataaacacaacagctcgagcaaaagcattttctaatcataattaactaagaatccaaaaaaaatttgagtgaaaaagtgaaattcgatagaactgtttaaaacttcacaaggaatttgtgaaagccactccaacttatagaactctgtgttttcataaaaaatcttttattttctgtccacattcataattcctcctaattctttatcgccaatttaaattatttggcgttttattttaaagtttttgttggtttatgtttactacacactaccaaaaaaaaattcctttttaattagtgatg

SEQ ID NO: 98958 - DNA, 206 bp, Heterodera glycines
  Promoter: Source sequence=SeqID_22260; Location=995..1200; Strand=+; Gene=SeqID_52932
atggagaccaagtataatattccaaggaacaggaattaaatgctttcatcccccaaaattaaaattttttaaatttaattttaattaaaaaaatataataaaaataaataattttaaatcattaagattttgcttctcattgaaaaaactttggacattgcaaaaacggagaataaaaaggcggcaaaaatgtgctcaaacaaatg

SEQ ID NO: 98959 - DNA, 69 bp, Heterodera glycines
  Promoter: Source sequence=SeqID_3807; Location=1..69; Strand=+; Gene =SeqID_51958
gtttagttattttatgttttccgcctttttgatgagtgtgcccacagcctcggcttcgtccgtgccatg

SEQ ID NO: 98960 - DNA, 563 bp, Heterodera glycines
  Promoter: Source sequence=SeqID_725; Location=3163..3725; Strand=+; Gene=SeqID_46156
tattcacttcatttttattattttttattctccccatttctcttttttcttatgtgttcgctgttttaacaatgagactcgcaataacaacattcttgattttttattctcttctaattaatggtcatgaaaaatcgaatttaattacttgtgtcttttctctttataaaaagggatggattcattcggcagggaaacactgccgccgaaggtagcacccctttaaaaaaattaactttcaaatcactgaaaggatattactagggatttcgggggcgttgaacacgaatttgtcatttattttagccattttcgaaccccattttgaatctacataaaatgacacatttttaatgttgcaatgttttgggattgaatttttactattttaatcaaaatatgaattgtgccggtcccagaatcccctcttgctcagtccgggcgccgtagcccgccggcagaacactcccaaattgaagaagggggatgaatcaatggatttgaatatattttttaaaatgggatctatcatcgacagattaccgggcagtcttaggtaaatg

SEQ ID NO: 98961 - DNA, 83 bp, Heterodera glycines
  Promoter: Source sequence=SeqID_4247; Location=3720..3802; Strand=-; Gene=SeqID_53750
ggtgcgtttcaaacaactatagtaaattcaaattttactattaaatttattttgttttaaaatgtgtcagttctcttacgatg

SEQ ID NO: 98962 - DNA, 71 bp, Heterodera glycines
  Promoter: Source sequence=SeqID_10094; Location=2548..2618; Strand=-; Gene=SeqID_73160
caatgtcggcactttcttttcaagttttttgccttccaatcaaatccccagttttttcagatcttcaaatg

SEQ ID NO: 98963 - DNA, 108 bp, Heterodera glycines
  Promoter: Source sequence=SeqID_23144; Location=1..108; Strand=+; Gene=SeqID_53849
gcaccgaacaaacgaaaaaaacggaaaaatatttcggaacttccttgtgaccaaaagtaaaaccaaattaataataatattttaatagtaattaccattttacagatg

SEQ ID NO: 98964 - DNA, 1003 bp, Heterodera glycines
  Promoter: Source sequence=SeqID_5385; Location=805..1807; Strand=-; Gene=SeqID_57847
tattcgatcatttagtccaaaatgattaattgtttgaaataactgaagtaaattcgtttaaaaatttcattaatttaatttagctttaacttttagattttataaaataaatagcaaaataaaaattaattttgtgttattttcacttgaaataaattaaaatttgattttttttttaattaaaaaattcccggaaaaccaaggtcccgtcccggcttctcaggtcccggtcccggttttgcccaacattcccggtccgctcaactctacggtagtaccataaaaataaagtttccaacgcaattaattctctgcaatttgtgttatgtgccaaaaaacccccaaaatatgtgctaaaacccaaaaaaaaggccaaaatatgtgccaaaaattgaaaaaaactgctcaaaaaataagttaatttctcaaaaaagtctcattttttatcaatttcgctagcttaatgtaatgctttttggcgtaaattttttttcgctctcaaagatttactcatttttcggaatttcttcgctaaaaatcaaattttgccttaaaagtgaaaaagtcatgaaaagggtcaaaaaaatacaaaaaaaaagaaaattttgaaaaattattgggcatttatttgaccacgaatttgagtgccaaaaaagacatttttgtaaaaaaaaacctaatttttccaaaaaatcgccaaaatatgtgacaaaaactgccgaaaccccaaaatatgtttttattcccaaaaagcccaaaataaatatgtgctaaaaactcgctctgattgaaaggaaaacaggtaaaaatgctatttttgagattttcatgcgatagataaaaaaatatataaaaacatataaatccgttccctgataatatccgtcaagaaataggaaaaccctaaaaatccaagctttacccaactcaattaattcttctgctatatattgtgtgacatcattcgtagctcggccaaattgtgctaattgcctcaaaaatg

SEQ ID NO: 98965 - DNA, 1003 bp, Heterodera glycines
  Promoter: Source sequence=SeqID_7565; Location=1491..2493; Strand=+; Gene=SeqID_65242
aaatattttattaaaaaaatgttcgaattcgtgttccggattcgaaataggtcaaaattgatatcatattcgtgatcagcgaccccgaaaacccccgggtactactccgaattgcataaagaaccctttttaatctctttttttatgggaccaataaaatacaggattacccaatttttttggagaaaattgggaagaaaaagaagaatgaactcaaaaaaagagaaataattgcaaaattttataaaataaaagagaaaatcaagcaaaaaggaagaaaatattcagcaaaagaatggagtaaaattaattcgaaaattgcattaatttttctaaaatctctttacattgtgaatttattttatttttattgaaaatatgtttattattttcgaatgagctccagaagaaagtaataaaattttatttaatcattaatttaacaattggcaattattttgtcattaagataaaattattattattatttctttgaaattaaacaggatttccttattttattaagtaaaataatgatttattcagttttttaatcagaaaaaaatcatttaaatgcctcaaaaaatgaattgccatttaattgaagaaaaataaaataaaatcttgaaaatgaaattctgtattttattatttttatttttgattactctaattgatcaaattggtggaacggaaaataaaaaattacaacaaaaaacatttgaggaaatatttggagaaaaatgggaggaaaaagaagaagaaaaacgaaatgaactcaaaaaaagagaaataattgaaaaaattatagaataaaagaaaaaaaaagcaaaaaggaagaaaatatccaaaaaaagaatggagtaaaattgaaacaaaaacaaacatttgaggccaaactttttgcagaccctccgtcactatccccccaattaactccaaaaaacagcgaattgtgcaccaattggacaatgccgcctcagcaattgaacaattccacatg

SEQ ID NO: 98966 - DNA, 1003 bp, Heterodera glycines
  Promoter: Source sequence=SeqID_1429; Location=3068..4070; Strand=-; Gene=SeqID_73511
ccctcttttccccgcccctccgcccatccattcattgggatgaaccaacccattttctgaatttgaatttgacccattggcgagggattagcgaattgggcgaaaacagcaaaaacattgtgaaattggcacaaaaaacaaaggtttaagcgtaaaatatgtaaatgtgaagctgaatgaacaagtcattctgttgccgtgtcgactctgataattgtcgccgcttcgcccctcaaatgccctgtgggaggctttgcttttgggtggtcactctttgcccccgagcgatgcttttcctttgcccccggcgccgctctttgcctgctgtcctcggccattgttccgctgttgtcctcgccttccctttgggcacattcgacgaccgatccgaagccaagcgaagaggagccccttggcaaaatggcaaaaggcttctcccccgccccccccttttgtggaagtgccgagaccaacactttgccttgaccatttcgagtgggcggagggcacaatttgcatttgctaattatggacagatggtaaggaggaggacaaagttgggaagggaaaaacgaagtgaaattataccccgggggagtacaagcaaattgggattgaaaacggagaaagtgccgaaggcattggcaacgcattaattacaaaagaaacaaaatgcaattggcacattttaatgacatttaatagggggcaaatggacaagttacaggtaaaattcacaaatcaattcaattaccaattatttgaattgagaaatcgcaacatttgccaaaacaatgcgattttcgtttttggtctgatgaaaaatgcgcatataaaataccctcgtcgattgttgatcatcgcgcaaaaaagtcttgagaaaagcgcgacggtattcggtgctaaaaagagatgaaaatgagaaatgccaaattggcattggcattggcacctgcaggcgcaaagcaccggcgcactgctggtgtaagcaaacacaaaaatg

SEQ ID NO: 98967 - DNA, 467 bp, Heterodera glycines
  Promoter: Source sequence=SeqID_10890; Location=1667..2133; Strand=-; Gene=SeqID_74171
acaaaaaaaataaatatgaatttataaaattaaatacaaataaattatttacatatgtacttgcaaaaaacataaaacaacacttataaattaggcatcattaacggtcaaacttcgaaaatcgaaccttttaaagttttatggcattgaatcattgtgtttatggcgcccaaagttccgattaagtcatcaagaacagaagaaaatagaaagtatgcaaaagaaagtggaaagtatgtttgggtttttattgcttaattattaattttcatgttaattaattttcgggtgaaataatttttgctgacgtcattatttctgacgaaaatgcaagaaaagaatatgcgtaataaaacgttgattaattagaaataaatattttttgcaattaataagcaaattcatataaaattaatttttaaattattgtaattctattaaattcattttaaaaaggcattattatg

SEQ ID NO: 98968 - DNA, 76 bp, Heterodera glycines
  Promoter: Source sequence=SeqID_16956; Location=1371..1446; Strand=-; Gene=SeqID_81383
ggtggccaacaaaaagtgcactcgtccgaagacccaaattgaaaaacaaatttcaaattatggcattttcaggatg

SEQ ID NO: 98969 - DNA, 981 bp, Heterodera glycines
  Promoter: Source sequence=SeqID_25804; Location=422..1402; Strand=-; Gene=SeqID_56565
tggcattttttggaaaatttcccaaaaaatgcaataaacatgaaaaatacatcccaagaatcgacctaaaaaattttcaaaaatatacccctaagaatcgacctaaaaattttcaaaaatacatccctaagaattggaaaaatttcacaaaaattcttcccccaaattttttttttcttgttcaatattttctaagaaaatagtttgtaactgcaatcagtgaataaaatctttttccttaattttaaattattttcaaattaaaaaacagctatttaaaaaattacacccctaaatttggaacttttttgccactatttttaccactattttggcattttttggtcactatttagttaattattttgagattttttatcactaaaaatccgatccctattcattagactaaaataatataattttattttctattagcgccaaaacaatccgaaataaggaaaaaattaaattcttcaatgattgaataaaatcaaatcaaattttgcttattggaatttctatacttagcatgaaaatcaatctttctagtgcattttctaaaaattttacgcactctcatcgattttttaaaataaatttttaattatttttatttattattttatttgtattactaatttttgaaaaatgatatgtttttgtgaaactcttctttcttctgtctcattttgttttcaataaaattttcccattttccttgcccatttctctgccttttcttccgctcctccataaaaataaaataaagtcataaaacaaagaaccaaaattgattgcgatggatttaagacttttgaaaaggcaaaattcttgttaagacggagagagtaaattaaaataatcctttttaatatctgtaaacaatcagacatattattaaattaatgcttaaattgtttaattaaaaacaattatatttaataattttttaatttaatttagaaaatcacaaaaatg

SEQ ID NO: 98970 - DNA, 307 bp, Heterodera glycines
  Promoter: Source sequence=SeqID_11994; Location=1533..1839; Strand=-; Gene=SeqID_75517
tgtttgttttcaatttgaccagctgctgttcacaaaacagggctttttgttcacccgtcaaatcgcctcatggccaaaaaattcgaaaagtccgcccaccgacaaattattaaaatggcagcaaaaaaagcggaaaacttttgcggcattttgtcatccgttggggggaaaaggcaaatggcacacattttggtgggtaaatgacagaaggagaataattttggacttttttgctgctcttgttgaggtgtgttttggtgccaggacaattgcatttgtggcctcaggcaattggccaaaaaaaatg

SEQ ID NO: 98971 - DNA, 52 bp, Heterodera glycines
  Promoter: Source sequence=SeqID_27689; Location=1017..1068; Strand=-; Gene=SeqID_58361
taattgactcactaattaagacacttcaaatgaggaagattgcccaaaaatg

SEQ ID NO: 98972 - DNA, 124 bp, Heterodera glycines
  Promoter: Source sequence=SeqID_33387; Location=1..124; Strand=+; Gene=SeqID_63462
gtctgcagtgggagttgggaacagaaaagacggacaaacaactaaagggcgcaaatttgctggctttaggccgtacatcgaagaactcaaacgtcgtctgacctccgttcagctgttcaccatg

SEQ ID NO: 98973 - DNA, 619 bp, Heterodera glycines
  Promoter: Source sequence=SeqID_480; Location=739..1357; Strand=-; Gene=SeqID_53916
ttatcaaaaaaagaaacgaaaaccctaaatgcagcttttatgtaaccgacagacaccatttttgggttctttttttgccttccccttgttcggatttcaaacacattaaagaaataatgtaacagtcgtagcagtcgcatcgacgagcatacttactcaaattacctatgtatttggcgctgccaaaatgaaatttattcttacggtagtcaaccaaaagtttacggttagtgccattttagtgccgtacatttcagtgcgacgcttttttttttatctttttagtacctatttcgctcttattggctttttgcaaattacagggacccacccgttttggtcgctcgtttcggcgtcagctcgtttttccacggtagcttttttctttggaatccaaatccaacaatattggtatcattcgaaagctttaacatgctttattagccttgctaaaaaaacaaaaaattttatgcctggaaaaaatttattaagaaaaaacttaaaaaacttcgtcttttcgcaattttcatgtataacttttttggtagttaactaatcgtgaagcaatagcttagaaaaagctttagacatgttaagcttttgaatgatatcaacaatg

SEQ ID NO: 98974 - DNA, 174 bp, Heterodera glycines
  misc_feature (18)..(18): n is a, c, g, or t
  Promoter: Source sequence=SeqID_45201; Location=1..174; Strand=+; Gene=SeqID_72544
caccaaattctacacaanagtgctcacacaattgggatctgctgcttaatgatatgaaaagcggtttggtttttactcaatataatatatatatatcattcctaacaataagatgtttctcgtcttcctaccacattggcccgacttcgtccggtgactgaacgacttggaatg

SEQ ID NO: 98975 - DNA, 805 bp, Heterodera glycines
  Promoter: Source sequence=SeqID_18344; Location=1..805; Strand=+; Gene=SeqID_82948
attatgctctacaaatcaatgaatcaatgtgccaactatttgctaagcttataatggtgaagaaaaccaaacaaaaaaggcattggggtgtaaaataagctttacataatggctaaaaattttatttaataaatcataaaattccactaaatattaaattttaatcaaacctggccagaatattcctttatattagcctcagcttttcagcaattttttagggttttctttttaacttcacaaaattatggcctcatggatgtttcaactatacaaaaattttaaaattcttcaacacagaggatagaaattctgaaaaacccttttctcaaaaacatttctgtggccaatccaataaagattgacaaataaaaataaaagattgtttattaaattaatttaatttctctataaattacttttatatttgcttttcaggaaatattttagacaaataaaaattaggggctcattagtgtgtcctgaaatttgagtggatttagcaaaaacttggacaatttacggggccatattttttgaagtcaagagaaaaacactaatcaattgatgtctggagttaatataaaaaaataatctggcaaagtttgattacaaaataaatttattatttgaattttcatgttttttaagtaacatataagccactatctaagacttacgttacagctcaatattcaaaagaattttgttttgattttgatcatatttttcattccgtctgttaaactttaatttagcaagctcattaaattactaattatattctcattattctctttttatg

SEQ ID NO: 98976 - DNA, 611 bp, Heterodera glycines
  Promoter: Source sequence=SeqID_3421; Location=1210..1820; Strand=-; Gene=SeqID_84615
atgcgagctccaaattccgcactggcgattcgtaacattggagtgcaactttttccgggaaaactggattatttcctttctgcctatcgtattgcgactaataaaccctatggctatctcgttgttgatatgcatgctgcttcaaaccccctgctgcgattaaggagcggcatatttaaagacgacgaagaagaaggaaaaaagatcattttcattccaaaaaatggccttttgtaaaattggagaaattgtacataaaaattttgattttattcgagtacttgccaaaaccaaatcgatgaaaaaaaggagacaaattttaaaacgtgcaaatgccgatcaattgttaacactaattgaaatagctttaaacattctttgttcacactttaaattaacaactcgccaaagaaagcgtttgctaccttatgcaacttttgttcgaagtcttgctcgtcgaaggaccgaaagaggggcacggaaggtcctggttcaaaccggaagtggactcggaggagtttttgcagctctgctcactcctattcttattgatttagcacgctctgctataaattcaagctcaaagagtgacaattgatcattttatcatg

SEQ ID NO: 98977 - DNA, 1003 bp, Heterodera glycines
  Promoter: Source sequence=SeqID_3144; Location=1957..2959; Strand=+; Gene=SeqID_83397
atgaaacaaccccgccccttgtcatggtaattgcggcaagtccaacagaatttctcctcgcatacgtgtccctttcttccgtcacgggtattccgttcaaagtcccacaagacaccgcacttcttgcactttttcgatttggtacagtaattagatgtgaggtggtgttgatagcattcacaaaggaaggtcctagggtgtccgtgggatttcagaatgaaatttggtcagtggatagagcacccatgggttcttaagaaaagtgattttattttttgcggaatgagcccgagtgccgagttattccgtgccaaagtttttggtttttttctaattaaggaaaagaaataattgtttgtttactttccaagtgtctaatggtgtagaggtagtgtgttagtcaatcttttttttgggtcccaggttcgaatcctgtgcatgctaatacattttacaatttttattttttctttttatgcataattaattattaaaaatattttttatgaaacaaaatcttttatgcattttaattttattcaattaaaatttaaaaaataaattaaatataaagatgaactaaatatcatgtcgatttgagaaaaaagttttctaattttttatataaattatgcaattaatgaaatgtaaatattttattcactaaacaaaattacgaaataagtcattatcattttttgaataatttaaatatttatagaatagcaaaaaaaaaaaattaataacttaaaaccatatttttattgtttgaattggattgaaactgattgttaaaaatagcataaaaagcttcaccacgtcatgtgactctaggaaagagcccaagattgaaatatttacaaaataaatgcataaaaataaagcaaagaaattaccgaaaaaagaatgtgataatcctttcaaattgtcattcctttcaaattgtcatctcctctcctaatcgatggcaaagagaacggcggcaaatttttcccctcccatg

SEQ ID NO: 98978 - DNA, 284 bp, Heterodera glycines
  Promoter: Source sequence=SeqID_28656; Location=1604..1887; Strand=-; Gene=SeqID_59247
aaaaaaatcagtggaaaaatgacaaaaaaaattaaagaaaaaaacaaaataaaaaatttttttagaggggccaaacgaaaaaataatcctttctcttgaatttaaaacactgaaaatccctcaaattttcaatttccagataatttgaatgtcaaattttgcatgattgtgaggtcatagcgattattacgtttgaaaaaacaatttctgcctctcaatttgaaaatttacattcacacagcacacacattttggccggaaatttggccgtaaatgagaaaatg

SEQ ID NO: 98979 - DNA, 127 bp, Heterodera glycines
  Promoter: Source sequence=SeqID_29941; Location=295..421; Strand=-; Gene=SeqID_60413
gaaaatggaacagaaagtggaagagaaagtggaagaggaacagaaagtggaagagaaagtggaagaggaacagaaagtggaagagaaagtggaagaggaacagaaagtggaagaggaatagaaaatg

SEQ ID NO: 98980 - DNA, 148 bp, Heterodera glycines
  Promoter: Source sequence=SeqID_40470; Location=535..682; Strand=-; Gene=SeqID_68794
tcaaatgttcagtttaaattgaatggtttcatgcacaattaattccttcgttaatataataaatttgattgaaattgaaaattttatattatattttcaatatatgccaataataaaaaataatgcagaaacaaattcatcgacaatg

SEQ ID NO: 98981 - DNA, 419 bp, Heterodera glycines
  Promoter: Source sequence=SeqID_28837; Location=293..711; Strand=+; Gene=SeqID_59420
tttcctccccttcgtcccgtccttctttttcttgcgcttcactttttcccacaaattcggcccaaaatgtctctgatcagtcccaactgaatcatcaacatcagcgggaacaagaagaagaagaacaagaacagctcattcgactgctgacagtcacttccgactcttctgccgatggccaaaaagagaagcaaaaggaaaaacgaacgcaaattccaagcaaaggttggaggaatttaaaaggaaaacggaaaggcaaaattataacgaaatgatgccattggcaggcaaattaatcaccgctttgatcgctaacactcgccggtgccgctcccgccaaagtcagttgggttaactctcaatggccattcgaaatttgtggaatgttgatgctaatttaagcacatcagaaccaaatg

SEQ ID NO: 98982 - DNA, 91 bp, Heterodera glycines
  Promoter: Source sequence=SeqID_17305; Location=1153..1243; Strand=-; Gene=SeqID_81782
ttttatcattggccttgttaagccttcgcaatatgctcgagcattgttcgacacttcttacgcatattttttggcactaaatcgcacgatg

SEQ ID NO: 98983 - DNA, 445 bp, Heterodera glycines
  Promoter: Source sequence=SeqID_20335; Location=1..445; Strand=+; Gene=SeqID_50850
tctctttattcttctctctctctctctctcttttccactttttctcactcttcctctcactatagcgcgcgcttctctctttcgctttctttctccctccctcactctctttctttttttctctctcacttcctctctctctccttctctctctttttcttccaaacacatataaattttttttgggcacattattttttagtgatcaactaaccgtaaaaaatggttaggtgccgaaaaaattcctatagagctggaaaaagctcttgcaaaaaatttatgacgagcaaaaagaaaataaaatttccacaaatttcttttaatttttagtgtgacttgtaagcctaaaaaactaacaaattaattaactcaaattaaaaataaaatgtaaaatgccatttttaaaaagttcaccaaaccgaccgactcggaagagccttcgatg

SEQ ID NO: 98984 - DNA, 485 bp, Heterodera glycines
  Promoter: Source sequence=SeqID_3033; Location=4816..5300; Strand=-; Gene=SeqID_82867
ttttctagaatttgaataaagaatgatttcgatttcttgctaggaataattttgacccaaaagtgggcgtggccaaagtgcacatatcctacacccggtcattttcccgattcattttaaaaattttcatcttttttttttgcacatctgctgtttctctctcctcctctcacttgtcttgtgctttatgggggccgtattatttaattgggaattttggggacagtataattaaattttattaaaattattaatatttttgctgttaaccagggcggtagatttaattaaaaaagctccgtttatcctggcagcaagttgtatgttttaacatattatgatgtgcctatccatgcccaatgtttcttcatcttccatcattcaccatcatttcttcttcacaacattttccatgctgacgtgcgcatataaataccgaaattttgttcactcctcctcaatccctgcacagatttaaaaatatg

SEQ ID NO: 98985 - DNA, 195 bp, Heterodera glycines
  Promoter: Source sequence=SeqID_26969; Location=782..976; Strand=-; Gene=SeqID_57703
ttccacacaaagcgtgaactgacaatgaatgaaaatggaatggaaagggacgacggaattgcccgggggggggggggacaatgagtcccggtctcacattcaaaaacaacattttaataatattgtttatatgtaagcataaaaacaaagcatttatttgtgtttgacattttaagaaaggtcgcgccgaaaatg

SEQ ID NO: 98986 - DNA, 794 bp, Heterodera glycines
  Promoter: Source sequence=SeqID_17010; Location=299..1092; Strand=+; Gene=SeqID_81433
tcttctcgttgtgttacgcccgttagtaaaatatgagaaaaatgcatcacaacagcgacttttatacacattttggacgtttttttttgcattgtgtgcagttgcagtgcgccaaaatgtgcgagtttcctattttgaatatttttcaaattaaatcttaattcagcacgatgatacacaaaatatgagtacggctaccaacctagagttagaatgggccggcatcgtttcggctccaaagtttcggcaccaaaattttttaataaataaataaatagaaatttcctaaaaagacaaatttattgtgcagtttctgaaattttaaaacttttcatatttctcttttatcctttttgacactcatattcctcactcttttctctgtctctttctatcttctccccttaataattcaaataataaaaaatgttcgaatgtctaataagtcaatcgggtcctgatttaaaatttcgtaatcccaatgctaagccagcctaagttgaggcctaatacgatgcccaggcctaaacagctggcttctgattcaaatttttcgacactcggattatttggcaaccggacaggaagcgataatgttttatctcatttaacgtctgaatttgtgtttaatgccaaaaagtgctataataataatcacacaatgcgacataattattaaaaaaaaaaatttgcccaaaattagtcattttgatggtaaatatctgttaaaaaaggacctaaatttgttaaaaaaaaacattattttattaaaggtatcgcccataaataaaatg

SEQ ID NO: 98987 - DNA, 497 bp, Heterodera glycines
  Promoter: Source sequence=SeqID_5662; Location=474..970; Strand=-; Gene=SeqID_58825
ttgacgaggccgcgtccaacaaaatttcaatattgtagcaggccgaagtggtggtggaggcacgatggaatgcctaatacatataaaaatttgaaattaaaatatcgatgaatcccgcgtttgcggattcaaattgccgcggtcgtgaaacgcggaaaaaaatgtcgaaaatcgcggtcgaactccttccccttcctcccccgaaattaaaaatgatttgacgacctccttgaacttgttgaccaattctttgccctttgatgcataagtgcttgaaaatcggcaacgcaaatgcttcggctgtccatcggtggtcggcgtgtgcaaccatttggataaagcctcgccagcagttgcattcctaccatcaaaagcaattggagcggggaacagacgaaggaactgatcgagttcagctgcgggagatcagtgagaattgtaggcgaaacgaaattgcgcaaattattcaaatttgcaggcacatagaatgccaaatg

SEQ ID NO: 98988 - DNA, 160 bp, Heterodera glycines
  Promoter: Source sequence=SeqID_7577; Location=3938..4097; Strand=-; Gene=SeqID_65294
tttcgggggtcgctttgacaacattatgctgtttcgacagttcttcctcaacgggttttgtccacaaatgatccgtcgtggtaacaaattatatgaaatgaaaattgcgcggggcgaaaaaaacccagagatcatcgtaagagacagctggaaccttatg

SEQ ID NO: 98989 - DNA, 187 bp, Heterodera glycines
  Promoter: Source sequence=SeqID_7253; Location=2266..2452; Strand=-; Gene=SeqID_46391
ttttcctttccttttatacatcccaatccaaaaaaatcatccggcgaaattttggctgctgcagtgcccagcagaatttgcgtataaaaggctcacattttgatgactcctgccatttgttttcaatccctctcgcccgaatcgcaaattatgccaaattctaattttttccccaactttcagtatg

SEQ ID NO: 98990 - DNA, 1003 bp, Heterodera glycines
  Promoter: Source sequence=SeqID_4571; Location=1131..2133; Strand=+; Gene=SeqID_54929
ccatttccatcatgacaaacaacaaaaaatactggcaaatttttcaaattttattttcggcaaaaaaatttcaaatgaatcgtcaggaggcgggcgcttcaattttttttcgaaaaaattattagaaaaatttttcttggtaggcctgcacatatcacaagctaacatagtaaaaagtaaaatactgtttttttttaaattactgattcgacctcctcattttgatctacctgaaattttgatcaagaccgggccaaaaaatggattcaataaaaaattcagcatttttgtgattctctaattttttcttgaaatttataaaaaatgtttcccatgtggttgatgggtcagctattttacgctcacaatttgctggtcttgatcaatgaaagcacaacacacaatggccttaatcgacttctatttggtgctaggcatgtacatacattattattattatattactctatagtgatggtcgagaccgaaatcctttttttcgagactcaaaaaaaaatcccgacaatttacttgaaaactgagattcgactcttgagcagcattactacatataccatgtgccaagacatttgcgcctcggattatgtgcgccacagacttttgcgcctatggtttaaaatcggtttcaaaaattaattttgtccattttaaatataaaattaataaatttaaaccgcgttatatgtacatagacacaaaaatacaggacgcaaaaatgtcatatataaatctactataagaacccaatttgtcactctctcgtccccctttttatccactttgtgaattcgaattttgcatagtttcaggaattctattcattatttgtgtggcattcgtgcatttatcgataaagctttttcttcagtttaattttgtaaaaaatcattttgggtttcgcaaatcgctttttaattattttttaaaattaattatcctttcattcaatttttaaatttgcccatttaattagcgccaaatg

SEQ ID NO: 98991 - DNA, 848 bp, Heterodera glycines
  Promoter: Source sequence=SeqID_45029; Location=1..848; Strand=+; Gene=SeqID_72426
ttttttgttttcgggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatg

SEQ ID NO: 98992 - DNA, 601 bp, Heterodera glycines
  Promoter: Source sequence=SeqID_6468; Location=1..601; Strand=+; Gene= SeqID_61701
ccccccccctctctattaatgatgctatcttttaagaattgtcctcctcaaatgtgtccttttagcagctgtgttatgctcaactcctcctcattttcgtttcatcatcctcatctcatcctcctcctcatctcttcgttcgttcgtcatttctcccttttcctccgtccccactttttcgctctctcttcggtcgcgcgtcgcctccattcgatgaatgttcccactgatcacccccccccccaaccaacaatcatttggtacgaagcgccggactaataaatcacaaatgcacatgcgataggtcccctcggggatggacggcgatcggagtttgtgtggtggggggagggggggggggaagagaagggatggatggcctttggcttcagaaaaggaatattacgtgttaaaatgataaccataataatactaccatcacagccccaccaaaatcaacccataaaaatgatcgccgcctccgtttgtccgccgatcgatcaggccatttgatcaactcgcggtttctgctgcactcgtccttctcgttttgcctctctctctctattcacagtcattccaacagaacaaccgccgaatg

SEQ ID NO: 98993 - DNA, 285 bp, Heterodera glycines
  Promoter: Source sequence=SeqID_15037; Location=1..285; Strand=+; Gene=SeqID_79211
ttatttaaatgaattagaagcttttaccccaataaatccattcttgttaaaaaattcattcaactttttgttcgaattagtgtccggtattcggaattaggtaaatccgagttcagatccgtaatcagcaccctcgaaaacccctaaaaactggttttgagccgaaaattaaaaaaaaatttttgaaaattatagacacccattcttcagaattgcccaaaaaatgaatatataaacggtgacttttgcctccctcccaacacaatttgcgtcccaacaataatg

SEQ ID NO: 98994 - DNA, 76 bp, Heterodera glycines
  Promoter: Source sequence=SeqID_15610; Location=1..76; Strand=+; Gene= SeqID_79901
ttgtatggtgattggcacaacccaaggccgatggtggaagatcccggtcacaatcaatggcttaaatttgaagatg

SEQ ID NO: 98995 - DNA, 322 bp, Heterodera glycines
  Promoter: Source sequence=SeqID_29795; Location=522..843; Strand=-; Gene=SeqID_60255
aaaaattgacctacatattaaaaatccataaatttttaagttttttaacaaattaattagtaatcaatccattttacttcaccgaccaaattggaaggtgaacaacgaacttgagcattttgatcagatcatccacagctgataagcattatgcttttcatttaaaattggtcatcccttttttatacagtatttttaatcaaaaaatttttctaaatttttttaatagccttctattatggttgtgcacaaaattgttcgtttggcactcattcgcctgctgagggcatgacatgcaacaccaattggtgttgcgaagatg

SEQ ID NO: 98996 - DNA, 368 bp, Heterodera glycines
  Promoter: Source sequence=SeqID_171; Location=229..596; Strand=-; Gene=SeqID_76059
tctgtaaaaaaaaatcaataaatcggcctggggattcactgtgtgtttgaattggcgcccttttgtatctttctctaaccactactctctcgtctatgtgtttgtggatgggcgtggcctatcgattaagaagggacagcccgtctggaggtcgctgcgcgctaacacccctctcactatcaatcaataataattacgtgttttttttcgcaggttcattttatgcttttaacaattataattataaactatttcttaatcgtaatggccccgagaaaaatcaatgatcaattggtgtttgagaacaaaagtaatcattttttgagttttttataataattttaaatttttttaaatttaaagaaatg

SEQ ID NO: 98997 - DNA, 190 bp, Heterodera glycines
  Promoter: Source sequence=SeqID_2980; Location=2206..2395; Strand=-; Gene=SeqID_82619
tgaatataatatggacaaaggcgaaaaataggtcctttttatgggttcatttacaacggatgttttggttggtataggcactcactcagtaaggacaaatgggatgtaattatacaatgacgtaggagagagatttattgagagtacatggtctggaaccgggatgatttggagggatcagtgaaaaatg

SEQ ID NO: 98998 - DNA, 135 bp, Heterodera glycines
  misc_feature (17)..(17): n is a, c, g, or t
  Promoter: Source sequence=SeqID_43339; Location=1316..1450; Strand=-; Gene=SeqID_71039
tagacaaagaaattctntggcccacattttggatgaaagcaattccaatcatattcatgtcattgataattttccaaattaaattttaaattattgaaaaatatataaataaaaaatgcaaattcctcacatatg

SEQ ID NO: 98999 - DNA, 560 bp, Heterodera glycines
  Promoter: Source sequence=SeqID_14275; Location=1..560; Strand=+; Gene=SeqID_78291
acggtgaagttggagtaaggggagatcagttggctaacgcaaaaagaattgggtcgataggtgcagaattcgcaatgtgcgggccacatttgcaaagagccccccccatttttttatatatagataactaggcgtcccggtagatggctgcgctttatagaaagccgagcctatcccgtcgaggtgtagatgcgtaaggtgtgcaccgtcgcggttgttagtgcagtagcagctcaggcgcagatgcgtgtctggatgttcgtgcagtagcagctaccggtaacagcctagcctagccgttcacccccaccccaccctacgcggcatgcaaaagaattgatcaggttcgtattgactcggtacactcgctcgtcgctccgcttcgctccgctcctcgctcgcgcacctcgagggtcagggcgcttcgcgcccgccccttgtcatgagcagcatcggttggcgcttgctcggcgtactcgctcgtcgctccgcttcgctccgctcctcgctcacacgcctcgaggggcagggcgcttcgcgcccgccccttgtcgataatg

SEQ ID NO: 99000 - DNA, 226 bp, Heterodera glycines
  Promoter: Source sequence=SeqID_3596; Location=1231..1456; Strand=+; Gene=SeqID_51024
tctgcaaaaagacacgcaatcagttaactaaacagtcaacgaaggaatattctggtgaatgattctatcgacgtgacggcatttagcttcactcccaattctttgaattgtctatacatctcatccactaccctcccctcaatcgaacttcgaaaacggcgctcagtcgggtgggacagttggccaaggcgaggataaaaggtccgtacacgtcgggcgcaaaatg

SEQ ID NO: 99001 - DNA, 129 bp, Heterodera glycines
  Promoter: Source sequence=SeqID_21730; Location=832..960; Strand=-; Gene=SeqID_52332
ttttcctgcccatttccaaaggtttgccttggcctgccaatttgtggcattttttttgtgtccgcaatgcattcgctcctccgatggcacattcgtcaaatgctttctgaagaaaatgagcaaaaaatg

SEQ ID NO: 99002 - DNA, 138 bp, Heterodera glycines
  misc_feature (121)..(121): n is a, c, g, or t
  Promoter: Source sequence=SeqID_7601; Location=1..138; Strand=+; Gene= SeqID_65362
taagcggggggagatggaccggtacaaaatccattgtctattcgattcgctgggggtcgaatgcggcaccatatcgtaccgaatgggccgtccttacaaccagcacaaaaaagtgcccgcncactcaaagtgatcatg

SEQ ID NO: 99003 - DNA, 643 bp, Heterodera glycines
  Promoter: Source sequence=SeqID_9073; Location=1342..1984; Strand=-; Gene=SeqID_70159
tctgtcacgggttgagaaactaaaaatgaatattttagatcgagaaaattttcggaaaaaatggaaaattatcgatattttcggtttacccttttaaaaaactggtaaatttaaatagaaaaaaatgaatttttcgctttttaaattgttttttgttaaaattataaattttacttcgtttttaatgataatagttttttaattcctatgtatatgattattaattatttattttcaaaccgttttctttctgctgagcattgacctccaaatgtttaaaataataattgtgtttatatattaattaattttgaattaccatttgagtggagaaaataagcgcaaaaaacgtgaaaatgtgaaaacaataataaccattcattttcggtttcaaatttataaaatatgaacacattcacaattctccaagcttttatatgctttcattctcatttaatttcttttttttaatttaaattggaaaatggctttaataaaaaaaaagtttattggatttgccacataaaaaacaaataaaatgataaaaagaatcaattaaaatattttattgcattaaattattcataaatggatttgggcaaaaatttgaagaaattaaaatgctctagaatattaaggaatg

SEQ ID NO: 99004 - DNA, 558 bp, Heterodera glycines
  Promoter: Source sequence=SeqID_7544; Location=1..558; Strand=+; Gene= SeqID_65167
tcaaaaaagttttaaaaatggtcgggtgaatcgtaggatcaacgccgtcatcatcatgataatcttaaagtaagtataagcttaggccgaatctttaggctttggcttcacatttagctggggttgaagtggatgcattttcacatatcatttccattttttatctattttatttaatcaagaatctcaattaaatagtggcaaaaattccgaaatagtggcgaaaatggcaaaatagtcgcaaaacgccaaaagtgtgggtttctgaaaaaatgagagaaaaaacagctcatttttcattaaaaaatgaagatagttttaattgagatcctaataatgaatttatagagaagaattttaagtaaaaaaaataattttatttttatattaattttttaattatttcaatggcgaaaagtacaaaacagtgatccctattgacgattagtggcgctagaattaattgtgtttctaagataaaaatacgtgtttttttttgtgctttctgatcgaaaattaaattgtagatacaaatttattcatttttttgaacaaatg

SEQ ID NO: 99005 - DNA, 950 bp, Heterodera glycines
  Promoter: Source sequence=SeqID_3371; Location=1046..1995; Strand=+; Gene=SeqID_84417
atttggtcgctatttatttatttgtattgatttcatattatattttattttttggcggcgatctcgtttttaattgttttgcgctttcttgaggacattttaattaatgttttgtcctcaatgtaagcggatttttcccttttgtggactttttctttattgacaataaacaataaacaaaaatatgtacaaaaagtgtcctcatttagtattttaaaaattaatatttggtattttttaggggtacattttcaaaaaatttttagttatttttcacatgaaatttctataaattttaaaaagttctcaaaatatttttaaaaaatgaaaatatttacgaaaaatttgccgaaatattggatttttttgaggattatttccagacccggtccgctcaaaatatgtaaaaaatgaaaaatgttagaaaaaagtccaaaatatgtaccaaataagtataaaacgtcgaaatatgtaaaatatgtaacaaaccccgaatatgtaaataaagtcccaacttttggactcaaacgagagttgaaaattaaatttccgacaaaattctcatttatacaccaaaaaaggtccattttttgtggaaatttccagcttgaaatttcgaagctataaaaagttgcttcgtacataaatatccatctttttttttgtaaaattctgtaatcaaatccgttttatcaccagtcatttttatgaacgattactcacaattaatgaattatttacatgcacataaaatgcaattgaaatggacgaattcgcgagcaaaacaaaggtcaaatacatacaaacaaacaaattataattagtattaatgggccagtcaattttgaaatattcgaactcggtccttttatttgtcttgtcgccatttttttttgatcgtcaacttatcccagagcgtgtccgacggtggccaatgtcccagccgaatg

SEQ ID NO: 99006 - DNA, 151 bp, Heterodera glycines
  Promoter: Source sequence=SeqID_29075; Location=634..784; Strand=-; Gene=SeqID_59637
tgttactaatgctcgcattcatcccccccccccctcgccctttcttttcgacacactgtttttcttattttgtgtttttattattacaaattagaacaatagttaaactacaaaaaagttaataatattaatttttaggaagcaaattatg

SEQ ID NO: 99007 - DNA, 248 bp, Heterodera glycines
  Promoter: Source sequence=SeqID_35636; Location=286..533; Strand=-; Gene=SeqID_65155
tctgagaatttggacgtacaacggaaactgttcgcagaagtgtagtcggctttgccacagtgacttacaattggataattcagcaattattttcggatggcttttgttcctcccccccccccctctcttcccattgggctgtttcgtttcgtttcatttcgtttgtcccttttcgccttctctccaaaaatttctccattaatattgttttacgaatttttgcttttaactttcaggcttagagaatg

SEQ ID NO: 99008 - DNA, 820 bp, Heterodera glycines
  Promoter: Source sequence=SeqID_10584; Location=1..820; Strand=+; Gene=SeqID_73820
ttagttggttcatacctttattttaaatatgttaatgcattttggcatcccgtcaaaaaaaaatttcggctttcgtaatcagtcgaaatcaacaacaattttgctgacaaatataatgataacatcagttgggaggaaaagatgatggtttccccgcggtcattatcaatagaaaatcggagaattcacctctcaacgccaaacccccgccccccccccaaaaaaaaattctatttttgattgtttaattatattgctgctgaatgatgatattgctgttaatgattttcacttcaaatttcgaataattaattaatttaaggctgaataattttcaaaagatttaacaaagccaaaagccacgaaatttttgacttggaaaatttacctattgcttttatttaaaagatttatttccttttgttttcagatataaacttccaactaccgtatttcctgaaatagagcccacggtggctttatttttcaacccccctcaaaagggggggggctctaattcagggggggctctatttctcaaccctctcgagaggtagggggggaggcttgatttcagagggaggaggggggataccaggtaattcagggggcggtgttattataggaaatgggtttttgttattattttaaaaagtcaaaaaatttcgacatgcggcttttcgggcagggtttgtttagcattaattttgttagcgcttctaatggtttttgacttttattttttaattcgaatatctcaattttcaatattattaattgttatttaatttaaaaaaaaataaaattttagcaaaaaatg

SEQ ID NO: 99009 - DNA, 166 bp, Heterodera glycines
  Promoter: Source sequence=SeqID_26091; Location=204..369; Strand=+; Gene=SeqID_56837
tggctgatggattcggcgcgacgactacacattgtggcaaagaaagatgtctgataaaattcatatgtacatttgaataaattttatttatgtgtgcattattggttaattttacctcatatttttgccaccttttcatacatttatcattttgttgtttaagatg

SEQ ID NO: 99010 - DNA, 1003 bp, Heterodera glycines
  Promoter: Source sequence=SeqID_10965; Location=1730..2732; Strand=-; Gene=SeqID_74274
aaatcgacgtaaaaaggaaaaatacacccctaaaaatcgaatttttgacttcagccccccccccccccccaaagccaagggtctggctacgcccttgggtgatgcgacatatgcggcgcagaattaaatgaccccaaaaatatttcaacaatttatttaagttaacagaattgttattttaagtttattttttaataatgactaatttaacaataattcttgcaacctaatcaaagataaaggttgagtcgtttgccgttgtaacatattcagaaaacgtttcacttcgccccacccagcattttcaaactataaatgggatactgtaataaaaatttttgacaataaggaaaacaaaaagatgatgatatagcccggtaaaaaaaatttccgggagcgggatcgggagttcaaagttttccgggatgggagtcccgaacgggaattccgtaaaaatcccgctccctttaaaatcccgttcaccgaaaaaagcgggaccgggaatcccgtaaaaatcccgcgggagtcccgacccggcgggctctaataattaatcacattcaagcttttactgggcgccgcaaatgtctgcgccgcaagtgtcagcgccgcaaatgtcggccaatcctttaaataagcgattgaaagtgattgtgtccgatcatttgatcgttaacaaatttttgaaaaaataaattaatcttttaaacaacttaattattgatcctataaactgaagaacgaatttccttagatttaatgctgtttaggctatcagggcttaaaaaaaaattcaactttgagttgcgaagtgaatttttcccataatctaaatttaaataagcaaacaaacaaattattatttttttttctctttattatgcctagggatgtcaaaaatatgtacaaaaaatggtcaaaatatgggtgctacgtcatttcgcgacaagtgcaaaaagggcacttcgcgacagtgcaaaaattgggcacttcgcgaaaaatg

SEQ ID NO: 99011 - DNA, 587 bp, Heterodera glycines
  Promoter: Source sequence=SeqID_8717; Location=3724..4310; Strand=+; Gene=SeqID_68947
atgtatgacaatgctttttttgatttatcgcttcgaatcgtcccattttatattcatttaataaacaataattattttaacaaaaaatgttaacattttcaaattttatatttttaatgtgttagtagacacatgaaaatagtacgcgaaaatgagagagaaagaaatgcaaaattttcatcactccatttttttttgctcttaaaacccctgagattttcttcgtgattttttcactatcgaaggaaaaagaaaaattcataaaaattgttcttcttttacaatttccaattttttgtgttcttctttctaaaattttgggtccggattggaatgagaaaaatatcgtggttcacgatccaggtcgtgatgagaaaaatatttgatttcaaatcggttttggcagaaacgcctgatccaggcacaggtattcaaaaataccgagccgagctttacaaacaatggtttcaatccaaagtgctaattcctatatatacttttttattttcccctgactttccgatgacaccgaaaacttaaatttcatattttctgtaaaattccagcacacaaaaaattccaaaatg

SEQ ID NO: 99012 - DNA, 195 bp, Heterodera glycines
  Promoter: Source sequence=SeqID_330; Location=10158..10352; Strand=-; Gene=SeqID_82637
atattcgaatttcttattatatgaaagcaacgcaaaccgtaactgaaccattttttgaagtggtgaacgaagcgacaaatgagaagctgatactgttggaagaatccgagtgtaattggctgatgaaacgatgtccaataattgtcggggagacggcgacggttcagcggaagaaagacgacaatttgaacaatg

SEQ ID NO: 99013 - DNA, 328 bp, Heterodera glycines
  Promoter: Source sequence=SeqID_3697; Location=3233..3560; Strand=+; Gene=SeqID_51507
ttactctaaaaaagttcaaaattaaggactacaaatataatatgtatatgaaacgaataaaatatttcatctttattttaaaattggcataatgtcaatattaaattcatattcataagctcatttttttattatgaaaagcccaatcattaggggtgtaaaaaagtctcggtctcgagtctcgaaaatcgagaccgagactttaaaacccgagaccgagaccaaaaaaccccgagacttttctcgagtcgagactcgagaccgagactctcgagcatcactagtgaacagcacgtcccaccattcgtcggatcttttgtggcggatg

SEQ ID NO: 99014 - DNA, 292 bp, Heterodera glycines
  Promoter: Source sequence=SeqID_30042; Location=1..292; Strand=+; Gene=SeqID_60491
aaaaaatggatccaaatcaatacaaagaaacattgtagaaaatggtgtgtacataggttgaataaattatattaatattaatgaaacagataatttataattttggattagaataaagcgtaaaattaatttaattttatgggtcagccttttattcgtaaagtttttgtttataaataaaaactgaaaaggaaataagaggatcatgttagccaatggaaaaaatcataaatgtatatttaattatgtaaattaattaggaaaaaattgcagagaacaaaatgaaaatatg

SEQ ID NO: 99015 - DNA, 346 bp, Heterodera glycines
  Promoter: Source sequence=SeqID_41506; Location=1..346; Strand=+; Gene=SeqID_69601
tagggcattgggtggcttttgagaggaagaagacccgatgaacaaaatgagaacgtttctaattttctcttccaattaaaagaaaattctttggaacatgaattttttctttttgttttcaaccgcaattgatcgtttttttaaattgttttgaattttttagttgttgatctttggcgggtgaattaaaaaatgcttacaaaattaatgagggatgtcattaaacttgaaatcaatcagtcacatttaaattacttaatttacataaaaataatggaggacaaataaataggggtaaaagaaaaggaaaaggcaacgcacggataattataaaagaagccctatg

SEQ ID NO: 99016 - DNA, 468 bp, Heterodera glycines
  Promoter: Source sequence=SeqID_906; Location=1701..2168; Strand=-; Gene=SeqID_63690
aaaaccaaaaatcgtgccaaaaattaaacaatggttttccttgaacgtagtgttgcgcacgaccggttattaaccgcgtacccccggttttcggtttcggttcggttaaccgaccgcgcgcaaccctacttggacgcttactcatatcctcgctgtctctgacattttccaactcatttttcaagggtgccttcgcgacggataaaagagggaaccaatttttgatttgggactcacgtgagcacgatattgaggagccaattttttttatctttgcaagtgacaaaggcattgaatggctacggacataccaaaattgggcgggcgacggcactttcaaaagtgatatatgacaggggtgtgaccattttctaaagttttgtagctcggccatcgaatttcatgcaattatataccctaaacattattgcacaacactcaagcataccatgcgcatatataataatg

SEQ ID NO: 99017 - DNA, 1003 bp, Heterodera glycines
  Promoter: Source sequence=SeqID_11459; Location=89..1091; Strand=+; Gene=SeqID_74858
aatttattcttggccttgctcgccacccccactccattcttggcacaaatccccacaatttgctcatttttatatcttgtcgatgagccgggggcacagaaagcgcaacagccaaatcaatttaattgacggaacttttgttttgccataaaaatgttgcgcaaaactatcggcagaattaattacgggttactgtagtccagaggcaaaaggcgtacagtagaatttgacattatttcaatgctgcccatcgctttgcttctgcaatcaagctaattgtgtttaatgaattgagtgactctcatttggccattctataggattatttggcattttccttttttaaattgttttcatgacgattgttttttcaattttgaatatttataatttttttattttcatttgcctattcgtttttttaacaattttattatttgagaaaactttatccgaactccgaattcaccaaaataatttatctccgagaatgggagctggttatttatattcttgaagttttactcctcctatgaaaatttaatttatgagagcgtccttgaaaataaggacagcacagtattcccatggaaacgttcacgtgcccaatcaataattggcagagtccggaacagggccggatcctgtcagggtttttccgaactcctgatcccgaaatccggctctactttgaaaaattgacgacctggatcagaaaaaataggatttttaatccataaaatcctgtacggatgcaaattcccgagttctggtcctggtcccgaattttacataatttcgggctctaataatacattttggatcactattcaggggatttgtgctgaattggattttgtatttgtccaacacctaaatctgaaaaattggatttaaagacaaattctgaaaatcgggatttaaggactttcaaggacaattttttcggcttaattcactgccgtgcccattccatcaagtgcctgtgaccatgaaaagcatg

SEQ ID NO: 99018 - DNA, 910 bp, Heterodera glycines
  Promoter: Source sequence=SeqID_17549; Location=1..910; Strand=+; Gene=SeqID_82058
ttatttcttagcgttttatgtgtaattattagtcaccatgaggcctaaaaatttgcttatattttgtgaaaaataaaaaaattgtttaaaaattaaattttaaaattttaatccttcaaccccagaaatcaaacttttaatgggctggatgacatgataaaaatatactaaaactagtctagttattgaataaaaacgtaattaatgaacttaaggcggcgttctaaaattatacaaattaattgtataaaaaaatataataccaaaaaataattcaaaataaatacggcattatattcagaatatatttatacagaaaatttgttacatttggtcacaaaataaaaattcatttaattaatatacttattatgatattttcaatacttatttaaaaacttatatttaaaacacttgcaaaaggcaaaatatacatttttttaaattaaaaagcaacataaaagatatttaaaaaataatcattaaatcaatttatttagcatttattcaattaaattttttcttcgaaatacgataattattggaatgaaaatcataaaaaaatttcttttaatggacaacaaatcattaactaatagatcaggctttagatttataataagctaaaaaattgaaatttataattaaattattttacaaattagtgaaatgatatttaataaacaaataatgagaaaaccaattgctaaattaaaaataccggatttaaattaaattatagataaataaaaaaacaaaaaaaattttttaagacatttgattttataaaaatatataaatttaattcattttaataataaataaaataatttatgcaataacaactttaaaattttttaaatatgtacaaattaaatgtaaaataaattttgctttttttcaggtaatg

SEQ ID NO: 99019 - DNA, 1003 bp, Heterodera glycines
  Promoter: Source sequence=SeqID_2299; Location=2958..3960; Strand=-; Gene=SeqID_78990
cgggtacagaaagccgggtcagagtcctagtttttaaaccgagtccaagtcatgaaaaatccaaacaaaaatctttaaaattttttcatgaaaattaaaaaatattttcatgaaatatatttattttagaaacaaactttattatttgtccattttttccaccttttttttgcggtgcgttttttaaaacttcggggacagttggggtcgggcggtgccggtaggcgccgccgaaaaaattttgaaaattgtcttcggatttgttaacagattttattcaaaaaatgaccaaaacttgttttttaaattttttgtttttaagtcgctttttttgtggcgctgtttttccaaaaaaaaattttttggaacattgggtgcggggtccggcggtgccgaatcggcaccgccgataggcgccgccggaaaaattctaaaattttgagtgtaatatattaacagaacttgtcaaaaaatgatcaaagttttggttaaatttgcagttttaggctgtttaaaaaaagaaaaaataataatttttaaattgaaatattttttattaattaaaatttcaattgaaaataatttaaagaaattatttaaaaaattctgtaccgttggggaattgaacccaagagaaaaataatgaaaggcagaaggtttagccagcagaccatatttgaattggagctatccaaaaatagagaaaacattaaggaaggaaagaaagagatttaagattttttttcgcgtaaatttgaaaatttttctggctgctcaaaagttcaatctttaggggtgtattttcaactctcgcctctcgtcccaaaaaacgagaggcgagagacgagaggcgagcgtaccaaaaatggcgagagttggcgagaggcgagagacgagaggcgagagttgtcccacccctgctatgcaccaaatatgcacaaaaaaaacttgaaaattaggggtgtaaattaatttaaaaaattttaattattcagagaaaatg

SEQ ID NO: 99020 - DNA, 1003 bp, Heterodera glycines
  Promoter: Source sequence=SeqID_26234; Location=495..1497; Strand=-; Gene=SeqID_56983
aactgaaaaatttttcattcttactcaattttattcaaaatccaaaaatttttactactttatttagttttttttttcttcaaaaatgatttttcatgccaaattgagcaattttaaagattttatttttagattaatgaattcaaagaaattttggaaaattttgtcctccattttgaaaatttttgttgcataattaacactttttttttacatattcaatttttaatataattttatgcgcaacattttgtgattttacacataaattgctctctttaggtattggtttcgctaatgaggcgcttgcaattgacccaactcataatgatgccttaaaatatttatgcatgttaatgggactcaaaattggccaaatgcaaaaattttttacaaatgcgaaaaaaatagttcatcttacagtggaattagatgtttgttgttgtttttttataaatccaaaaattaaaaatggtcctttttatggcgattattaattttggggcagggatttataattatgagaaattgtgaagtatttaaaaacaaatatttacgaaaaaatgccgaaataattatcaaaatattgtaaaaaaaaaacccgaatattgaccagcccaaaaacctgaaacttcaaaaatttaccgtgcgattttttactaaaaatttaaccaaaaaaaaaataaaataataataaacataaattccatatttacgaaaaatcgccgaaataatgatcaaaattttgtaaaaaatctgaaatattaagcaaatatttaagaaaaataagaaatttgcattgtatttggcattttttcgtgtatatttatttctaaattttaaaatatcttacaagaaattttttcttaaatgtccaaaaatcgaaatttcaaaattttgtcgtacaatttatttattgtaaaattaaaaaaaaacattttaaatataaatcccatccgattaattatattgcagaaattgttgcaacgagctgatcagcatg

SEQ ID NO: 99021 - DNA, 161 bp, Heterodera glycines
  Promoter: Source sequence=SeqID_44771; Location=1..161; Strand=+; Gene=SeqID_72201
ctggaactttacacattcaaaaggatcgataagccacgctttcgcggtccgtattcgtactgaaaatcaggatcaagtaagcatttgcctttttgctctacgagaggtttccgtcctctctgagcttgccttaggacacctgcgttacgctttgacagatg

SEQ ID NO: 99022 - DNA, 991 bp, Heterodera glycines
  misc_feature (243)..(243): n is a, c, g, or t
  Promoter: Source sequence=SeqID_38060; Location=1..991; Strand=+; Gene=SeqID_66990
gggtaagcagtgctggtcgtttcatcacggcaccgacccttttggctagtcagcaatcgttgcttactttgccagatcggacgggtgcgcatgattccactgttccaagcaccccaccaaaagcaaaacgatataaccaaatattaaggaaaaattttttaaaaaattttttctccatcttcctttttgatactaaagcatcagagtgctaaaattaagttgtaaataaaatttggtgcgctntagagctctttctgaaaaaaatatttatgaaacaaaaaaatcgactttttcaagtgtccgtttagggtactcaaacaattatggggagcaaaaatccaacgcagaattaaagtacaggctatagggaagctattcccgaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaactcaaaaaaaaatttttttggataaaaattatttaaatgaactgactagataatatttaaaataggttattactcttcctttcagtatccctgcaaagtttggtgcgcttctgatcagtttctgaaaaaaaagttaagcctaaactttttggcctgtttaaaaaggaattaaaaattttattcatctccctttttgatagaaaaagcatcagagtgcctaaactaacctgtaaataaagttttgtgtgtttcagagcacgttctgaaaaaatacttatgaattaattttgcaaaataataaataattaatgaaaaagtcagaatttcgaaaaattttaaaaacaacaagcgttggcattttttcaggttaagttagtcctttacaatg

SEQ ID NO: 99023 - DNA, 636 bp, Heterodera glycines
  misc_feature (217)..(217): n is a, c, g, or t
  Promoter: Source sequence=SeqID_12759; Location=1..636; Strand=+; Gene=SeqID_76466
gacggggctttttggcgcggagagaatatgatcaatggaaaagttagaggagcgttttcggggatgattgtccatttttttttattctgagagtggagtgaaaaggaatgagcaaaatctcggtatttatatgcgagcgccggcatggaaatggcgtgaaatggtgaatgaataataaatatttggacatggaaaaatttcaaaaaacttaaacaanactatggcctgaagagcagcacaccgccacccatgaagcacaagacgacagggcacctaaacgactcgggaaattagtcaagtcaagcgaaagacctcaagccctaaaaggcaaattgctgccaggataaacggtgctttttgtaattaaagcaaccgccctggttaacagcaaaaatatttattttaattatacggtcccaaaatcacaattaaatgatacggtccccataaagcacaggacaagtgaggaagaggagaggaaaacagcagatgtgcaaaaaaaaagtgaaaatttttaaaatgaatcgggaaaatgaccgggtgtacgatacgcgtactttggccacgcccacttgcgcaccaaaattattcccaacaagaaatcgaaatcattctttattcaaattttggaaaatg

SEQ ID NO: 99024 - DNA, 197 bp, Heterodera glycines
  Promoter: Source sequence=SeqID_5759; Location=3426..3622; Strand=-; Gene=SeqID_46112
tcgctcagggccgtgatttaagggatgccgtcagggaacattcaagacaggggctgactaaccttaccgacaagttacaacaatgtggtaaaggaaaaaaggccctgatcactaataagaaccgaaaacgggtatttgatcagttaagtttcatctaaaggtataaatagaacaaataatacaaaaagttaaaaatg

SEQ ID NO: 99025 - DNA, 291 bp, Heterodera glycines
  Promoter: Source sequence=SeqID_2030; Location=1399..1689; Strand=-; Gene=SeqID_77411
ggtaaaaaacacccatgccttttttaattattttcaaattgtaagacaatgttctaactgctcttctcaacacttttgacgggacgcagcagcaaacgcgggcacttcgccctgaaggtacaaaatggtggatttacaacaataaaattattacatttgatttgaatccaattccggtcaacctttcataaaggttttttaaaatttactttttcagacatcgacaaattgccttctacaaaggtcgggcccaaacacatagaaaatgcaacccaatgtacgacctgcatg

SEQ ID NO: 99026 - DNA, 174 bp, Heterodera glycines
  Promoter: Source sequence=SeqID_41649; Location=1..174; Strand=+; Gene=SeqID_69733
aggcaaataatttttatttcacgggtatttttcagaaaataccaattaaataatgacatcacagatagacacaagtttgtaataaatttaaacatacagaattttttggaataaaatggctttaaataggcaaataatttttatttcacgggtatttttcagaattaaataatg

SEQ ID NO: 99027 - DNA, 242 bp, Heterodera glycines
  misc_feature (78)..(79): n is a, c, g, or t
  Promoter: Source sequence=SeqID_26412; Location=2263..2504; Strand=-; Gene=SeqID_57145
cttttttagtttctaaatttagagatattttcctagttttttttttgaaaaacctgattaagttttctaaattttttnntcgtgcattgtaaaaaaataagaaaagatttagaaaaaaaatacatataaaaaacctctctaagaaattcagaaaaaaaaaaatttgtcgctgggagggaacataattgaacctttgtttttgtctatacaaatttataacttttttcagccaccgaaccatg

SEQ ID NO: 99028 - DNA, 389 bp, Heterodera glycines
  Promoter: Source sequence=SeqID_12418; Location=1..389; Strand=+; Gene=SeqID_76025
agccattgtcccttatctgccgcattaattttctttcttgttgtaatcacaaacttttggcaaaaagacagaaaattttgtcactattttgcattgttcattgtttttatttattgctaattttttaaatttcattttattttaataaatattaaaaaaagataataattttttgcccgaattttacccaaatccataaatttttaacactaaaattaccgtacttactgaattagtagctccgggggttctatttttcaacctcccccctcgaaagggggggttctaatacagaggagggttctaattcggaggggggtacgaattcagtaagtacgttatctatgcctttttttatcagaattataattaaaattgtacaaaaaatg

SEQ ID NO: 99029 - DNA, 150 bp, Heterodera glycines
  misc_feature (17)..(17): n is a, c, g, or t
  misc_feature (28)..(28): n is a, c, g, or t
  Promoter: Source sequence=SeqID_576; Location=1235..1384; Strand=-; Gene=SeqID_56554
ctgacagagaattttantttgtaaattntgaggaaattcagccactggtatattattttgaatttaagggacttttggaactcggagtcagtgtcgacgttttggaagacgtggaacattcccgtccaccggtgggctattcaccacatg

SEQ ID NO: 99030 - DNA, 545 bp, Heterodera glycines
  Promoter: Source sequence=SeqID_304; Location=1..545; Strand=+; Gene =SeqID_81641
ccgagcagctttcctaaaactcagcaaaaagtccaagaataggtgtattaattcaaatgaattaccatcattgtggaattctgccgaagaatcgcgtatttgaaaaatgaattattgtcgaatgagaagttctacagaagaatcgcgtttttttaatggctcaggaaagtaccaaagttttgggtcaaaaattccctgggggcatttatcaaaacaaaagcccacccgccgtcttccttctgctaatgactacccaattagcatttcccccttccctttgtgttttcggttgcttttgttaatgattgattaatttgttgggcctttgcgccgttcgttccgttgcctttgcccttttttgtcctttgaaattgccttttttacgtgtgcttcgttcgtccccagctgtctgttgttttttccttccaatcgatcccttcgcttttcccccatttttcctttggccatccgttcgctcatttttctccttttccgtccgcttaattcacttggccattcatttgtcgtccttccttcgcattatg

SEQ ID NO: 99031 - DNA, 128 bp, Heterodera glycines
  Promoter: Source sequence=SeqID_12967; Location=3730..3857; Strand=-; Gene=SeqID_76723
tacgattgtctagccttttctcgcccgccccctttaggccactttccagcaaatgcagaccaattacgtgccggtgaaaccgacgagagtgccagcgcaacgcgcgatgacttccgccggaggctatg

SEQ ID NO: 99032 - DNA, 221 bp, Heterodera glycines
  Promoter: Source sequence=SeqID_8414; Location=2957..3177; Strand=-; Gene=SeqID_67982
gttggcttccgcgccattgcttccggtctaataattttatttccttataaaaagagcataaaagaaaatcgatttataaatttatttttatttagaataaattttcgaatggaaattcttttttcaacctagattttttactgtatatttttgagaatttttaaaaaagaatattcataaaattccaattcttacatatttaattcattttagtaaatatg

SEQ ID NO: 99033 - DNA, 270 bp, Heterodera glycines
  Promoter: Source sequence=SeqID_37676; Location=83..352; Strand=+; Gene=SeqID_66686
taattttagccaaactttctacgagtgctgcaattgggagcttaaattctgttctgaagaatttccccattaaccaataagaatgtgatcgaatcgctcgaacaggacgacacactcaaaaaggtgatgaaatttgtgcgcactcaatgtcccgacaaaaagacgatgtcagaggacattgtcccttttcaccgacggagagaagcgttgccaatactggccagaaattgacaaaaaaattgaagaagttgttcgttcctgccaaatatg

SEQ ID NO: 99034 - DNA, 740 bp, Heterodera glycines
  misc_feature (43)..(43): n is a, c, g, or t
  misc_feature (49)..(49): n is a, c, g, or t
  misc_feature (51)..(51): n is a, c, g, or t
  misc_feature (54)..(54): n is a, c, g, or t
  misc_feature (61)..(61): n is a, c, g, or t
  misc_feature (72)..(72): n is a, c, g, or t
  misc_feature (85)..(85): n is a, c, g, or t
  misc_feature (90)..(91): n is a, c, g, or t
  misc_feature (93)..(93): n is a, c, g, or t
  misc_feature (96)..(96): n is a, c, g, or t
  misc_feature (98)..(98): n is a, c, g, or t
  misc_feature (103)..(104): n is a, c, g, or t
  misc_feature (106)..(107): n is a, c, g, or t
  misc_feature (112)..(112): n is a, c, g, or t
  misc_feature (115)..(115): n is a, c, g, or t
  misc_feature (119)..(119): n is a, c, g, or t
  misc_feature (125)..(126): n is a, c, g, or t
  misc_feature (131)..(131): n is a, c, g, or t
  misc_feature (133)..(133): n is a, c, g, or t
  misc_feature (136)..(141): n is a, c, g, or t
  misc_feature (143)..(143): n is a, c, g, or t
  misc_feature (145)..(145): n is a, c, g, or t
  misc_feature (155)..(155): n is a, c, g, or t
  misc_feature (161)..(162): n is a, c, g, or t
  misc_feature (167)..(167): n is a, c, g, or t
  misc_feature (176)..(176): n is a, c, g, or t
  misc_feature (183)..(183): n is a, c, g, or t
  misc_feature (185)..(185): n is a, c, g, or t
  misc_feature (191)..(192): n is a, c, g, or t
  misc_feature (230)..(231): n is a, c, g, or t
  misc_feature (234)..(234): n is a, c, g, or t
  misc_feature (252)..(252): n is a, c, g, or t
  misc_feature (255)..(255): n is a, c, g, or t
  misc_feature (283)..(283): n is a, c, g, or t
  misc_feature (291)..(292): n is a, c, g, or t
  misc_feature (297)..(297): n is a, c, g, or t
  misc_feature (313)..(313): n is a, c, g, or t
  misc_feature (325)..(325): n is a, c, g, or t
  misc_feature (331)..(331): n is a, c, g, or t
  misc_feature (339)..(339): n is a, c, g, or t
  misc_feature (342)..(343): n is a, c, g, or t
  misc_feature (347)..(347): n is a, c, g, or t
  misc_feature (350)..(351): n is a, c, g, or t
  misc_feature (357)..(358): n is a, c, g, or t
  misc_feature (369)..(369): n is a, c, g, or t
  misc_feature (372)..(373): n is a, c, g, or t
  misc_feature (378)..(378): n is a, c, g, or t
  misc_feature (381)..(381): n is a, c, g, or t
  misc_feature (385)..(387): n is a, c, g, or t
  misc_feature (395)..(395): n is a, c, g, or t
  misc_feature (400)..(400): n is a, c, g, or t
  misc_feature (404)..(405): n is a, c, g, or t
  misc_feature (408)..(408): n is a, c, g, or t
  misc_feature (414)..(414): n is a, c, g, or t
  misc_feature (421)..(422): n is a, c, g, or t
  misc_feature (432)..(434): n is a, c, g, or t
  misc_feature (436)..(436): n is a, c, g, or t
  misc_feature (438)..(438): n is a, c, g, or t
  misc_feature (461)..(462): n is a, c, g, or t
  misc_feature (477)..(480): n is a, c, g, or t
  misc_feature (482)..(482): n is a, c, g, or t
  misc_feature (485)..(488): n is a, c, g, or t
  misc_feature (504)..(505): n is a, c, g, or t
  misc_feature (508)..(508): n is a, c, g, or t
  misc_feature (519)..(521): n is a, c, g, or t
  misc_feature (529)..(533): n is a, c, g, or t
  misc_feature (536)..(536): n is a, c, g, or t
  misc_feature (545)..(548): n is a, c, g, or t
  misc_feature (556)..(556): n is a, c, g, or t
  misc_feature (561)..(561): n is a, c, g, or t
  misc_feature (563)..(563): n is a, c, g, or t
  misc_feature (566)..(566): n is a, c, g, or t
  misc_feature (569)..(570): n is a, c, g, or t
  misc_feature (572)..(574): n is a, c, g, or t
  misc_feature (576)..(576): n is a, c, g, or t
  misc_feature (579)..(580): n is a, c, g, or t
  misc_feature (584)..(584): n is a, c, g, or t
  misc_feature (586)..(587): n is a, c, g, or t
  misc_feature (593)..(595): n is a, c, g, or t
  misc_feature (597)..(598): n is a, c, g, or t
  Promoter: Source sequence=SeqID_11423; Location=1..740; Strand=+; Gene=SeqID_74814
ggatgccaaagaaaaaagttatagcgaaaacctataaaggggngaaaancngcncacaganaaccgacaagnacctttaaaacgnccatnngncgncngaaanngnngaaanaancccnaaaacnngggananccnnnnnnancnccactcttanaaggcnnagaanccaaagggncgaaaancngcgagnngccaaggggaaagaagcgcaacagcaaacggccgaacnngcngagcaggaaggggccgangancagaaaaaggcgcagcaaaaggacccancccgcgcnncggcncccaaacggagggaangggccaagaaangggagncaaagggnaannaccnaannaggaannaagcacacagnaannaaacnaanaaannnccaggganacggnacgnnagncaccanaaacaanngaagaaggcnnngngnggccaaaaaaagagcggcaaaannggacccacggagaannnngnccnnnncagcaacaaaccggannccncgcccgacacnnngaagcagnnnnnggnaaaaccaannnnaaaaggcnaccgnanccnaannannnanagnnggcncnncacaannngnncaaattggccgaagcgcgcaagaattgtttgttcgtcgttttggagctgttttcggacgggcacaaaaagacgcaaatgccgaaagtgatcagcaattcgttagatgttttcccactgatcggcgcgcaactgatcaaaatg

SEQ ID NO: 99035 - DNA, 1003 bp, Heterodera glycines
  Promoter: Source sequence=SeqID_17910; Location=1208..2210; Strand=+; Gene=SeqID_82469
cgttgcttattatttatttctcttaaatttcaaataaatttcaatattgtaatttattctataaaagagatagtgtttatgaaccagaataaatttttatttgtgaaatttcctaaaaataaaatacatattttttccaatgtgcttattatattattgctaattccttcatttgtaataagcagttcaattaattaattctatgttccttccctaaaattttagcttatgatttctgagttattataaatcaaaaattcgattttaattttcatattattattcaccagtataccggatcattagttatgacattgaatgctcagtaagcatttataattatttttttattattaatattttggtcgatatttgattaactctgataatgaaggaaaaggagaataaagttgttatacagaatttgatctttttgtgtttttaaagttggcttcgtttaaaaatttttagtcttattgttacgcacataacgcatgtaaatatatgtttaaaatttttgcatttacaataattatattttttgttacttagggtattaactattttttgctgtgtaattgaataggcaattgagacaattattaaacagcatttgcatttctattataacgtacaacatatagtttttatttgttaaagggttgtattttatttatttattgtctataatcttatgttgaaatgatgatgcttttatgtttctctttgcggggacatttatgatatgattatattatatggcactaaatacattttcgtcttttttagaagaaaaaaaggaatttaaccatttaatttattaaatacaagaatggaacattaatatgactgattatgaaagatcattaataaatgcttttgattgtttatgacaggtttttctcgggaaaaatgttttattatttgttgaaaattatttattggctaattttttaaattattattttttattaatttaatttcttttttattttcgaggatg

SEQ ID NO: 99036 - DNA, 111 bp, Heterodera glycines
  misc_feature (91)..(91): n is a, c, g, or t
  Promoter: Source sequence=SeqID_23241; Location=1516..1626; Strand=-; Gene=SeqID_53952
aaatttttcttggcgataaagttttgcttcgtcatcgccaatcgcaatcatggcgcgctgggatcgtcagccaatgtcagggagtcattancgaggtaaagtttccgaatg

SEQ ID NO: 99037 - DNA, 1003 bp, Heterodera glycines
  Promoter: Source sequence=SeqID_11046; Location=73..1075; Strand=+; Gene=SeqID_74378
ggggggggggtaaagtgcttcatcgaataaggggcagcttattgccaccgattcgatggggggagaggggggggggtgaaaagtgggggcaccggggggagaaagagacgcaaaattggcggtgaataggaaaaagcgatgtggatgaatggaaaatggaaaaaggtgatgatggaagaaggaagattcacaatatttttttttgttgagctttaactttaagaaaatgtttccatttttatttttaaacgatttttatttttttgaattttatatttaatacaaaaatggaaaatcgttgcaaattctgctgttgggttaagaaaacaaaagaaaatgagtaaaaaatggtggaggtaaaaatgatttatgagactgaaaatggaagatggaaaaaatggtgccggggagggaaatgaagaaaattttagaaaaaaataatcgtgcatagagatgattaatgatgaacggaaaatgaagaggaatgatgaaagggtaaggggatttttatgaaaaaaattttggtgtgtgaaaaatgaaggtgagaaaaaggatgatgatgaattggtgaagtaaaatgaagaggatgaaaggaaatgagaagaatagaaaattataaaaaaagggatataaatttggaggatgaaacaaatccaatacaaagaaaaatatggcttaaggagaatttgttgggtgaaaatggaggtgggaaaagggatgaagatgaagtgaaatttttgagggaaaacaaagaaaaaattatgacgaatagaaagatgaagaaagaagaattgttgaaagaaataaattcaaataaaaaacttaggatgtaaaagaaagtgccgattaaaaaaacggcactaaattggtaggaggaaattaaaaggaaggaaaatggcttagaaaggaagaagatgatgatgatgaattgatggaagaacaacaatggagctggaaaggttgacgatgaatataatgaagagggataaacactaaagggatg

SEQ ID NO: 99038 - DNA, 79 bp, Heterodera glycines
  Promoter: Source sequence=SeqID_10548; Location=337..415; Strand=+; Gene=SeqID_73784
attacaatacttaatgattaaatgttggcacatttaaaattaattaggcgagcatttgggccaattttttccaccgatg

SEQ ID NO: 99039 - DNA, 93 bp, Heterodera glycines
  Promoter: Source sequence=SeqID_5034; Location=2974..3066; Strand=-; Gene=SeqID_56659
ttttaggtagacaaaatgtaatccaattggactgtatgcacgcaattgacaaggtcaacatttgtaatgatatagaagttaaactgaaaaatg

SEQ ID NO: 99040 - DNA, 699 bp, Heterodera glycines
  Promoter: Source sequence=SeqID_3841; Location=1..699; Strand=+; Gene= SeqID_52094
ccggacccctttctttcccaaaagttttttggaaaagcgcgccgaaaaaaattatgtgaaacgtaaatctgaatttctaataatattctatcacttagtccaaaaatgattaattgtttgaaataaatgaagaaaatttgatttgaaaattttcattaatttaatttagctttaacttttggattttattaaataaaaaacaaaataaaaatttaattttgtattattttcagttgaaaaaaaattaaaatttgaatttttttaaaaatttttgaatttttttgaattttaaaaaattcccggttggtcccggttcccggtcccggtttttgcaaaaattcccggtcccgtggcactctagtttcaagcctcccaaagagcgtaaataaacacaaaaaaccttaaaaaactgattcaattattatttgctattttttattaccttttatttatgtttttgtatgaaaaattccttttccaaaaaacattaaaaatgtcttttataattcgaaaaaagcaaacgcagacattccgcagcagttgagtgagatcgcatttcatttaatggatttttccgctcttccaattatttgcccatttaaatgctatcattccccaacagttaaattccttaaattgaataaaaattaattaaattaaaaaagcatatttaaataaattttaccgtgttaaaaaatg

SEQ ID NO: 99041 - DNA, 1003 bp, Heterodera glycines
  Promoter: Source sequence=SeqID_3061; Location=1204..2206; Strand=-; Gene=SeqID_83018
tcgaaaattttggattttcgactttttgttcgaattcgggtccgagttcggaatagtcttgaaaccattcgctagctctaaaaattctctattagcctaaaaatttcaacaaattttgtttaatttgaacaaagttatagacaaaagtacacaagcaagcaggttagttgattttgggcaaatatgaataattttttattaaaaaattttcatttgatcgttttttataatgctgttattgatgatttttatataagtttaagcatcgatttaacagccaatttacgttgcaaattttcactgttgaaattatttaattgacttccaagggaaataactaacaaaagtgaagaatttggagaaaggagaattttttctttgtttttaaattaaaattttttttattttatggcaaaatgttacatatcaaaattttttttaaaaattatgatgttacaaaaaatatgaattgataaaaatcaattctaatcaccgaggggtcatatgagaagggggtctggggttcgagtccgcttggctgcggtttatttactcgaaagtcgaaatcggcagaagagacagtagtaaaacaacaaaacaggatgaaaaaaagagcaacttaaaaggaaaaacaaacttgttcataacttttggtatattgtaaatcattgtgcataaactttgtcaacacgcaaagtataagttgaagcggaaaagcgatgaataggagatgaagcgggtggaaaaactgagtcgggcgcaagcgcggaaaggtgtgccaaaaacggatgcccgcgccgtaaagaaggaagcaagcggaacaatgcgcggaaatgcgagagcggacgcaccgcggacgacagtgcggcggacagtggacattgcttgatagggtttaaaatgcaaaatttgggccactgtcataatttacactaattagctaattagagaatgagtctagcaaatcaaaaattgtgaattttacccagggaaaagcagaatg

SEQ ID NO: 99042 - DNA, 290 bp, Heterodera glycines
  Promoter: Source sequence=SeqID_1547; Location=1249..1538; Strand=-; Gene=SeqID_74384
agcccatttcgagaaagaattactcgattgagtaaatttcggcataaatttgaagagaaaaaaaggattttcgatgagagacctattttgattttggcaacaaatgtcgggacgcaaatgtccgaaaatggcccttaagaaatgggccgcaaatgtccgaggcgcaaatgtcgggccgcaaaagacggaccgcaattgtcgtttttggctggtggccgcaaatgtcgtgacacgaaatcaacaacagcaaaaaggaaacagcgaagggggaggagaaggaagagaaaatg

SEQ ID NO: 99043 - DNA, 166 bp, Heterodera glycines
  Promoter: Source sequence=SeqID_41101; Location=568..733; Strand=-; Gene=SeqID_69294
ggtgggtaaagaagagataaacaagattaaatgataatgagagaggcagaaaagaagtgtgaaaagaaagagagaatgagggggcgacaaagggaaaagaaaagaaataggggaaaagatagtagggggaaagacgacaagagaaaaaagtgggaaaacaaaaatg

SEQ ID NO: 99044 - DNA, 256 bp, Heterodera glycines
  Promoter: Source sequence=SeqID_9906; Location=350..605; Strand=+; Gene=SeqID_72935
aaacagcggaccaattaaatagaacatccatttgtgactttaaaataataaatgttcaacggtagtttaaatataactctttggttttatgaagaacaaattcaagttctggcttttgttgtttctcattttgttccttaaaatttatcatatctaagagagaagaaacgatgagtgagatgaatatcaattcttcgtctctaaggtgaaaatctttttaacatttggtggggacaatgttcgatttaaaattatg

SEQ ID NO: 99045 - DNA, 130 bp, Heterodera glycines
  Promoter: Source sequence=SeqID_11693; Location=525..654; Strand=-; Gene=SeqID_75175
tctgctatttggcccatttttttgataattcgatgcaaaaaaggcggtaaattttttggcgttttttttgccataaaatgccaaaagtgaaaacaatttttacagtaacccaacagacgtccacgcgatg

SEQ ID NO: 99046 - DNA, 672 bp, Heterodera glycines
  misc_feature (266)..(266): n is a, c, g, or t
  Promoter: Source sequence=SeqID_18158; Location=1..672; Strand=+; Gene=SeqID_82742
gtagagatttaaatttaataattggattaacgattttattaatttcggggcacatttttaaataaaatgggaattaatgaaaaaaacatttaaaactaatcattatttacttaatatttgccaatatttgttcagtagaacaaaatttattaaatcttaataatttttattttacattaaataatttttttatattgtaaaagcagaagatttagatttatattatttataaaaataaaaaattaccaaatttatttttgagaatntaagaagaaaatgaaactccacctattattagttttaattatatttttaatcatcgaaattgatcaaattaaaacggaaaaggaaaaattacaacaaaaatcatttgaggaaatttttggagaaaaatgggaagaaaaagaagaagaaaggcgaaatgaactcaaaaaaagagaaataattgcaaaattttataaaataaaagagaaaatcaagcaaaaaggacgaaaatactcaacaaaagaatgtaataaaattgaagaaaaaataacgaaaaaattggggacaaatcgaaggaaaatttatgaatggattaaagaattggggcttcaaaaacaaataaagaaaagctataaatcaaaaagtgatgaacaaaaacatgaaattgttcagaaatttattgaaatg

SEQ ID NO: 99047 - DNA, 544 bp, Heterodera glycines
  Promoter: Source sequence=SeqID_2782; Location=5636..6179; Strand=-; Gene=SeqID_81561
atagattgattctgactgatcactctcatgtaatgggctttctaaattaaccgctcacatcacagcagatagatcagcgcatttacaatggatccatggggcgatatttttgaaattttatggtcagaggttcggagactagcaacgtccctggatatcgattgcttagctactagaaatgtcctcatcaacgcatgtaactgatacatggtccgagaattttgaaatattgtggtcggagttcgggattatcccctccctggatattaactgagtaactaacataattctagaacataatctcgaagttgtgatagcgatgctgctcggactctagctagtatattatagcactaagtgctccccgcccgcccttcccctttctttacccctaaagcttttccacagagtccgacatttgcccattggaccatgccagcgccagcattcttggctttgtctattacaacacgtgagcttggcttttcccaaagttattttctataattttgcacttaattaaggtctatccgttttaacaatg

SEQ ID NO: 99048 - DNA, 192 bp, Heterodera glycines
  Promoter: Source sequence=SeqID_20142; Location=1..192; Strand=+; Gene=SeqID_84928
aacgccgccgaatggagaaagatttattaacaaaaaaatacagtataatgacgaaaaaaatttattaaaaaaattacattataataagaaaaaaagatggtaaaaaataaccccccacacccaccggtttaaaaaaattttttaaaatacagtacccgaaaaaaatgcgcgaaaaaattttgcgcgaaaatg

SEQ ID NO: 99049 - DNA, 56 bp, Heterodera glycines; identical to SEQ ID NO: 98501
  Promoter: Source sequence=SeqID_4818; Location=831..886; Strand=+; Gene=SeqID_55839

SEQ ID NO: 99050 - DNA, 171 bp, Heterodera glycines
  Promoter: Source sequence=SeqID_24508; Location=1..171; Strand=+; Gene=SeqID_55238
taatgtgtgcaaatatgtacaaaatcacttgcgacgggcgccggcattcacacagacgctacaaaaaaaagaactgtgtgtgctgtgccgtccgtgccgagtgcaaaatatgccgacaaattacttcgttcagaacaaactaattaatgccaatttgtttccagacaaatg

SEQ ID NO: 99051 - DNA, 132 bp, Heterodera glycines
  misc_feature (7)..(7): n is a, c, g, or t
  Promoter: Source sequence=SeqID_16972; Location=1..132; Strand=+; Gene=SeqID_81396
attttantctcatatcatttgaaaattttaattttgtacaaattttgaatgaatttaccattttaaggcttggtctgtgtgattctgggcaattttgcgtccggttttgccggcgtttacgtggagaaaatg

SEQ ID NO: 99052 - DNA, 858 bp, Heterodera glycines
  misc_feature (6)..(6): n is a, c, g, or t
  misc_feature (19)..(19): n is a, c, g, or t
  Promoter: Source sequence=SeqID_6099; Location=1..858; Strand=+; Gene= SeqID_60328
gatttntgggcgaaataanttcgcgtcaaacaaacacattttttattgcatttttttgtcaaagaatttctgtttacatgaaatatcgaaaaatgctaaaaatttttacaatattgacaaaactccaaaatattgaaataaatattttttttcaaaacccccaaaaattttgttttattgaccaatattgacgttcaaatgaaaaaattcaagcgcataaatccgtttttgagcttctttcttcaacgcatataaacaaaaaaaaattgaatatatatgttaattccatccctattaattatcttagaatcagccattaagaatacctatatcgaaaatgaaccatttcattttatcaacgtaactccttgaactctatgcccgtgggattgatttcttgcctgaaaaatggcaactcattatcgataataatggctggtgttttaaacgtatttgaattttttaaatttttaaatagatttttttgctaaatttaaaaagaaattttgttttttttttgcgcaaattaaaattcaaataataataattattatatttgacaaattctgcagataaaatattttttacattttattttcacatgtatgaagaaaatcaaatacatcaataatcgatcatatgcattgtttcatgcaattgtattcttctgatggcactcgaatatctgccatattattatacaaattcatattatagtttttataattctatatttaatattaaaataataaaaatattcgtaaattcactttctcgaaccaatttatacattactctaattaattgtcgtgaattagcttaacattctctaatttagttgagaaaaattgttaaatg

SEQ ID NO: 99053 - DNA, 175 bp, Heterodera glycines
  Promoter: Source sequence=SeqID_15965; Location=2083..2257; Strand=-; Gene=SeqID_80320
ttccttttgcgtctgttaattttgctttaaaatgaattttggccatttcaatcaatcgattccgatcaaaaaatcattcacaatttttctttccttttctgttgtttttatgtgttggccaacctcagctcagttcttttcagtttcattcaatgattaccttttttgtcagatg

SEQ ID NO: 99054 - DNA, 509 bp, Heterodera glycines
  Promoter: Source sequence=SeqID_3671; Location=214..722; Strand=+; Gene=SeqID_51375
gctgaagggcgctgttttgcgctatgcgaaagcgatcgaactccgtctcgggggagaaaaagaaaaatcgacgaatgtcattatgatggaaagtgctgtcgcccctttttattcaaactgatcaggaggaccttccctagtaataatgctaggggaacctttgtttttcttttaacgccaataaatttattgaccaatcccaaattctcggatgaacatttttatgtgcgtaatttggccttcgtccgccccctttggagtcgataattcattcatttgaaaatttaaatgtcgaaacataagcaattggtaaatttcagtgcatttacacggcgagtcaattttgggctccaagtagtgaacgacaaaacgacgttttagtcgtttaaaaaaaagaaacgatttaacatcgttttgttaattttaacgatgtgcataacgccaacgatgttttaacgatgtttttttaaattacgaattatagaattgaaaaggatgtaaatgaaatg

SEQ ID NO: 99055 - DNA, 1003 bp, Heterodera glycines
  Promoter: Source sequence=SeqID_7836; Location=479..1481; Strand=+; Gene=SeqID_46481
aaatgcgtcggaacaattttttcccaactcttttttttggagtgcggatagcgagaagatagacaattcatggccatggcacattaacattaaggttctggacggttttatgcgtcccataacatattatgcgtcccatgaagggaaccggccattttggcgcaagactatatcattttgatttcacagcaaaattaaataatcttggtatgattttaagtggcttgatagtgcctattaacctgcaaagtttcaaaaaatttagctgagaaacaaaaaagttatggccaaaaaacctcaaaaaattgcattttcctggccattttggcgcagcgcgccatatcttttttaaaacctaatataattttttgaaattttgcaggctaataaagaacatttagacctattgattaatatcaacattattttatttggtcgaattaaaaaaaagttatgaatctttaaacttgtctgcgccaaaatgaccccgaccctcccatgaatgaccgaccatcctggtatcaaatgaaagctaaaagtctcaggattttataaatgcaagaaaagtgcaaacactggcattaaaaaagaaattacaatgagaaatcacgcaattcaactttttcgagaataattttttgtctacttatataaaagcttctatagaccttaagctttcatttgataccaagaatataagtattggccaagtaagaaaaaagttatggcctaagaaactgggtatggtcattcatgggacgcataaaaccgactagaaccaacattaaacgaattgcctaaaaacgaattggaatttttaatgaccaaaattgaaaaggagttaaccttccttctgtattagacatattcccaaggaagagtaaattattttccgaatcctcccaatatgttaatttcatatttttatttccattctttttaagtggatttgttctttattcattgcttacaaacaaaacccattgattcttcgtcaaaaatg

SEQ ID NO: 99056 - DNA, 738 bp, Heterodera glycines
  Promoter: Source sequence=SeqID_3436; Location=5696..6433; Strand=-; Gene=SeqID_84677
gggtgagtgagtgaatgcatcaatttgtgttcacgacgtgtgcacaacgttttccaccacttttcagaattaaaaacaaaattaaaacaaaaaattttatgaaaaaatcttaaaacaagaaaaaagaatttaaaaaatttccaccgattttagaaccagtggacacaccgactcaaaaaatgagacataagtcattaaatagagagtgcagagaaagacacatttctctcttattggcgaactatttctttacagagaaagaaaaaaaaacttaaaaaatgacgattttcgaaatcatttttgagagtttatgcaaaccaagctgaacaatcttggtatcattcgaaagctcttgatgaggagaagctttttataagcaaacgctatacagttgaatgagttagaaaaaggatgtgtgcgttcgaaattttgaatttgaagaaaatcaaaaatgttcttttttcttgatttttaaaatttgtggacgtttttttcaaatgactcaaaaaagacaaattttccattaattacttactgtttccatcttttaaaaataacgaaactttaatattggaaaaagtttttttttaatttgtatcaacttgcaaaactttgcaaaaatacattaaataaattttgacgaaatttcttaatttttacccataccgcatagattttaaaaataatatcggaataaaaaaatttatgggcctacgaacaaaaaatcagacaaaaatg

SEQ ID NO: 99057 - DNA, 68 bp, Heterodera glycines
  Promoter: Source sequence=SeqID_24440; Location=1035..1102; Strand=+; Gene=SeqID_55175
tttggtggtgccaacgctagcccaacaggacagcaggtaggtggtgaataggaatcacttgggtaatg

SEQ ID NO: 99058 - DNA, 63 bp, Heterodera glycines
  Promoter: Source sequence=SeqID_33398; Location=1053..1115; Strand=+; Gene=SeqID_63470
ggtggcgccgccttctcttgcacttcgtttttcaattcttttttcccttggcaggccatcatg

SEQ ID NO: 99059 - DNA, 981 bp, Heterodera glycines
  Promoter: Source sequence=SeqID_517; Location=1357..2337; Strand=-; Gene=SeqID_55093
gagaaaaggaaaaacgtgtgaaaatggataaatgtgattgaattgataatggccaatgggaaataattaaatgagggaaatgcgtcgaataatccttacaataacataaaaacttatttcttttcctctccgtttggcatactattttcatatctctacccaatgaaaaacgtgaaattcgcaaatgctaacaattttcgataaaatggtataaaatcactttaattttttagaatcaatataaaaagaatcaatttacgcattttggttaaaaacggcggcctagggcttgagttataacgtaatgaaaatttaaaactctcacaacttttttctgacatgacaaatgcttagcacttgcttagaaaatattcagcttttcaaaaactttttttagataccaaatttgttcagtttagtggggaatgaagcgagttatggttgatcaaaataaagaataccaaaaggcatttacccagggctcccaagtgtgcttatttctaagatttgtgcttattttgaggggccggatcttagaaacctaaaatgtgcttatttcagcattacgtgcttattttgggatttgaaaataaaaaaatgcaaaattttaatgaatgttttgaattatcgttttttattgaagcgaatatttgaattactaattcgattttgaaaaaattcaaatttatttcgttttattgagtgtaaaatacccaaaatttcagagaaaatctgtaaaaaacagtcaaaatttctatttttcctccggcggcgcttttcggctccgcgggtccccaaaacttatttgttttcttaaaaattggctcaaaatctcaaaaattggtcattttctggcggaactctgttaacaaattgggcgctacttaaaaagagtattcttttgaaaattttttcactttttttttggtcaacattttttttttgtttgttttgatacagaatttgtttttttaacagatg

SEQ ID NO: 99060 - DNA, 77 bp, Heterodera glycines
  Promoter: Source sequence=SeqID_14547; Location=1532..1608; Strand=-; Gene=SeqID_78616
attcttcctttttagcctttctttttgactttccattgactgtgccttttcgtcttcaattttgttcatccaaaatg

SEQ ID NO: 99061 - DNA, 532 bp, Heterodera glycines
  Promoter: Source sequence=SeqID_25493; Location=602..1133; Strand=-; Gene=SeqID_56231
aaaaaaaaaattaattttttccaaaaaatttgtggccaaaaattaataaaaaaaaaaaaattccaaaattggaaaattaattttttcccttataaaaatacaatttttcggaatgtataacttttgccaaactcgactcaaggggtgagttcagtaatttttttatagacacattttcgcaaaattaatcacttttaattcgcaaagaaaacgagtcgaaggcaaaaaaggaaccaagtcatcaaaaacaatcagaggagattattattttttattttatttattctttcattcatccattcaattattaggtcacagtttttaatggcaaatttaaatatgaataattcctatgggtcatcattttgcctcaatttattcttaattgaccctaaaaaatatttaaaaaatcagcagaaaaataaatgctcatttctttattctttgaaattttatcgaaataataattatatattaaaaaaacatctgaaaatgatttaaggaatttgaattttcaatacctttaaaaatg

SEQ ID NO: 99062 - DNA, 137 bp, Heterodera glycines
  Promoter: Source sequence=SeqID_2263; Location=1982..2118; Strand=-; Gene=SeqID_78779
ggtagggctcaaattccggcaaaatggagtttcaatcccccgtaatcttatcccggtctgaggccaatccaaattcccgactttatattattttaagtttgaatttaaaaatttttcagcattttttctgcaatatg

SEQ ID NO: 99063 - DNA, 144 bp, Heterodera glycines
  Promoter: Source sequence=SeqID_16758; Location=2335..2478; Strand=-; Gene=SeqID_81169
tttgggcaataattttaaaaacaatttaaattgtttttataaaccaaaaaccgagtaaaaatgtaatgcctttctgtgtttggcactttgtcctcctcaaagttttgcgcattttttggcgaaaactcttcggccgatgaaatg

SEQ ID NO: 99064 - DNA, 206 bp, Heterodera glycines
  Promoter: Source sequence=SeqID_37337; Location=1..206; Strand=+; Gene=SeqID_66434
cttatccatgccatctatcatctatgattctttcatgcatgcattattcatgcaaacattcattcatgctagccttattcaatcattctttcattcattcatgccatgtgctttcatagaatcatgcgtttataaattttcatgcattacttataaatgtaataaatattataaatggtgcggaattagcttatcacattcagatg

SEQ ID NO: 99065 - DNA, 73 bp, Heterodera glycines
  Promoter: Source sequence=SeqID_17411; Location=550..622; Strand=+; Gene=SeqID_81894
ggtttgcaccatgtctggaacttgtttttaaaatattttctaggcatcttccgagttcggtcttttatacatg

SEQ ID NO: 99066 - DNA, 154 bp, Heterodera glycines
  Promoter: Source sequence=SeqID_13756; Location=1482..1635; Strand=-; Gene=SeqID_77676
ttaataattttaattttttggggaaattgatttgggaaaaataagaaagaatggcaaaagaaattgttttgatgtaaattcaccgccatcaaaaacatagtttgggtaaacaatctttcagttattgatcatctaggttaatccataaattatg

SEQ ID NO: 99067 - DNA, 303 bp, Heterodera glycines
  Promoter: Source sequence=SeqID_24361; Location=1422..1724; Strand=-; Gene=SeqID_55083
tttggggaaaagggataaaaatgaatgaaaaataaggaacgagagtctcgaacatcggcgattgcatttgtttacccaatcttttgacccgtagcaatattttggtcgataaacggaaaggatgaggaaacattttttaaataaactatggaacagaagagaatgaaaaagggtatataaaacgattcgattttaaatttggtaacattcatgatcaaagctccaaaaaatggccattaatattagtgacaaaaaatctttgatggagaatatttccagcctctcgcacctgatcctccgatg

SEQ ID NO: 99068 - DNA, 81 bp, Heterodera glycines
  Promoter: Source sequence=SeqID_14827; Location=1610..1690; Strand=-; Gene=SeqID_47238
tttaatggatgtataaatatttgaattcaattttcatttggtttagtttcttctgctgatgtttctaaggctggcaaaatg

SEQ ID NO: 99069 - DNA, 241 bp, Heterodera glycines
  Promoter: Source sequence=SeqID_5690; Location=1211..1451; Strand=-; Gene=SeqID_58916
ttttgttaatgaagtaaattactggggttagtgtgaagagagtggcaatgaaaagaaaggtgcaaaatttgaattttcgctgttctaaatcagcaggttgcaaattttgtggaggctgttgaagcggttttttcttcgtcttctattgtgagccaaagtttccgattgatggtctaagttttaattttttctttaaaaatatttaataatatttttaagagttttgaatacaatagggatg

SEQ ID NO: 99070 - DNA, 655 bp, Heterodera glycines
  Promoter: Source sequence=SeqID_15355; Location=1316..1970; Strand=-; Gene=SeqID_79613
aatatttgtgaaaatagtaaatataacaattagaaagaaataaaattacaatttaaattgcaaatttaattattagtttaattatcaaaaaaatgcaaaaatttatcattaattgaaaattggcttaaattctttcgcgaaaggacgcctctgattttaaggacagaaatgagaaattaatttgtcctttaattcatttgcaaaggataaaaaaatgagaaaggaaaggacaagcgatgaaaagagaaaagggaaattgatttttgcttctctgcgaaaaagaaaacgaaaagaaaagagaataaatgagtaaatttttcggtgtttttttactaacatttttcaatgtttttaaatattttatggtttaaattactttaaaaaactgagaaaaaactgaaagatttcatcgcaaatgaaaaggcaaatgtgccccttgtcgtgtcgttgtcgtccgtcatcgattgttcttccattttgcattatttagcgtatttattatttatttactcttttcgacgaccaataaattccattttcgggccgttttaagccaaaagcatttttcatacagttagcttaaatggtccgacatttttttcctattattttttgtgttgttttatttttcttcgaagagaccgatgggaaaatg

SEQ ID NO: 99071 - DNA, 188 bp, Heterodera glycines
  Promoter: Source sequence=SeqID_12241; Location=287..474; Strand=-; Gene=SeqID_75811
tacctaaatatatttctgtcaccaatttattgtttaaatcctttatcagcgattatcgtaaataaatacgatggcgcgaatgactaaatatgtcatttgttattattgcaatttctcggaacttccgaaccgttaattctgtttgttatttctggatctgattgtgtttttgttttctggtagaaatg

SEQ ID NO: 99072 - DNA, 95 bp, Heterodera glycines
  Promoter: Source sequence=SeqID_994; Location=474..568; Strand=+; Gene=SeqID_65599
ggtcgttctgctgattcaataataaatcccttgcaagtccaaaaatttcagtgccggcagagcatgcgcaaaccgtggccaacatcgaagccatg

SEQ ID NO: 99073 - DNA, 358 bp, Heterodera glycines
  Promoter: Source sequence=SeqID_16723; Location=1283..1640; Strand=+; Gene=SeqID_81122
tgtcagcaaaaagacaaatagataattaattaactaattaaatagggaaaattaattcggaaaaaaggaaaattaatgaaataattttaacaaatgttcttcgcattgctgatcagttcaagaagcaaatggaggagcatgaattttgtgtattctttcacaataattttaggctgtgaaaagcggaagaatttccgacaaaaaatcattggaaaatctttgcggggagggggcggccggactatctcagagttttgccaagggatgtaattctggggaagggagcaaaaaaagaaaaaattgccacccaaaatccaaatttggcaacaatttttaggccaaggaaaaacaacgaatg

SEQ ID NO: 99074 - DNA, 53 bp, Heterodera glycines
  Promoter: Source sequence=SeqID_8554; Location=2548..2600; Strand=-; Gene=SeqID_68511
ggtgcttgtgccaatttgctttttgaatttttaatttcaaaaattctcagatg

SEQ ID NO: 99075 - DNA, 70 bp, Heterodera glycines
  Promoter: Source sequence=SeqID_36370; Location=1..70; Strand=+; Gene= SeqID_65700
tctgtcacataaatgtaataatccgccatttttttgccaggacatttggtctgaacgtgccgatcggatg

SEQ ID NO: 99076 - DNA, 557 bp, Heterodera glycines
  Promoter: Source sequence=SeqID_15057; Location=1..557; Strand=+; Gene=SeqID_79228
ccaaatttatttccattgggacaaaatcggacttggaatggaaattttgaaataatacggggagatttgagaatttccgaccaaagaggggaaattttgggaatttccgagggaattcaagaggaagaggaagtgaaaggcaaaaatacaaaataaatgcgatttcggatgaggcagctcagccttcggcatccaactcccgaaggtccctgaccccgacaatgacatttttgacaatttcaatgattctgtgctcatttttcgggactatttctggtcaataccaattatgttctgatcgggttcccaccacacccatttggttaccaaacgtaacggaatgttcagtaccggagtgccaaaaagctgaagagagaaaagttacactttttttacctgtccgaatgccaaaacaattctcagtttataactgctatcagaaaatgatgaaaatttgtacgggaaattttctttttttctggaaagacataaaaattctggattcgtacgtgaagggagtaagtcaccgagcttgtcagggatttaaaaataacatg

SEQ ID NO: 99077 - DNA, 722 bp, Heterodera glycines
  Promoter: Source sequence=SeqID_8081; Location=402..1123; Strand=+; Gene=SeqID_66923
ttcaaaaagcgaaaaaagaaaaattttacagctaaataatttgagtcaaatgtcttaaatgggaaccatggcaaaatatgcattttttttttgcactttgcctacttttctcggctcttctcgttatatgattttaaaaaaaaattttatgcagcgaaattttgaatttttttaatttgaaaaaattaatttttttgtgtgaccattcaaaatttgttttttttttgtcaaaagcaaaccgcaaaagcgaaactttcttaattctaactgaaaatggttaaacgcctcctctcttttttccacaaaaaataatgattttaaatatcggccgactgttaatttttgccgtttttataaaaccaagacaaataaataaacaagtatctctaaacatttaaagtcagtcaattttgcctcgaaaaaaagtcgaaaattcatttttcataatctaaaagatctaacagcagctgtgaggaaataaaatgcgttaaaaatgcaaatcaacggaagacggccaacggattttgaatgggagagcgaaaacgactagcaaatgtccatttcgtgcattttcatcgattttggggcaataaatgtgatttttggtgaaaaatgaatttttgacatttgtaaaaagtgaaaatgtggggcctaaatttaaatttttaaatacctaaaaataaataatttagcttattgttagtttttaattaaacataatg

SEQ ID NO: 99078 - DNA, 152 bp, Heterodera glycines
  Promoter: Source sequence=SeqID_20480; Location=1492..1643; Strand=+; Gene=SeqID_51019
ttttagatgttgaaatttaattgcaaaaattttataaattttttacaattaatttatcggggaactgaaattttatgcgcacttataaatatatttaaattaaaaatatataatttaaaaataaaattaattattattatgataaaattatg

SEQ ID NO: 99079 - DNA, 732 bp, Heterodera glycines
  Promoter: Source sequence=SeqID_15627; Location=1..732; Strand=+; Gene=SeqID_79917
ttttcattttatttctttcatttttcacgttttgagtgcccccccccccaatttcgtccacataaattgccaattactcgcctcaattggcgcagtttcttctgccaaattatttaacaaaaacaacacatttcgttgcagccaaaaagtttaaaaaataatttaaaaaagacaaaatgaagaaaatggcaaaagaacaaagaaaatggagaaagaagagacgggcggcgcgagagtcaaatcggcaaatccagcacaaaacaattgtcaaaagtcccattttcttctgatgcgattggttggccgtcgttcgtagcgaaaggctttttatgcggcgatttgaaagcaaagaccaaaagacaataaaatccttaaaatcaccactcattgatgagcagcaacagatggacgaatgaataaatgaatagggaaaagggggggggggggggacggatgttacgttaacgttacatgtgtcatctcttaataagcaacaaacaaaacgatttctccagctggcatgagatggacagtgacggaaggaatgtggcagccgatgagagaaaacggaaggacaaatgaaagaaaagaaaaagagaggaaaaagagagggggagagagacaagcggataaagggataaaaagcgcaattttaaatttatttacttttgaagagaaaatgaaggaaaagcgaagcaaatggcaaattaaaacggaacaattcacggaatg

SEQ ID NO: 99080 - DNA, 204 bp, Heterodera glycines
  Promoter: Source sequence=SeqID_222; Location=1631..1834; Strand=-; Gene=SeqID_78402
attgactgtcgcctctacattcccgtgactgcgcactttcccgaccgagctatcgcagctttcctggatccggaacttcgcatcctctcgctgacagcacaacatgcaagctgtaatagctaccggttccatcatcttcaactgcgaagcaatcccaacatctggttatggattgtctctcgaaccggcacagcacgacgaatg

SEQ ID NO: 99081 - DNA, 166 bp, Heterodera glycines
  Promoter: Source sequence=SeqID_24933; Location=196..361; Strand=+; Gene=SeqID_55674
ctaattgtggaactatggatgaagaacaaatttttcaaccttttgatgaagacaatatggaacaaagtcataatttcatggtataaacattcacccattattttataaatgttaattggcaatttcgaaggattatgaaagtggcacacatgacgacgcaataatg

SEQ ID NO: 99082 - DNA, 149 bp, Heterodera glycines
  Promoter: Source sequence=SeqID_3790; Location=391..539; Strand=+; Gene=SeqID_51887
ggaaagaaaatcaaataaaattctttcaattcaaagataaaatacccgcggaagtgccacaatttcaaattaacaacgaagaggcgacgatttttgccgctgtgaaaacggtgaacaaaatttcagcgtcctattttggtgtaaaaatg

SEQ ID NO: 99083 - DNA, 1003 bp, Heterodera glycines
  Promoter: Source sequence=SeqID_9532; Location=1200..2202; Strand=-; Gene=SeqID_71762
tgaataaaaaaataacaaatgacactattcaaccggataaaattgggagacatatccggaaaaaaaattttcaatttttttttcaaaaaatggaaaattttatcaaaaattcatattcaaaatttatttatttatttacttgactacatttttgatttttaaaatatttatctcatttccatttttagcacctatttggggggtttataatagggttgctccccgaccccgagccccctacctccgactttttatcccccgaccccccgacactaactcggggaattggggactcttgaaaatttttaaatttgtacaattttcttaataaaattaattaaaaattcctaaaattccgaaaaactttcggcggcgcctatcggaaccgccggcctcccaaaactccaaaaatttttttaccaaaaattggcttgaaaatcacaaaatttgacaatttttggataaaattctcttaacaaattatactcattttcaaaaaatttcccggcggcgcctatcggcagcgccggacacccccctcccccacctcagaggtgatctttcgctttttctattgataaaaatggtttattgtttttttttgggaaaagatttaaaaaattcaaaaaaaccgaaaccgaaacggtataccgaaaattttgcttcggtttttttcggtttcggttttttcggtttttaaccgaaaccgaccgaccgacaaatttttgagtttttcggtttttttcggtttcggtttttataccgaaaccgaccgaccgaccgaccttcttgtccggtctctactaaatcgaattgttgacttcagcccccccccccccccccgaagacaagggtctgccactacgtccttgctcgctgggcccttttaattttttatattccaacataagattaaatttttttttaattttttgaattttagcgagtcaattctgatgagtttcaaaatgaattcatgaccaaattcaacatcagcgaaatg

SEQ ID NO: 99084 - DNA, 55 bp, Heterodera glycines
  Promoter: Source sequence=SeqID_14292; Location=2519..2573; Strand=-; Gene=SeqID_78315
ggtacattttaatttgtaaacaattattttttaatgattttaggcgtgaacaatg

SEQ ID NO: 99085 - DNA, 564 bp, Heterodera glycines
  Promoter: Source sequence=SeqID_24090; Location=441..1004; Strand=+; Gene=SeqID_54785
aattggcaaataaggtggcaaataattcacatttctcagcactgttatgatagcatttattttcataaattagattaggtatttcaaagggattgacattgaattttgtatatatttataaattgaatttcttccctttgaaatagcctttttctcaatttggctatggtatttatttgtttgtatttttatatgtaaagaaatgctatcgtgtatagtgcttttttggatgggtcagttttagcttgcctgaataatttagccttttctttgatggatgctattaaatgttgtgggtatttaggagtcaaatcattcttggttaaacgctttattggaatacactcatttaaaatttttaacaacgtactgttaaaggcggaatatttttgatttatgctaaagcattcatatgacaaggcatttagccttgatgctatgactatattaaaatgtaacacattcgatggacaataccaacgaaagtttacgatctttgttttcggttttgttttaggagtaattaatgtaaaaaattgtgttaaatgatccgatgaaaatatg

SEQ ID NO: 99086 - DNA, 827 bp, Heterodera glycines
  Promoter: Source sequence=SeqID_12362; Location=1332..2158; Strand=+; Gene=SeqID_75966
gatttgtaattatatgaaatccatatttttttcctggactgttggaggcctgaaacgcatgaaaaacatgtttttagcttggtttgaagcctctaggaaggagttcttatccatatttttccatatttcgcgatttatttccatattttggcattaagtcctattaaacggcccccatcagctaaattagccgttttgaccccaaaggccgtaaaaatttccgaaaaagacattttttagcaaaattttgtcgaaaaaattgattaaatttaaattttcttaaaaattggttaatttatgtcaaaaataagcaaaaatggaaattttcgattttttggtttgttttctctagaaattgctttttttcttctaaaacgagttcttatacagtatttagccattttagatgtattttactagaatttgatgaatttgaataaacatttcaaaatttatccctcaattcggaaaatttgtgttctatttttgccattttatgcccatatttcgcgatttttggtccatattttatggccatatttcgagattttataatccattttttgcatccctagtaataacaattaacatttagtcatgcagagatcacaaaaaatcaatatttccctttttgtctataattttcgctattttcctcatcattttattgtttgccggaggcgagatttagtgataaaaattattaaaaataatctcattttttttcaacgaactgatcatatgtaattaacatatccattttccacacttaattaagatttaatttttccataatttgtttcagtaatttgcaaatgctcgaaatg

SEQ ID NO: 99087 - DNA, 632 bp, Heterodera glycines
  Promoter: Source sequence=SeqID_23406; Location=453..1084; Strand=-; Gene=SeqID_54113
tcgataataatgtttaatgagttccaatcaaataaaaacaaagattaatgagtattcaatcaattaaaaagaaactttaataaattcaattagtcgataataatatttattgagttccaatcaattaaaaacaaagtttaatgagttttcatattcctttggcagtcattttgattcaattttgcaaactattttacaattaagccattgccaacaaaaagccactttggtacatttaatgaagattgggacagaatttgtggaagtgatgaccagcagcaatgtgtgagaaagtttgatggcaaattccagcgcaatgttgtgtgtttttgttataaaaaataattatgcattgttaaattataacttaaattaaattaattaaatatattttatattcacttttagtttattccgtcgcttaaattggccggctgtttaattgcaaaaaattcaaatgttttcttggagtcgttgttttgctactttgcaaatatgaataaatttaacatcacaaatttcgattacaattatttgaatttgtttgttcatattttattaataattaaacgtgacttagagagaatggcattattttttttttaaattttagaccgagaattaggaagatg

SEQ ID NO: 99088 - DNA, 1003 bp, Heterodera glycines
  Promoter: Source sequence=SeqID_1411; Location=2610..3612; Strand=+; Gene=SeqID_73356
cttttccaatttggtgaatgaatttctcatgtaaaaagccttaaattttttctttatttggcaaatcaataaattttataaaaataatactttgaaatgaaaaaaagaattttctttattttgactttttcaaacaattaattttcattattatctctttcgatatttaacaaataattattactttttaaaaatttgcaaaaaaaaaaattttaaaaaaagctaatgaggtttttctttttactataatttaagaatttttttaatttttgcattcagccaaaaaatgaacgagaatatcaatgaccataaccaacaaaaaaagcaagaaaacatatgaaaaaaattgtaaatctttgaaaatctccgtcctcaactgggcaagttttcctttcttatgcccccaggctctccttttcggcctgctttgttgcggtaaaaaaataaatttcgattttgaaaaatcacttaaagaatatgattgattgcgttgagacaaaacgaattaatttttttaaatttttccctcggcaaataattcaattgaaatctttctatttttttcttggaaaatttccgggtcggtcccggtcaaaaatagaggtccctggttctggctgatttggtctcagttttgcacaacattcttgttcccgtattattattctcaattaaccaaaatttttgttattttttgtttgctattattacaaattaataaaaaaaatttttttttgaaattttcttttctcccattattggaaaggcaattaatgtatttgatggacagcacagatcacttacatatttagtcattcaatgataataataaatgtgatgattcagaaatgtatagcaaaatgtgtggggaaatcattcaatgaattaatttaatttcgttatttcgcattcacaattttgaaataacggataattactataaaatttgtttgtcaaatttagtcataatttaaaataataccaaatttatttttaaaaaatg

SEQ ID NO: 99089 - DNA, 388 bp, Heterodera glycines
  Promoter: Source sequence=SeqID_20732; Location=1063..1450; Strand=-; Gene=SeqID_51292
tattttgcgattttatatccatataattcctagccctacagatcagtaatcacgaataaaaaaatattccatttttaagcgtcatataaaaaataattagagctttggagaattattattatagataggtaaatggattcagaggagacgatttaatgaatttttttaatattgtttatgcccatggtaaagacaaaatccaacatcaaaaagcagttataatcaattatataattgataaatgcacatacgatgtccttaaaatggaaaacgcgcattgcttacataaattaatacgcattttgcaaatattagtctttttttaataagtttttgtctctcactcaaaaaaaaaattttccttaaatttaaatattcagcaaaaatg

SEQ ID NO: 99090 - DNA, 985 bp, Heterodera glycines
  misc_feature (35)..(35): n is a, c, g, or t
  Promoter: Source sequence=SeqID_31708; Location=1..985; Strand=+; Gene=SeqID_62011
tctcgccccataaattaataattgaacctaaattntggagttaaatgcacatatgaaaaagttttattttccacctcaattggcatgtgagcaattttcctctttcgaatgccattctaaaaagtattaaaaaaaataaaacatttgggtagaaatccagaaaaaaaatttgaaaggcttttttctcttctaaattggattttccttgctgcatatatattaaagaataatggagaagtgagagtggcactggcggtgccgggggggggggacacgtaatgttttgtcagatttatgaactacagattttgacaaatattgtccgtttttatggacatttggaacccgcggtgccgaaatttttaatgagagattgttaagaaaaatagaaaaatttcatccttccctgctaacaattttgacatgaaccaacggaaaaaagactaaaacctagagcactagacatttaaagcctactaaaaagtaaaaaataattatattaatttcaaaaaagaaattaaatttttaaatttagagaaaccaaaattaggaattaaaaaagtctcgtcttcgcgataacccgagacctggacgaaaaaactaagaattttctcgcgttgggaccgttactcatgatcaccaggggaaattcccggttttttcccgggtttcccagccaaaaagtcccggttttgcccaaaattcccggtcccgtactaccctactataaatctgaacgaaatgctgatgttttttggcattttgcccaaatttctttataaataaaataaatgccaaactatgtctcttttattaaccaattttaagcagctaaaattggaattaggtcattttcccatttttaggtctaattaggtcattttcccatttttaggtctaattttggtcgtttttagaccaataaaataagttttaaaaaaaaaattcattttaaggcacaaaaaagtgcttacatcagagaatg

SEQ ID NO: 99091 - DNA, 137 bp, Heterodera glycines
  Promoter: Source sequence=SeqID_34365; Location=1..137; Strand=+; Gene=SeqID_64184
tgatgaaatataatatataacgaaaatgcacatcgctgtccgtgtgctttgggatgtggtggacatcgagcggagactgagcacggcaccgctgggaaattggcacgggcgcaatttcaaaatttgaaattgaaatg

SEQ ID NO: 99092 - DNA, 309 bp, Heterodera glycines
  Promoter: Source sequence=SeqID_2510; Location=492..800; Strand=+; Gene=SeqID_80146
tccctgtaaattaataatgattttttatagtggcttccgccataataattttttttggcatatttccatttgaatatttaattttttgccattacattgggcccacgtattttttttccggcggaagtgccaaggaaataagcaaacagatgaaaatattagaaaattaaccagcatgaatatgaggaagtattatgaaaactatgtcaaatgaaagtgtataaaatgaagggaaaaatggaaaatataataaaataaaatttaaaataagtacgaaaaacaacaacatttgataatcatttcacaatg

SEQ ID NO: 99093 - DNA, 110 bp, Heterodera glycines
  Promoter: Source sequence=SeqID_36720; Location=369..478; Strand=-; Gene=SeqID_65971
agaaattttctatgcaacaaacgctctcgaacatgaaacgaagtgcggtgcgccgtggccattttatttttcaaataatttttaaatttaatagatattccagaaaaatg

SEQ ID NO: 99094 - DNA, 287 bp, Heterodera glycines
  Promoter: Source sequence=SeqID_29086; Location=391..677; Strand=-; Gene=SeqID_59644
aatttttctgggatttttctttttttatttcactaaaattaccatttttggtgccaaaactgttaaaaatgaaaaaaaaatcacataaatttttaaatttaggtatgaaatagtaatttattttaaatatttctttttgtttttaatttttatatgtttttctaataaaatcaaggaaaacaatttattttttttgtttttgtttcacaaaaataattttttcggagatcgcaaaaataagcacacctaacaaaaataacaccaaatcttagaaataagcacaaatg

SEQ ID NO: 99095 - DNA, 98 bp, Heterodera glycines
  Promoter: Source sequence=SeqID_39615; Location=734..831; Strand=-; Gene=SeqID_68138
aatcaattaaatagcttctgagataataaggtttatcataaaatttcatttaaaaataaaccctcaattattggtatgaacgatactttccaaacatg

SEQ ID NO: 99096 - DNA, 54 bp, Heterodera glycines
  Promoter: Source sequence=SeqID_2126; Location=1..54; Strand=+; Gene =SeqID_77976
caaggacaagcgctgattttgtgcccaaaaccgtaaaataacaaatctaaaatg

SEQ ID NO: 99097 - DNA, 145 bp, Heterodera glycines
  Promoter: Source sequence=SeqID_16831; Location=1342..1486; Strand=-; Gene=SeqID_81251
tttttgcgctttttatgtccgtatttcggtctttcttagtccatattttatgttttttattccatataatttcgagccctaatcattgtttaatttccgtattcagcaatttgtttgtcctatttttttcttcaaatttcacatg

SEQ ID NO: 99098 - DNA, 989 bp, Heterodera glycines
  Promoter: Source sequence=SeqID_15113; Location=2335..3323; Strand=-; Gene=SeqID_79296
aagtgatcactcaattgtcaattcaataattcactaaaacaatgccaaattgaagtgatcattcaaatgccaattcaataattcactacaattatgctcaatttgagtgatcactcaattgccaattcaataattcactagaacaatgccaaattgaagtgatcattcaaatgccaattcaatattttgccataatctaaatttctgccccataaaagaggtaccttcgcaagcggtgaaacaaccaataatcctgacatttattcattcataatcttttgtagctttctgattgccctccaaatttaatcattttgtagccgttggcattttcgctcaattaataacattgcttaccatgcttataatgatgccatcatcccgggttttgaccccgatagtcctttctcgttcttccaaagcctgaatcccggcccctctttttcaaaagtccggcctctagatttatgggtaaaaaggaatatatgtatgtccattttgaagtgatcttggatttaacaaattatacttttttaattaattgaaattaaagttaattttttaatttatttttgcgtaaccctcttgtccaaagataaatctaaaaaatgaataaaattcaaattttgagcttgaactagcttcggtgcggcataatcatcagtatgtatattaacccatgaaattatgcggcacttttcctcttttcgtccaccgaaattccctacggatccctaggaattgcaataaaaacataaaataacctcataagagtcgacttataaatctcaaaaaaaattatgggtaagggagggacgacggcaatgccacaggcaccgccgggaaaattttttcaaaaattagggtaagatttgttggtaagattggtcccaaaaataatcaaattttccccaaagcttcagaattctatagctaaatcgctcaaaaaatcgaggattaaagtaatatttaatatttcagaaaaaatg

SEQ ID NO: 99099 - DNA, 779 bp, Heterodera glycines
  Promoter: Source sequence=SeqID_21900; Location=895..1673; Strand=-; Gene=SeqID_52538
acttaaaaactgtgcaatttgtaatcaaatttaattcccacttaacaatggaggttttgcggtaaaaaagaatttgttagaaggttcaattatatgcaactagaaaaaagtggatatcattttaaagaatttttgaattttaataaacaaatttaaaaataataattttaatgacattttttaaaattttttttattaaaaacgtattaaagccgacaaaattataaaataatttattaattaagaatatgtggagaaaaaaaaagtcaaaactatgatacctccaattattttgattcaatgattcgattttatatgattttttaaattataaaaatttatttatttatttctttaagaaagaatgggaaaaaaatcataaaccaaaacaaagttaatttttagaaatatctctttttaataatttggtttttttaaatttatatattttatattaatttgatttaatttaactttacttttctaattatattgtataaaattaaatttgacaaagagtataaaaaaatatggttaaagtcaatcacttgtcgcagcatatttacaattttattaataataataataaaaattatttgtaagcttttgccaaccccataaatgtgcaggaaattcgtgcaaaaacaattttttgccacattaatggctagccaaacaaacgactaaataaaaagcctcgcatgatttatttcaaataaaaattaataaaatattgaaaaaaaatttttttttaattatttattttttccttaaatatg

SEQ ID NO: 99100 - DNA, 1003 bp, Heterodera glycines
  Promoter: Source sequence=SeqID_11842; Location=150..1152; Strand=+; Gene=SeqID_75344
atatttatccattatttgaaaaacaaataaataaacaatgtttttggcagaaagtaaattttgtttcaaataaaatattatataaatatataaagttcattatgaaattaaagaccaaaggaaataaatacaaacaaaaagttttaaattttatttgttatactttaaaaacataaagaacaaatagattcaacaaaacaacaaaaatgaattaattgttgaactctggttaacgcagaaagttaaataaaataacagcaatgaaaagccaaaatatttataaaaaaatagccaaaaattttcaaaaaaatacaaacttcggaacgtaaaaagcaacagaagaaaaaaggaccggaaaagacaagccttataatctgaaaaaaagttcatatacaaaataataaatatataggtaaaagacattgaagaagtaaaatattgatttaatgcataaattaattttttattcgatgctttatcctagatagtatttaaaaccccaaaatgtaaaacaaaaaatcgataaattaatcataaatattgtttaaaaattcggaataaggtaaagttgaatcaaaatccagctattaacgaaaaattggtaatttatattataaaatatctttataataaatataaatttgaaccaaaataataataatttgttaagcatacatttctgtttaaagaaaatcaatttccttaataaattaaaaaataatatttaaataagcaaagatttggatatatatttaaaaaataataattttaatcattttttgaattaaggcgggaggtgtttgttgacccaaagaatattctccaatttgacaaggttttactgaaaaatacaataatttaaaacacggtgataaacgtaaattaacaaccaggaataaaaagaataaagtattagaatatggtcttaaaattttttaaactaaacatacaagcttcagagtgaaaaaaagctatattaagaaaataggaatggaagagtatg

SEQ ID NO: 99101 - DNA, 245 bp, Heterodera glycines
  Promoter: Source sequence=SeqID_18812; Location=2016..2260; Strand=-; Gene=SeqID_83494
ggtgaaaagccaacctctgtggggttttcgggttttctgaccatgaataccttatgtatgatgtatgtataagattttcaaaaatgatgttttatcattgatttcgaaaaccaaatcaaagcattattctgcttttggccttgccaagtcttcttcatttatttaactttgtttcttttagagtttgtcatttattaaaatgagcataacgctcgccttttgattagtgagtcaacaaaataatg

SEQ ID NO: 99102 - DNA, 138 bp, Heterodera glycines
  Promoter: Source sequence=SeqID_38791; Location=773..910; Strand=-; Gene=SeqID_67506
tcactataaccagtccgtgccttcatttcggccgatttgcccaatgaactaatcgaacttctggagaagatcgtcctcgagaattcggcgtttaccgagaaccgaaacctgcaaaatttgctgattttgaccgccatg

SEQ ID NO: 99103 - DNA, 1003 bp, Heterodera glycines
  Promoter: Source sequence=SeqID_359; Location=2338..3340; Strand=+; Gene=SeqID_84292
gtcccagcactatgggtcaagcccagtgttagacaaaattactcataacgccaaatagcgtatttggcgtaaatttttgcgcgttaattcaaaatttacactggtaaatgccttttttgtattgtttattttaatcagacgtaactcacttcattcccaactaaactgaacaaatttggtacctaaaaaaagtttttgaagaggagaatctttttctaagcgaaaactaagcaatttgattttttagaaaaaagttgtgggagtttcaaatcttaattacgttataactcaagtcttaaactgctgatttcaaccaaaatgcggaaagtaatcatttttctattgattctaaatgtccaacagattttgtaccgtatcaacaaaaattaatataatttgcgaatttcatgatttttaatgtgttagagacatgaaaatagtacgccaaaaagagagaaaaaaaatgcaaaacttttattattccataacttttcaatttgacctattttaatattaacttgacctattaaccgatgcagaatttttttctctatcgctatgcaaaatttggtgtggatttaacaagtaggaaaaaagttaaacaggatgaagtgaatgttgctttttacataattaaaatgaagagatagtacgccaaagagagagaaattacaaagaaaaagagaaacgacgagatagtactaggcttttctctgcacagtggagttgacccatagtgtcccagcagtgttagacaaacaaatcatttcgccaaataatataattggcgtaattttttgcccactaattcaaaaaatacactgatcattgcctttttgcattgtttattttgatcagtcataactcgattcatcccaacaaagccgaacaaattgatatctaaaaaaaagtttttgaaaagaatctttttcgaagcaaatttacgaatctccgtttcctgggttccccactttagtcatcctcggtctgatcaaggatcatg

SEQ ID NO: 99104 - DNA, 171 bp, Heterodera glycines
  Promoter: Source sequence=SeqID_16117; Location=1315..1485; Strand=-; Gene=SeqID_80474
catcccaaatttgctggccatttccaatagacaaatgcacattatttttggccaacaaatcattttaatctccccccatccgttcatccgttttcaaatctctcacttttattttggtaggtatataaagaggtcgaaaagactttttggatgcataatagcgaaaaaatg

SEQ ID NO: 99105 - DNA, 281 bp, Heterodera glycines
  Promoter: Source sequence=SeqID_6760; Location=1..281; Strand=+; Gene= SeqID_62786
tttagtccacatcgaggctcaaaacgggcgcttctcctttatggtttaaattttgttggccttacagagattagaagccttacaacagtgattagaagagttacaattagaagagttttataggtagaggagtaaatttcccatccgaaaatgatgctaattttgccgtaaatccttactatacagtcgacgaagaaagctatttacagcttttccgagaaaatttggtcaaaatattggaaaaggcgaaaaataattcggaaattgcacggaaaaagatg

SEQ ID NO: 99106 - DNA, 125 bp, Heterodera glycines
  Promoter: Source sequence=SeqID_25254; Location=394..518; Strand=+; Gene=SeqID_55999
agttcgtcgctcttccatttctattttcattcatttttacttagatcgtcacagagcaacgtaattttttcaaaaccggcgcaactcgtgccgcggcatttcgcaaggaacagctgaagaaaatg

SEQ ID NO: 99107 - DNA, 243 bp, Heterodera glycines
  Promoter: Source sequence=SeqID_35819; Location=765..1007; Strand=-; Gene=SeqID_65285
ttttcagaaatcagattaattctccaatgtgcccaaatttagcccccagccacagcccctgcttctcccagtttaagtctggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 99108 - DNA, 457 bp, Heterodera glycines
  Promoter: Source sequence=SeqID_30053; Location=1074..1530; Strand=-; Gene=SeqID_60507
aaaaaattattcattaattaataatttgttttcattttatatggagaagcaacatttagatatttagttagtatagccaatcctcccttccccacaaaaaatgacacaaataaattatatacccaattgaatcgtctcgaggccgctaaggggattggagtaaaagtggtgagacgagacggagggcggagttatcactaatgataccaattagttaattgttttaaaaggctagtgatgtccaattttcttgacttttcggcttttaaactggtcagaaaacgccttaaacacattttggcactcgagacaattgattgggatatataatttgtgccattttttgtggggattggctatacctcatcccaactttttgttgaaaattcatgtaaatttttaacattaattttatttatttttgtttttgcgaattactttttcagtgccaaaaatg

SEQ ID NO: 99109 - DNA, 110 bp, Heterodera glycines; identical to SEQ ID NO: 98226
  Promoter: Source sequence=SeqID_10216; Location=136..245; Strand=-; Gene=SeqID_73344

SEQ ID NO: 99110 - DNA, 293 bp, Heterodera glycines
  misc_feature (38)..(38): n is a, c, g, or t
  Promoter: Source sequence=SeqID_14719; Location=1..293; Strand=+; Gene=SeqID_78847
gattagaagaggtaaaagagtgatttaagaggtaaaanagtgatttaagaggtgcaacagtgattagcagaggtacaacagtgattagaagaggtgcaacagtgattagaagaggtaaaacagtgatttaagaggtaaaacagtgatttaagaggtgcaacagtgattagcagaggtacaactgtgattaggagaggtacaacagtgatcagaagaggtacaacagtgattagaagaggtgcaacagtgattagaagaggtaaaacagtgatttaagaggtgcaacagtgatg

SEQ ID NO: 99111 - DNA, 113 bp, Heterodera glycines
  Promoter: Source sequence=SeqID_24690; Location=474..586; Strand=+; Gene=SeqID_55439
tttccaattgcctcccaattcttcagatacctggcgaaccatcggacactcttgaagggggtttagcgccattaaaaagcatcgacaccataaaatccaccgaaggcataatg

SEQ ID NO: 99112 - DNA, 1003 bp, Heterodera glycines
  misc_feature (506)..(506): n is a, c, g, or t
  misc_feature (518)..(518): n is a, c, g, or t
  Promoter: Source sequence=SeqID_12793; Location=2601..3603; Strand=+; Gene=SeqID_76526
tttgtgccttttccccgtgctcactttgggctgtttcggcggcgcttctcttcccggccaattccccggccaagtgaactttgacagttacgcagcaccaccgagttacaaaagtgagaagagttcgctcaaaaaatgatcaaaatgaatgtttaagcagcaccaccagcagcagttgcgagtcccctttctgctccaacaattactttggaggctccgccccctcctcccgctcctattttccctcttcctgctcctcttcctcctccttccgctcctctcttccctcctcttcctcctcctcccgctcctctcttccctcctcttccccctcctcccgctcctcttttccctcctccccaattaccgcaactctttcaatcgcctctcaaatactcccagccctcttcctattcaagtaatgtttaagcattggcttttttgctatctcttctcccttcagttgctcctcctccgtcttatagcgtttcgcccccctcttctcnccagtacgggtncgtgatgttatgtttggctatgcaaattgttgtgctttagaggccacttacgcaactccgtccaccgttccccccacaattccccaattgtattcagtcgttcctccgcagtacaaagtaagtcccgaaaaacctttctccccaaaagctttgccttgtcaaggttgaagcccctcagcttcccgctttcccaactcttccgccagtcgttttccccgcattgccaaatctgtccccgccgcctcctcccgagccaattttcttcgctgggcccccgccaccaccgcccgtgaaagtctcaagctattgttcgtagtcacgtatccctttcgaattgatccgaatgtttcagctgttgggccacagcctccgccgccgccaccccccgccccgtcctattccatgtcgccctacgaagtgcctccccctggtaataaaaacgcaaattttaattccaatagaccaatgaatcatcgttttatatg

SEQ ID NO: 99113 - DNA, 322 bp, Heterodera glycines
  Promoter: Source sequence=SeqID_38895; Location=1..322; Strand=+; Gene=SeqID_67593
aatttggagagattatatcgtttttagtgcgctaggttcgatggaaactttttaaaatataagcctaaaatttttcgcaaatttaaaaagcaattaaaaatttttagattttttattcatctccctttttgatagagaaagcatcagagagccttatttaacttttaattaacatttggtgtgtttcagagcacgttctgaaaaaatacttatgaattaattttgcaaaaaataaataagtaatgaaaaagtcagaatttcgaaaaattttaaaaacaacaagcgttggcattttttcaggttaagttagtcctttacaatg

SEQ ID NO: 99114 - DNA, 591 bp, Heterodera glycines
  Promoter: Source sequence=SeqID_45456; Location=1..591; Strand=+; Gene=SeqID_72754
cttgtaaatgaaaaaaaaacactgggaaaatttgaaatttacataaataaaaatttttcaacatgccaagctccactgaaaacctctaaacaaacagtaacacgaaattaacttttcaacacaaaaaagcagcttctctaagcattttttccaatgttaccaccttttgccgctgagttttcacttcgtttgcatattttaaaatttaatgctaatttgactcaaaggcaaaatttaatttttaaatcgaaaactggataaaatttgacaattcatttttaacccttttcaaacggtcaaacccggacaaatttggtataattcgaaatttttcaggtcttaaactcacggagctctttcaaatgacaccaaatatcttatccgtacggtttgaaaaggttggaaacatagaactgtcaaattttggccaattttttgatttagaaaaacatttcgccaagaaattttcatttttactcgaaaaatttgttttaccctttacccctaaaactcaaattgacagctaattaaaaatttccctattttttagcgatttttttccaataaattactgcatatttaacaaaaatg

SEQ ID NO: 99115 - DNA, 1003 bp, Heterodera glycines
  Promoter: Source sequence=SeqID_9053; Location=1013..2015; Strand=-; Gene=SeqID_70112
gcagaagtttgtgggagatctccctggcctgagggctagaaacaaagacgtgtacacgcaagtaaagaagtctgacattttaaatttctgtccgggctagtcgaaaactaaagggacattaaaacgaagagaaaagaggtgagaacatttgtccgggctagcgaaaagctaaagggattttaaaaatgcagaaaaaagaagaacgaaatttgccccgggctagtccaaatgctaaaggggcttactgcatcgaaaattgacaaaatttgacaattatttgtaggagagagagagaataggaaaagagagtgaaggaagccaaaaataaccaagaaaaagtcctggtagcaaatgaataaggactaatttataaaaatacttgaacgattgtgaagcaaaaaaaaaagagagagagagagagaagaagtgagacaaaaaaaataaataataaaacaattttttttgaggagagcaaaaaggcccgggctgacaaccaatcaaaggggcactattttagctaattaaaaagagggaccaattaaaaaatgaaaattaggccctatcattttgcttacagtatgagttacagtttttacaagttccaaagttcattttatctcgttgttttctctcgtttttcacgccataagaatattcacgtaatcacgtgcctccgcatttttcattgggcgagatcattcactttacacatttttgcggcgcctgagaattgttaattgctcttgttaggcggagtttaaacggagatggagcagataagcctatttctggaaggcgttcgcatctatttgattacccgctgtcattcattaatttttttctctctcaattaatgcataatgggattaccaaataattttttttagcaaaataaaacaaaatcttactacgaactgaacgacttcgaatgtctacatcagggggctcgtcaaatgagttcccctttggtacatcccaagccttcgggcaggaaacaaagatg

SEQ ID NO: 99116 - DNA, 542 bp, Heterodera glycines
  Promoter: Source sequence=SeqID_19345; Location=987..1528; Strand=-; Gene=SeqID_84078
cctgagataaccaaaatggaataatattgatttaggttgaataaaattcaaattcaacttcccaaaagttttatttaatattaaatatatttttattattttttttcttcgaagtacaaaaatcaaattttgtaaaaattaattttccacatagcaccaagtattttaaaaatgctaaaattttaggaattttgatgcaaaaagtgtactatacagttttttggttctggtcggttttatgcgtcccatgaaatattatgcgtgtcccataatcattttatgcgacccataatcattttatgtgccaaccagggatggacgaaatttcgtttcgtcctacattttcggcactttttgtgtttcgttttcgtgtttcgttttcgtctaccaaagttttttcgtttcgttttcggttttcaaaattttgtttttcgtttcgtgtttcgttttcggtttttaaattttgtttttcgtttcgtgtttcgttttcgtcagagcaaaattggacgaaaaagacgaaaataaatacacccttaagaatg

SEQ ID NO: 99117 - DNA, 289 bp, Heterodera glycines
  Promoter: Source sequence=SeqID_42484; Location=476..764; Strand=+; Gene=SeqID_70362
attaaaaaacccaattttcagatttatcccttcacgccgtacacttacatggtcgcactaattcccatctttctgcttaccgacttagtgggtttttttagaaaaaccaatcaaatactgggatgtttctgggaaatcgaaacccgaaaaaattttgtgggccacaatttttggacattaaaaatttgaaatcaaaattttgccaccaagttttgactgtgcccttggcgcaattttgaaccatttcaatacaacatttgccaaacagctgctctacaagccgacaatg

SEQ ID NO: 99118 - DNA, 305 bp, Heterodera glycines
  Promoter: Source sequence=SeqID_7097; Location=1..305; Strand=+; Gene= SeqID_63836
ttagtttattaagaaaaacaaaaacaaaataaagcaaaattcattaatttttacgaaaataaaataaaaaaatcgaaaatttccaatgttttgaaaattttagaaagataatttttttacattaattttctcgctattttaccattacttttttttgaaaaaattttcgtatttatgggtcaaaagagccgatttaatagaggggccaatttttttcgaaaaataccaaaatatgagcaatagccggaaatttacgaaatttccaaaaattttgccggattttttttcaggagagttcaattatg

SEQ ID NO: 99119 - DNA, 1003 bp, Heterodera glycines
  misc_feature (186)..(186): n is a, c, g, or t
  misc_feature (326)..(326): n is a, c, g, or t
  Promoter: Source sequence=SeqID_9928; Location=2785..3787; Strand=-; Gene=SeqID_72962
aggataaacaggataaaaataaataaatttagctaaaaacaatagaacaattagtgaaaaagtaaccaattaaaatatgtaaatgcttgaatgctttaagcaaggccagataccaaagaaaattgtaacagatatgtgtaaattgagtaatttggacagatatggacaaaatgtccagtagacaanatgtacagtggacattgcgaccaaaaataaaaatttatcttaacagtttcgaaaaaggttttgacattcattcactgtcgtaatgtccaatgatcagttgcccacttttgtaaaattgtacaaaaattgttaaattttgnaaaaaaactcaaaaaaaaaatttccgaaaatttccgactttttatccaaaatgttggaaatcgtaattctgactccctaaattttttcggaaatcggaattccggccccaaacatgtcggaaaccggaaatcggaattccgtaccatccctgctgcacagtaaagcattagtttcgaatctttatacccatataaaactttctaaaattttgatatattattgaaattttttaaaccagttaaaaaattgccgcatttttatttttgatgatagaattttatcgtacctaattttttttcctggacgcttactcttttaaatgtttatttataaagcctatttttaaaactctatgaaatttttgcttattacatttccaaatttttgaatacttaatatgaaattctaacctattgtggatttgaataatatcttgtcaaatggtgtgtattgccttataaacaaacaaatttggcggatgtgggttggtacgaggcgccgccgcccatcacacgataacatgaagctttagaatttttggtgttaaatttttatcttataaaatcaattagccgatttaatgtttatatataaaaaaataattaatgatgacttccggttgatcaatcaaaaatttcgatgagggtcactggtgatcagtcctcggccaacaatg

SEQ ID NO: 99120 - DNA, 1003 bp, Heterodera glycines
  Promoter: Source sequence=SeqID_5441; Location=506..1508; Strand=-; Gene=SeqID_46040
taacttaatataaggggctaacagtctgcaaaatttcataaaattttatttgaaacaattagcgtgtttttaaacttgaaaatttaaatttttttgtttacctgaaattttaaagtttttatataaaaaaatacagactttttaaaaaaattgtaagtgaaccgaaaatattgaaattttgtaaccctttttttatttacatataactcccagccctaattatttatttattttagttagaaatttaaatgtttaattttgataaagatttatttgattttttgagttatgaatgaatatttaactaaaaatgcatcaaaatagcaaaaaaaaaaaaaaatttttttaaattactgaattgcacaacatttttttgagaggattataactacaacagtttaatattaagaaacaaattaacaattaagatttggttaaaagtagagcaatcgccgctcaatttggtggcaaagtgccaattgattacggtgggctgaagggttatggtgaaaggcacaaatttccaacggattattatggtaaatttaattgaagaattatttaatttttgctaactccttttctctattaagacaaaaaagaaaacaaaaatatgggcagaacatcagaattggcaacaaatccattgcaaattaatgccaaagtaattgagtatttaaaacaaaaaaaaaattgacaaaatttaaaattcaataaaatctataataataaaaaataaattaaatgaaatttcaaatccaaataattagtcaaaaaggcatattgatgaatatttaattagagcccttatttttaaaattgttgaaagctattaagcaaaaagaaataaaatattttggctagatttgactcgaacatttacaatttttctttataaatccgtactctaatattataataaaaaataatcagcccagacatattaattatgtcatgaaaatttagttttagtttttatttttaggcttccaaccagaagatg

SEQ ID NO: 99121 - DNA, 632 bp, Heterodera glycines
  Promoter: Source sequence=SeqID_31131; Location=237..868; Strand=-; Gene=SeqID_61512
taaatcattctgtgcatttgatttgtcattcataaaacataaaacatttatttagtcatttctgcaatttattcggcttattttttacagagataaaacaaaatttttgttaattccttttaattcggccaatttaaaggccatacaaaaattgccatttatcagcgaaaataaaaataaaataaaacaaaatttgacggacggacgataagggcaaaggggagaaaggaccaaacgaaagatcggcgggagaagggcggcgggggacgacggcatgacaaatatttggggaaaaagggggaaaaaaggaggaaaaagggggaaaaggggggaaagtcatcgccccctcccccccccccctcagccaaacccaaagtcattttttagtttttgctcaaattttacaccaaaaaaagtttgacagaaagattaatcattctcaccaccaaatgtttaaacatttcaacgatttattaaaagtaattttactgtattttttaggaaatcattttaaaatatcttaataatcttttaaaattatccttctttttgagggaatattttttaaatttgtaaattggcaacaaattaaataaaaattttaaatttcttttgattgtttcggcaatatg

SEQ ID NO: 99122 - DNA, 89 bp, Heterodera glycines
  Promoter: Source sequence=SeqID_390; Location=1482..1570; Strand=-; Gene=SeqID_51212
actaaatctgaggcgatattcggattctccgggtttggtttgcccatgaaaacatcaatttcattttattaggtcctttcagaacaatg

SEQ ID NO: 99123 - DNA, 75 bp, Heterodera glycines
  Promoter: Source sequence=SeqID_35099; Location=1190..1264; Strand=-; Gene=SeqID_64735
taaacggtcaagagtttattaaagtatggggaaaacgacatcagtgtcccgactcaagtttatttaccggacatg

SEQ ID NO: 99124 - DNA, 147 bp, Heterodera glycines
  Promoter: Source sequence=SeqID_18896; Location=1..147; Strand=+; Gene=SeqID_83604
gtgcacctagattggatggaggcgtgggttcgattcccacccgatggctaacattttgtcaacaaatctgagatgagaaaagcaaaaaccaaataataaattttgaacatctggactcaggtcagggaagcacttgtgaataatatg

SEQ ID NO: 99125 - DNA, 104 bp, Heterodera glycines
  Promoter: Source sequence=SeqID_11110; Location=1128..1231; Strand=-; Gene=SeqID_74449
tcactaaaattaaacaacttaattaattaaaaaactatatttatttaattttttttaaaggctttccatgctgtccgggcagtcaacaattggccgcgctgatg

SEQ ID NO: 99126 - DNA, 81 bp, Heterodera glycines
  Promoter: Source sequence=SeqID_9498; Location=2585..2665; Strand=-; Gene=SeqID_71642
tgaaccaacaatgaatggggcggtaaagaaaatcagtatcacgacagaaacagtagcgaatcatcatcgcccataagtatg

SEQ ID NO: 99127 - DNA, 195 bp, Heterodera glycines
  Promoter: Source sequence=SeqID_12438; Location=2968..3162; Strand=-; Gene=SeqID_76051
catttccatgagttgaatgttgttgtagaagttagtggccttctcctcattgttgtccatccttcgattgtcgtccactttctctgccaccgataagcaatccgatggcacctttaaaggcgtatattcaaaattttcgttcgtttttgtctttccgattccccaacgaaattcaccactctctccaatttgatg

SEQ ID NO: 99128 - DNA, 302 bp, Heterodera glycines
  Promoter: Source sequence=SeqID_37753; Location=663..964; Strand=-; Gene=SeqID_66744
gtcatttgcatgaaacgacaaacacatgctaattaatgggtaataattagttaccattagcagcattcattggtcggtgtgtgggcgtgggcattcccacggcggacactccgcggggcaaacccaacgccaaatcagcaaataataataataaatgaagtcactagtcactcactcttcgcattttatcaccgcacgaatcgatcaccgccgcctccgccgattctcagcccaattcattagtcgattatcacttcccatttaaatcacaacatttggtgcaacaatttgaccaaacgatg

SEQ ID NO: 99129 - DNA, 60 bp, Heterodera glycines
  Promoter: Source sequence=SeqID_10297; Location=1747..1806; Strand=+; Gene=SeqID_73461
aataaaatatttttcaataaataatttaaattttattagatggtttataatttgaaaatg

SEQ ID NO: 99130 - DNA, 79 bp, Heterodera glycines
  Promoter: Source sequence=SeqID_5701; Location=1..79; Strand=+; Gene =SeqID_58953
aaaaggaacattatccatatagcgcccgaaattttatgcaaataatgtttagatggtttaatataaaaattgaatcatg

SEQ ID NO: 99131 - DNA, 220 bp, Heterodera glycines
  Promoter: Source sequence=SeqID_13042; Location=400..619; Strand=-; Gene=SeqID_76822
ttgattttaacataaaaaaatatatatatataaatataattaataaatttcaaaagtaataaaattttcgtataattaaaattaaatttagtttaatttatatataattaatatatgtttttatgcaattataggtttttacatgtcgcgtcgataaacgcacaaaatgcatcctaaaattcgatttcatttaaatgatttttaggtgacaccaaaaatg

SEQ ID NO: 99132 - DNA, 328 bp, Heterodera glycines
  Promoter: Source sequence=SeqID_4660; Location=3593..3920; Strand=+; Gene=SeqID_55267
taattttccggcaaaaaaatggcttgaattttataaaaaatttggcaatagttgcttatctgcgaaaattatccggcgcggcggccggcgcctatcgatggtagcactgctggatttgactagttttttatggttgtagtttatgcgtccaaccaatgactttgctgttttttgggccataacttttttttaaaggtaaaagcttaacattttttgtatcaaaactaaagcttaaagtctcggaatttataatttacagtatacctaaatgtaagaagaaaaaaaacatgcgatgcaattatatgaaagttgtgttaattaactaatg

SEQ ID NO: 99133 - DNA, 1003 bp, Heterodera glycines
  Promoter: Source sequence=SeqID_24194; Location=615..1617; Strand=-; Gene=SeqID_54908
attatgttaaagcgaaggaattaattcaaatgaaatttaataaatgcactaaaattgtataaatcatttaatatttttaattgctgtcccatttaaaaaaagttttttcttttttggcttttcctatttctccccctattttaattgaatgctttttgattggagctcaaaaatttttatgaaagtgaatgatttttcgctggccgatcagcgcttaaatgcgttggtcggccgtacaaaaatgggcggtccctgcggaccgaagcggcgcggccaatgggcggcagcgcacggccgcaccgcacacagcccacaagccaaagccaccagataagcaggacggaggatgggatgggatggggggggggggggggtaaccccgaactatagcgataaaagccccccaggggatgattcatttttggttgtacaattccatcgttggtggtggtcggtcggtggcggtggcgctaaacgaccgacagaaaatgaaaatgaattgctaatgagttttttataatgagcaaaaaaaaaaagaagcgaaaaatatttttatttgtgataatatttgtactaattgtgcgaaatataattagaatagttttattttaaatgcattttattgaaaagagaaagtggaagagataatgtaaaaagagtttgagggaaatacattaaaattaaatcccgaaagaattttttatcgagagcagttattttggcactaaaatgccacaaattgataaaattttcgtctcaataaataaaaaaagaattcattaaaatgcttaattatgtcattttgtattattcttcttctctcttttttaaaatcaaatatgaacattttttttggtttcgaattaatgccatttgattgcctttctgatcagatttggtgtatttgaaaaaatttgtggcaaatggcatggaaaggaacaaaaacggattaataaaaaagaaaagatgatccaagaaacactccattaattagtttaaaatg

SEQ ID NO: 99134 - DNA, 457 bp, Heterodera glycines
  Promoter: Source sequence=SeqID_30368; Location=1237..1693; Strand=-; Gene=SeqID_60782
ttggataaaccgaagcaagtgctagcgaaaactcgacttattttcttttgcgtgatatggagacatttgtgccacggattaggaacaaacgaatagaattcacgctaaatttgaaaaattggattattcaatggaaaaaatgcctgatttctcaggagcgaaatagcggactattgaatgttgagccgaaaagcatcccaaaagagtggagacaaacccatcggtaaagcgaaggcgtgcaacgcctcgcacactgtccgaattggtggacaacggctgaacgtccaaaaagcgggcgaagcgactgcgccgtgtggcaaaaacggaggggtagccaatgcgatagatggaccgggaggcggtgtccacggaaatgacggcgacaattcgcgtgaaatatctgtgacgaaacggggggtgggggagtaaaaatggaaaattggagaaaacgaaaatg

SEQ ID NO: 99135 - DNA, 221 bp, Heterodera glycines
  Promoter: Source sequence=SeqID_15173; Location=2870..3090; Strand=+; Gene=SeqID_79371
atcatagccgggggttggactgtcagggtttttgtctgttttttccgaccgttcgacctccgtttaatttaccatcgtttctttttataaaataaaaccgcgttctccattcattttttttcaattttgtgttgcttttcattcgatatttttgccttattcttgtccttttacactgatccatgattttataaagcattgttttgaatttcgaaaaaatg

SEQ ID NO: 99136 - DNA, 566 bp, Heterodera glycines
  Promoter: Source sequence=SeqID_14358; Location=954..1519; Strand=+; Gene=SeqID_78392
tgtgtgtcaggggtcatggtcatggagcccgaacggaaacgcagtaaatatgcctctctctcacacacaaacacggagattttttagaaattttgcttacctctttcatggaactaggccattacgaaatttgaaatgagacgcgcaattcttcaaaatttgtgccgaaattgtttttttttggaaatggccatggcacacccattttcggccaattcatttttattaaccaaactcatatactgtttttgaaacttgaaaatgggtgaaatttttgtttttaatcggttttaattgcgaaggatcataggagcaaagagctacttccccaggacttttgaattgtttttggaaattgaatctcaaaattcaccgcgttgacttcatttttcatgcacaaaagaaaaaaaaattagttggaaaaaagtttgcctagaaataagaagagttgtcattcaaaaattttggcacaaaatcccattcaaaattgcttttttcttaatgaaaataatgattgaaaaaatcacaccgcataaaaaacgtaaaatttttttgcataaattatg

SEQ ID NO: 99137 - DNA, 352 bp, Heterodera glycines
  Promoter: Source sequence=SeqID_33094; Location=580..931; Strand=+; Gene=SeqID_63258
ggtgaataattggcattggcaaaaacttaaataaaaataatttattttataaaatcaaaaatgatttatttaaattaataaagtaatttgataagaatttttaaataaggtgcaaaatgagttccgccaaaattgttgggatgccctcgcttgtcacaatcggctgtttattaatggcaaaagtttgacgatcaattacagaggatttttaatgtttggtaattaattctaatgaaaatatttttaaaatttgttttttcaaggctattgttccatcttcgctaaatattccattttgttgaacaaagattgctccaacattttttactttgaaatttcagtcacaaaaatg

SEQ ID NO: 99138 - DNA, 482 bp, Heterodera glycines
  Promoter: Source sequence=SeqID_40940; Location=837..1318; Strand=-; Gene=SeqID_69168
ccccccccccccccgcccgtcccggcccattcactccatgggccaaccgtgggctaaccgctggcccaccctcttcagccatttaaacttttgggctatctgctgctgtttggtgagtagcctgcttattgcttggctttatccctccctctcgcccccccccccccgctttttgctcaattgagcaaattatttgtttttttaagttgggcgtaagcggcgcttactaagcgccgattcagatgtacggaaaatgaatcgcgattttcggggcgctattttcacgtgaccgcgcgcaattcgtgccaattttttcactatcgcggcatttttctgtcgcatgcctacgcctcccccaaaccccaaaaaaaacaatccaattgaaaacaatttcccattctgtcccttttaatttgtcgcccattcccctctccctcttttaatatagtttaattaattaggacaccttattttcggggatg

SEQ ID NO: 99139 - DNA, 320 bp, Heterodera glycines
  Promoter: Source sequence=SeqID_17925; Location=969..1288; Strand=-; Gene=SeqID_82483
ttgtttggaatgagttgcgcaacatcactcaaattttgaacatagattatcaacattaattaaaaatacctaataaataattaatgaaaaaataacatttttttgaaactgtataattaaataataaataattaccattttttgaaattgccctttcatttaaacaaacaatttttataaataaatgcttattctttttgttttcatttttaacctaattccagtttttaattattttaatatcaaaatttatttttatcccaatttcgactttgttaagcccctttttttagctgatcgactccgacggttgcagcatg

SEQ ID NO: 99140 - DNA, 1003 bp, Heterodera glycines
  Promoter: Source sequence=SeqID_5764; Location=1735..2737; Strand=+; Gene=SeqID_59147
taatgattcatccctaatttggctagttttccttgctattttattatatgacagtgtttctgctgttcagtttagtcattccccctttttctttctctcatttttcgttgtattattttgtcccctcaaaaaaaaattgtgcaacaaaaaattcattgaaaaaatttatttggaagtaaaaaataggaaaaatttccgatttttacaccccaaaaaaatttcacgcaaattctatttgatttgatatgttcagacagaattttgcccaatcaatttttggttgaattttcaattttaattttaacaaatacaaattaatttcaaaattttctccccaaatttttggttgggcaaaaaaataaaaaattgaaataaaaattaaacaaattattacaatttaaaaaattcccaataacatttcttctgtgataagtcggcaatcattatcattcattcgtttcatttgtcatttttttattctctcaaaaatatattttatattttattattcttttttttgcatttaacctccgaaatttctgtcattttcatgtaaataaaataaaataaaatttattttttcaatttttatttaaatgtgagaacggattaaacaaaatcactttgcatttgttggatttgccacttaataattattcaaatttaatatcgtaataattttcgtgaaaaattttgctttttcttttaaatttttctgcttttctaagtcttcaatgtctttcccatctttgaaatttaattgaaatttcggcacttttttactcttagatcccacgaagtttatatgagctttagggatcactgaccatgaatccggcactaattttgaccaatccctaatccaaactagaaaaaagtcaaaaaattaaattttatgaatttggttcgagggcacacaaaaatatttttcgttggggcctaaagtaaaaagtgccaaattttctctattttttttaagttccgataattttttaaagccatg

SEQ ID NO: 99141 - DNA, 1003 bp, Heterodera glycines
  Promoter: Source sequence=SeqID_1179; Location=822..1824; Strand=-; Gene=SeqID_69402
aaaaaaacaaatactcgaaattttctttcattccgccgacgaatattggctgatctaaggtaggaagaatgtatttgtttttctttttgataaataaatatgtaaatacctttaatccctgcaaataatttttcacattcgttttgcctttggtgttgcgcaacaaaggcataagaattgcgaaaaagaaataaaaataatagaaggaacataacaacggaaattattaatgctttattattatttttattgaaagaaaaaatgaaatttttttataagaatttgtaaaaaaatcgatagaatataattttacaaatgaccaatattacatagaagggaagtgaagaacgacagaaactaatatatgcaaacacaattaataaatgagctaacttttcaatcttaattgattgttaggcttcgtataaaacggtaattcgaattcaagacgcaaatttgtaaaattttcgtggcacattttccggaggcctaccagacccaattcggggcacaaatagtctctgatccggaacccggatcgatccggttcaagaaaaaccttttgttccagtttttcatgaaaacatgtttattttttttccttcaacactttggatttttgtatatttcttaatatttatcgcaaaagaatattatggtaaaaagtttaacccgccgattggatcaccgaagcatgagaagtaacaaaagaaaactttgattcataatttcttagttgaaaattgatgcaaattttgtggcaatatttgcgagcatttaattgataatgattgcctacgaattcttttagccggaaattgattgatattttcttgtttttgtaaatatgatgggtatttatttgttttttagcatattttggcatataaattcataaaaaccacttttattattgtatttaaccggaatttaatttattttatttaaaattttcccacttttttctgctaaaaaaaatttgaaattaattaaagagaaaatg

SEQ ID NO: 99142 - DNA, 127 bp, Heterodera glycines
  Promoter: Source sequence=SeqID_8259; Location=53..179; Strand=+; Gene=SeqID_46579
aatgggtaaaaatgtcttcattttaataatcctgcgaaaaaaaaacttcatacaaaaatcgattttttcgaaaacttcatcccttttttaggtttccgtgacaaaaagtggcagcagcgatgtaatg

SEQ ID NO: 99143 - DNA, 52 bp, Heterodera glycines
  Promoter: Source sequence=SeqID_3099; Location=1..52; Strand=+; Gene =SeqID_83190
ggggctctgttttagggaatatggtataacaattcttacattcgccaccatg

SEQ ID NO: 99144 - DNA, 58 bp, Heterodera glycines
  Promoter: Source sequence=SeqID_31955; Location=1..58; Strand=+; Gene= SeqID_62277
atcccctcacgaaaatctgcagaggcgacctttgcaacccggaagtgagcacgtcatg

SEQ ID NO: 99145 - DNA, 154 bp, Heterodera glycines
  Promoter: Source sequence=SeqID_11711; Location=952..1105; Strand=-; Gene=SeqID_75201
ttcgtggagatttggcctttataaaatcacattttgacattttacctggagcaattgaaaaattagaatcacgcaatctcacactcattgaaagtttgtgaaaactcgatatttttctatgcaaattttctaggtttggacttagtgagcgatg

SEQ ID NO: 99146 - DNA, 1003 bp, Heterodera glycines
  misc_feature (381)..(381): n is a, c, g, or t
  Promoter: Source sequence=SeqID_7810; Location=418..1420; Strand=+; Gene=SeqID_66033
tttaattaaaaactaattgaatgaataaacgatggaagcagaatttgttattttaaagatcaaaaaaaaaacatatttttgaaccttttgttcaactgttttttgcgataaatagaaattggtttaacactaaaacacaccctttggatttcatttgtcattatggtacattagccaaccgtatacccattaaaataatgtgcatgaaaaacgagacctttatcttttttagtcgcttctagcatgaaatttttgttgcttttttttattcgtgaattcattaatttttctacaaaatttcaaatgaaccgcaaagtcggttctaaatggggaaaatattttttttaatgaaaattttgaaaatatgccttaaaattgtgnagaagatagtgatcgatcaacaacaaaaaaaacggccgatcaatgggatttacgcgcaattgatcagacaatttgagcggaatgagcatattttgtgctatgttggaaatttaaaaaagaaatatcttctttttttatgggttttattatttatttatttgacttctttgcacttttatgacgtttttacctttttaagcaaaattatttaatttgtctattaaaaataaaaataaaaattcagagtcccaatttggtttgtaagaaataggtgaaagacaaatcaattaataataactttacctcaaaaatgaatttcttaaaagggccggccaaccatcgacagtatcaacagcgggggtggcacggaattccgattacggcatttttggggtcaaaatccgatttttggctgttgttttagaataaataaattttctaagttgtagaacaaaatttcaaattgaaaattttatatacgcaaatcttttttaaacgcttccacgaatatattgttggaaaatgtataagttaagcaaaaaatagaaaagtgagctttttcgtaagttatggatgatgtgagagatggacgtaatgcacaaagaaaacggtagaaaaaatg

SEQ ID NO: 99147 - DNA, 63 bp, Heterodera glycines
  Promoter: Source sequence=SeqID_27539; Location=288..350; Strand=+; Gene=SeqID_58237
tttcgctcgatttttggaattgcaaagacattactgaactccatctgccaaggacaacaaatg

SEQ ID NO: 99148 - DNA, 183 bp, Heterodera glycines
  Promoter: Source sequence=SeqID_3685; Location=1584..1766; Strand=+; Gene=SeqID_51446
aatggaatttgttgtaagtaattatcacccatttatccgatgatttttggattcaaatttttttaaaaaggtcagcaagggagcagcagcagcagcaacacaaatccgtatggaggttacggtacgggaggaacatcgccttacgggaacataccgaacggatacggtatcggcaccggaatg

SEQ ID NO: 99149 - DNA, 329 bp, Heterodera glycines
  Promoter: Source sequence=SeqID_2064; Location=438..766; Strand=-; Gene=SeqID_77630
tttttatacaaaaaaattttccctgaaatttgtatttgacattttttttgaacaaaaaaagcgattcgtgtcaattagtgttagccggaaaattaacaagatatagcattaagttaaacgtcaaaccacccgccttaattaactcccatttaaggcttaaatgatcagcccaacgcattaattaaacaggcaattttcaattagtgccgccgattaattacccattttttgtctttacgcctttataaatagagacggaatgaacactcattttcattctctctgtaatcattcaacaattgtatttctctgcaattattattataatg

SEQ ID NO: 99150 - DNA, 1003 bp, Heterodera glycines
  Promoter: Source sequence=SeqID_19595; Location=2661..3663; Strand=-; Gene=SeqID_84333
caaatatcttcaaaagatccagagctttcgaatgatatcattgatgttatgtttagtcaacaaagaaaaacgaaggccctgaagataatgtcgggagggaggttattactaatgaattgttggggcggggggtatcccggcgccgctgtttggcaccgaccactttgtttctcattcgcaccctgtaagagcactaatgtacactttggtttgctcgataaataaaaataaaattttgtgtttccaatgtttcccatcttccacttgttcttcctccgcacccggatgcggttgttgtatttcgcactcgtactcattcacaccgtccggggcgtccactttttctttttttgaataaacttttataaaaaaatgcgtagaaaaaggatggtgctaagatagttgcatttttaaatttttttggattttaatatgaaccgaaaaaagttcagaacaagcgctgctgtgttgagcctttaaaaaccctgcttaaaactttacagtaatctcaatgatagtcagttaaatctttaaaatcttaggataatccttgataattatctttctaaatcttgcttacagattttcaaatatgctcggcagcgattattctgggatatgcttagggcctgaaaaatgccaaaatattgacaaatagtgacaaaagtaaccaaaagtccgaatagtgacataattttcatccaaaaattgagcaaaaacgaagcgccaaatagtgatttacagtgacggataatacatcataattgaaaatttcaacacagaaacgcgttttttgagtttctttcttcaaaacaatggaacaaaaaaagaagttaaattaataaatgttgcgaccctttaataaggtgctaaaatgtgaaaactgctaaaagatctcatattattgaagaatttatttttaatttatttttgaattttcgaatggctaaaaagtatttatgaataaaaaagaaattctcagcaaatatacaacgaaaaaatg

SEQ ID NO: 99151 - DNA, 66 bp, Heterodera glycines
  Promoter: Source sequence=SeqID_24519; Location=929..994; Strand=-; Gene=SeqID_55247
aaattttcaaatcaaacattaccattttcagacttttttgcaacggtccaccggttgcaagaaatg

SEQ ID NO: 99152 - DNA, 813 bp, Heterodera glycines
  Promoter: Source sequence=SeqID_1310; Location=1..813; Strand=+; Gene= SeqID_72324
cttcttttaggcaaatgtccaaaatttcttaaaatagaaaataaccaaattaaatttttatttggttttctccttaagttttaatataaaaaaatataaattttgtatgcctattttgtttttcgccatttttgtgccgaaaaaattcctattaattaggtatttcttgatttgtataagcataaaaaagactccaatgagtttatctgtcttcttaattgatcatacataggtgcacagcattaaaatttcttaagtgtcaatatcaagtaattttactaaatttaaagctaaaaaatgcttaatcgatatcaattaatataacttaatttctcatcaatgatttttaatccttgataggattttgataaaggataaatttttggccattaaaaataacaaagaatgaaacagttttaattattgaaactaatttttggtcaaaacatttaaaaaagcgaaagatttcaattttcgttttttttatctgggatataatattatatttaaatttaattgtaggagagaatgtcaccgaagtatgaaatgcccgtgaaataattattcttttagaatgaaaatattaaaaattgtctacaaatacatatgtctctgtctaataatttcccaatataaattcataattatttcacggggaaatgttagttttttcgtaaattgatttacaaacaaattttaattagttttattgatttaattaattaattattccaatgacccatttcctgccaaaaaaatataaaagttcattatttaaattaaaatttatagaaaaattataatatataaatg

SEQ ID NO: 99153 - DNA, 203 bp, Heterodera glycines
  Promoter: Source sequence=SeqID_27224; Location=434..636; Strand=-; Gene=SeqID_57918
agcagcaacaagtagagattggagagctgataaaacagaatcgcgactggttgtgtgctttggccaagacgaaatccggaaaaaaatgcaggaaacttatacgaaaagcaaacactgaacaactactatcgctggtcgaaatttgtttgaatctcgtcgcttcgcgcttccaactgacaaccagacagaagaagcgactaatg

SEQ ID NO: 99154 - DNA, 1003 bp, Heterodera glycines
  Promoter: Source sequence=SeqID_12438; Location=1259..2261; Strand=+; Gene=SeqID_76052
tttctgcggctttaactcgacgagaaatgcacgaaaaacacattctttttcgaaaatttttcgtttttagtgccactattcatcactaggaatcactattttggagcttcgccactaaaaaaaactatttcggaagttagccactaaaataattttttgccactattttggcgtttcgtcattatttttgccactattttggcattttttggaaaatttcccaaaaaatgcaataaaaacgaaaaatacaccccaagaatcgacctaaaaaattttcaaaaatacacccctaagaatcgacctaaaaattttcaaaaatacatccctaagaattggaaaaatttcacaaaaattcttcccccaattttttttttcttgttcaatattttctaagaaaatattttgtaactgcaatcagtgaataaaatctttttccttaattttaaattattttcaaattaaaaaacagctatttaaaaaattacacccctaaatttggaactttttcaccactatttttgtcactattttggaatttttttctcactatttagttaattattttgggattttttatcactaaaaatccgatccctactgatcactaatctgacatcagattgtcatataaatcatctaatctatgatttttcatcaagtgatttctcgtcagaaaatagtttgaatttttttttaaagtaacagcgagcgagtggaattgcagacccattcgaagagatcttaactcaattttggtatggcatttatgcctccgcaataattttggcgcgtagctttagcaattccacacgcaagttgttgattttaaaaaaaaaattcaaactttggcctcaaaacggaaaagtaccgaaatttgttaattagcaactattttctagttttttaaaaaattttagagcctaaatgcataattttttttactaattcgatgtcttctctcctcactcattgaatttgttagatttttcttttgattgacatg

SEQ ID NO: 99155 - DNA, 227 bp, Heterodera glycines
  misc_feature (14)..(14): n is a, c, g, or t
  misc_feature (44)..(44): n is a, c, g, or t
  Promoter: Source sequence=SeqID_15274; Location=1655..1881; Strand=-; Gene=SeqID_79489
tattaagaataatngtgtgtttattaattaatattttgaagttntattggagggtgcaagaatgaatatttggaaatcgtagattattattttatatagtagaaatttcattttgaagagaagcgttgcaaaaataagctcacaacgacacaaataatgaatagatgtggaataattatcttgcagtggtcttttatcaaattttgcagcataaaatccagcatatg

SEQ ID NO: 99156 - DNA, 360 bp, Heterodera glycines
  Promoter: Source sequence=SeqID_36381; Location=1..360; Strand=+; Gene=SeqID_65705
gggaaagcagttaatgtcctcgacccaagcagcatagttttagcatgtggctctcctggtgaggagtttagctgtgccggcaattatgaaattttggtttatagagaagaatccgatttagaagaagcgcccagttcatacgcatttgttgcggttctgcatttttcttttgttgcggaaagatcaaacgcattgctgcggttctgctttttaacgcattgctgcgaatttcaccgatttcgtcccactgctaacgcattgctgcgataagtgaggacttggtaccgatttattaacgcattgttgcgaacgtcttggacttcgaaacgccgaattttatcaccgccgcttagagggatg

SEQ ID NO: 99157 - DNA, 57 bp, Heterodera glycines
  Promoter: Source sequence=SeqID_42079; Location=1270..1326; Strand=-; Gene=SeqID_70070
aacgaagtgcaccccaattgatgacatattttgctattgtttttaggctcgctgatg

SEQ ID NO: 99158 - DNA, 209 bp, Heterodera glycines
  Promoter: Source sequence=SeqID_12036; Location=1309..1517; Strand=-; Gene=SeqID_75565
atttttagttcaactttttgcacaaaattgcaaattcgggcggctgattcttcacaaaattgttgaagtatggtgaaaaataaaatttctggatttgttcttttatttttgtttttagcgtggtcaaaaacccggtgaccaaccatttgccggtgggctgccgtaaatttctgagcacactgaactgccccaatttggtgtccaacatg

SEQ ID NO: 99159 - DNA, 716 bp, Heterodera glycines
  misc_feature (65)..(65): n is a, c, g, or t
  misc_feature (79)..(79): n is a, c, g, or t
  Promoter: Source sequence=SeqID_21268; Location=464..1179; Strand=-; Gene=SeqID_51861
ttgtttatcgataaaggggcagccaacagaaattagctgcctcatcaattttttgttgttgtttngatgggttttttgnacaaaaatcggctcggttaattggccccgtggtctttcatctatcataaaccgtagaccaattaaataataataataattattattattattattattttatggggtcggctgacagcaaaaagtggcgttgataattgataaaattttacacaatttggccatttattcttcaccaatccttccttatctcttatctgttcgttttatacaatacatatgtacaaaataacataataaataataacaattttcttgttttcttctgatcgatatgctgcactttgaatttgggagggccatgggaaattggcaaaatttaatttaattttttttttgttttctaaatttcttaaaatttttcgaattttatatttttttaaaaacttggatgattttttaataattcggcttggatgatgtaccgctccgacgactggatttttggaaattttaacgaattttttggagaatttgggtgaaagaggtcttgaatgggataccaataaggattccgaaaattttcatcacaaaatactttttcccttaaaaatttctaggagtgtggaggggccttggggaggggggaattttccgggaaaaagaaccgaaaaaaataaaaatttcaagaaaaaatg

SEQ ID NO: 99160 - DNA, 119 bp, Heterodera glycines
  Promoter: Source sequence=SeqID_19488; Location=1970..2088; Strand=+; Gene=SeqID_84210
ggtcaaaaataaaaatttgatatatatttttgtgtatttttaaaaaaaattcagcgctccgttcgccgacaaagggaatatttgtgcaaaaataagggaggccccgtggagggacaatg

SEQ ID NO: 99161 - DNA, 163 bp, Heterodera glycines
  Promoter: Source sequence=SeqID_4290; Location=902..1064; Strand=+; Gene=SeqID_53908
atccggtcccgtgcctatctctacgcacatccattacctatatcacaacccaaaatgaattttacaatggtttatcccaatatcagcaattcattcctcttatttcacattccatattcattttacctgttttgtttgcagatttaatcgacacacaacaatg

SEQ ID NO: 99162 - DNA, 142 bp, Heterodera glycines
  misc_feature (88)..(88): n is a, c, g, or t
  misc_feature (100)..(100): n is a, c, g, or t
  Promoter: Source sequence=SeqID_42627; Location=887..1028; Strand=-; Gene=SeqID_70478
ttcaaaaatcttttgattgagagactcggtcggacgggggcagatttctggagcaatttaccacaggatttaggctttttgttacacnattttccacaanaaattgtgcgcaatttttctttttcaggccaaataaataatg

SEQ ID NO: 99163 - DNA, 823 bp, Heterodera glycines
  Promoter: Source sequence=SeqID_25504; Location=1..823; Strand=+; Gene=SeqID_56248
tgatcagtagggctgtgaattttagtgacgaaaaatcccaaaatagttaactaaaatagtgagtaaaaatgccaaaatagtgaagaaatagtggcaaaaagtccgaaatagtgacgaatagtgacataattttcagacaaaaattaagcaaaaataatttttattcactgattgcagttacaaatgagttggactgggatttttaagaccaaaaaacccaaaatagttacctaaaaaaattttttaaattaaaaatttttgccaagaaagtaaatttttgagaaatttttttttgatttcataggagtatattttgaaaaattttagctcgattcttaggggtgtattttttggttttattgcatttttgttaaggaattttgcccaaaaatgtcaaaatagtgacaaaacgccaaaatagtgatttttaactattttagtgacgaagtcgccaaaatagtgatttttaactattttagtgacgaagtcgccaaaatagtgatttctagtgaccgataatgacatcagaatcgaaaatttttaatgcagaaatgcgttttttgagctcctttcttcaaatcaatcgagcaaaaaatttagttaaaacctaaaattcacagccctagtgatcagcgaccccgaaaacctcataaaaaattttttttaatggtctgtaaagtacatagtaaatacccacaaaaatctaatccctaaatattattctgaagtgtttgccgattattttcgtaatctttacattttcacttcactaaacacagatcattctgcacacatcgcatcattcatttattgttttcttatg

SEQ ID NO: 99164 - DNA, 132 bp, Heterodera glycines
  misc_feature (12)..(12): n is a, c, g, or t
  Promoter: Source sequence=SeqID_31232; Location=1459..1590; Strand=-; Gene=SeqID_61607
atacataaaacncatttgttgttcaattttcttaatttttgctaatatataatcaatccccaaatccgaaatttagtgatttgaaactgatttatttaccaatctcttccaatgaatttcctcctgtccatg

SEQ ID NO: 99165 - DNA, 994 bp, Heterodera glycines
  Promoter: Source sequence=SeqID_2011; Location=1434..2427; Strand=+; Gene=SeqID_77313
aaaaaagaaattataaaaataattaaattgttataattaatgtaatttaaaatttaatttttttttattttaaaagaaagcaacacattttcttgtatcttcttgagtgaataaatttgtatttttgacaattttgttttaaatatttatgtattgtttccaagtgtacttttttctatcatttatccttggtttgaggcgtcccttaaattttgggatttcttaaatttagttaaaatccaaattttagtgacgaaagaattgtcaatatactttttttttaatttttgcaaataattttcggatagagaatatctggtgatattgactttttatacatattaaaaacatgcgatattctgaaaaattattggttaggtctcgagaaaagtttctaaattatgaaaatttgttaaaaaaagaacattgacataatgcaatattaaatatatattttttatatttttaatttctttaattgtttatttatttaaatcagtattttcttttaatttaaacaaaatcgcatctaaaaacataaaatttttaacgttgatagctatcaaatttcaaatatgccatcagtgtctggaaaaaattgttatttttcccatcatttttgtcaatccacctacattgaaacaatacactcgtttatttttaacaagaaattgtcgcaaaaataagtgcagaatgaatttgaaaataaaatttataatattaaattatattatcatttttaaaaataaatttaaaaaaatattttattctaaaaaatttagccaaattaagcaaaaaatgcagcctcttctaatgctatttttgactataatgagttataacttggtcccaatgatttgtgatggaaactatttgggccaaataggtacaggtaaaaatttaattactaaaaataaaagaattttgcaaaataaattttaaggaaataggcaacaacaataacctattaagagagtatttgtcgcgtggaatg

SEQ ID NO: 99166 - DNA, 625 bp, Heterodera glycines
  Promoter: Source sequence=SeqID_8845; Location=511..1135; Strand=+; Gene=SeqID_69409
cgtaattagcccaattatcatttttacgttaaattttaattcagttcaacaaaatgcttgaatttcccccgcaatactctttctccgctgaaccgacttaagcacctctcgatggagtcaaatttgttgcaaatgttgcccaattatgcctttcagtaatattaaattgcttttgctttttaattacccccttttttggtggcttgtccatcttcaatggctttcattggcccgtaatcggtttgtttaatccctgttcatttaattaattgccatttcctaattctcaggttgtcttcaattaatgcgaaattgttccactcaacaagtgccattcaaattcggtggctcaatttggccaataatcggatcagtcggatggagacagccgcttttcaggccccacttggaaatgttgtccattgaacatgtgtcttttcctgttttagaatctgccgaatttggaacgcctttatttgtccaacaatcggtttacaactttgccccctcaagtcaattgatcatggataattagcaataatacttttgtgtcatttcataaaattttgagtttagattctttcagcactgaagaatttgcgacaattgagcttggctcacaatg

SEQ ID NO: 99167 - DNA, 852 bp, Heterodera glycines
  Promoter: Source sequence=SeqID_9766; Location=1..852; Strand=+; Gene= SeqID_72627
ccgcttgggaaattttgaaaattagagagtacaatttgttaatttttgtcccaaaatgaacaatttttaggaatttgatgctgttttactgtgtttgaaaattgctagagaagatccaaattcataggggtactaaattctgatcactcccgaccaccattatggagagtgatctgatcagggtggtgcactgacttttttggtcagtaccctgttattacttcgctaaactttttcaaatttgtatctagcgcagaaaaatgataaatgtcttcaaagttttagacctatgtttttgttacgccaaatttgggccactttcagggaaaagtcgtaaaactttttttctatactttacaatttattttattatttaattacatgtaaaatattaaaaaattcgtaaatcaatacatgcgttaatattgtatgacgttttgtcatatggccgtcgtccctctgctgtcattataaacatgggagaagggagaaggcaggcaatggcattgtgggggggggggggagaaggccggcaatttctaaaagccaacaatgaaaataggcataatgtggggtgaagacaaaaaaaattatagtttttattgtattctatgaaatttatatggcagagaaaaaaagtaatagcattttgcatataatggaaacagaaataaatgaaaggggtatagaaaaaaatgaaataacacaaaaggaagacgcacacagccgaaagaattaggcaaaatgccacgtttggcaacgtggcaaatttcccttatttaatcagaaaggaaaggcaagaaaatcataattcaatcaacatttgaagcaaaggaatcaacaccagacatg

SEQ ID NO: 99168 - DNA, 239 bp, Heterodera glycines
  Promoter: Source sequence=SeqID_23776; Location=1..239; Strand=+; Gene=SeqID_54477
tttaaaactcggatgttttaaatttccttcccagttcagctaaaaaaggaggccacgggcgacccaaagcgacgccgcggggtgtggcagacaacgcttcggagtcgcggctgacggacgcattggacacggcgaatcggcacgcaaaagcagcggccaatgcaaagtatcaaactgttcaggtaaaatgggagcacaaaaaacatcaatgaaaaagggggtggcggaagtcagggatg

SEQ ID NO: 99169 - DNA, 195 bp, Heterodera glycines
  Promoter: Source sequence=SeqID_14845; Location=383..577; Strand=+; Gene=SeqID_78999
tttctcgcaccctacaggaaaatatgtcatcattttaaataatttaagaaattattaacatgaaaatttcgaaaaagtcgaaattttgaagttttttctttgtcatttttctattatcatttctccgaaaaaagtcaattaaaaatcagacaattaatgaaatattatatatattaattagttttttttagcatg

SEQ ID NO: 99170 - DNA, 514 bp, Heterodera glycines
  misc_feature (53)..(53): n is a, c, g, or t
  misc_feature (132)..(132): n is a, c, g, or t
  misc_feature (140)..(140): n is a, c, g, or t
  misc_feature (189)..(189): n is a, c, g, or t
  Promoter: Source sequence=SeqID_3885; Location=4200..4713; Strand=-; Gene=SeqID_52282
ttttcatggcttttcggcgccgtttgccatactttttttatacttagattttntatttgacatgaaaatgttaagcacatatagagcttttaaatgatgccagatttgctaactttactgactaaagaaaanagttatanaatttcaaaattggctgcgaaacagcctgcggcgaactgaccccgaccncaaaaaatggcacctcttttttttctttaccaaattttttgattaaaaacaaatttatttgcctttttttcgcctatttaatgtttttatgtattttgctacctaaaaagtgtaaagaaaaaattttatttgcatattttgcgatttgtttttctgcctttttaggtgcctaattcgcgattttttgtgcctaaaaatggagtcccaataataatgttttcttaaaaattccaatccctatggctattttgcccattttaaacagggaaattaagttaaaccatttaaaatttttgaaatttttattcatttttttaagaatatg

SEQ ID NO: 99171 - DNA, 73 bp, Heterodera glycines
  Promoter: Source sequence=SeqID_31404; Location=1..73; Strand=+; Gene= SeqID_61761
tttattacaaataaaaataatactttttcacattcttatcaccaaaataaaattaaaaaatttctaaaaaatg

SEQ ID NO: 99172 - DNA, 52 bp, Heterodera glycines
  Promoter: Source sequence=SeqID_26991; Location=756..807; Strand=-; Gene=SeqID_57723
acaggctcttttggcggtgtttttgctgaaagcgggtacagtcaagtcaatg

SEQ ID NO: 99173 - DNA, 580 bp, Heterodera glycines
  Promoter: Source sequence=SeqID_7312; Location=245..824; Strand=-; Gene=SeqID_64425
ttggctcgagaaaatgaaaattgtggtgagaattgcgaattgttagtggaattttgataattcaatcatttttcaaagtaatttcctttaagcttctttagtctgaacaatgtttgagtgaggtgcaaacgctgtgccaattgttgctgggcgtgcccggcatttttcgtcttaagggaatttcaatggtacggtcaaagaccgatgggcacatggctggtgggttcaaattcaattatttaatttgttatgtaacaattttaaataatttttaggtttgttaaccctttttgaagggtctaacattccggttctaaattggcactatcctcccacgctcaactttccgcgtgacatcagagcgcgagttggccttccgttggcaaaagatgcgccaaattacgtaggcccttttttaaccgatggaaattgggcaaaaaaaaaattaggaaattaaaaattttttagtcaagaaaaaggaaatggctttcgattttgaccttttttattcccttaaattcatttaaccattatttaatccaaaaagtgtaaaaagcacgatttataggtgaacgaaatg

SEQ ID NO: 99174 - DNA, 101 bp, Heterodera glycines
  Promoter: Source sequence=SeqID_2108; Location=5363..5463; Strand=-; Gene=SeqID_77901
tttttgaacactcgctcccccccccccttggggaaggctttttttataattatataaaataaaatttccattcttatggctatctaaagataccaagaatg

SEQ ID NO: 99175 - DNA, 211 bp, Heterodera glycines
  Promoter: Source sequence=SeqID_26671; Location=1174..1384; Strand=-; Gene=SeqID_57428
tattttagaaaaaaagtatttttgagatttttttggggctgtactgcagtatatgctttcgttcaatcactgatcattctcagttttgttaggccataagtttttttaatctgttcattgactaatttcttggtgttaaacgaaggcttaaagtcttgtgaatttataaataaagaagaaagcaaatatgacttgcagaaaaatagcaatg

SEQ ID NO: 99176 - DNA, 140 bp, Heterodera glycines
  Promoter: Source sequence=SeqID_27958; Location=1..140; Strand=+; Gene=SeqID_58616
ttcgcctattatcactgtttaactataaaataaaaattctatataaataaattaccaaagatatgacaaataaggcttctctccaaatgatactaatcgctttgcgtcaacttaccttcactaagttcatttagggaatg

SEQ ID NO: 99177 - DNA, 779 bp, Heterodera glycines
  Promoter: Source sequence=SeqID_8030; Location=4645..5423; Strand=-; Gene=SeqID_66754
acatggttttcaacaattccaaacacaaaaaacccaattcgaacttcaaaaaatcagtggtctcattgccaatcttttgacaaaaattcttaaaaaaactgattttattcttagaaatgttttttcgtgttcgggttagaaattgttgaaaaataatgtaatccttaaagcatgctaataaataatttcataaaaaaaaattaaaaaatatgattctttttgacacgtacttcgtaccacatttacttatgtattgttagcaaaattaattaaaaatcccaaatatttcctctgcggccctatcagaaccaccggataccaccaatgtatcccaaatttttttgaaaaagcatgttaaaaattatttttgttctaaaaatcgtccaaacatggcacttaaaaattgcacttgagaaaaaagggccgaaaagcaacaaaaaaagtgttcgtttcatccgttggttttccccactgtctctgctgcagggcattttcgaattcaaacctttgctttaagcgtatagacacttattgttcattcagataaagcaatttcccactcctccgtctcgtgacctttgctgtggttcgggctgttcaaactgtacgattttttttagctttgcgcagaaacataccaaaaacactttgaatttgttgggttttctcttcatgaaatgctctttttgttatgtttctgatctgaaaccgatcactttcacctttgtaattaattggataattaaggcgtttggattcaatttgctgacgaagtgatg

SEQ ID NO: 99178 - DNA, 997 bp, Heterodera glycines
  Promoter: Source sequence=SeqID_15643; Location=1424..2420; Strand=-; Gene=SeqID_79938
atcagtttccttctttgtctcgagcctaattccaagtctcgaatatcttcaaactttatgttactactaatcattgggtaaaatacaaatgaaatagattttttaaaatattattttaataaatttttattttgccaaggcattgatcagcttgtgcttcggttgggtgtgctttttctttctgcttcgttgtcccagtggtttttcctaggcaattttcataaattttattagggcatgccgtaaaattatggccttcgaggcctctggctttttcgttcggctctcagagtcgaatgctttttatgaaaaaatgatcctgactcggaaccttcaatttctaattgggacagaaaccaaattggtaaatttttccgagcggaaacttcagatttaaaattattattttttttcaaaaatacccgagttttaaaaacgaaataaaaaaactggggacattaattttaatcagttacaaacagtacgggaggaggagaagcagagacaggtcatagaaccgagaacaatgaaaaaattttctgcgggaggggagggccaactcagtctgtccaattcgcctggccaaacttcgtttgtgccaatttgagattaacttttttaagtcgtaccgaaccaaattggggttttcggtactttaatacagtatccttttattaactgtaaagaaggaaaggaatgcgtttcacaatcaaaaaatttccgatttccctggggagggagggaaatgattaatcattgaaaaacatcccccgggggcgaatttaagaaaataggcaataaaagaaaaaaaagaatgaagaagccaaaacatggagaaaatgatgacgaataaaggaaaaacaaaacgaatggaatattcctcatcattcaatctatgcttttgtacgcttcattcattcattgttaaaaatattttgagcaaatataatttaaaaaatttatcgtttagaattagccgaaaaattcaaacgaaatg

SEQ ID NO: 99179 - DNA, 1003 bp, Heterodera glycines
  Promoter: Source sequence=SeqID_2240; Location=408..1410; Strand=+; Gene=SeqID_78648
atgttccattccacaccgccccttattcttggcaatcatagtctccagagaccaaaattcattccgaataattcctaaaacattattgcctttttttaacccaacggaaaatttagatttaaatgccaaaacccaaaaatcttcatttattcatttttttccatgcctgcgggccggacaaaagaattgcttgcaaaaaattgctaatgattttattgctattcagttcgaacgttcaaattgtagagtctcctcaagaaaaggaaattaaaggaatttcagtggacaaagaaatttgtgatcatttttgtgcccatccatgccagccgactaatttaatttttccaaccgaagagagaaatgcaactttgggttggacttgtgtacacctaaagccaaaaattgtccctcaaagttggtcctcatttttctcgaaaaatgcttggacaattggcggcataatttttactcttgccggcatttccttttgtgtaattcgagcatatttgtggtcaattgacccgattcaattgaaattaatgtttgaaatttcttttcaaaatttgcaatttccccgcttttgactgcgtttttaattaattccatatgaccaaagttttgcagtgcccccccatttttttctctccgtgccaaatatggcagccgacggaaagcaattcatctcccgtcccctctcccgttttttgctcttccccgtcgcaacattagctttttgcggcgatgaatctcccctgccgctcgggagaaaaaggttttttgcctttttttcccattagctcgccgctgttgtaacatttgaaaaaataaattgcatttttgctgtaacgcccatcgtccactcggacccgtcgttatttaaggccggctcatccttcagaaaagccatttcttgctttcattctcatttttcctccgctccttcatttttttttcatttttccatttcctttttcaattttcaatttttttttttttttagatg

SEQ ID NO: 99180 - DNA, 104 bp, Heterodera glycines; identical to SEQ ID NO: 98209
  Promoter: Source sequence=SeqID_9843; Location=1604..1707; Strand=-; Gene=SeqID_72864

SEQ ID NO: 99181 - DNA, 281 bp, Heterodera glycines
  misc_feature (13)..(13): n is a, c, g, or t
  Promoter: Source sequence=SeqID_24944; Location=1..281; Strand=+; Gene=SeqID_55680
atgatggcattantgggtgaaaattatataggtacataccttctgatggatttgacgggggatcaatttcattatagaatttttgttcgaattcaggtccgggattcgaaattggtcaaaatgtttgcagcaattttttttaatgtgaaaatttccgagtctcatggcaaaatttgccacattttattctttttaatttaacttagcaccgaacttattaattttctagtcaacatttgctgggtgagccttccttccccaaaaagtttttgataaaaatg

SEQ ID NO: 99182 - DNA, 61 bp, Heterodera glycines
  Promoter: Source sequence=SeqID_19821; Location=766..826; Strand=+; Gene=SeqID_84560
tgtaccaaatgatctaacccttttttgtggttaaagaaattgtcagatgtttcgctacatg

SEQ ID NO: 99183 - DNA, 60 bp, Heterodera glycines
  Promoter: Source sequence=SeqID_9554; Location=1..60; Strand=+; Gene =SeqID_71871
gttaatttatgtcaaaaataagcaaaattttgcttttcaggttgatttttcgctaaaatg

SEQ ID NO: 99184 - DNA, 475 bp, Heterodera glycines
  Promoter: Source sequence=SeqID_43361; Location=1..475; Strand=+; Gene=SeqID_71048
gttcctagttttttggaaaattgcgccgcaaaaaaagcggttttgaaaagcaaaaaaatagtcaatttatggaccgttaataatttgattcccgatcaaatttttacagtccgatccatttgaaaagtcttagtcaactcatcagccccttttaatgcatcccgccagcccctaaaaatttatttttcaaaatttcgtgtttttttttgatttttagaaatttttttgaaatttaattaaatttttttcgaatttttcaaaatcccgcaatcccgcgcgggatctcgcaaattttaaatgcgggatttgcgggattaatcccgcgggatcccgtcccgcaaagaattttgagttccagtcccgcagcgggatccgcaaatttgaaatttccggtctctagtaaataatacaaaaaaaagaactaaattaatataaattatgaaatattaatgaatacaaatttcagttggttatg

SEQ ID NO: 99185 - DNA, 86 bp, Heterodera glycines
  Promoter: Source sequence=SeqID_3662; Location=88..173; Strand=+; Gene=SeqID_51327
agtatgcaagagggattctttcatttgctcacattttttaatgttttgattagtttttatattcttatttgcaggtgttctatatg

SEQ ID NO: 99186 - DNA, 86 bp, Heterodera glycines
  Promoter: Source sequence=SeqID_12525; Location=1..86; Strand=+; Gene= SeqID_76173
cgcacatcagcgtcaagttggccgaccaacgagtgcaagagggtcagccgttgaaattgcactgcaaagtggagggcgtgccaatg

SEQ ID NO: 99187 - DNA, 430 bp, Heterodera glycines
  Promoter: Source sequence=SeqID_4022; Location=5848..6277; Strand=+; Gene=SeqID_52847
aattttaaagcattttaatgacattcaatatttaaataaaaaattttaaaaataaaatggaaaataatgaaaaaataaataaatacatttgaataattagaaaataaattaatttaaaattggttatcaatttattatgaagaattaaatttaagttgattagaatttttaattaaattatattactccaactagaaattaaatagattaaaattaaattttaacatttaatttcctcaaataaaactattttgtttttattggaaggagtgttgaaggagagaaaaaacaacagcaacaacactatgaacaaaatgccaatgccaatgctgagcaagagtcggcattggcgtcaacaaacactgatagcattgataatgataatgataataatcacccgccggactccgtcattttggcggatgcaatg

SEQ ID NO: 99188 - DNA, 62 bp, Heterodera glycines
  Promoter: Source sequence=SeqID_21756; Location=1333..1394; Strand=-; Gene=SeqID_52353
tttctccgctacggcaaccaaatggcgccacaaccgaattgctggccccaagttcggagatg

SEQ ID NO: 99189 - DNA, 446 bp, Heterodera glycines
  Promoter: Source sequence=SeqID_28925; Location=649..1094; Strand=-; Gene=SeqID_59496
tttcacactggggcaaaattggtggcacggggacacagtggcactctttgccccgctctcgacacatttcccccgggggctttttggttgacattatttgtggtcattcattggctgggcgagaaggtggccatggacggacggggcagtacttattagggaagcgatacttaagactttaattgacccaatgaatgggggcaatgagcaatgaatgggaggaacaaacgccggcatcaacgaacatttgttggcacagccggcaggggggggggggatgatggcacaggcggcgcaaatggtgcgggggaatcatggctttggctaatgattgtaaaagcatagaaaaatcgggggcttttggcggtgaaattattacggttaggtcaaatcaagaagaaaatgagtgagcctgagctggcaaagtgaggagagtcacggacatg

SEQ ID NO: 99190 - DNA, 71 bp, Heterodera glycines
  Promoter: Source sequence=SeqID_39454; Location=813..883; Strand=-; Gene=SeqID_68019
taaaaccgatcagtaagtggttcccgattttgctctttgctaattgcacaaatttttgttcacacaaaatg

SEQ ID NO: 99191 - DNA, 633 bp, Heterodera glycines
  Promoter: Source sequence=SeqID_8493; Location=295..927; Strand=-; Gene=SeqID_68278
gagatccaggctcaattgaaccctaataataatttaaaattaatttaatttttaatcaaataaattttatttattttccctgtgaacggagtgaagaaaatgcagagaaaagtgagaaatatgagagaaatattgtacaaacagacagcgggagaaaggcgttctctgccctaattgtattgtaaaaaatggaggacgtggaagaaattgcgtacgcgcgaggcgaggcaataatcattcgttcactattaaaaatgatggattatttttaatttaatattaaattttaattgatttttaaattttttgtagaaaaattattcgtcattgcaattttagtcctacgtaatcataattattttaaatttatattatgtgaatgaaaaagaaaagccagcgaatttctaattccaaaaaaaaaattctaaaaaaatctatttgggaattaacgacagagttttttcaattttcacaaggctcgaaaattttcaaaaaaatcactgatttaagcgcctgggaattaaatcccataatttcttcgtttttcccatcccaaatttctgagttaaacttagacccttcaaatttttcagcattttttgtatatcatcgtaaaaatatttttaaaaaatg

SEQ ID NO: 99192 - DNA, 115 bp, Heterodera glycines
  Promoter: Source sequence=SeqID_17137; Location=878..992; Strand=-; Gene=SeqID_81575
gtcttttctttttcatttctttgtgtttaatttttctttactccgctgaaattctaatcgcttaataaatcaaaaggaatttatacatataaaaaagtccccctaattggtaatg

SEQ ID NO: 99193 - DNA, 141 bp, Heterodera glycines
  Promoter: Source sequence=SeqID_20744; Location=1..141; Strand=+; Gene=SeqID_51311
agttcgcctcaatttcgtcaccagagagacccaaacatttgaatgggaacaattggccaacaaaagatggacacttttttaaatttaattaataaaagagatttttacccaaacggtgtccatttttagtgaaaatgaatg

SEQ ID NO: 99194 - DNA, 203 bp, Heterodera glycines
  Promoter: Source sequence=SeqID_31719; Location=359..561; Strand=-; Gene=SeqID_62026
cctgtaataaatatgccattttgagatcatttccattgttattgttcttcagttcgttcgtcggatgtcccccgcagggaccccaaggcgatgtttctccctttccgtgctgcccctttttctcttaatttggcatttttcatttgccgaagaaatcattcgaattgattcctccaacaacgaattgacgccggacaaaaatg

SEQ ID NO: 99195 - DNA, 1003 bp, Heterodera glycines
  Promoter: Source sequence=SeqID_6356; Location=943..1945; Strand=+; Gene=SeqID_61259
taatcaaaagaggcatttattttacaatttttaaaaattattaatgcatttttgtacctcttctgccatttgttgtacctacttctctcttttaatcactgttgtacctcttctaggttggtaattaaaatatttttaaataaataaaacaaatgtttatatttattgcaaaatcttctttttctttaaaagacaattaatttaaaccaaaacacattcatcctttaaattgatttacaattaacggttcccctcttaaaagaacaatgacattttactgagggttttgaatttttacgaaaattaaacttttcagtgttatttaaaaatttaacattgccaaaattgatcggcaaaaactgaatattttcagtatttgtttccaggcccaattgaaccctaataataatttaaaattaatttgatttttaatcaaataaattttatttattttccctgtgaacggagtgaagaaaatgcagagaaaagtgaaaaatatgagagaaatattgtacaaacagacagcgggagaaaggcgttctctgccctaattgtattgtaaaaaatggaggacgtggaagaaatattgatttttaaattttttgtagaaaaattattcgtcattacaattttagtcctacgtaatcataattattttaaatttatattatgtgaatgaaaaagaaaagccagcgaatttctaattccaaaaaaaaaaattctaaaaaatctatttgggaattaacgacagagttttttcaattttcacaaggctcgaaaatttttttaaaaatcactgatttaagcgcctgagaattaaataaaataatttcttcgttttcctcatcccaaatttcttagttaaatggcattctttttttttcaattttatacccaattaaaaaaatattttaaatttttttcaaaattttcatcaaggtcttgacccttcaaatttttcagcattttttgtatatcatcgtaaaaatatttttaaaaaatg

SEQ ID NO: 99196 - DNA, 795 bp, Heterodera glycines
  Promoter: Source sequence=SeqID_27812; Location=1..795; Strand=+; Gene=SeqID_58477
cccaaactgggctttttaaatatgggaacctggtaaatcttcttatttagtcaattcttcagccgtttaacgtagggttagactcgcattagtttccgctcggattgagactcgaatacccggcttatacggaaccgaaatatcgagaaagtccaattttatttaagggcataaaaatgatataaaataatatattttgacatcgatccataaagaattgtaatgagtccaggaaaattaaccttttaattgagtgtataattcgcttaaaattttaaatctaatttgattaaaatttttgctttgagattagaggtattttttatatatatttaaatttttttaaatgctaaatattctgcagaatctttccggtgtccaaatttctgttgcccctcgaacaccaagaaatttgacatttattcttggaaatgagctgttttttcttgaaaaacaaaacgcatataaactattttaactattaaaattctttctctatttattaattctcagaaaactcatcaacagttgacgtcggcgaactaattaatttggaaaaagaattggcaaattttgagcaaaatattctccaattttataaattgggtaattacataaattgaccacttattctaattacggttttgtctaaaaaaaatccttcgaaaaatgaataaatggtcgaaagaataatggaattttatgtcaaaacccccaggcacggtaatggctgcaaatttagtaccgtacccgcacatccatgcctggggaaagccgatacatacaattgaaatg

SEQ ID NO: 99197 - DNA, 466 bp, Heterodera glycines
  Promoter: Source sequence=SeqID_10150; Location=1281..1746; Strand=+; Gene=SeqID_73252
ttttgtttgtttgtttgtttgtttcttattcatttatttattcatggttgggaaatttttcaatatttatttggaataaaaattttcaattatcattctcagcaaaattattttttctaaatttaaaataaaaattaaactgtttaaaattgtaaaaaagtaattaataatttttgaacattctctaaattgtgaaactaattgaaatatttttatgttaatgaattttttcaatttcttatatttttaatttttttccctaaaaatgctaagaattaattatttaattttctttcctcaattataagcatcccactgattaaaagctctttagagggaagatcgaaattaagccacggagcttaatcatattttaaaaatagacaaatttatttcaaattaatccattttaatatattttaaaaactttaagtccataaaatcttccaaatttactctaaaaatg

SEQ ID NO: 99198 - DNA, 102 bp, Heterodera glycines
  Promoter: Source sequence=SeqID_1009; Location=2703..2804; Strand=+; Gene=SeqID_65980
agcgtaaaactaaaaatgtacatttagttgaatgtttgttgtttttctatttaaaaataatttttatttgcacttttaatagcacctcttgcgtgcacgatg

SEQ ID NO: 99199 - DNA, 806 bp, Heterodera glycines
  Promoter: Source sequence=SeqID_4584; Location=954..1759; Strand=-; Gene=SeqID_54990
tttcttctttcgttttttgagtgcataattttgattgacataaatttcttgtcactatttttctatatttattcccagaaaattaattttctctgtataaaaatggacaccaaaaagattttaatatatggactttttacattgtttattttgcttgtacttttgtcgcttgagtcacgttttcctgtatatctttgagccgttctagcgactttttcaccatttttcgtccggtgttttcccatttggttggccgtgcgtttcgtgttccgccggcaggtcaattcttttctattggattaaattatgtgtcggacgtgggcggggggggggggggtcattcgtttcaaactctcaggtttaccgttatatcatttatctaaaacggcagaatccacgagtggcgtttttggtgttaatctgttgcgggtttcctaaagtttccattccatcctttgttatctcttgttttatttgctttcccatttttctacagttgcttttccctgttttatggcttcgtcctctgaacaatccgccggtgggcagtgccaccaaaaggcgggggatggacaaacgccggccattgatcggcttgaaggtgctaaaaaagacccaaaggcagtgacggaggacgaatggcgcaaagtgttgtcgccggaggcgtttgaagtgacgcggcagtccggcacggaggtgggccaacaaaaggggggggggtggggagaaatgccattgccagaacttaaaagcaaagccgagtgcaccgtgaaaaatcatcgcatttaattaaattagccgaaatg

SEQ ID NO: 99200 - DNA, 147 bp, Heterodera glycines
  Promoter: Source sequence=SeqID_5721; Location=1..147; Strand=+; Gene= SeqID_59025
gctgttgccaaccctgccaatcagccaccattggtaccaattaatgcccaaatcgtgccaaatttgccggctgttgctgcgcctgcgcctttagccactgctcggttgccgcagctcagtcttcctgttttttcgggcgaaccaatg

SEQ ID NO: 99201 - DNA, 390 bp, Heterodera glycines
  Promoter: Source sequence=SeqID_41356; Location=650..1039; Strand=-; Gene=SeqID_69503
attttaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatg

SEQ ID NO: 99202 - DNA, 564 bp, Heterodera glycines
  Promoter: Source sequence=SeqID_16848; Location=431..994; Strand=-; Gene=SeqID_81271
gttccgggtcaagagcctgtgggtaagggaaaaccaaaacctattgggtgaaacccaagcctattgggcggttggggaggaaaagccaaagcctattgggcggtggggaggagaagccaaagcctattggaggggtgtggtgacatgtggcggctggcagggtgccaagagatggcggcggcataatccaagcctattggagagtgtataaaaaagaaaatttaaaataataataaaaatagaaattaaataaaaagatgaaaatataaaaattaaataaaattaaaaataattaatttacaaatcttaaaaataaaaaaagcaattagtgccaaaagttcctactaaagagccattgattatttgcttttcaaaggaacttttttgtcgcctttttgcaacgaacaaatttttggtcgcaaattttaaaagggaacagccaaaaaagtaattaattaagttcgagaatcggctggctagggcgggtctgtccggatctgtggccgaaagtgccagtttaaaatcatttgaaccaaatccgtcccaattctccctaaaaaaatg

SEQ ID NO: 99203 - DNA, 161 bp, Heterodera glycines
  Promoter: Source sequence=SeqID_10635; Location=2234..2394; Strand=-; Gene=SeqID_73869
ccccccccccctattccccccccattgctcacccatcattttattccttctctttaataattttttcattttttaaaattatttttgaaaaagcaaataaatttaagcagcttggatattctgcttcttctactgccgttgtttctattctatgtaaaatg

SEQ ID NO: 99204 - DNA, 314 bp, Heterodera glycines
  Promoter: Source sequence=SeqID_2430; Location=34..347; Strand=+; Gene=SeqID_47295
catggaattttaaactctaaaaaagccaaaattttaaataccccccaattttcactcatttcttgtagccccaggccatttcattaaaaaattctggcgatttcaaaattctgatttagcatttttggattttccggagatagcgaaaccacaattagagccaaatagtttattatttaatttattttcaaataaaaaaaaattaggcggcactgctcgcggcgctcaatctgcgcgaacggcggtttgacaaatttcgcgaaattgcgaccgaacaattaacggtttacatgcgccaacggattccgaaaatg

SEQ ID NO: 99205 - DNA, 1003 bp, Heterodera glycines
  Promoter: Source sequence=SeqID_13060; Location=363..1365; Strand=-; Gene=SeqID_76839
tttttttcctctctctctctcaagcaccattctcatcaaattctctgtggcatttcattcaaattttgcgtcgttctcactcaaatacaaatttgcatatagtccaacatttaccttaagcaaatgacaaaaatggccacagcatttgaaatcgccaacacataacagcccttcttctttgctatttattcaatccattttaatgatgtatttggtattacaacgatcccttgtcatttcattcacttttaccctaatgagtacctcacaaaaaacctaactagtccctgaattcgaaaccaatccggacaaatatagattcattaaaaagagcagagcctgagctatcaaactacttgccaaatattttttatttaatctccaactcgttttatgtacagttgaaataagacacttttggtttgcgtaatttccaagaaaaagacattttcataaaataacatttcatcaaatgttaattactatttcccatattcctttatgtacagtaagcattgaaattcaaaaaaagtaatagtaatggactacagtatgcattgattttatattacagtttttcttcattaatcgtaatagttttttttcatttctctctacctatttcatcccaaaccgtgaaatttcgcattacctttgttgttccattagccagtgaccattcacgtgttcttcatcggctcctttgccttatgggaggagctaatgtgtccataaaaggctgatctcgatcttcacattcattctcatccgcgaaggaaaatctcttttaatatttaaacctttttttcgctaggcaaatcattcatttctcgatcaaatccttctcacacttcatttatgcttagcacagcttttcaatttcagtttttttctccttttctctttttatttccccgttgtaccttccaatgtttttccttatccaataattgagtataagcaaatgaccgtctgatttaattgggttcaatcttagctaatg

SEQ ID NO: 99206 - DNA, 59 bp, Heterodera glycines
  Promoter: Source sequence=SeqID_21913; Location=1..59; Strand=+; Gene= SeqID_52547
attggtgtcagattcttggtcagcgacttcaaaaaccttttgaacaagttttcgtaatg

SEQ ID NO: 99207 - DNA, 1003 bp, Heterodera glycines
  Promoter: Source sequence=SeqID_2637; Location=930..1932; Strand=+; Gene=SeqID_80838
ggtgtagttgaaaattttacggcatttttttctttgatgaaataaatttagcatgaaaatttcatgaaattttgttgcggttcaaaaaaatatagcccaaactatgagaacggacgggctatgagatacggaagatagggctgtgcgagaagtgatttttactgggaaccgagaaacgagaccgagaaatgaccccgggaaacgatacgagaaccgagacccaaaaaacccgagaaatttctcgactcgggaatcgagaaccgagaaatctaaatgaaattgattcaaatgtatttttttaaaatcaaaaacacattaaaaagggggctaggtcaaacggaatttttgcgtaggagtctcaacattaaagttaccgcattttttgcttttaaaaacgctttttcgcgcatttttccaaaaatttttggggaacatgagggtccggtggtgccggtaggcgctgccggaaaatttttttgtaattttttagtgagatgataacagattttcaccaaaaaggccaatttttgcatggcaaattttaggtaaactttttttcctcttttcccccttagccggcgacctcccgcccgaaacggtcatccttaacagtgtaaaaactcaaaaatctgctctcgtgagtagacgacgacacaaacacaattgccccttggatatatcgcgggggggggggggggggggttttaaagatttttgtgacagtaacggcatttgtcacctcttttcgccaccataccacgcacagtcaaacggagcagccgaaaagtttgttgatttcttcaaaagacagttgaagaaatgcagtggggataaaaattggttgaaacaatcacttttgtcttatcgctccatcccaattgcagttttaaacaatcgatcaccagcagaactgtttctcggccgaccactccggaccaaactttctcttatgaaaccggaacggccgagtccattcttccgaggcccgtatcaataacgcatg

SEQ ID NO: 99208 - DNA, 76 bp, Heterodera glycines
  Promoter: Source sequence=SeqID_10509; Location=4009..4084; Strand=+; Gene=SeqID_73736
agcacataagcagggcaccctttaaatttgttattgaaaccattttaagtacaaagtttctttttttctcaaaatg

SEQ ID NO: 99209 - DNA, 134 bp, Heterodera glycines
  Promoter: Source sequence=SeqID_33971; Location=1..134; Strand=+; Gene=SeqID_63887
ctaaatataaattgcataacaaaaaatatttgccatgtatgaaatctacagaaattggaagaaattcaataataataatgaacgtttaaaaatatataaaatattatgccattattaaataataagtgaaaatg

SEQ ID NO: 99210 - DNA, 617 bp, Heterodera glycines
  Promoter: Source sequence=SeqID_6784; Location=521..1137; Strand=-; Gene=SeqID_62894
aattagtataaaataccacaaaagacccaataaagtttagaataacgttttaagtacttacttttgatatcactcttttgataaaatctatttttaagtttgattttttataagaaattctatataaatattaactcaaatatgcaaaaaggtgaaaataattaggaaaattgcaaaacaaatacaatccagaaaaaaatcttttgtaagaaattcttataattactttttttttgaaatctctattgaaaaattctaaaaattttttatatgaaattatttaatgatttaaggcacacaatgcccatgttttattgaagacacgcattgcatcagctgttatcaacaaatattacatcacagaaacaaatttgttcaacacaataaataacgtattttttaaatttaatttaattaaaaaattacattaaataaaataataaatcataaataaatgaaaggaatttcagtcttacgatttaattaagggtttttgcaaatcctatagttaaattaattaataaaataattgttttttaaattttttctttatttcaaacttaattcatactttaatatttttaataaaaattaatattttaaataaatcatagatg

SEQ ID NO: 99211 - DNA, 1003 bp, Heterodera glycines
  Promoter: Source sequence=SeqID_3269; Location=1062..2064; Strand=-; Gene=SeqID_83975
ttgcacaaggcaactagtcaaggaaaataaataataaattttggagatattttttaaacaaaatttttttatttcttaggggtgtatttgaaaatgtttgggtcgattcttaggggtgtatttttctgaaatttttggattgattcttaagggtgtatgttcttttttattgcacttttgctatgaaatttctggaaaagggccaaaataggtgctaaagttcgaaaatgccaaaataggtgttattttaaagacaaaaagagtgtgtatcatcatcattggaaaaaattaaagaaaatttaaatattttgacgagccttttcccggtccattgccaagttctctctattaattaatgaacctttttttactattaatactttttagaatttttaagtaagaaaaggcaaaaaaatatattttcaatttttctttttattaaaatttttattagggcccaaatttattggatttcatattaatacacttttttcagccgaaaatgcttactaaaaatattttcagcttggtttgaaacttctggaatattttatttccttaatttccattcttcaccttgtgtcaatattttcaaaatttctccatttattcggcattttcatcaaaaattttcatgttcataattcttatttgattattattatattaattttttctcaatgaaataaaatttgttcttcgaattaaataatattttttatattttttcattaattaaatttttttagtctcaaaaaataatttcgtcaacttttttgaagtgaaccaaagcaagcatatgtcgcagcaattgcttctttatgggcccttttcccatctttaattgtcttcaaatcgatcaaaacttaaaattgaaaagccctccattctctttgctttaaatgcgatgtttatttaactagaaattcgttttaaattttttaaatatttttcgggtcttattccaaattcatcagccatcttctcatcaggcacaaaaatg

SEQ ID NO: 99212 - DNA, 120 bp, Heterodera glycines
  Promoter: Source sequence=SeqID_25265; Location=1066..1185; Strand=-; Gene=SeqID_56013
gagagagagagagaatatatgagagagagagaacaaatgagagagagggagaggcagtggaaataagagagagtgtgagagggagagagatggagagtgcgaaagggaggggaagagatg

SEQ ID NO: 99213 - DNA, 318 bp, Heterodera glycines
  Promoter: Source sequence=SeqID_3587; Location=5157..5474; Strand=+; Gene=SeqID_50985
aaccctgttgaagttttaattgatatgttctaccaacgtatagataggttggaacatagaaaaaacaatttaaaaatatattttagagatttggtcggatcgtggtcattgttctatagactcccaccctcactttttgacacttcccgccgggtggttgcggagaataaactggaagaatttttaaaattaccatcattttttcgcatgcttttttataataaatattaaatgttcatgttgtttttaaagtgaaggttttgacccaaatatttaatcaattttaatttattatttttggtagaattccagaaaatg

SEQ ID NO: 99214 - DNA, 138 bp, Heterodera glycines
  Promoter: Source sequence=SeqID_13606; Location=1265..1402; Strand=-; Gene=SeqID_77510
aaagaaaaaggaaaatatgaaaatgaaaaaagaaataaaattgagtggaaaattgcaaaattattaggcacaaatcgccacaaaatatataaatggaaaaaagaattaaatttaaataaaaagaaaattaataaaatg

SEQ ID NO: 99215 - DNA, 209 bp, Heterodera glycines
  Promoter: Source sequence=SeqID_26014; Location=1251..1459; Strand=+; Gene=SeqID_56764
gatcagtcggtcgtccgttcgatcggtcttccgttagatcagtcggtcgtccgttcgatcggtcttccgttcgatcagtcgtccgttcaaacggtctcgaaagaaagacagaacattcggccgccccttcaagcggtctcgaacgaaaaacagatcagtcggtcgtccgtccgatcagtcgtccgttcgatcggccgccccttcgaatg

SEQ ID NO: 99216 - DNA, 413 bp, Heterodera glycines
  Promoter: Source sequence=SeqID_10860; Location=3880..4292; Strand=-; Gene=SeqID_74139
tcgtacgcgtcgtgccgtagtcggtcgaaggtcgttgagggaaatgtgtgtgtcgttggccagcaaaaggcagaaagacgaaaatgaatattagtgagggattggaggagatttgttgcttttatattctttttttggaatgaatttcttttggaaatttaagtcatataaaaggcgttgaattttgcaaaaactttcatttccttgccctctttaattaactattgggttgatgaaaaagttctgacactctgaaaaaacaaattatgcaaaaaatgatatttaattctaaagagattgaaaaagggaggcaggcaattgggatgaatcagcggacggttggccatcttctggccatttgcatttgttgtatagccattacttttgcaaaatcgaacgattttcaaaaaatg

SEQ ID NO: 99217 - DNA, 100 bp, Heterodera glycines
  Promoter: Source sequence=SeqID_34938; Location=663..762; Strand=-; Gene=SeqID_64622
cagcgcactttcctctttgaagcgtcggtcaatccgcgcgcgtcaccgggcgaaattgtgagaaaagcaattcgattttttggcactgatcgggagaatg

SEQ ID NO: 99218 - DNA, 118 bp, Heterodera glycines
  misc_feature (19)..(19): n is a, c, g, or t
  Promoter: Source sequence=SeqID_17065; Location=1..118; Strand=+; Gene=SeqID_81492
agaccgagaccgaaaaccncgagatccaaaaaaacccgagacttttctcgagtcgagactcgagaccgagactctcgagcatcactagttgttatgatcgtgctgataaagagaaatg

SEQ ID NO: 99219 - DNA, 240 bp, Heterodera glycines
  Promoter: Source sequence=SeqID_12124; Location=1..240; Strand=+; Gene=SeqID_75693
accaaattaaagcaaaaaatttgggcccaaccattttaaagcaaaatgcctaattggggtgaattaaaaaaattagggaatctttccccaaattattcattttgttctgtcccaaagatgcccaagcaaaaatccacgcaatttgggtgaaatatcagccgggagatgaatgcgatgatgagcaggaagcgacgtaagtggggaaaaggatgaaaatgatgccaacgggggaaaagcatg

SEQ ID NO: 99220 - DNA, 94 bp, Heterodera glycines; identical to SEQ ID NO: 97954
  Promoter: Source sequence=SeqID_33587; Location=408..501; Strand=+; Gene=SeqID_63606

SEQ ID NO: 99221 - DNA, 383 bp, Heterodera glycines
  Promoter: Source sequence=SeqID_11540; Location=1..383; Strand=+; Gene=SeqID_74977
aaagaaataccgtagccatttgttcgacacataaattctatgatgattgtttattgaatgtaatgactacaataatgctaatactttcattttgcaaatattaaaataatacataaattttttgctggaatactgtttaattacgctgataccgtatccttcgtttaacaaataattgatggcatataattctgctggaaaacggtagtcccatatccatttggctacagtatccatatcatcacaaaacagatattttgtgatcccttccaaaaatgatatgttgctaatgagttgattcattcggttgagtttgtgcttttcagttttgtgccgatcagtttggccgaccagcctccgcccaccattttgcagaagcaatg

SEQ ID NO: 99222 - DNA, 101 bp, Heterodera glycines
  Promoter: Source sequence=SeqID_41671; Location=1304..1404; Strand=-; Gene=SeqID_69745
ttccgccgccgttcgcacttttcggttaagccattcttaacctctggacattcccattgccacctaaattgctctttctcctgctaatgatgatgatgatg

SEQ ID NO: 99223 - DNA, 812 bp, Heterodera glycines
  Promoter: Source sequence=SeqID_18911; Location=1..812; Strand=+; Gene=SeqID_83623
ataaatagggctccaatttttaggcaaaagcctatttttttcctgagctccccgtggcctgaaacgcacgaaaaacatgttttttttgggctgttgttaagctattttttgtgttattaatgcctattttctaggcttttatttttagagcccaaaaagattaaaaaattttgaaagagcctatttttgcctattttggcgttttgccgaaaatttgttaacaaaaatgcaataaaaacaaaaaatacacccctaagaatcgatttttttggaattttaaaaatacacccctaacaaataagcagagattcaaaaatttctgaaaataaatcacctaagaaatgaagattttctcaaaaatcgtctttaaaattttttttggacaattttttgaatttaaaaaataatgtaactcaatactgatctgacttatttttttaccatttgaataaaattttttcattttacacccctaaatttgagactttttagagcctattttccattttttggagcctattttgggggttttttagagcctaaagcctacctattttagcggtttttagtgcctataaattggagccctacttcatatacatattttgaccatcattttcaaaggttatctcctttcgcgggcttttcaaattttcaatgaaaacgaatgaaatttcagtggatttataaatatcctaacaaaaacaacctcaaaattagaagaaaatatcttttttgatactaatccattgattttacatagaaataacctacaataacgataaactgttaatccccaattgtttaaaatg

SEQ ID NO: 99224 - DNA, 392 bp, Heterodera glycines
  Promoter: Source sequence=SeqID_13863; Location=1295..1686; Strand=-; Gene=SeqID_77810
taagccacaattaaatgaatttaaataatagattaacagcacctaactttattggaattcgaatttcatctaaatggttaggaatttcactttatgcaattttattgtttgtactttgtttgtaggtaaaagaaaatttaaaagcaaaattttttcattattttttttaactttggcgtatcgcttcaaattcaaagtgggtttcagtggtactcttctttttgaagattagcaaaaagaacgatacttattgtattgaaatctatctaaattttgtatctacatataatacagtagcgattttaacaaaaaaaaacagttttatgtttttccaattaaataaataccaaaattaacaaatttaataaatgcaaataattaatccaatgatg

SEQ ID NO: 99225 - DNA, 857 bp, Heterodera glycines
  Promoter: Source sequence=SeqID_14494; Location=467..1323; Strand=-; Gene=SeqID_78538
tttattaaatcgctaaataatatttaattgaaattaattttaattttttgttatatttcgtggatttttttttaatatgtttatgtaaaaacaatttattatatatagtttcataatgtcaaacattaaaatttttttgtatataaacagagaagcagaaaaaaacgtggcacgcacttaaaatgttggcataatttatttgtttttcgtcagcggatggacggcaccactagcaacttacgaaatgcttacaattttgaaactgttttttttaattagaaaaaacaattaatttctttcaaataactggcaaaattttcccatgattttgccttgtcattttcgtaaaatcattcgaacattaaaagaatgctgttcgatcggaccgttattccctaaaaatgcataaaaatttatgaaaaaacaaattctggcgttactttgatcaaattacgctgtggaatgccagattcgtcttgaagtcctaaaaacgtgtgcttttcctgtacctctaattaaaaatggtaatttgaattttttttttttaattttttaaaagcctattcaaagtgttttggattcaacgaacaaaattttgttgtttccgaccaaagagtatcaagagtatcacgtaatttgatgaattttattttaattttattcattcattcatcgaattggggatggattttttttttttacaaaaacttgtgcacctaatttgtctttaattagtaatttgcaagtattaattactaattaatgtgcgcaaacctttctatttaaaggcagatgatagtgtttaattggaaatcattagaatatttttgtttcagcaaaatttcacactgaaaatg

SEQ ID NO: 99226 - DNA, 1003 bp, Heterodera glycines
  Promoter: Source sequence=SeqID_3210; Location=892..1894; Strand=+; Gene=SeqID_83730
agtgccaaatttgaattcatattcttttttcagacttctttttctttagcattttggcaatataattttcattttttgttgatgagttttaaataaaataaataatattcaattacgctgttttcatccttaatgacccaattaaaatatttaaatataaagcccttaatcttttatttcatcaattcttacagttgtaaagaattatatagtccagcagaatagaaatagttaaaagtggaatggataattcgttaaaaatatacattccgaaatttgttaaaatttctatgctttcggtagcatttttacacttttaaaatctttttattttaaatccttatttgatgcccaagcatcccaatgcccaaatttactgctggtggcgcaagctcgccacctcataacttttaatttaatatgtagattagttattttaaaattaataaaatcaatctaaaataataatttatgaaattgaaatcattcaatataaagttggaataaatattcatataaaatggctaatatttgcaacattttgggcaatctgtacgttcatattgttcaaatttcctccccaatatggtcacattgccaattctttgtcatcaaatacacaatgccaagatacaattcatgtaaagacaaatgagtatggctgcaaataaatttctcgttttcgcacatatttaaatattttgagatttttagaattaattgaaatttttaatgaaaatgcaaaaatgacatttttgaaaaggtacctcctaaaaatctaaaatcgatttaagaaaaatagatactaaaattaactaataaaccaaaacatcatttgtccatatttacacattttggcggtcatgtttaatgtctgtatattgcgatttttcttacataaacttacgggtcggggtcgttttcgcgtgggccgctatcctatgaaaagtcgatactcaatgaaatttagcccggataaagcggtgtacaaatacagaaaatg

SEQ ID NO: 99227 - DNA, 484 bp, Heterodera glycines
  Promoter: Source sequence=SeqID_1420; Location=916..1399; Strand=-; Gene=SeqID_73444
ttgggtcgtgaactgcttgctgcttttttgttttgttgttctccagaagatattctcgggagtgggaaagtttttcacgggaaaacaaataaatgtacaaaattcggtcctatataagcagaacgatcacagaagtgtggcacagattcattgtagatcatcatcatcaacattcaaagtacccaattcatcataaagtgtcgggcccaattcatcatattcaggccaaattttcaaaaatgaaatcaattttttctgttgcactaatgacacacatttgtccaattatccaacaaaattagttgggcaaaatattacgcccagccaacctgtattcatgaattaaggcatatggataaatcctgatttaacctcagaagcccaatttggcctgatttatacataaaaatttttgtcaaaaattaaaaaaaccaaatttagcaaaaaaaaaagtttccatttcttcacttccgcattgaaaatg

SEQ ID NO: 99228 - DNA, 781 bp, Heterodera glycines
  Promoter: Source sequence=SeqID_7889; Location=1165..1945; Strand=-; Gene=SeqID_66294
tattctataaattgtcatttaaaaatattagaataattttttataaggatttgaaggattgattatttaaaattgttagaatttccaaaaatttcctgggccggcggcacgttgctgcgctttttctaacttttgataaatcttttctttttaaattcagaacagaacccattttccgggcctccttgttttaatttttttcgaccaattttgaacccgttggttgagtaaatttataagtacgtgtatagtcttttcaattttgtaccaatattttttctatttcatttttatcatagctatgttgtaaaattaaaagagtaaaatgccgaaatatctttaatagtaaaaaaatatcttttctcaaatgcaaccaaaaatgacttaaatatagtcaaaataattcacaacagatttgggaataattgttatttaatagttttatcctatctttggaaagtaataagatagagacaaaatgtgacgaaagttttgcaggtggcatgcaactcccggaccaatgttttggcaattttccggagcaaagcttaatgaaaataaaccatttctatgagaattaacaaagaccctgttcagtaaaaaaggggactaactaaaaaattagaatttttaatcgcttaataagttcgtggtaaaatgacctcgtcaaataaccaccttattttgctacggcccctggtggcaatagcattaaagaatgaatatttctaaaaaaatttataaattaaataaataaaaattgcgtctatcatacaaaatg

SEQ ID NO: 99229 - DNA, 237 bp, Heterodera glycines
  misc_feature (22)..(22): n is a, c, g, or t
  misc_feature (33)..(34): n is a, c, g, or t
  misc_feature (44)..(44): n is a, c, g, or t
  misc_feature (54)..(54): n is a, c, g, or t
  misc_feature (91)..(91): n is a, c, g, or t
  Promoter: Source sequence=SeqID_30379; Location=1..237; Strand=+; Gene=SeqID_60789
aaaaggaattaaaaatttttanaaatattatcnnatctcccttntgatagaaanagcatcagagagccttattaaacttttaattaacatntggtgcgtttcagagcactttctgaaaaaatacttatgaattaattttgcaaaaaataaataagtaatgaaaaagtcagaattttgaaaaattttaaaaacaacaagcgttggcattttttcaggttaagttagtcctttacaatg

SEQ ID NO: 99230 - DNA, 454 bp, Heterodera glycines
  Promoter: Source sequence=SeqID_17334; Location=1..454; Strand=+; Gene=SeqID_81815
cttagttgtgtttgtaccaaagaatggagcccaatagtcagtgaggaacaagttaaaattagtcaactcatccacgacaattccaaatggctttgtgcgctggccagaacgaggtccgcgaaaaagtgttgcaagctgatacggaaagcgaacgctgatcaactgctagcgctggtggaaatttgtttgaacattgtcgcatctcgatttcgcttgaacaaacgtcagaagaacaggctgatgccctacgcagattttgttcgctgcctgagcagagtgagaagtgaacgaggcgcgagacgtatgattgttcagaagggagcaggggttggcggactgttcgctgcactcctaacacccgtgttaattgaagttgcaaaatcatttgtgagcaaaaatgtataaataccgtaaaaaaattgttgttatttcacactcgttgtttcataaaatg

SEQ ID NO: 99231 - DNA, 53 bp, Heterodera glycines
  Promoter: Source sequence=SeqID_9359; Location=1084..1136; Strand=-; Gene=SeqID_71109
ggtaaaaactaaaccatttaatgtttttaaaacgaattttcagcaagagaatg

SEQ ID NO: 99232 - DNA, 104 bp, Heterodera glycines
  Promoter: Source sequence=SeqID_30999; Location=1278..1381; Strand=-; Gene=SeqID_61353
cctcccttttgtgcactatttcgtttcaaaattgaatcattttttttggctttttgaaataaattgtgaaaaatatacgaaaattattttagcttttaattatg

SEQ ID NO: 99233 - DNA, 664 bp, Heterodera glycines
  Promoter: Source sequence=SeqID_36011; Location=408..1071; Strand=+; Gene=SeqID_65451
attaatatttttgtgataccaattgttaagtgcgtaactgttgtgaaaaaagggtacgaaaaactgtgataaccccattcagagactagcaaaaaaaatcagaataggattggatttgcgtaccaattattatttttataatgggtttgttaaatgcgaaacagttgacaaaagttgttataactcaattcagagatgagatagaaaaaaacaacaataggcttggagagcccttgaagagctgcaccggatgcaagtgccgccgttgctgtacgcttagcggttgctctgcaatgacggaaaattgcaaaatcagaaaagaccaaatattatcaggaatacactctcccatctcacccgtagacaaaccgaatggtatatgttcgaacggcaagttgactaccgtaactaattaatatttttgtgataccaattgttaagtgcgtaactgttgtgaaaaaagggtacgaaaaactgtgataaccccattcagagactagctaaaaaaatcagaataggattggatttgcgtaccaattattatttttataatgggtttgttaaatgcgaaacagttgacaaaagttgttataactcaattcagagatgagatagaaaaaaacaacaataggcttggagagcccttgaagagctgcaccggatg

SEQ ID NO: 99234 - DNA, 377 bp, Heterodera glycines
  Promoter: Source sequence=SeqID_9794; Location=1874..2250; Strand=-; Gene=SeqID_72707
actgttattaaatgctaattaacaacgatgagtaataatcattaagattcgctttggcgctgctgcgttcgttcggcaacttttcgaattatctcgcaaaaaattgggacggagaattcgattgggacattttgtgatcatgtttttgacaaaaaatcaaataatttgggattccctaatttcgtttcgtttgcggtaagtgccaattcaaacaaatattttaatttgacattcgtggaccagccaatattgaagttcatttatttatttgcctggtgtaaagaaatcataacaaaataaattaatttctaaaacataaccaattgaccacgcataaacaaaaattaaattagatgatttaaattaaggaattgatg

SEQ ID NO: 99235 - DNA, 292 bp, Heterodera glycines
  Promoter: Source sequence=SeqID_17942; Location=2583..2874; Strand=-; Gene=SeqID_82498
attcaaaaatatgaaacaattaaagaaaagttaagagaaaaaggtaaatatgaacgaaaaaatcaaacaaaaattgagacaaaaattggaaaattattaggcgcaaatcgtaaaaaaatatataaatggaaaaaagaattaaatttatataaaaagagttatttatctggcaaaattcgaccaaattttgacgaaatattcggcaacgaatggacaataaaaaagagatgaagtttttataaaaactgaacaaattgaccaaaatgataactctgcggcagttgatcaaatg

SEQ ID NO: 99236 - DNA, 73 bp, Heterodera glycines
  Promoter: Source sequence=SeqID_1231; Location=781..853; Strand=-; Gene=SeqID_70240
aaatcaacaaacggggcacagtaggaacaattttactgccattgaacgaccacagccaaacagttaccgaatg

SEQ ID NO: 99237 - DNA, 93 bp, Heterodera glycines
  Promoter: Source sequence=SeqID_4534; Location=2291..2383; Strand=-; Gene=SeqID_54803
attgtgtaatttattttttttttgccttagttatagtcgaaatttatttttaattttttaattttctaaaatttattttagtctcgaaaaatg

SEQ ID NO: 99238 - DNA, 153 bp, Heterodera glycines
  Promoter: Source sequence=SeqID_37044; Location=1..153; Strand=+; Gene=SeqID_66227
acactagaaaccaaattaccagcacttttaacacctaaaaacagattcctatgaattatttttgtcgctttttgttattttttgaattatttctcgctcttatattttggttttatttttctattagctttttaaattttaatttcaataatg

SEQ ID NO: 99239 - DNA, 184 bp, Heterodera glycines
  Promoter: Source sequence=SeqID_13231; Location=1..184; Strand=+; Gene=SeqID_77063
tatgtcgaaggtgagcagtcgaaattccccgttaattgccttaattatttaattgctttactttttcggtcgactcgccggtcgtcgcatttggtggtgtccgagtggcgaaggtttggtttcgaattgccgtaattaaattatgcctatgttttggcacacatcaattaattaataattaatg

SEQ ID NO: 99240 - DNA, 673 bp, Heterodera glycines
  Promoter: Source sequence=SeqID_26258; Location=1..673; Strand=+; Gene=SeqID_57005
cggctcccgaagcatcggttaaaagaaaagctgttcataaaacattcacatgcctttattaggtgattattttttttctacatcagcttatcagcaattctctctttggcacttattccgccagtttaattaggcacgtatttacaaccattgtcaacgcagcaccgcttggcgttgaaggagggctggcatattttggcaaaacctaccattggcactactaaattcgtggctgatcggggacgaaggccatgctggtgtcggacacttctctctgcgtcgcacacaaaccactaatcgaattaaaatattttattcataaacaattttattttcacataattttggaggaaaaggcgtggatgcgcttggcattttggcattgcacgcccggcggaagtcaagtcatatgatctttccccgaagccttttcgccctttcctttaaaatattgggcggatggtatttttatttttatgttgaaagaaaataaataataaagaaaattttttttttagtgagcaaagtatgattatttctattcacacatttgaaattcatgtgaaaaaggcattgaaaattttcgcttaaaaggccttagaattcgcttaattctgacttcatttcacctttcttcgaccattcattccaatctttaataaaaaaaaatatg

SEQ ID NO: 99241 - DNA, 516 bp, Heterodera glycines
  Promoter: Source sequence=SeqID_3136; Location=384..899; Strand=+; Gene=SeqID_83367
taattaaaaatcttttttttctgaaaatgcaattcttcggtatcaaattttgagtcgatccgcaaatttttttttttgaattattgttaaaatttattattggcgaattgtcttttctagcggttgtgcttggcggcgcagacacacagaattgcatgcgattgcaattttcaatgcactctcttcaacttttttgcgaaatataaacttgagaacgcccgccttttttcattttttggatttttcttttcgactgtcgcattcctctcgcagataattgataggtaattcgaaatcaattaaggaattaactttcacaaattaaaatctcagactattaacactctaaaagagttttccgttatatttgtgcgttgcgtgccgaacgggcttcattataaagatccaacaaacccatctaaacacaaaatttcaaatgtttgcaattcttttctaccttaagctgacttctgtgctttcaccgttaatcttttgattgtttctgaaaccaaaatg

SEQ ID NO: 99242 - DNA, 805 bp, Heterodera glycines
  Promoter: Source sequence=SeqID_1619; Location=1120..1924; Strand=-; Gene=SeqID_74885
actgatattaatcctatcgaatccattttgattaaaaaatatccgaaataaaaagcaagtttttacattttataagttttaataaatatgttgactttttgggcccaattttaaaaatgaggaatataaacataacattcaatatttaaaacataattacaaaaaaaaaagttttattatctaaaaaagatgttttaaaaaaattttcgtttgttatatgtcaaagaaatttgatggtgtgaaaatcgcagaaatggatctacagaagagaacttttttcaaattcaatcccaaatatgttggaaatttaagtggatattacacataaaaagagattacaaaatttcaacaaaatggcttttgtatttgtatgatgagtgtagtacaacagtctcttcagcctaatttcgacgaccctaaaaataaccaattttaggcattttcattttaatattttgaagaagaaattcgattaataatctaaaataaccgacaatggatatttttttggaaaaaaataaataaagaaaaacaaaaaataataataatgacgaaagaaataaattactaattttgttttttgatgcaaaaaaaatcgtcagttcaaaaaattgcgcatctgtcattgattctaattcattatataattcaaaaccagttattcataatttcatttgaaatataaacgatttcttactgctcaaatgcataaattcttcaaaaataattattatttttacaataaaaatgctttcttttcttttttaaattaaatttaaggaattcaattagcattattataatg

SEQ ID NO: 99243 - DNA, 505 bp, Heterodera glycines
  Promoter: Source sequence=SeqID_15720; Location=1..505; Strand=+; Gene=SeqID_80043
gatcagagaactgatcactttatggccaaaacagtttggagagaattaactgacaaatgagtaccaaattgatcggaactaaagaattgtgataaatcattacataaacggatcaaatcgattttgcaagggctaaccaagttcaaatcagataggtttaagaaaagtgacaagttttatgcagcttaattcccagttgattgaataacgaatgatcagtcaaagcagtgtgacaagaattatcagccgagatgtatcaaagtgatcggaaataaacaatagtgataaagtcattagacaaattgaacaaattgctttgccaatgtatgatcaaattcaatcctaagtaggcttaagaaaagtgttcaatttgatgcagctgctgattttccaggtgattgaagaacgaatcaaaatcagagcagcagcagaaaaaggccaaagtgaagaagccgcgggcaatgacagaaagggggaggcatttttggaccttttgttggagatg

SEQ ID NO: 99244 - DNA, 1003 bp, Heterodera glycines
  Promoter: Source sequence=SeqID_11679; Location=951..1953; Strand=+; Gene=SeqID_75148
gttcatgtattctgtttaaaacgctaggctgcttcaactttcgatgagagaggtcgcaatttgagtatggagaccgtttgagtgtgactcattaaatacatgcatttgataaattcatttttaattagagcaactctccaatggcattggtcattttttggtcaaaattcataaaaaatttgtatggaaacattaaatcgttggcggaaagttaataaagatttgcagaataatttttcaatttgtccttctttttaatttattttaagtgagacaaaatgaatgaaattattttatttaaaaaataaatgaaaaatctaagcgaaaatttaaaaaagaaaatataattattgaaaattctgctcaaaatcttttcgcatttaaaattttaatgcgatgaatcagcaaaaaaaaatggaaaaaattggagcatttgcacaaacaaaagaaaagccaaagcgcgtcgattaagcattggtattttggtctatttgcgatgattttttgaaaattggaccattatttgcataacagcaaaaataatccgccgttatttgggcgagattaaaaatatgaaatcattcgcctaaattttgtgtcagcgcattcattgcataaaataaaagaagaaatgcgggagaatttgcatttcatttccaaaaatcattttaaaaatatcattttttgtgcatttccgttgaattaccctttaaattttttccatcggttcgatttgtttgaagtgcgcggccaaagagtggcggcgcacttaaaaatggcaattatcgatttgcggaacgaatttaatggaattaaatatttcattttaaaaacaaaataatttttggtttttaaaaaacaatttaccagaatgattgacaggtggcaaaagaatgaataatgagaggaaaaaaggtacaagaaataataaatatattttaaaattaattacatttcaaatttaaaatcagttttaattgtgtccgtcgctgtcgtctcaatg

SEQ ID NO: 99245 - DNA, 619 bp, Heterodera glycines
  Promoter: Source sequence=SeqID_21057; Location=798..1416; Strand=-; Gene=SeqID_51646
aatgaatgaatttgacagcacaactccgaattgaaaaaccccaagtcaaatcgatggcatttcaatattatttcttttttatggtgtccgaaataaaataatttttcaaattcactttaaaactttcaccgacgatgtgaattttttcagtataaaaaaatattttaaatcaaaaatgtaattaattttaataaaattgtcgttttcacaataatttctttagatacgtgtaaaatcaatttctttattgatttaaaaatgcaaaaattctttcattttatttatttttagagatttaaacaaattgaattttaatgcaattaatagcatggatttgctttattctaaaattccaccaaattacaagcattggcagtaaattgacactggaagtttctccaagtctgtacgagcattctttgtttaggtatataatatttaaatacgtttcaaaataaaaaaataatattaaatatattttgattcattttaaaacagttatgcgattgatgttcgttgtactgatttaaatggcaacaaatggcaaacattatacggcagcatttggaaaaattacccgtcccattcgttttttcagacagaaaagagtggcaaaatg

SEQ ID NO: 99246 - DNA, 179 bp, Heterodera glycines
  Promoter: Source sequence=SeqID_9672; Location=1..179; Strand=+; Gene= SeqID_72285
ccccccccccccccggtaatttgttaatttttcccaaatattccctcaatttgctttttcttagattcgttcgccgcggtttcgtctccgccagtctccgaaatgaaacaaatttcgttgtccgttgtgctgttgagaattgctttctgttgtccgattacgagggacttgacgtaatg

SEQ ID NO: 99247 - DNA, 1003 bp, Heterodera glycines
  Promoter: Source sequence=SeqID_15012; Location=232..1234; Strand=+; Gene=SeqID_79167
tattatttttatcgaattctcaaccggtatgagtagattcggctactgaacattggggctttcgttatggatcttcattcattttcttgcctgtttctgctcagacatttctctgtcggacgggcggaaatgaatgccattttgaacaaaaatagcgcttccgttgtcggggcaacattgtgtaagtaagaagaatcgggcattttctgtggaaacagagaacattgttcagacacgacgctttttccatgtgcggaatgtgccaaaatgatcatccaatcgcgcatcagtcgggttgtttatttgagcgacaaaaataccgtccaaatggaggcttcgcgtcgccttttcaacatcacaggcatcaaattcaggtccgtccttccttatccctctcgcaaataaatgcatattctcattttactaatgtgtaataattgttccctttagccgatacgaatcctctcgtcccgaggtgactctccgcttcaaatgaactcttctgacggtgccgtgccttccattttataattttctttgttactttgtcttgttatttgagctgcctgctctcataagggcattattgtatttctgtcctcactttcgattttcatgccaaattccctcactttctctttttaccgaaaatgccttcgattaccctttttccctgtgctttccttttctgtttaattcatttatcgattgtctttgctcgccttcgttcgtttgtttgtccatctgtcctctttcactgatttcttcttttgaccaacttttgcatacctttctttttttcgtttaaatgttggcataagaaatatgggtatttttgtcattccaaaatgttcttttttgtttaaattgataaattttagggaatttctttgttggtttaaattcaagttaatttttcattgtaccttttcggatttttaattattcgactaattgtaattggagtaaggttaaacgttcccattgccttccattaaaaatg

SEQ ID NO: 99248 - DNA, 90 bp, Heterodera glycines
  Promoter: Source sequence=SeqID_1831; Location=1227..1316; Strand=-; Gene=SeqID_47049
agtaaaaaaacaattgaaaaataccgtaattattaccgtattcccaaggccttccgcgtgaacaccgactcggcctggactgatctgatg

SEQ ID NO: 99249 - DNA, 216 bp, Heterodera glycines
  Promoter: Source sequence=SeqID_10448; Location=1361..1576; Strand=-; Gene=SeqID_73653
actaaatgttgaagtatttgaccaatgtcacggccattttgagcagaagtgcaattcagtcggactaatgtttttgtgaatgagaatgaataaatgagagggaatgttttatcgccaacaaatactgggagggttcgccacgcacagtgaataaaatcaataaacgacctttgatatggaagttgcacaaatgaggtgagcacagcggtcgcaatg

SEQ ID NO: 99250 - DNA, 270 bp, Heterodera glycines
  misc_feature (19)..(19): n is a, c, g, or t
  Promoter: Source sequence=SeqID_14404; Location=1303..1572; Strand=-; Gene=SeqID_78441
gaattatttcagaattttntggcccatcaaatcctttttcattttgtcattttcaaatctaccataaacttatgaccacccaaaaatagggtgtggtacactcaggcgaaagttgctccgtcactaaatattccctagagaagataatggtgcctttggaaagccacagaaaatgctataaaaaacatcaaaacattaagcgtaaaagatttcattgaaaagttttatcaaagcaaatagaaattgagagcaccctaccataaacatatg

SEQ ID NO: 99251 - DNA, 220 bp, Heterodera glycines
  misc_feature (20)..(20): n is a, c, g, or t
  Promoter: Source sequence=SeqID_7080; Location=2474..2693; Strand=-; Gene=SeqID_63784
attgattgtcccagaacttnttttgaaacccaatgacattttatggaattttaatatttattagatatatagaggagttaaaattcaaaaaaaaaaaataatttaactgcttctgagaaaagttataaatcattcgatagccctaagaattctctaattatttttaaaattaaaaaaaaattcattgggtttttaaaaagttctggacaagtcacaaatg

SEQ ID NO: 99252 - DNA, 180 bp, Heterodera glycines
  Promoter: Source sequence=SeqID_37216; Location=1..180; Strand=+; Gene=SeqID_66340
gtcgggcaatggaaatggcacagatttgcccatgacaaagagttgtggcattccattgtccttttgaattgtgattgttctccaaattgtcaattcggctttgccattgaaatgtttgttcaccagcccatgtgacgaaagaagtgccaatttgaggccgagttgggcgcggtcaaaatg

SEQ ID NO: 99253 - DNA, 1003 bp, Heterodera glycines
  Promoter: Source sequence=SeqID_1347; Location=277..1279; Strand=-; Gene=SeqID_72950
cctacgtaattttttggggtttggcttggacttaggtacttttttgttagtgttctgtcagaataaggcttgtgtgatttttggcatttttaggtcgtacatttatttttgttgcttcgatgtcgccaaaatcgtctcatgtcaattacgatcttctgccggaaatttctcacaccttccgcagccctgaaccccgaccatctgttctagtttctgacatgttttctgttttgtgtgcttcgccgcttatcatccttttccttttggtaaatgtttaaatttggatgttttttctacataatttttactttttagtggcttcgtattggcatcaattttggaaaattcaagttttcgctcagtgctcttggtaaataccactttttaaattctctgtcatattattattgttttatatttgtccatttttagggtttcatcttggtctgtgtgctgtttttgggctctacgttttcttctggctcgagttgaacatgttccagacgttgaaatggctggctgttattggcgtgcccactttgttccttggaagtcgtctttccttttaaaaccaatgctttaaagcttaacacaccgttttttgggatatattgtatttcttaatttatatgttggtaaataatattatggttttttaaattccatttataataaattgctgtatgaactttaaacattttgttgtcaatcagtatttgtgaacattatttactgtcaatgtgaacctcaatttcttaggcctataatttttttttattgggtcaaagcatactttcttggtatcaatcgaaagttaaagtttatagaatttttcaaaattcagtgtttaaggaaactcaaaaaattaatcccaaagtacctatactcgattaagcggaattacggatattctcattttatttgcttttttctaactataaattccagagactttgtcgtttggacgcataaactgcactaaagcctgtttttaattagtatg

SEQ ID NO: 99254 - DNA, 799 bp, Heterodera glycines
  Promoter: Source sequence=SeqID_7503; Location=6055..6853; Strand=-; Gene=SeqID_65033
acaaaattaagaatttttttcaatgaaaatcagctaaaaatataaaaaaaatatggaattttgtgttgcgaaagaaatatggaaaataataataattttatttaaaaatatatctataaaatttgcattcgaaaacaaataaacaaatatgatgaaaacaaaattatctaatcatttaaaataataaattgcttcattattcgtcgctcgttgaaaagtcgtctgatttgaatgttattaaaaacaaaaggggtaggggggctttggtttgaattttttttttttttttgtaaaattatttctactaaagaaaatttgttcttgaggggttttgggatccctgatcacgaatctcacatcagttttaaccaataccgacttccgaacctaaataaattttgcacatcaacagagtccccccttagggtttttaaaaaaattcgaaatctacgattttaattaacatagcgctcattattcaaatatgaattcgaaaaagaatttaaaaaaagtaaataatttaatttttgtataaattaaataaaattgtgtaaaaataaattgaaataaggaaatgaatattaaatttgtaaaaacaaaaaaaaaaatcaatcaaataataatgctactttaaatcacaatgattcaattatttttatttgttatattaaaatttttcatttcattcgaaattattttttttacaataaaaaaatttaataaatcattttactttatataattttaattttttagataatttcgttgcaataattgtaatttcagagacataaaaatg

SEQ ID NO: 99255 - DNA, 466 bp, Heterodera glycines
  Promoter: Source sequence=SeqID_8610; Location=1..466; Strand=+; Gene= SeqID_68674
agtagttagtactgccacaccgtcgtagcgcgcgaagatttcgcgcactagcgacagggtattgggcgtttttgcggcgcggatcaaagggtttcgcgcgttgggcgtagggtttggggtgggtgtcggcgggctcaaaggggggtttggggggttggtcggggaccgtcgtagtgcgcgaaattttcgggacaggtggtcagttaaaattcgaggacatgtttgtgctggtgggggcggatggggagcgtggtcggggaaaagcgacgccaattgattgctgaccaccccctccgtttttctctcctcttccactactgttatgacctccactcgcaatgcctcccctccttcgcttgtgatgccgaaggtcattatgacccccccccccccatctgaatctttttttttgttttgtttctttatttcgtagtttttttatttttttgttttaaatttaaagatg

SEQ ID NO: 99256 - DNA, 307 bp, Heterodera glycines
  Promoter: Source sequence=SeqID_15293; Location=1109..1415; Strand=+; Gene=SeqID_79517
tttgtgtggcaaagttatgggaaaggttaatgaatatcattatgagaactttttacaaattttagcatatgtagtacaatatcatttttcaaaaaaaaaaaaaaattctttaaacaattttataatgtaaattgtttatttgggtatgatatttaattgtaagcattatgtcattttttaaaattctttattttatgtttccattttttccggcatgaactaaacagtttaaaaaattttagaaaaatttggatattttaattgctgattatgaattttatttgatttattcagttctcctatgatg

SEQ ID NO: 99257 - DNA, 396 bp, Heterodera glycines
  Promoter: Source sequence=SeqID_17205; Location=1162..1557; Strand=-; Gene=SeqID_81674
ttttattaggcaattttttaacatatatttttattacaaaaatacaaaattatatttaattttaggtttctaataaaattgaaaagaacacctataaaagaaaaaattgatccaagacaattgagaagtttgaatttttagtaggtattattttgaaaataagcttaaagttcaaataaaattttcaaaatttttgggataggcttaagattccgactctctttgattcgagacaccttaaacatgaaaatcaaatagctttgaaatcattaaatcaagctattaaaagaagcatctgatgctgatgatgataacaataacttaaactcaaacaaatttgatgaataaggtgtttattcaaattgacaacaacatttttccagtcagcataaaatg

SEQ ID NO: 99258 - DNA, 1003 bp, Heterodera glycines
  Promoter: Source sequence=SeqID_3210; Location=169..1171; Strand=-; Gene=SeqID_83731
acaaatttcggaatgtatatttttaacgaattatccattccacttttaactatttctattctgctggactatataattctttacaactgtaagaattgatgaaataaaagattaagggctttatatttaaatattttaattgggtcattaaggatgaaaacagcgtaattgaatattatttattttatttaaaactcatcaacaaaaaatgaaaattatattgccaaaatgctaaagaaaaagaagtctgaaaaaagaatatgaattcaaatttggcactttccgttctaatgtattgttttcaattttcgtttaattttgtttataattttttttactttgctcaaaattgaataaagcacaataacttttccaacttttcaaattttcttatttttattttaaaataattcctttattaaatttcaatttatacaattgtgagtgcttgcacttttctgttttttgactcagcacgctttcttttagcttataattatggatagaattttttaattttatctgtttagcttttattacccgagtgatcattcaaaaagtcaattaaatttaatgaaaacgaccaaactaatgatggcgtctgagcccaataatgagaagcaaacaaatttaattgatgaaaatttctcttggccaaattaacattagaaattggccaaatgataaatagttcagctaaacaaattttgttcaaattttttgggtttccgtcaactcgaaacaaaagtttagtttagtcaactgtcaagtgcataaaaattttttaacataaattttaaataattttaatcgatataaattggcatcaattgaatggttggctaaagaaagatcagctaaacaaattttttgttcaaatttcaacaaactttggttctcctaagcgcaacaaaatttttgtttaaaagcgattaactttttagacattttcacactaaaataatatcaattaataaattgaataaaaattaattaatcaatg

SEQ ID NO: 99259 - DNA, 408 bp, Heterodera glycines
  Promoter: Source sequence=SeqID_12058; Location=1..408; Strand=+; Gene=SeqID_75586
attcttaaaacgaaaagattacaaaatttgtttgtccattatctgcaaacggtgctctaatttcagtgaggctctaaatatatttttaaacaggaaacattgctgtgacaacttgccctcggattcgacattgagtgcgttgtgaaaaaaaaaatacaaaagctaaaatggattctttttttaatgtgcaaataaagtgacttatgcaataggcattactgccttttattacgcaaaaatagttggcctttttcaataaaaaaaaatcgctaatcattgtaacataataaacttagccaacagcgatagaaattaaataaaatccaatcatcatcattatcatataaatttaatgcattacagaatttaagaaaatgtttggggtcaaagattgacgaacggaggatg

SEQ ID NO: 99260 - DNA, 1003 bp, Heterodera glycines
  Promoter: Source sequence=SeqID_2701; Location=1487..2489; Strand=+; Gene=SeqID_81163
ttaggaatcgagaataaaatgatcttttagtttgccgaaaaagtaattaataattaaatatggtgagaaaaaagcggcaacttgaaaaaaaggtttcctaaatttcatgaatgcaaaaatgcaaaaaaaaaatcaagctgagaaaaaggggcaaaggggcaatatttaaggcagatgccgttttggcctgccattagtcttaaatccccatctccatttttctcaccacatcattctgtccatgccacaaattttagcactagattgaaaatttaagaattttctgaagcatttacacatccattttagcctttttcccacatcccgtcctaggtaatatttttgttcctaatttttttaccaaaaaaaacttaccactatctttatttgaaaaggacgtccttaaaattcgaattctgtttgagttgttccttaattttttgcagaactttagtattttaaccaatttttaacaaattcacacaaaaaataatttttcatggcgacgcctatcggcgaatcctgactaaaatttcttttaaatttctgcccaaaatctgcaaaaatgctcaaaaaaattgtcaaaaattgcaaaatgaaagaatttttaaagacaaaatttctaaaaaatttttttcccaggcggcgcctatcggcatctccggtgctaaaatatgggagaaacttcattttggagaaaaaaaaaacaactgaattgaataaaaaatgttaccctttttattgatttaataaattttttttgagttatctctgaaaattacacaattcctccattatgtccttgaaacccgacatatttgtcttttcaaaccaaactaagtagatacacctgttttactttaaaaatagaaaaaagttttttagtgtgattgagttatatttttaattattttgtgcctatttctccctattataatattttcaataaatttattataatttccaataaatttaatatattttttcctttagaaccaaaatg

SEQ ID NO: 99261 - DNA, 1003 bp, Heterodera glycines
  Promoter: Source sequence=SeqID_19504; Location=561..1563; Strand=+; Gene=SeqID_84229
ttgtctttttaataatttctgttcgagaatgtctgttgatatcgagaattttaattttcttaaacaattttgcttttaaggacaattaagggtatattcttctgcaaattgagggaaatgcatttgattttcctactgattttgccaatcctttggccggccaaccatcgaatgccatggacaaaaagtgccaaaacattctgacaaaatgccaaacgactcaagcaaaatgacaaaacactctgacaaagtgtcgaatgattctagcaaaattcccacccaaattgccgtcgggacagattattttttgctcgaaaaatatggacaaaaaattctaggcaaaaatagcaaacacaatgaacaattgaaaaggtcattatagggctaaagaaaaaaaagtatctgctggaggaagtttttgctaaaaattcaaaggtaattaaaaaagggtgatgtgtaggacagtcgcttgtgggacccatatttccaattagttgatgggtagagagaggagattgatatagatcatcaatagtaaatatttttaagtgtttgctttaatttaatataggattcctgatattaaataacaaataaaatttttggaaaattgatcaaaaatggggaggcaaaccggactagtacctgtttttcattaaatttgttgtttttgccttttcattttcaaatgcttttttaggccgtctttgcctcgcgttacacaatcctcgcgctgttgaaaaagttcaaagttctcaacataatattttttggcgattttggaatcggtgccctctgggcatttaacttattttaaaaatgtttattcttttgccaacaaaatttatttgcaattttctctttaattctctgacttttgagcccaatttcgaaagatcgccaaaaaaaaagaaaagaaaatactgtttaattcgtctattctttgcagaagaaaattttcaacaaattgaagcgtcgtttgggcaccgaagaggcgaaaatg

SEQ ID NO: 99262 - DNA, 160 bp, Heterodera glycines
  Promoter: Source sequence=SeqID_6613; Location=900..1059; Strand=-; Gene=SeqID_62203
aaaaagggcaaaaaaatgggaaattgggtggaaatagaaattctattgggggaggcgaataaatactttgcattctacactttcatcagtctttaaaatccattttatgacctaaattgaccctagtcaataaatgattattttccacattttagcgatg

SEQ ID NO: 99263 - DNA, 604 bp, Heterodera glycines
  Promoter: Source sequence=SeqID_31243; Location=538..1141; Strand=-; Gene=SeqID_61617
tcccggcaccgggactcccgtttttacgggactttcggtcctaatggtttgtccaaaaaatgggaactgggtcgggagtcccggcaaaatcccggcgggaccccggtccgtacgggccctaatggtttcattcataaactcttatttatgaaaaagtgataaataaattatttatgaaggcctattttataaaatatgtacattaatcagggcggccaagtgtccttatttgtaagatttgtccttattttggcacgacctccttgctttgtgcttattcatggatttgaaaataaaaatgcaaaaatttaatatttttttaattacatattgttttttattgaagcgaatatttgaattaattcgtttttgtaaaaaatttcatttttatttttctttagtgtaaattcgttaattttaaatgcccaaaatgcccccaaaacgtaaaaatatctatttaaagtgataaatatattatttgtgaaggcctattttataaaatatgtacattaatccatgttaattggaaaaggtattttcgtaaaatttaaatgcacataatttgcttaaatcgttcttttttattaaaaaatttagaaaaatg

SEQ ID NO: 99264 - DNA, 149 bp, Heterodera glycines
  Promoter: Source sequence=SeqID_3532; Location=1..149; Strand=+; Gene= SeqID_85053
aagtaagcgcagtgaatgaaaatcagtcattactttgtccacgaaatgacaacgcaattccctttaattgttcttctctctgccatttttctttagccaattttctctttttcagaatttgttcgcagcccaaaaacgaaagagaaatg

SEQ ID NO: 99265 - DNA, 421 bp, Heterodera glycines
  Promoter: Source sequence=SeqID_13796; Location=1..421; Strand=+; Gene=SeqID_77726
cgaaatttgaccaaaaaagatctattttaagtcaataccttccactaaatacaaatcaaagatgcatttttcgaggctacaatttttttttcttcttaaaatcagaattaccgaccataaattgataggaaatcggaattccgtgtcttcctgacccatatatcgcatataagtttgaatatttagaatttcttgtaatattttttcattttttcgtcccacatctgaagggtattcatgtatctttttaagacacataggatggaattccgaggccctaaaactttgaatgtcagcggaatctaggagacctccaaaaattttttggaaatttgatttcaaatttccatccctgtaactatgtatatatcagtatccgttttttaaacaagaaaattcactttccactgtgcaaacaatg

SEQ ID NO: 99266 - DNA, 175 bp, Heterodera glycines
  Promoter: Source sequence=SeqID_23787; Location=1..175; Strand=+; Gene=SeqID_54488
aaaataaaaaaaaattaaaatatttctaaaatggaaaaacattttagaatcaaccaagaaatgccgattcattaaaaattattttaaaagagaaaaaacatttaaaaataaaaataaattatttgaaatatttttaatttcaaattttttttagcatcaatcaagaaatacgatg

SEQ ID NO: 99267 - DNA, 74 bp, Heterodera glycines
  Promoter: Source sequence=SeqID_915; Location=2435..2508; Strand=-; Gene=SeqID_63921
tattaagatggtacaaagaatgtattacttgtcagcttaggcattctccaaatcctccttatagagcagaaatg

SEQ ID NO: 99268 - DNA, 249 bp, Heterodera glycines
  Promoter: Source sequence=SeqID_4157; Location=2973..3221; Strand=-; Gene=SeqID_53402
tttatgacgtcatttgactcggctttcccttcgcttcttcaaataaaaaatgctttaatttatttctttctttttgctttgcttttgcaaaatttgcagaaaaagagcataattcaatcattaataatcattcacaattctcacattttctcctcaaattaatgttcaattttgtttcatttaaatgccattttctttttttacattttagcttttaattttattgctttttttaattgttgccaaatg

SEQ ID NO: 99269 - DNA, 505 bp, Heterodera glycines
  Promoter: Source sequence=SeqID_7794; Location=1..505; Strand=+; Gene= SeqID_65995
ataggtagcttaatagcagcttagatttaactaattgttaggagactaagaaaaaagctaaatcctaaaaaatggccctgacgtactttccctttcttttttactttagaaaaaacaatacacttacagtatcaatacagaatattgcaaactgcggctgccttaaacacacagtgactattattgttcattggcggtttacattcacattatgctgctgccggtggttctgcttgttgctgggattacggtaataagtttggcaaaacggtacaattattggcccaatggaaatgtaaaatgtgaaattgctttcgtagttcgtttttgttgagtatcgtataagaaaaaataaataaatttaattattatttatctttatttgcttttaatttgttcattttcacccaaattgttcccattttcggccgatccctgcgggaattacgaagcactaacccaccaattcttcgaccacatttacgagcataaccatgacaaaatg

SEQ ID NO: 99270 - DNA, 129 bp, Heterodera glycines
  Promoter: Source sequence=SeqID_398; Location=332..460; Strand=-; Gene=SeqID_51353
tctcctgttaaagcatttgtatttaagaatgaacatggaaaataaaatttaaattttcaaaatggcacatttattaaatattacatttgattgggatgttgacaagggcgcttttttggttgacgaatg

SEQ ID NO: 99271 - DNA, 59 bp, Heterodera glycines
  Promoter: Source sequence=SeqID_5210; Location=590..648; Strand=+; Gene=SeqID_57277
ggtgagggagaaaaaacccataagacaacaatttgtcactttagccaaacggagcaatg

SEQ ID NO: 99272 - DNA, 906 bp, Heterodera glycines
  Promoter: Source sequence=SeqID_19697; Location=1293..2198; Strand=-; Gene=SeqID_84446
tatacgaaatctgccagctacggtaattgggaggttatgtaataaaatgaaaatggtaaaaaaaaacacttggtcctcaaattttgtttacgtactggtgttggaagctaaccttaaaagatcacttagagcttattaatagtgactgtttttttaatgtaaatacatattttttcctggcttctccatagcctaattagtaggaaaaacactttcttttttgagtttacgaacaaaaatcgcgatttttatttacatattttcggatttttgtccatatttccatattttaaatctatatttcggaattttcacaaaaaaacaaccaaattacacccctaaagatggaaaatttttggaaaataagcccaaaatcgaaaaattttcagaaaattaccaaaaactgcgcaaaaaatttttcatcagaaaattcgggtaaaaattaattttttgcaaaaatttactattttttgcttttttttaagtaaattaaatttttttggtaatgaataaataggaggcctcaattatcaaattatattatttatgtattaaaaatgattttttatttcttgaccggaaaatttatgggtttatgtttaaaaattccaaccaattttcagaaaattttgtgccaattttcgttttttttgtcagcgtttttgtccatatttcgtccatattttgcgatttttccgtccatattataatccatattttggattttttttgtccttataaatccggtccctacctattacatatgtacgtatttatatatatatatatatatatatatatataatatatatatatatatatatatatttctagtttggtatttctgtaaaaaatatacattcctaaaatctgtttttgagttcagcccccccccccgaagccatg

SEQ ID NO: 99273 - DNA, 570 bp, Heterodera glycines
  Promoter: Source sequence=SeqID_1768; Location=1..570; Strand=+; Gene= SeqID_75835
attttttaagggcgacagtggcagtccgttgctaagcaaaattggtgacaagaattgggtccaagttggtgttttatagagaccggaccgggccgggcccggtaccggtttttaccgggcccggaaaccggaaccggtgatttttggaaaaatccggtttgaccggttttccggtttgaccggtttttgagagaccgggctcggaaaccggtcgttttttaaaatgtaacccggcccggaaaccggccttttggaccggttttgaccggttttataatcaagccaaaaatgtttctttttgttcatttttctttgaaaatgtctttttggcataatgtttttaattttttttgtcaatgttcaagttgaattttttaattctaatgtttgcttctttataattattaaataatgtcttttttgtttagattttatgcaaatgagtttaatttggcaaattggcctatttaaaaaaacgtccaagactacagcaaaaatgaattgaaggaatgggaaattgataatgacctcgatgaactacaacaaaatgaatttgttcgtcctgttatg

SEQ ID NO: 99274 - DNA, 92 bp, Heterodera glycines
  Promoter: Source sequence=SeqID_10178; Location=5254..5345; Strand=-; Gene=SeqID_73283
tctacgatgcgagtgcacacgccaagggagtcccttccctcaacgactgtttgttgagagggccggtttggctgccggacctggccggaatg

SEQ ID NO: 99275 - DNA, 873 bp, Heterodera glycines
  Promoter: Source sequence=SeqID_348; Location=3478..4350; Strand=+; Gene=SeqID_83556
aaatttgatatttttcaaattaattttttcgactatttcattttgtgagaatgaatattttgataaatttttgtaatttaatttaattttaatataatttttaatggtaatattacctattgtaccccgccccctttttttcaaaaagcaaatttttctaaaaaaaattttaaaatagttgttttataagttttcaggatcggagaatagtagagttatccccctcccatgcataaactatccacaagggtaaatgtgcacattgaattgattttgggtaatacttgaatttttggaaaaaaagaattttaatttttgattattttttcgcaagaatggggagacaaaaaattcaaaatattttaatttctgtagagggattgaaacaggggaaagaagaagggaaaagtcaaagagactagccactagaccatttgcacaatttgtattgtttctttgaaagaatatatttatgattatttcttaattttttccttttaactccaattttcatcactaatttttcactcagaccccattcttaccagcgcttgtttttcccggttcccggttgccctaccgggaccgggacctgagcttttcaaaatccgggaccgggaaccgggacctcggatgaccgggaattcccggcccggtcccgctctactctatccaaaattcaaattctaatctagatttatttatattacgccaaggcgaaaaattcaaaactaaaggtgaggattattggctaactcagctgaattttggtgtctcaaacctcaacaaaaaatttatgctgcctaaattttaaaaaaacggaaatctgctgagaatttttcattttatttttgcagcatataagtgcaaatg

SEQ ID NO: 99276 - DNA, 178 bp, Heterodera glycines
  Promoter: Source sequence=SeqID_15387; Location=3589..3766; Strand=-; Gene=SeqID_79648
ttttagttcgtcgctcctctcgcttgttctcccttttttgccttgctcttttgcaattgagcttgtgtggcaaatttcttttagccattaaacaattaaaaaagtcaacgaaatctttaaatatgtattacaaaaaaacaagatagaaaattattaaaaccttatagaacattcgatg

SEQ ID NO: 99277 - DNA, 579 bp, Heterodera glycines
  misc_feature (24)..(24): n is a, c, g, or t
  Promoter: Source sequence=SeqID_2472; Location=1..579; Strand=+; Gene= SeqID_79894
tttataacaaatatacaatttaancatcatcggcatataaattttattttcactcctgatggcaaagcatcaggaagatcgttaatataaatcaaaaataataaaggtccaaggacagagccctgggggacgccagagccaacttttttactggaggataaatcatccccaattttaacacgaaaagtcctattactcaaaaagtcctttatccacatcaaaagtttgccccttatacctattttttccaatttgtataaaaataattcatggggcactgagtcaaatgctttttgaaaatcaatataaatacagtcaacattttttccatttattattgcctcgtaccaatcttccacaactgttattagttgactcgttgtagacctattcctaacaaaaccaaattgaaattccgaaatttttttgttttttaatagaaaattgtaaatatttttgcttaaaattctttccataaccctgcatagtgagcaggttaatgaaattggcctatagttttcgggattatttttgtcaccctttttaaaaagcggaaaaacaattgattctttccagatg

SEQ ID NO: 99278 - DNA, 1003 bp, Heterodera glycines
  Promoter: Source sequence=SeqID_1556; Location=2879..3881; Strand=+; Gene=SeqID_74445
ttttgttttttccttttttaagaatttaaaaaataaaagtatttttaaaaccaaaaaacatttaaaaaaaaccacggttaaggtctcaaaaatggaaagtcaagaatttttttaaattttgttttttattttttgggtaattcaatttcgttttcatgtatggtcgagtttccttttcttaaaaaaaagtttaggccgaataaaaaaaactggggccgagaccgtgactttaaagcttgcatcgagctcagacaggattttgtaaagcagaaaaacgttggaaaattttctgatcataaaattatccattaaataacatttgttttaattgttaaattcccggctttttcccggttttcccagccaaaaagtcccggcttttcaacccaaaaaggtcccggtcccgggtttgcccaaatttcccggtcccgctgcactctagtttaaacagttatgacacaattttttttgcctgagccaatcaccaaaatctcaatatctgacagcctcagatcagtttcaaacatttgaatttgtcaccacaattttaaaaatggaaatttcaaaataattcttcgaagatgaagaatttttcctttaaatttttattgaaaatagactaaaatggttttgaattttcatctttaaattcaattatttttcccctttcaaaaaattaaatttaaattattcaaaaaagagaaaattattaaatatgaaaattaattctgtgttgtcattcctattttcgtttgattggccaataaattttttttaagataaacaaaatgataatttaacgaattgaatgtgcatgcttttttgaataaattatagcaattatctgctgaaggaaagaatgatgaattcgaaaggtataaataaaaattggtgccaaattaggcttagccattcattttttctaacaatttataaattattttccattcattctttttccaataatttataaattatattaaacaaaaatgctttagaaatg

SEQ ID NO: 99279 - DNA, 1003 bp, Heterodera glycines
  Promoter: Source sequence=SeqID_24783; Location=324..1326; Strand=+; Gene=SeqID_55527
ctgctgcttggtgatcataaatttatttattgaaaattgaattcatttgcttaaatatgtaagaaataaagataaatatcggattgatatcagataagcacattcttttaacattttgaaatgttgataagcctcgctttaactttaatttgtacaattatttggtgatttgtcttttcactaactcgatttaataatggaattttctggaaaaattgtcagtatttttttttgttcataaattttatcagcactgaaggtttttcttcaaaaaaaaataatttaaatttgatcctaaatatttaaaataggtcatttttgggcaaaatttgttaaaaataattttttttcaatttttaaaaacttttcttaaatttttttttcgctgttgccagagatttaaaccagcaggcttcaaattttcaaaaaaattcagcttaaaacacgaaaattttttctcctcttctttatctctccttttgcattctctctctttcactctcccaaaattaatttacagacaattatcattaatcattttgtcacatgacactgccagcaagagaaaattctcgaatttttttatgcaatgcatccggccttgaaccatttgggcgcacaataacaaaactaaaatcactcagagaacagcagccaatcaaatacaaaaactggtccaaaaataatttaaaataattaattagcatttatttttggtgaaaatgcaagcgaaattcatgtgggcaacatcgatcaaaaaattggaaataataaataaaatataatttagttattatgaaaagggaaacagttacgtaattctcaaatcgaaacaaatattaattcattttattattagattagcttgctttctataaaatttatttcaatgaaaaaagatgtacctaaataaagttcaaaaaataaattatgctgagatcaattttcagtaatttcaaaaataatttgccaaattattttttcagaagctttttggtacatg

SEQ ID NO: 99280 - DNA, 301 bp, Heterodera glycines
  Promoter: Source sequence=SeqID_5510; Location=6749..7049; Strand=+; Gene=SeqID_58284
atcgagaagaaggaccacctgttggccatcagtctgatccgcagagattcggcgcaactgaccgtgggaaaatcattaacccaaagacgggccgagagtttatcgactcggacctggcctggtcaattgaacgcctggtggaccctcgcccggagaatgccccttcgccacgcggaaccaaagagttgaagaggaaactcgcacagaatccgcttgccagtagcctactcaatcgactgtttgttgggtctgggttcgtcggacaagtcaaacaaaacgggcgttttattccctcaaaatg

SEQ ID NO: 99281 - DNA, 138 bp, Heterodera glycines
  Promoter: Source sequence=SeqID_35354; Location=1284..1421; Strand=-; Gene=SeqID_64926
gttttttcagaatattttttcatagcttatcaatctttctttctaaggctaatatagcctgtaaagagctttcgaatgtacaaagattgttaagtttgtttgacaaagaaaaaagttataagcccagaagcacaaatg

SEQ ID NO: 99282 - DNA, 145 bp, Heterodera glycines
  Promoter: Source sequence=SeqID_10013; Location=1..145; Strand=+; Gene=SeqID_73065
aggtcatcattttgccgaaaattagttaaaaatgaaggaatggtcatttatttttatttctctttttattctttgtcatttattcaacagaaacatttttcttataaaaagataaaatataagcttgttttatcaaacaaaaatg

SEQ ID NO: 99283 - DNA, 457 bp, Heterodera glycines
  Promoter: Source sequence=SeqID_19915; Location=1416..1872; Strand=-; Gene=SeqID_84672
agattttaccaaaggttaagagtatattttgtatttgggtgaggttttcctaaaatattggttgaagagggtttcgatgttgtcgacaggcgccgcagaatgccgatgggcgccgtcgacagaaaattttaaaaagactggtctttgaaatagattcgttaaaaattaaattttacttgaaatgtccattaaatatgataataaaggacaaataaatcacttcaagaaaaaaaaaaattaacgaattgatgccgccgtttcacagcttattcgattttacgtggatattattgactttataaaaataattgggtggaattatgtaatcatataaataattaaaatggcttttcctatttatttctgccgctgccaaatgtaaatttttgctaattaacttttttaatttgtgcgaccattcattaatgaaatgattttaaaatttgttgttaaaatg

SEQ ID NO: 99284 - DNA, 93 bp, Heterodera glycines
  Promoter: Source sequence=SeqID_12069; Location=901..993; Strand=+; Gene=SeqID_75614
aaataataataataattcggtatttttttaaacatttattccccaattttatttgcattttcttagcttttgaaagcgcacaaatgcattatg

SEQ ID NO: 99285 - DNA, 405 bp, Heterodera glycines
  Promoter: Source sequence=SeqID_38498; Location=1..405; Strand=+; Gene=SeqID_67286
aaaaagggtggcatacaattaactatgattaatccaaaaaaaaactattcaaggactatatatttttttaaaagttactttcctttttttgatcaccacagcattttcattacaaaaagaccaaattgaattgataaaattgtttttaatctctgtttgtttttggattgtaactttgttcattgtcgaccaaatccaataatcatggtatcattcaaaagctttacactttagtatgccatgctaaagtttcattatttctttgattaatctattggaaactatgccgaaaaaataggagttttttaaataaacaaattgcaataactaaatgttaattgggcttttaaatttttgcagaatggccaccgctatcagctggatgcctttcgcaaaggtaacatg

SEQ ID NO: 99286 - DNA, 907 bp, Heterodera glycines
  Promoter: Source sequence=SeqID_8132; Location=1375..2281; Strand=+; Gene=SeqID_67075
tgcttaagtgcatttgctttatgattattagggctgggatttttatgttttaacatattttttttgcggcttagttatggcgagagaagccctaaaatagcattttctccgaacaatttttgttttagagcgacttataaaaacataaaaacacatattttggcgttttggcacataaaaacatatagcacatatttgggctattttggattttttagcacatattttggcatttttgaaaaaaatcgtaagaatacaagaaaatctgaaaatgcaccctaaaaattgactactttacgtttcttaagcatttagaaaatttctttatatatttaaatgcctaaagcaggcaaatcaaacgctgtgttaaatcgtcactggatttcaaagttcccggaaggaacttattcaactgatggaaaaattaatccgggactttacaaattgattgatatcgccaaaattttgactggcggtcgggcgaaaattgataaagactgatattaaatatgatttttttgcgtaaatacacttggttttttcaatttttagcacaaatttttgcattttttaacacatatttaggcctttttttttggtttttagcacataaatcccagccctaatgattataggttctattgtacccgttctgaccttctgcggtggccatgaagcgctcagtagtgctgctccctcggacacgacatcttcataatgtatcgccagttgccggtagtccacttcattgaaggaattgaaccgctggcagagtgtgaccaactatttggtgaggcacatgttttaatttttacatttttgcttaaaacaaaaacttgatggaaagcgatgtttcatccattttagctctatttgagttttccttgctttttattaaatgcaaatg

SEQ ID NO: 99287 - DNA, 93 bp, Heterodera glycines
  Promoter: Source sequence=SeqID_12058; Location=3614..3706; Strand=-; Gene=SeqID_75587
tttttggagttcgatttggaaaaaatattagaaaaaatcatcgaaatttgaatttaggacagcgaaaggtacgtggaacagttgctcaacatg

SEQ ID NO: 99288 - DNA, 91 bp, Heterodera glycines
  Promoter: Source sequence=SeqID_21283; Location=985..1075; Strand=-; Gene=SeqID_51879
tgtattggggtggcatcaaaaagtgttttttatttaccatttcacattttatgttcaggccgtttacacacaattggaaaacattggcatg

SEQ ID NO: 99289 - DNA, 311 bp, Heterodera glycines
  Promoter: Source sequence=SeqID_506; Location=6355..6665; Strand=-; Gene=SeqID_54754
aaagtccagcaaatttgggatgtttttgcgcgtgaaatttggccattgttgcgcccaacattcaccatttggactttcccgatgaccatcatttggacaatttgcgtcgtctcatttcgccaacaattctcgccgatctcgatcagttgaattcaatcgactccgatgatttattgcccgattcaccagctgatgatggaccaaatgcaactgttggccaagtgctgtcaaattggttgaacactccgcgaaacgatggaaagccaaagcaattgcgttcttgtgactattgtcatgtgtcagaaaccatg

SEQ ID NO: 99290 - DNA, 449 bp, Heterodera glycines
  Promoter: Source sequence=SeqID_20546; Location=1..449; Strand=+; Gene=SeqID_51084
gtccgaaaattattataaattactcattttctgaaaaatttttcaaaaaaagtttttagaattctttttataaaaaattttctagattttcaagaaaaatttctaaatttgagtttctagtttaaaaataccaaagattttttttttgcaaattttttaaaaggtttcggctacgaaatttgtccaattccaatcagttcaagccgtttttttttacaaaactaaaattaattttcccgactcatttacgactgaactgactcaacaaattggggggcaggaaattgtacaaaaaagcgatgcaagcggagattttccacaacacgcccaacctggacgtgttggaagcggcggtggaggaccttttgctgctcgagtcaacggcgccagcagttgcttctacctccccctcggcctcggctgtcccgggcgacgatggtactgaaatg

SEQ ID NO: 99291 - DNA, 389 bp, Heterodera glycines
  Promoter: Source sequence=SeqID_2283; Location=1..389; Strand=+; Gene= SeqID_78883
ctcccggcccctgtcccgttttttgctcagaccactgggaatcccgatctcgggatcccgccccggttcattttccaattcagggccccggtcccggcaatcgaaaaattccgatttctactatttactatttttccgccgccccctcaaaggggagcaccattggaacaggaatgaatactgtaattgagggtggggtaattcaatagatacggtaattgatatttagctgaaaaatttctaaatcatttaaaattgtaaaaattttcttcgattttttgaagatgatgcgctgtttttggggcatatgccctctgccctcgtcattctccgatttgtgggaccgtgccgccggcggcagttgcgccacccatttgcatgccaacatg

SEQ ID NO: 99292 - DNA, 1003 bp, Heterodera glycines
  Promoter: Source sequence=SeqID_1981; Location=2794..3796; Strand=+; Gene=SeqID_77178
gtcttacaattagctaattgctaactgtggctctcttttcggtttttgatttgttgtgattagagaccggaaatttcaaatttgcggatcccgctgcgggattggaactcaaaattcaattacttttatggctttttggaatatatatatttttacattttattttggtcatttgcatattataccatgatgcaaaaaagaattcattttaaatgacctatttaccaaactcacgcttaattaattagtaaaaggaaaaacatttaccgtaatggacagccaaaccaccgtaaatgcctaactattgcatctcacgtaaatgtctacgtaaacagtcgcacatatgccctccacaatcagcacatggccaacaatgttgatgaatgcaggatagaaattgtcggaatgagtgtgccaagttccaaaatgccatggcataagcaacgaaaatgaaagtgccgctgatttcggtgccgtttgaagatgtttcaaccattttcatgaaaattttgtttaaaggaaaattcaaacactaacaaaagctaaatataaaataaaataaaattattgccattcggacgaatatttggttgcaaactgtcaattaagctaattttgttagctttttcgtcgcaaacgcaaataaaattataattaaatttttgttatctcattaataaatgtcagatttaatagatgagcacagaatgagaattgttaaaatcaaatgatttgtggtacttaaattatttatgtcattttaaaatgatatttgaaattagaccatgttttaaaaaatcggtgcaacaatttttttttattataatttttttagaagtttaaaatacttttaaagtaattttttgctcttaatttaataataagaattttatttaaagccaaactgtcaattatactaattttatttcttgtttattcataaacaataaaaaagtcatcagaagggcgagaaccacttactctgacgactgttcagataatg

SEQ ID NO: 99293 - DNA, 696 bp, Heterodera glycines
  Promoter: Source sequence=SeqID_3693; Location=1..696; Strand=+; Gene= SeqID_51479
aaatcagaaattcacaaaatccattccaattgccaaacgcgaaccaaatcccataccaaaacgaacaaattcgttattttggtaaaaggaatttccaaaattcgtgttctcttttcaaacccattccaaattttgcaccaaaatcccagggtttcgtctttcctatcttaatttgggttgatcattgtgccattgcttttcaatcccttaaaaaatcaaggatgaaaaacaccaaattccaagtcgcaaagacaaacggcctctaccggttcggagagctgataaacgaggctatggaagaagtgaaagccaaaaatattttgggttttcaacaattggaaaaattaaaaatggaaatttttgcaatttttttttgcggtgtgtaaaattttatttgtgggccataactctttcctcaaccgattaatatttcttaaatttaccatatataaaattttttggaattccataattgtttttcaagggtttactatacggaaacggaaatttacatgtaaatgaaattattttttaatcaattatttacgattaaaaacaagataaattgcaattaatttgataatttctactttatgaaaattttttttataaattacataatatatatatatatctatctataataaatataagctgaaaacaaaaatcatttgatttttttgactcaaaaaaatg

SEQ ID NO: 99294 - DNA, 251 bp, Heterodera glycines
  Promoter: Source sequence=SeqID_28936; Location=614..864; Strand=-; Gene=SeqID_59513
aatttatttaaataaaattatttttgcagcaatcggtccgagaataggtgccactgttttcaccacttcaaattcattcttgacaacattgtgcaagtaaatcagtctcgataattaattaaattgtaaaaatgaattgtttaatcatttgcaaataaatgtattttaattttaaatttaaataaaaattactaaattattatataaatataatttaaaaaaaaatttagattactgtggcaacgagcatg

SEQ ID NO: 99295 - DNA, 150 bp, Heterodera glycines
  misc_feature (62)..(62): n is a, c, g, or t
  Promoter: Source sequence=SeqID_39465; Location=1..150; Strand=+; Gene=SeqID_68035
cataatgtactgtttgcatatggtaacaaagcaaatattaaatacgcactcaagtacccttntaaagggccaggacattgttatgtcgagtgcaaacaagagtccggcaataaaatcggaattgatgagccggctcaatatgccaagatg

SEQ ID NO: 99296 - DNA, 54 bp, Heterodera glycines
  Promoter: Source sequence=SeqID_1589; Location=5492..5545; Strand=-; Gene=SeqID_74652
ggtgggtccctttggcttctcaacccattgaaatggcaattgctctttgagatg

SEQ ID NO: 99297 - DNA, 1003 bp, Heterodera glycines
  Promoter: Source sequence=SeqID_6056; Location=77..1079; Strand=-; Gene=SeqID_60163
ttctccccaaaatattccttctttcgtcccgtcctttcgcaaatatttcggccctttcctttgcttttcctttgccaccaatcgatcgatttacggccaaaattaaaataaataaacgattaaattctataaatttctcaccgttttcaattcatcctaatgaatagggcgaggatttttagttttttaactatttttctgcggctttatttcaacgagaaatgcacgaaaaacacatttttagctcggaaattcttcgttttaacgccactattcatcactaggaatcactattttggagctttgccactaaaaaaaatttattttggaagttggccactaaaataattttttgccactattttggcgtttcgtcattatttttgccactattttggcattttttggaaaatttcccaaaaaatgcaataaaaacgaaaaatacacccctaagaattggaaaattttcacaaaaattcttcccccaaattttttttttcttgttcaatatttgctaagaaaatattttgtaactgcaatcagtgaaaaagttgtttgccttattttaaattattttcaaattaaaaaacagcctatttaaaaaattacacccctaaatttggatcttgttcgccactatttttgccactattttgccatttttttgtcactatttagttaattattttgggattttttgccactaaaaatcctcgccctattaatgaatgccaatttgcattatccccgcgagcgattcgttgccgttgtgggccacgaccctttccattgccttcgctgtttctccatcgccgttgccatttggaacattgtgagcggattcaattttaatcattattaacttttattaaaattaattttgtttctttcgcgtgccattctcatttccaattgtttttgcattttgtctcatttctctgcagttgtactgtttgctccaatttgccctgctcggctggcaagttcaggtggtcaaacaatg

SEQ ID NO: 99298 - DNA, 871 bp, Heterodera glycines
  Promoter: Source sequence=SeqID_20761; Location=1..871; Strand=+; Gene=SeqID_51326
taattaaatttacaaaattaaatattgttttccaatttagctgtttttagaaaatcttttattgtgacagggagcaattcatttccccttgaaaatgttttattgtttaattttcaaaatccgaatttttttaaatcacagaaaaaattttctagcgattttttaaattttatgtttattaataagttttttaaaaaattttcaaaacttttttgcttgaattttcttataattttttttaaaatataagtttggcgaattttctttttactgcagcgccattttaatattttttttcttgaaaataggcatttcaacggctgccggcattgcctacaacacatatttatacgccgtggtgcacaagaaacactacaaaaaagtgacgtcatacttgcgcatggcgacaatggtcggcaaattcttggcattctgtgccggccaagttttgatcagcacgggaattggcgattttatgctgcttaatcaggtggcataaatggacatctaaaattatatgatgctttaaagaatgataatatattttaatattttctaaataaacaatttatttagcattttcattactaataatttaaattgatttataaaaattcttttacctattaaatttgaattatttattttttcttaaaaatatattttacagaattattatcattaaaacagatgattttaatttttaatcctttcaaaatacggatcatttttagattttttaaaattccttatttcaaatatatattttatttttaatttaaaaaactcataataaattaattagttaattaattagttgactctgttggtctcctcctcgctgattcccatcgttcttttgttgccgatg

SEQ ID NO: 99299 - DNA, 950 bp, Heterodera glycines
  Promoter: Source sequence=SeqID_1297; Location=906..1855; Strand=+; Gene=SeqID_71908
tcagcccctataaatttattttcagcattttttgatttttggaaattttttgaatttaattgaaattttttcgaattttccaaaatcccgcaatcccgcacgggatcccacaaatttaaatgcgggatttgcgggattaattccgcgggatcccgtcccgcaaaaaattttgagttccagtcccgcagcgggatccgcaaatttgaaatttccggtctctactagaaactgcgtcaattgattaaatttgatatctaaccgaaattatgtgatgaaaaaaattttggaattaaaaaaaatttgaaaaaacttcggcttcggcttcgaaaacttcgggttttttgggcttcgagcttcggacttcggcttcgaataaaaattgggcttcgccttcggcttcggcttcgagtgctaagccgagcttcgcccagccctggttcggatcccggtgaattcgatttagtattcattaatttttattaaaatattaaaataaatattttttagaaaaaaaaattgatttatccccctggacgataaatagagacggggagattatttttcaataatggagacgggcgatatatctactcctttgaattttcataatacaattgtttactttgttttggaccgtaggcactgcttacaaaaattagctgcccttttttatacaaaatttgtacaaaattacgatattttggtgtttgttatgctgcattcataacattatccgggttttaaggcatttttattccgcgttcaatctaatagaaaattgacaaattattcaataatcttttggcatcagttttttttcttattttttgtgtgtaatttatgcattggttgtctgctggtgtctgtcctgtcggagtgacggcttttaactggcaattttagccaaaattcatcaatgatgcctaattatggtgcggaaaggaaaaatg

SEQ ID NO: 99300 - DNA, 110 bp, Heterodera glycines; identical to SEQ ID NO: 98226
  Promoter: Source sequence=SeqID_32494; Location=553..662; Strand=+; Gene=SeqID_62799

SEQ ID NO: 99301 - DNA, 760 bp, Heterodera glycines
  Promoter: Source sequence=SeqID_316; Location=2129..2888; Strand=-; Gene=SeqID_81968
ccggaaaatttaaaaaaaaatcattttttcgccaaattttctcgagaatattgaataaatttaaattttcttagaaattaataaatttatgtcaaaaataagcaaaaaagcgaaaatttcgcttttgcggttgattatgcgctaaaaattagtaaattttagttttatcgtgttttttttcttctaaaatgatttttaatacaatatgtagccatttttgaaagctttacttcgcgtatagcgaatttgaagaaattttgggaaattataccctcaatttggaaaaatttatgtccttatttttgccattttatgtccatatttcgcgacttttggtccatatttatggccatattttgcgattttatatcaatataattctccgccctaatgataaattaattttggtaggcgatgtcgacaggcgccgccggatgatttttgaaagttttatgccatttgttaagagatttggcacaaaaataagcaattttaacacaacaagcgccactcctcatcgtgcaaaacattcgatggcattcacttgagccggacccaaacactgccgcactcgcggagcgagaacgacaccaaagttgcaaaaaaattgggtgtttcggtacaaaaatgccaaatacagaactcgagtccggaattttaacctagatagtctttaaacatatagcaaagaattgctattatgttagctttcccgaatccgccataatccctgcgtatctcagagccggattccgacatg

SEQ ID NO: 99302 - DNA, 247 bp, Heterodera glycines
  Promoter: Source sequence=SeqID_32525; Location=926..1172; Strand=-; Gene=SeqID_62838
attttatttcaaatctattcaaatgccgaaaagccgtcgcaccaaaaaactcagtaaagaaatgcttttctcaaggacatccttaaaatggcacatgacagcttgtgttatcggaaaaagtgcttgttgttttgcttttttaatgatttcggatgaatgctcacatatcacagtatttagggctccatgggatcaaactcaaacataaaaacatttaaaaattaaaattttcagtaactccccaatg

SEQ ID NO: 99303 - DNA, 107 bp, Heterodera glycines
  Promoter: Source sequence=SeqID_38641; Location=1199..1305; Strand=-; Gene=SeqID_67391
cgcggcgttcctcgcgctcctcctcctccgcctctttctcttcttcattttcgtcctcttcttcttcctctcattcaccttccgccaaaaaacaaaagaaagaaatg

SEQ ID NO: 99304 - DNA, 770 bp, Heterodera glycines
  Promoter: Source sequence=SeqID_7709; Location=4569..5338; Strand=-; Gene=SeqID_65702
ccccccttttttcttttcctcactttctttccattttcccctctccgttcctcgttttcttctttttctcatcttcccatcgtcctcttttttccccttatcctttcctctttttctccatcctttcctctacttcctttttctcctttccttctcttccttttcctttccccacttcctttttcttccatttttacccctctcttccccccccttcttttcccaagtccgtctgcccatttgatcactttcccctccctctcctcccccccccctcaatcattgcgggagctgcgcctcctctcctccatgtatcctccgattcctatcgatcaatctcatcgctttcctttcccttcttcgagcgtggattcgctgctccttttgctttcctccggtgatcgttcgttgtttttcctccctccgattgacttgaaatggatgcctccttcgttcgcttttaggcagggataggtagatcattatgcgaccaaacagagctaagctgtccgtttaggcattcaaatgcattaccgttcccatttcttcccatttgtcatatgccctcatggccgtccaccttgcgctttccattgtcattctctgtttcatcagaaacggcgacgattctttttgcttccgctctcattcgcgattctccgtgcttgcgcgtctgctccgcctcagtcattcgctcgtgagctcaccactacggacacttcagcagctgctcaaggttcatgtaccgttgtgaaaaggacgcagagatg

SEQ ID NO: 99305 - DNA, 160 bp, Heterodera glycines
  Promoter: Source sequence=SeqID_35669; Location=1..160; Strand=+; Gene=SeqID_65169
attgaaagggtggttgcggaggaaaaagggaaaagacctccacgagtatggttttgtgaaatggcgtgggtacagcacacctttcaacagctggattccactgaactcaatcacgtcgaaaaacatataaactgcaaacaaatgaaagcaactaaaaatg

SEQ ID NO: 99306 - DNA, 875 bp, Heterodera glycines
  Promoter: Source sequence=SeqID_30838; Location=715..1589; Strand=-; Gene=SeqID_61236
aaaaatagatttttttgttttcggggcagtccccccgaaccgatgcgcccatatttatggggagaccgaatccttcgggagtagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatagatttttttgttttcggggcagtccccccgaaccgatgcgcccagatttatggggagaccgaatccttcgggagtagcttccctatagcctgtactttaatttttgcgttggattttttgctccccataatttgtttgagtcccccaaacggacacttgaaaaaaatcgttttttttgttttcggggcagtcccccccgaaccgatgcgcccagatttatggggagaccgaatccttcggggaatagcttccctatagcctgtactttaattctgcgttggatttttgctccccataaatgtttgagtaccccaaacggacacttgaaaaaatcgatttttttgtttcataaatatttttttcagaaagtcatg

SEQ ID NO: 99307 - DNA, 167 bp, Heterodera glycines
  Promoter: Source sequence=SeqID_40432; Location=1..167; Strand=+; Gene=SeqID_68772
gcacctcacgcatgtgaacggaatccaagtaacgtcgttgcgcaaaaagtaacgactgccatcaaaaggcgtgctgttgagacgatggaagctccctctgtaatccgtgccgtttctcttcaaagcattagttcgcctgcactttcagaagtgccgtcaaaaaaatg

SEQ ID NO: 99308 - DNA, 341 bp, Heterodera glycines
  misc_feature (301)..(302): n is a, c, g, or t
  misc_feature (316)..(317): n is a, c, g, or t
  Promoter: Source sequence=SeqID_10655; Location=1..341; Strand=+; Gene=SeqID_73897
tctttttaattatttattggataaatttattgttgcttttgtgattgattttaaaagcatgagatgcctaatttcacatacaattgtccctttgttcgcaaaatttggaagtgcaaaaaaagaaaaccccggcaccattccttttcgtttccaacagtttgatgttcatatagtaaatgatagaaaaaaatagccataaaatactcatatgtcatatataataccagtgtgttgtagcctgaaagatagacataacagataagacatatgatatctgagtaaataatcttaaaattataanntttattatatatannaaattcttatttatgcataaaatg

SEQ ID NO: 99309 - DNA, 233 bp, Heterodera glycines
  Promoter: Source sequence=SeqID_21924; Location=1..233; Strand=+; Gene=SeqID_52560
ttttttataatttacaaatgaataaagaaattaaaaaaagtaagtttgatgaagcattgattaatttttaaatataagaaatttaaaaaaaagataatgtttggtgaggcattgatcaattttttaaacataaagaaattaaaaatgatacttttggtgaagcattgatcaattttttaaaacattaattaaataaataaatttttataatattaagaaataaaatacatatg

SEQ ID NO: 99310 - DNA, 72 bp, Heterodera glycines
  Promoter: Source sequence=SeqID_6814; Location=2522..2593; Strand=-; Gene=SeqID_62973
ttattttttgtccaaaaaagctaaaaaaatttttttttaaatttaagtttataaattattcctgaccaaatg

SEQ ID NO: 99311 - DNA, 63 bp, Heterodera glycines
  Promoter: Source sequence=SeqID_17348; Location=211..273; Strand=-; Gene=SeqID_81826
acttcaagaaaatgtaaaggaatttaataatttaaaatatatttcttatttttagcttgaatg

SEQ ID NO: 99312 - DNA, 51 bp, Heterodera glycines
  Promoter: Source sequence=SeqID_756; Location=353..403; Strand=+; Gene=SeqID_60558
aaagcgtttgaatttttgtgtatttctcatcagttgaataaatccataatg

SEQ ID NO: 99313 - DNA, 121 bp, Heterodera glycines
  Promoter: Source sequence=SeqID_14541; Location=1532..1652; Strand=-; Gene=SeqID_47210
ggcaagtactttgtctttaattttagttcgggagcttaatttattctttaggacatctggtacaagaaagtccaaaagttttctgtctcaaaccgtttggtctcttctccgtgttcccatg

SEQ ID NO: 99314 - DNA, 369 bp, Heterodera glycines
  Promoter: Source sequence=SeqID_15669; Location=1351..1719; Strand=-; Gene=SeqID_79975
aattaaatttgccttttggtatggtaattagtaggaccatcgtagtagcaggtaaaacaacatttttactaaaattttcgagagaaagagatcgaatcgattagcccacacccaaaatcagtgctttatcgttacggtcaatttaatcgatagtattcctcgtactacaaaaaatgggagtgcatcgtgcacaaaggacctcctagggacgaattgctgagctctctaaagaagcctctcttattaattctagatgaccttttaacaataattgatgagaaaaacctatctgaattattcattaaaaaagctcatcatcttaatatgggtgtgattttcataacccaaaatttatttgaaaaaaagatg

SEQ ID NO: 99315 - DNA, 283 bp, Heterodera glycines
  Promoter: Source sequence=SeqID_31010; Location=1..283; Strand=+; Gene=SeqID_61365
cccacttctttttaatactttcctttccgtcgcgggactataaagagcagccgcgaaccgggacgcctagttatctatatataaaaataaggggggggctaaccacaaaacgacctggccgcaagcgaatatcgagagttgagcaccgagaccggtaccattcgaaagagctcggttttctctacaattctaaccgtgtggaaaaattagcgacaagcagacattttcgagaaaatcgcgttcgaacaaaaaaaacccggctttttacaactggccaaaaatg

SEQ ID NO: 99316 - DNA, 155 bp, Heterodera glycines
  Promoter: Source sequence=SeqID_11279; Location=1797..1951; Strand=-; Gene=SeqID_74656
ggtaaaaatctggttgctgttgtggatgtacttattttcggcatttttttttactacaagagcttaattattgttttaaaaataaatttggggtttgttaccattcaggggacataaccagtgaacatggaaaatgtgctcataaagtgatcatg

SEQ ID NO: 99317 - DNA, 170 bp, Heterodera glycines
  Promoter: Source sequence=SeqID_12512; Location=1509..1678; Strand=-; Gene=SeqID_76159
ggtcagtaaaactaatgcatttacccagttttaattattctaattgtaaacctttgttttaattttcaactactttgcaaagccttttttgtctacggctcactgtcttaataccctgttataaatttaattaattttttttatttgatatcttacactttaagattatg

SEQ ID NO: 99318 - DNA, 338 bp, Heterodera glycines
  Promoter: Source sequence=SeqID_4153; Location=6999..7336; Strand=-; Gene=SeqID_45732
ctcaactaattgtaaattgtgaaataggatggacaattttctccattccatttagtgtgttagttctaaggttttaaaaacactaaaattttctattttatggcagaaatctttaaaaataggtaggtatgtaatttccaaaactaccccttttccctttactatcttacaaaaaccaccgacgatttttggactgggttgcaaaaaagaaagtctttctaaaattagaatacgattttatattctaggataaaaatttactgattacggatctgaacacagaattcgaaacatcttgaatttgactatgattttttacagatcgatttctgaaaatg

SEQ ID NO: 99319 - DNA, 248 bp, Heterodera glycines
  Promoter: Source sequence=SeqID_14703; Location=3813..4060; Strand=-; Gene=SeqID_78822
ccttacaataatgcgagggaaactgtattattaatttcaacaatattaaaaatatttatgtaggtaggataaaacggaagaaacattatggaagataacggtcaatttatgatacttttattatcaaattatatttttcaaaggattcctctcgagagcataccgcggacagaccaccgccggaaaggaacccgcggtgatttgccgggattacgaattaaaccaaaaaatttggcatagccaaaatg

SEQ ID NO: 99320 - DNA, 120 bp, Heterodera glycines
  Promoter: Source sequence=SeqID_1715; Location=941..1060; Strand=+; Gene=SeqID_75470
attttttttgaataaattttcaaatgttgtctcttttttatttatttctttggttttttgtccttaatattttttaacgtataaaagaaataaaaataattaaaaataaaattaaaaatg

SEQ ID NO: 99321 - DNA, 574 bp, Heterodera glycines
  Promoter: Source sequence=SeqID_5023; Location=75..648; Strand=+; Gene=SeqID_56603
gagaattttcagcccaatgtaatgtgctttatctcatgtttatagcatgagtttaaaaaaagttataaaattaattgtgattgtgaaactcaaaaccataggggggaccccatggttttgcatttcatgaaaatattttgtgctcatatgtatgtcaaaatgcatgtttatggcataatataagaagatgaacatggatatagggtattttttcagtttcatgcttttgcgaaggttttgttagttttccgatttcacataggcatttgtttaactcgttttccttcacaaaaccccttaagttttaaaattttacttatctaattttgtccaaataaatgtcataaaatgtgccactttcatatgcctacataattcttttttaagaaatacttgaaaaatttcacttttttccacgaaaaaagtaccgaattttctggtgcttttactcaatgtccccatcttttttctctttgttaaaatttatttttttttatgaatttttgaaggaaaaaaacccactgaactgaaaagtaccaaaaactgtcttaataatttgcctcaacaaaaaatg

SEQ ID NO: 99322 - DNA, 101 bp, Heterodera glycines
  Promoter: Source sequence=SeqID_1981; Location=6041..6141; Strand=-; Gene=SeqID_77179
atcgctttgtacgctttttttgccatttttctccacatcggattttgtgtcaaaattgtcattttgatttttggcataaattttataactctcgggacatg

SEQ ID NO: 99323 - DNA, 57 bp, Heterodera glycines
  Promoter: Source sequence=SeqID_27103; Location=1278..1334; Strand=-; Gene=SeqID_57813
tctgaaaaaaacactgctaaaaaattgtcgaacagtctaaactaaattgatgaaatg

SEQ ID NO: 99324 - DNA, 958 bp, Heterodera glycines
  Promoter: Source sequence=SeqID_13625; Location=1462..2419; Strand=-; Gene=SeqID_77533
tatccgtccatttttgtacaaatttcttttgcgccaatttcgtccgtccgtcggttggcgcacaatttgcaatttgcaatttccattccccgcccaaatttcaccttgaaaatcagccccaaaattggcgaataaatgtgaagagggggacaaacaacacacaacacaaataaataaataaataattgcacatattctgtggatggagttttgattgggaagaaaattgaaaattttggaagaaaactaaaattggcaaaatttcaacaaaaatattttttaaatgaattttttaattttaatattatgtagttgaattcatttcattttttctgtttgcattttatcaattttcaattagatcaacaattcttatttgtactcattatctattaaataattttgatttttatattttatgtagaaatcaaaattttacaattttgcttagtaatttatcgattctttatattatatcagagttcccaagttttttttttcaaaataagacaaaatggcctaaaaactaagattctgaccccaaaaataagattttttctaaaactaatatttgcgtgaaggaaacgcaataaaaacatgaaaaattgacttaaaacaataatcatgtttacgttttggtggcattttgtgaatttcactcaaaaaatgaaataaaatgtaatttttttttaaaatcaaattaattcaaatattcgcttcagaaaaaaatgaaaaatcaaaatagtcattcaaatttttcattttttattttcaaatccaaaaataagcacaaaataagcacgtaacgctgaaataagcacaaatcttagaaataagcacatttttactttctaagatccgacccctcaaaataagcacaaatcttagaaataagcacacttgggaactctggtttaatttgatgaaaaaggaattgcggtgcaattataaaacaatg

SEQ ID NO: 99325 - DNA, 901 bp, Heterodera glycines
  Promoter: Source sequence=SeqID_12836; Location=2742..3642; Strand=+; Gene=SeqID_76566
aatttcgtaccctttcccattttctcttcctcttccttttttatttccatcgcttaatttgcatttgtttatcgctatttcactaaaattcaaatgttctttgtccacccgattggggctcttttctcagattcccattttttgccccctctttgtcctattcatcgtatctcttcgccatcaccaatcttttcaaatttgtgcttccccttcgccttctcatcgcctatcgcaggtgccgacccattcacatgttttgcattttttgtctccctgcccggggcctatttaaccccccggctcctcttctttttcttccttctgttttttttgactgatccatttttcgctccccttttttccttatctttttcgctccccactttgctctctccgattgttgtttatcctacggcaaataaattgtgtttgttgaccgctcctttggtcgcggcaaattcccttccctcccttcggaattgccaacagcaaatcgtacaattggggccttcctctgccccttggtccgttctcgaaaactgcaactgtcgaacgggatcggatctccccgtgatccgaggctcacttcttcccttcccaccggtgaacgagtcgggtcaatcccgacggtcgcagtttggagtccactcactcctcccttgagtggtggtgccgtttctttccttccctctttgtcccgccctccctcttctcctttctcggccccccttgggcctcaattcgaaaggggtcgactaagccgagaacgagggcatagaacccggtgatcacccctccctttgatcaccaggggttttcggacaaactggtgccgctaacagggggttacctttcttcggacaacgccaacttcggacattggatttcggacgacaaaatg

SEQ ID NO: 99326 - DNA, 190 bp, Heterodera glycines
  Promoter: Source sequence=SeqID_39780; Location=660..849; Strand=-; Gene=SeqID_68270
tagtcggtagcgcccaacgtcgcggaaggtttaacttaagcttaagctaatttttgagttcatattctattttaaaaattttaaatttaattttatatgttataaattttttaaatttaattttatgcgtaattaaatactatgtgaacatcttcattttattcttaactgcttcatctaagcaaaaatg

SEQ ID NO: 99327 - DNA, 363 bp, Heterodera glycines
  Promoter: Source sequence=SeqID_9108; Location=1..363; Strand=+; Gene= SeqID_70277
tttagaaaatactaacttttaaaaaaaaaaaattttctttattctttttttgtgcaattgtcatcatcacattaaagaatgcaatttttttaattaattggaatgtttgaaaaaaaagaaaaatatgaaaattttcaaaaattcctaattttggactaactgttttttagagtcaaaaatttttgaagcaattctgaaaatttctttcatcttccaagcacgaacctgttatacatgttagttgtctgatcactgatcacatctctgatcataggatttattttttctatgaatttaataaataattaattttcttaaatctgattgaataattaatttaccacaggacattgcattcgaatg

SEQ ID NO: 99328 - DNA, 1003 bp, Heterodera glycines
  Promoter: Source sequence=SeqID_17601; Location=217..1219; Strand=+; Gene=SeqID_82105
aaattacgggcattgaagttcttgaaatttgaattatcaataaatcagcaaaatttagttttttggttattttgttaagtaattttccaaaaaatgtcgaaatagtgaaaaatagtgacaaaacgccaaaaaagtgaattttcactattttagtgacgaagcgccaaaatagtgctttctagtgaccaataatgacggggccaggacgttttcgcgtggccgttttcgcgtgagggacgttttcgcgtggcccgttttcgcgtggggtacgttttagcgtgagtgcctattaggactgaaattggtcggatgtgtgtcgaacatacatttcgacctatttcgaatcccaaacccgatttcaaacaattttttgcttttatttactcaaaagcgtcctcatttttatgcttgcaaagattaacaacttcaagtattaacaacatgaatgagacacagaatccgaccatcggcatcacgacatttctttaatttttttcttttttccggggcggaggactcttcttttcacatacatatcctatagattaacccattggaaagtcttaactgttttgttcaattttttgccgtacaaaagtaatgccccaaacattttacgcacaaataactcaattttatatagaaaaaattctgtaataggggttggaaatttttttttaaattatgataaataagcctgccagaaagagagaaaacaattttataccaaattgcatttgggatggtgagtttacactaataccagcagagcattagaccgtgaaaaaattatttgactgtataataatttgtcagtcttaatttagtttataaaattcacttaaatatatattgaattaagcaccagaagtaaaacgggagtgaaaaaattttccaaactataaaaaagtaaaaaattcgcttatgtgcaaccacgcgaaactgccacgcgaaaacggccctcacgcgaaaacggccacgcgaaaacggccacgcgaaaatg

SEQ ID NO: 99329 - DNA, 80 bp, Heterodera glycines
  misc_feature (48)..(48): n is a, c, g, or t
  misc_feature (53)..(53): n is a, c, g, or t
  misc_feature (69)..(69): n is a, c, g, or t
  Promoter: Source sequence=SeqID_32; Location=1..80; Strand=+; Gene =SeqID_50793
agtgtgtgtttcgcccatcgtgaggcggacggtgcccctctggagacnggacnccatctaggcgacctntcggatgaatg

SEQ ID NO: 99330 - DNA, 218 bp, Heterodera glycines
  Promoter: Source sequence=SeqID_17153; Location=1..218; Strand=+; Gene=SeqID_81592
caaattcaggttgcaaaaatttttttcgacgttcaatttcgaagatgaaggaatataattgcgataatggaggagaatgtgatattgaacaatgtaatattttaaagttaaatggtatattagataggattaaaattggaataaatgtttaatttttatataaacaagataaaacatgtaaactgtgccggctgaacaaatgcttaacggtcggaatg

SEQ ID NO: 99331 - DNA, 989 bp, Heterodera glycines
  Promoter: Source sequence=SeqID_15029; Location=1..989; Strand=+; Gene=SeqID_79193
cgaagagatcttagctcaaattgtggcatttatgcctccgaaataattttggcgcgtagtttttacaattctacgcgcccgctgttgattttttaaaaattcaaattttggcctcaaaacggaaaagtacctttttcaattcataggggtgtgttttctgaaatttttttcaggccatttcttagggatatactttcacgattttattgcatttcaaatggaactttccgaaaaacgccaaaaaggcaccaaaacggcaaaatgccaaaaaaggcatttaaggcacgaaaatcccgaaaaaggcaaaaaaaaaaggcataataaaagtcaacgtagaagtctttttaagaatatttttttttgaatttttttttgtttgcacatgcatatttttttcctggactgtgggaggcctgaaacgcatgaaaaacaagtttttagcctggtttgaagcttctaggatggatttccatatgcatattttgcatatttgggcatttttccaaaaaacttctattagaacggcccccatcagctaaattggcctttttaccccaatgaacggaaaatttcctcaaaaaatcatattttagcaaaatttctcgaaaatattagtaaaaatacaatttttttcaaaatttaaaatttatgccaaaaaatgttaaaaaatagaaaattttcgattttttactcaattttcttcaaaataaataattttacttttattttgtatttttgattctatgatgatttttcataccatatttaaccattttcgagattcttagcttaaatttagtgaatttgaagaatttgggaaaattttgccctcaatttggaaaaatctatgtgcatatttttcactttttatgcgcatattttgcgattttatgtgcatataattctactccctacctatcatatatttttttagaaaatactcaataattaaattccattttcttcattctcgacccactttatcgatg

SEQ ID NO: 99332 - DNA, 401 bp, Heterodera glycines
  Promoter: Source sequence=SeqID_816; Location=3168..3568; Strand=-; Gene=SeqID_61941
ttgatatatgagtgttactcaattgttgagcgaacaccgcattaatctcgcaaacaaggcatgcggagcagttcaatgcaaaaacaaattttcaggtatctaaattggcaaacaccgggatttgggtcgggacggtcacaaatttggggtcggaattcaggacaaagctaaatcactacaaaggtcgataaacaacgctgtggataattttaacagattctaatcaaaatgattattttaaagatttttttcaattgtttaaacagaaattctttaaccaccaattctataaatttatattagaatatttttgggataccttttactctcccttagatataaattattttttataaggaatgaatttttaaaatattaacttttctttatttcagcggatg

SEQ ID NO: 99333 - DNA, 570 bp, Heterodera glycines
  Promoter: Source sequence=SeqID_5504; Location=1..570; Strand=+; Gene= SeqID_58272
aaacaattagtaaatttaattaaaatataaaatgatatggttataatttattgaagtgcatttcttttaccggctaactgtgatgaattttgaagaattttatttattctgcgttttgaaatgtaaaatttgggaaagaacaacggatttttcgatatattaatgaatatcaactctttatttagtgaagtataattgggcaagagtaaaacttttaaattaaaatttttcattattttattaatattataatatttattgacttattagttgtaaattattttatcaatattatgctgctaataaaatatttacataaaatttagtttgaatatcagtagtcattttaatttttaaaaataatgctttaaaaatttaatatacaaagtatgaaatattcaaaagtaaacataaaaagtgaaagaaaattctcatacaaattaagaataatttaaatacattttgactgaaataaaaagaggaatactttttatattactcctaataaattacaattttatagataaaaaatattacattataatattttttagttatcaattatttatg

SEQ ID NO: 99334 - DNA, 67 bp, Heterodera glycines
  Promoter: Source sequence=SeqID_24299; Location=1555..1621; Strand=-; Gene=SeqID_55020
tgaaattcatcgaaaacggcacggcataaacttctttgtggcggcatttttcattgtcgcccaaatg

SEQ ID NO: 99335 - DNA, 196 bp, Heterodera glycines
  misc_feature (43)..(43): n is a, c, g, or t
  misc_feature (51)..(51): n is a, c, g, or t
  misc_feature (94)..(94): n is a, c, g, or t
  misc_feature (105)..(105): n is a, c, g, or t
  Promoter: Source sequence=SeqID_35121; Location=1..196; Strand=+; Gene=SeqID_64751
ctcagatttttgaattgagaaagttgtaaataagtaataagantagctgtnccataagaaagctccgctcgactgcccatttctgatcgcttcngatgcctttgnctatgccatcactcggttcccctatttcctctcatttttgctcgtttgcattcgtcacccgattcgactaatcgattgctctttcctaatg

SEQ ID NO: 99336 - DNA, 171 bp, Heterodera glycines
  Promoter: Source sequence=SeqID_12714; Location=1984..2154; Strand=+; Gene=SeqID_76408
gctgagacggaggaaaattaaataagcaaagatcaaattttaattattgtcattatttttattcataaattagaaaaatgccatattataattaaatcgggcaatcgttatttattttagtttattatttaaatatttgtccctattgttctttttttacgtcattgtatg

SEQ ID NO: 99337 - DNA, 280 bp, Heterodera glycines
  Promoter: Source sequence=SeqID_2655; Location=918..1197; Strand=+; Gene=SeqID_80909
aaccttttttatcttgttttttcgatatttatcttaagttatacaattaaaggattgaattaaatttgattttatcctaagtataatatacctataaaagttggcactttaaccaacacatattgagtcagacgcatttcatttatatttattcaaaaaactaattttacattttcataaattgacccaattccaatgcctgccgtaaaaggtacgtaaatgttgacgaacattgtggcaacttctgctgctcattccgcccacttaaggtgatggaatg

SEQ ID NO: 99338 - DNA, 314 bp, Heterodera glycines
  Promoter: Source sequence=SeqID_2378; Location=8482..8795; Strand=+; Gene=SeqID_79426
atgcacatctgcaccgcaaggggggcgggggagactgtctccgacagaaattaaaacaaaaaataataacaaaaaaatatataaaataacaaaatcaaaacaaaattctttttacacattttttggtcggggattagcccaattgtcccacttttcacataaataaatatttgttgctaatccgtgggctctgcccaccatttcccccttttttcattaatccccacaggcattttggtgacttgtactgattaaatcgggaagtggtttggcgttcttggccctgctcatcgccccccccccacggcccaatg

SEQ ID NO: 99339 - DNA, 788 bp, Heterodera glycines
  Promoter: Source sequence=SeqID_20984; Location=627..1414; Strand=+; Gene=SeqID_51559
tatttacttgaaaataaaataaaccattgacccgcttatctaagcccctttcggctgcaaaataataatttatttatttttttaaatagagaatgttaactttaaaaatttttacaaaattgcatttatttttcagaatttttctttgtaaatttttattccattttttatttgcaaaaaaccgctaaaacccggcgccgagaaatttataaatttaggtttattttgtcaaaaacaggtttctagcaatttttattttatagttactacacatctgaataaaatgtaattactttccgtggtgagtcgaagtgacaaaaaggcaaatgtgggcgaagtgacaaaaaggcaaatgtgggcgaagtgacaaaaaggcaaatgtgggcgaagtgacaaaaaggcaaatgtgggcgaagtgacaaaaaggcaaatgtgggcgaagtgacaaaaaggcaaatgagtggtgatcagaagaggcgggtcatttaagtaccgaataatgattttaattaattaataatataactattttaatctattaattatattgctggccataattataatttcgttattatttaatatttcccaatcaaattacaatattatattctgtctagagagagaaataatatccacatgcatagttgatcaattcgatcaattgcacttttatttattcacaattatatattatattctgtctagagcatttttcatttctttaatattccactattaacttgtctttaataatttatttccgaatttttaattgatttagaatg

SEQ ID NO: 99340 - DNA, 1003 bp, Heterodera glycines
  Promoter: Source sequence=SeqID_3996; Location=1188..2190; Strand=+; Gene=SeqID_52740
aactgaaatttattttgaacaaaattaataaaataaaaaattcataaatataaataacaaagctttgtataaaaatttattggctctacttcagtttatgcgtccaatcgacttttatgcgtccaatcacgttttatgcgtccaatctcattttatgcgtccaatcaaagttttatgcgtccaatcattttttatgcatccaataacatttaccatgtgaaaattattatcccttgccagtttttgtaaaaaaaatcttttacactacacgggataattgcgtctcatttcttccaaaatatgctgatatattttggaatttccgtgaaatcgtctgaacatatactgatacaaatatgtcggcaacatatcctcatttgagccacgcaaatggcgaagagatgtcttcagagacccccacgtagcctcaatgccttgggtatgcacttgtctgtcatgagggtcgacaataccgactaatggaaaaaggcagcggctgcccataaaaagtgtggcaaaatttttgactcatgaaagcataaaacctttattttggcaaaaaaacataatttgatacataaaaaatgattggacgcataaaaagcgattggacgcatgaaatgagattggacgcataaaactttgattggacgcacaaaactttgattggacgcataaaaagcgattggacgcataaaagtcgattggacgcataaaaaacgattggacgcataaactgagattggacgcataaaacgtgattggacgcataaaagtcgattggacgcataaaaaacgattggacacataaactgaagtagagccaaaagttatagcccaaaaaaacgacacggcgcccaactgacatagaccgcttcctcacttttcattttaaatgtatgttagaagttgcctgtaaactagagagtacccaactttttaagtagcgccaaaattcattatttaaactctggctgaaaaaatcgaacgttacgacgacatg

SEQ ID NO: 99341 - DNA, 206 bp, Heterodera glycines
  Promoter: Source sequence=SeqID_14509; Location=1..206; Strand=+; Gene=SeqID_78560
ttgctccttgcgattgcctcgtaacgctcgagcgatgacagctttcgccataatttctttcctctctttgcaagtttttgagtaaacaattaggcggacgcccttttttaaaaggaacaaagcaaaacaaaaaacgttgggctttatgtgattattttgctaattcgccaaaaggagttcaaaaaaaaattgcagaatttaacatg

SEQ ID NO: 99342 - DNA, 680 bp, Heterodera glycines
  Promoter: Source sequence=SeqID_16527; Location=546..1225; Strand=-; Gene=SeqID_80932
tttcggtgtgtctgccccctctcccctcccaacgggtttcttcgcttcctcccattgcttaatggccctcaacgtgcgatggttttgctgccccgctaatccgcgctttgtttggtttgtgagctccaggccatcaatttgcacatagtgatcagtcagtgagcagatgacggcaatcagtctgaactgcttggcgatcaccgacgcctaaacaggccacccacccgcggccgatgatcgatgggagaagcgccctttttccgactctccgcgattgttttgactgacaatggataaaagcagacacaatcacttcgtcagccttccacgacaaaagaaagataataagcaaaaaccattcattctgaggggggcaaaacgcttcagggcaaaatatccggccccgggggtcgttttggtcaacaggaaaggccctaatttggccgacatttgccagtcgaacaagtttgccagattagcctgttcctcggcagcgaacaatgggcggcttctaatctgatttatccgcgcgccatcaccgatcgccttataaaagcggtgtccaattggcaaatgtcatcattcaatccttccaagttcccaattcagctgaactcaaaacagcgcttccactttattaggacaatttccattcccattttaggcatttattaaacatg

SEQ ID NO: 99343 - DNA, 113 bp, Heterodera glycines
  Promoter: Source sequence=SeqID_37709; Location=151..263; Strand=+; Gene=SeqID_66708
ttggcacctcattcaccctattttacctccttcagaggctttccttttgctggaattggcggagtgtcctcaatgatcgccccgtacgcgctgaattcgatggccggcggatg

SEQ ID NO: 99344 - DNA, 322 bp, Heterodera glycines
  Promoter: Source sequence=SeqID_11486; Location=223..544; Strand=-; Gene=SeqID_74902
tttttagcaattacaatcagagaaagggcaccgaaatttggcaatgaaaaaggcaaaaaataatttaatgaaaaactataatattttaatgtcatttagatgaattcattcctcaacaaattctttcaacttccgaatttctaagagccctttgtttggtcgcttcaattgaaatgggtaaattcaaaattaatttccatttatactcataaaaaaccgctaaatttcagcttttttcggcaccggtaacatcgcctcgctgaattccttcaatccgtcctttctccgttattttgtctccgttttttctcccttcacaatg

SEQ ID NO: 99345 - DNA, 77 bp, Heterodera glycines
  Promoter: Source sequence=SeqID_20886; Location=1419..1495; Strand=-; Gene=SeqID_51469
ggtaggtatcataatttcctcgcaacttttagaccagggtgatatcatactgccaataactccgattacgtcaaatg

SEQ ID NO: 99346 - DNA, 74 bp, Heterodera glycines
  misc_feature (7)..(7): n is a, c, g, or t
  Promoter: Source sequence=SeqID_9192; Location=6418..6491; Strand=-; Gene=SeqID_70552
tggaatncggtggacaaaacgtcacaaatgggaggcaattaaacaatataatcaaataattatttaatctgatg

SEQ ID NO: 99347 - DNA, 104 bp, Heterodera glycines
  Promoter: Source sequence=SeqID_33116; Location=1..104; Strand=+; Gene=SeqID_63272
ggtacatcgatcacttcgttatcgcttttcttcgttccaatcaccaaattttcgacaaaagaggcaccaatttacagttgtttattcctccttcatcggtaatg

SEQ ID NO: 99348 - DNA, 699 bp, Heterodera glycines
  Promoter: Source sequence=SeqID_17957; Location=1..699; Strand=+; Gene=SeqID_82522
agtgagaagaaaaatgaaacacaatttatcaaaatatttatgtatattttatgcacttgagttcgctaagctttatcaaacggttggacgtgaaaaccgacatattatgaaaacagggaaaaacaacacgaattgggatggtttaaaatctgttactcaatttttcgccgtcaaaaatctttttgtgaaagctgtgaggtgacattttggaccaaagaccgtcaccaaatggaatgtagggagcgctgcaaaaagtgttgccggatggggttcgggttcccctgtttggatgtttgtgaggcgatacactgtggagaatgcaatcggaatttctacaacaatgattgtttcgagtctcacaaaaagacagcttgtagggagtacaagaaatgcaacaaatgtgtggaaacacacaatacgcgaaacaaacacacgtgcggggagaaattctgtagaatttgcaaagtctatcatccgggtcggcaatgtttcattaaaaaaatcaaactccgacagcagaaagcataccgaattgtggcttatgacctcgagacgacgcttgaagggggcgaacacaaaccaaatcttgttagtgccgcgcatacttgtagtgtttgtgtgggagaagagatggaatgcgaaatttgtaatggtccgcggatgatcacttggtctgtagcagctgggtttgaaccgatg

SEQ ID NO: 99349 - DNA, 864 bp, Heterodera glycines
  Promoter: Source sequence=SeqID_1269; Location=1..864; Strand=+; Gene= SeqID_71091
tttttaaaaaaggggaaaaacttggggattttttgggcattaactttttttaaaatttgtttgagtgcattaaaaattgccgacatccaattcatctcgttattctgcatcagatgatattaaatttattagaatgtgttacacttttaataaagttacactcaattttctggttatggccaagtccctaattttggcaccaaatttcattggcccatggctgacaggagaacaacttataggacatgctacgtcacccgtcttattccctggaccctatagacttaatttatggctaaattatttctctcaaaaattccttatagggtaggctctttaaagaatatggcaaggtcgtggatccagtgaaaattacctaggttcaaagaatggcacagaattttacaaaaagggcattgttaaactcccatctcggcggcaaaaggttgtagacagtcagggcaattactttgttaagtagctttttgatcggctttgttatgattgttatttttcattttttgttcataaatttttttccttcaaaaagcgcccttttttatgcaacgacctagtaaccttggcaatatttttatcttttcagttgtattcctttgaccttcatttacatatttaaattaatgtattttatttttaggtttttatattccccccttaaaattcacacccattccttttgttcaggacgaccattgctttgtcggttcgaatgctgcctcgggcagtggtgagcatccgccgtccgtctgcactcctccgcccctctccgggtctcttccgccgattacctcacttgggaagcgcccattgcacccgcacaataattcctcacagcatcaaatg

SEQ ID NO: 99350 - DNA, 818 bp, Heterodera glycines
  Promoter: Source sequence=SeqID_16755; Location=1..818; Strand=+; Gene=SeqID_81160
tacgtgtggaatgttccacttagtctgaatggccgggagctcaaaaaaaggctcagccaacttattggactggtaaaaatattttgggaattaatttcatagcgcgttatccaacaggttcgcttcatcgaaacattcgaagcaagtttattaatttataacttaaaaaatgttttgaatttaatgatgaaatgtgtaaagaggattttgaaattcattcattcggaaattcaaaattgggtcattttatttgactgggctgagattttatgtgaatacaattttttcctggattctccatgctctgaataatttaaaaacaattttttctgtttgcgaacaaaaattgaaattttatttacctttttttttgcatatttttgggtttttctatagtatattacatagttcacatttttcttcacattttgaattttaaaatatattcgcaattttttcgtacatttttaattttttacattttttgagtttttgataatttgtagatttttttttattaaatctacccttaaaaatcgatttttcaaaaaggcaccaaatatcaatttttaactaattaggtatttttatggaattgtgttctttctaatttttttttttgtaataaactttttgtccaaaaatcataataaattttttattaaatattttttaggtcttagatatttcgggattattttcttttggatgaaagcattgacaattacattaaatttgaggcatggatcaaaaggtcggacaatgtgctcatcgagttctgttcaatggaatcggttagacgctttgccgtcatgatg

SEQ ID NO: 99351 - DNA, 543 bp, Heterodera glycines
  Promoter: Source sequence=SeqID_8528; Location=1031..1573; Strand=+; Gene=SeqID_68410
tatgctggtggtggggggtggggagttcaattaataattttgtgatgttaattactataattattgctataattgcggcgcagttaatttttacaaattttttcaattgtccgatcgcttagctttggattgattttttaggtgcgttcggcacatcacttggcaaaaacaaagtgggcaccctcgcaatcatttttttttgcttttttttgtcattacttttccagaaaaggagcgggaaacggtgggggcccattgagttacggtgaggtgatgcacgagtcgttgacggacagcttcgaatgggcacggccatatgccaaaacagccaagtaaaatgccgtgttttggttaggggccgtcccagagggagagggactggcacgaagaaaatgaaaaaatacgaaaacatttggttgtcacccaaaccccgaaaatcatcttaagaccgcggactgttccggtattttggttgcaccagtttaagcttaaaggcaattttcttatggggaatgggcatccctgaagaattttatcaaaatg

SEQ ID NO: 99352 - DNA, 804 bp, Heterodera glycines
  Promoter: Source sequence=SeqID_39961; Location=334..1137; Strand=+; Gene=SeqID_68409
ttgggcattgaggtgtggtggtgataagaaaacaaacaatgttttttgatcaaagacagaattttttggaaagaaattatgacaatttttggtatttgtgagagtcgaaaatgcttcgaggcaatgatttaattatgggctaatgtcccaatcgtaaggtgctcactctgtacttgggatggcgcgacgtgaactttgtttggctgctgttgccgcttttgttttgcgctggcgcaatttggtaaatttgtcgggcacgcttatttgttaggaaaattttgatgggggccaactcatgaatttggcaaaattggaccgaggagaaaagttaagttcaaataatttttcggtttaatttaaagggaccgaatttcggaatatttgtgcgctagcaggagatatcaaaaatgtttatatatttgtttgctaatttcaatttggaatcattcgaaaattacacgtactttaatagacatcccgaactcaaatagcaattaattatcaatggaagccaagattgatcactatttggtgaagaacaaatagaacaaatgatggggctaaatcggtattagttcagttggtaaagtccgtttaagccagaggctccgcttcaaatccgctcgctcaactgtcttttcccaacagttttatcaacccagtaaaatcaggcacagccttcctaatgcagtttcaaccaaatgatttatttttattttatcgaatccctgaaactccaatgatgatggtccgattttcttctcatttgtcaggattgtctctcagcgatggtaccatcagatg

SEQ ID NO: 99353 - DNA, 293 bp, Heterodera glycines
  Promoter: Source sequence=SeqID_31977; Location=1300..1592; Strand=-; Gene=SeqID_62290
attttttatttaatataaatcgaggatcaataaacttttccttggccgattatatttcatttaatttcaatatatttatttttttggaattccataaattatttttaacatttacaaacacggaaagggaaataaaaatttttaaaatcaactatttaccattaaatataatagattgcaattgattgagatttttcaaaaataaatagagattttgcatatattccacttataatataacaaatataagcagaaaaaacaaaatttattattattttttgcatcaaaaaatg

SEQ ID NO: 99354 - DNA, 320 bp, Heterodera glycines
  Promoter: Source sequence=SeqID_11754; Location=2372..2691; Strand=-; Gene=SeqID_75248
tctgaaaaaaatttaaatttaaataatctcaaaaaagggcaaaacaaaaaaaaagcaaaaaataaataaaatttcaacagccaattaattaattaattaatttggggcaaaatgttataaattatataagttaatgttaatgttaatgtttgtgcgtgtgtgtgtgaattgaattcattagtgagcagcacaaaactgagggcttttatgagtgattttattggaccgttattttatcaaaaatcaaaattttatcaattttttgtttggcggcggcgaaaattgcaaataaaaaattaatttttgttaaataaacaatg

SEQ ID NO: 99355 - DNA, 928 bp, Heterodera glycines
  Promoter: Source sequence=SeqID_19275; Location=1..928; Strand=+; Gene=SeqID_84022
tttcttaaaaactgccactatgggcgtttcttaaaaactgccactatgggcgtttcttaaaaactgccactatgggcgtttcttaaaaactgccaagtgggcgtttcttaaaaactgccaagtgggcgtttcttaaaaactgccaccatgggcgtttcttaaaaactgccactatgggcgtttcttaaaaactgccactatgggcgtttcttaaaaactgccactatgggcgtttcttaaaaactgccactatgggcgtttcttaaaaactgccaagtgggcgtttcttaaaaactgccaagtgggcgtttcttaaaaactgccaagtgggcgtttcttaaaaactgccactatgggcgtttcttaaaaactgccactatgggcgtttcttaaaaactgccactatgggcgtttcttaaaaactgccactatgggcgtttcttaaaaactgccaagtgggcgtttcttaaaaactgccaagtgggcgtttcttaaaaactgccaccatgggcgtttcttaaaaactgccactatgggcgtttcttaaaaactgccaccatgggcgtttcttaaaaactgccaagtgggcgtttcttaaaaactgccaagtgggcgtttcttaaaaactgcaaaacaaatatatttatttattaaaaaatgtttatgtcagttgtttgccaacgttataaataataaaaatatatatacatataatttttacatcatttgtttgtcaacactatcttcaacaccaagctcagtaaaattaaaatattaataaatttattgcttctgatgattgtagttaataaaatttacaaatgagctcaacgatatatttaatattttttcttttcttgtgctgtttaaaaaatgtcttttaggtgataaaaagtcgctgaaaatcgaaaattgttcggacaaaatg

SEQ ID NO: 99356 - DNA, 1003 bp, Heterodera glycines
  Promoter: Source sequence=SeqID_7109; Location=1060..2062; Strand=-; Gene=SeqID_63863
tggtgggtgattttaaataaagtgaatgtccagacgaatccagcaagtttatttcgcagggctccaaaaatgtattttcaaaatagggacaaacgaggttaaaactaagatttgcccccaaaattacgattttttttgaaaaaacgacgttttaaattgttaaaacaattaaaaacagtgctacttagtgcaaatcttcaatatcagcatttagaatccaaaatcagcaattttgcaaaaatttattccaattaaaaaaaatgaataaaaatttgcggcacgcttttttgggaacagcgggccggcgatgtcggtaggcgccgcagtgaaaaaatttgaaaatttaaatgcattttattaacagaatttcacgtccggcggtgccgattggcgctgccgggaaaatttgattgcgcttaagcaaagttatggcatgttttgtcgaaaattcgctaaaatgccggattttagaaacgacatagaaccatccccgacttgtcattctgacggaccccgctcaccaataagagtttcccgacggggataagggagcttgggttaatatttagtgatgctcgatatcgaaaatttcctgatactctagtgactaaaaccaagacccaaaaagcccgggacttttaaggagtcgagactgtggcatttggccacttgaaaaatattgataagaaataaaattaataattatacaaaaataaatattttgaggtgcataaattaataaaaaaaaatacattgaattaattgatattattatttatattttttccggaaatgtaagtgccgcatgtgttggccaagaagagaggaagaaaaacggatgacttccgctattgaaacgccaattgaatgattttcattaaaatgccttttttcctgtattcaatttcatcatttttgacaaaaacacactttaaaaaataccaaaaaatatttttaatttaaaaattaagttacgaggtaaaaatgaattttctcacgaatg

SEQ ID NO: 99357 - DNA, 125 bp, Heterodera glycines
  Promoter: Source sequence=SeqID_4911; Location=241..365; Strand=+; Gene=SeqID_56174
aaatttgatgaaatcgttattagttattaccaaggcacaaatagctggtcagcaatacgggtcggggaataggcagcggggtcggggctcacaagggaacttcgcgaactgttagtcggaaaatg

SEQ ID NO: 99358 - DNA, 1003 bp, Heterodera glycines
  Promoter: Source sequence=SeqID_13507; Location=2280..3282; Strand=-; Gene=SeqID_77402
ttcttcccatccctccatttgtctgcctgcggcgggaaagtcaactccgatcacctttctcccctcgttgaccacgacgagtgattcctctcaaatccccctcccccaatttgcatcccttctcatcccatctcgcggcgcgacatttccctgatgagggaagagcgcggggttaaattgaggaattgggtgggggcgggaggaagaaggacgtggcgggacggaggagggggcaaattggaagaaatttcatttcatcgccgccaccgccgccgtcacagtgaaagagccgcttcttccctttcccattaaaaccaacaaatcccccccccccctccccccaattttaagccgaggtgccacaaccaattttttatgccacttttttttgggtgtcatttcgcgctaacatttctcatttgtcattcatttgcattcattcatttttcattccattggttttcgctttttgatcgacgcttttgagggaatggcatttttatgattcatccatttttatttgtttgccatcagcagaatgaagaagggagatcattgctttcgcggggggggcatgggaggagaagctaaattccgacttatcgaaaaattttttgttctttaattaaaatttatgattttttggcggagggtgcgacttattttaaaaacttttttgcaaccgtcttttgggttccaatttcttaaaattcgaggtcagcagcgccatccctagtttaatcagagacgatcaattttgcttttttgaattcattgatcaaatatcgattcatatggctggcgcatcattaatcaatccactctctgatcactgatcgaacactaaattgagaaatttctaatcgcaatctgtgccatttcaaaagctgatcatcactcggcatatgctgctgcctgcgctttatcactatcgtctcatttcgccgatgaattgaccgacgacgacggcactttttttgtcccaccctttttgtgccaaatg

SEQ ID NO: 99359 - DNA, 95 bp, Heterodera glycines
  Promoter: Source sequence=SeqID_9072; Location=2132..2226; Strand=+; Gene=SeqID_70158
acaaatgtttgggctttttccttatgtgcgtccctccaacaaatggtgaaaaattggagcatttctaattgcattaattttaattaccaaagatg

SEQ ID NO: 99360 - DNA, 149 bp, Heterodera glycines
  Promoter: Source sequence=SeqID_37956; Location=1205..1353; Strand=+; Gene=SeqID_66920
ttccgttgttgagggaaaagcgaagccaacgatttattcgggtttttgtcgcaaaaatatatttaaatgcgaattgctgactttgaaatacagtttcgatgttcgaaaatgcctccaaactgtggaagatcgagttgtttgtggagatg

SEQ ID NO: 99361 - DNA, 924 bp, Heterodera glycines
  Promoter: Source sequence=SeqID_19518; Location=1586..2509; Strand=-; Gene=SeqID_84248
agataaatagtaaagaaaacaaaaagacaaagaccgagagatagagagagagagacagagaaaagagcacatacacatacactatgggtacgccccactgtgcagagaaaagccggcggccccacaaagtgtccaagccacgaaatgtccaaaagagtaaaaacccacgaaatgtccaaaatttttcaaaatttataaaaacaaaatgagtttaatttaggatttttagggttttcggggtcgctgaatacgaatataccctttatattaccccttgcctaaccttaggcccatctgaataataaaaaactcaaattcgagacttggacatttcgtgggctggacattttgtgggtcagcggaaaagcctagtactatctcgtcgtttctctttttctttgtaatttctctcactttggcgtactatctcttcattttaatgatgtaaaaaacaacatttacttttctatgtctaactttttttctttatgttaaatccgtaccaaattttgcatagcgatagagaaaaaaattatgaacaaactttcagtgttttgagtaaaaatttcggcctagaacattacaaaaatgggatgaaaaaaatttgcatttctttttctctctttttggcgtactattttcatgtctctaacacgtgaaaaaacaccaaattcgaaaattctaataattttggttataagggtacaaaatcactttgaacatttagaatcaatagaaaaaagaataaatttagcattttggttagaaagagctgcctaggacttgagttataacatgataaaagtttgaaattcccacaacttttttctgagatgacaaattacttaacattcgcttagaaaaagattccccttttcaaaatctttttttagataccaaatttgttcagtttagttgggaatg

SEQ ID NO: 99362 - DNA, 360 bp, Heterodera glycines
  Promoter: Source sequence=SeqID_22468; Location=567..926; Strand=+; Gene=SeqID_53139
aacgaaattagtggtatttttggtaaaacattcgtcattaattagtgaaacagccattgattaatgaacttggcacagatttattacgttccttaaaattgggtcgcgtcactttggagcggcacattttggcgctaccaatggaaatggcgctaaaatctcaataaaagcagtttttagttcttttgccatatggtccaacaagtttaattttaatagacaaataaaaaatatggtagcgtttgcatcaaaaacggtgacaaagtcacctaacacaaaatcaaaattagaacatgctttaatgatgaatacattcagttccgaagagctgatcgggtgctataaaagctcgaaaaaatg

SEQ ID NO: 99363 - DNA, 261 bp, Heterodera glycines
  Promoter: Source sequence=SeqID_11497; Location=3174..3434; Strand=-; Gene=SeqID_74924
gaaggcgtatttagagacataattaggttagataacgaagcaaaagaattttctttttctgcacataataccatggttgaagcccaaaatattaaaaataaaaacccggataaacctggtgtgaatttttggcatagcaaattattagatggagttttaaaaattcatgccctatttgacaaaataaaaaaagaagaaaaaaatatgaaaaatattaaaaaaggtatggaaaaatgtctagacagaaaagatttaactatg

SEQ ID NO: 99364 - DNA, 69 bp, Heterodera glycines
  Promoter: Source sequence=SeqID_44755; Location=1..69; Strand=+; Gene= SeqID_72192
cggtaatcagtgttctctgatcaactttgctgtttagccttattataccacgcaacagcagtgctgatg

SEQ ID NO: 99365 - DNA, 414 bp, Heterodera glycines
  Promoter: Source sequence=SeqID_14600; Location=1..414; Strand=+; Gene=SeqID_78678
caccccagagaaaagcaatataaaatttttaactttattttccggcgggacctccaattctgcagtattttttcccctgatacagtggaaccatgtttattacaaatgttttagaggtctttgaacgcgatgacttccattttgactcgaattcctatcttaattccaacaaaaagttggaaattcgaattttcggtttttaggtattttttcattttttaacatattataaaatttcggattttatttttgttgtaattctggttaggagtaaggatttagcctgctaatgggtgctataaccttttgaaacggactttgcgcataggcgaaatttgtccgagccttaaaatcatttcccgcaatttctgtgagtaccacccaaaaacttattattattattattttgtaatg

SEQ ID NO: 99366 - DNA, 224 bp, Heterodera glycines
  Promoter: Source sequence=SeqID_39815; Location=238..461; Strand=+; Gene=SeqID_68291
gccgaatcaatcattttgcgttgtcagaattgttgactgtttgggtcagaaagtgcaatttcgcctgtttgaatctgctgaaagagaccaacggaaagtcgccccgttttatgctaatcggaaatccgcaaggactttttgacgagggcgaactcagcgcagatttggaagaacgaggcgaaggcacagtttcggaaaacagtggcagagcagcggacagaatg

SEQ ID NO: 99367 - DNA, 607 bp, Heterodera glycines
  Promoter: Source sequence=SeqID_25527; Location=600..1206; Strand=-; Gene=SeqID_56270
tagggagtacattaggtttggtttggaacacacacccctcccctcctgggttttgatggggcggcaacttcaaagggttgcgcccctcccatagggtttggttcttggcggcagcttcagaggtagtccaataggcatgggtttgtgagcgggcggcacatttcaaaagaaaacacccctcccgtaggtttgggtttgtgcggtaaacacccgctcggaaccgtgcgctttcggggcactcggtacaaacggtcaagagtttattaaagtatgggaaaacgacagcagtgtcccgactcaagtttatttaccggacatgaattttaaaaccgccgggggcctgggaaataaaattaacgaggcattcacacatcattacaaaatcaaaaaacaacgtggaaggagagaagccaaggctgaagataccaaagactcaaaaattgatgtcgcaaagagggccgcagaacgcgccgggagagacgtagaaagacattttaatcagatcaacaatatatcgaattccatccaaacccaactaaacacactacgagaaacaaatcctcaaattttagaagagcctgatataaaaatttggtttgacaaaatg

SEQ ID NO: 99368 - DNA, 920 bp, Heterodera glycines
  Promoter: Source sequence=SeqID_10696; Location=1627..2546; Strand=+; Gene=SeqID_73949
aatgtctcaagttgagcagtgcaatttttttgtccaaggcttctatgtcaaaacacaaaagccggacaaaattcttttaaaaaccggcatttttagccggtttcgcaatgccaaaaaccatagaaaacattcaacaaaacatttatctccctttttaccggtttgtttggtaaagaaagaagcaattcataaaaaaaatctttttccatcaggttgcctgttcttagaaattgaactcggtcacaattctgtcattcataatacatttttgtattttttttcagataacatttaacatgagaggtatactcgcccaattatcgaagtagagtaacttttttattgcaattaggagttcgaaatttgtcagaaaataaatatatttttttataaataaagaaaaaattaaaaaattccttttttgtgtgtttataaacagaagaataatttgaagctaaattaaaacattttggagaaaaattctcaattttacacaaatttttttggtgtgaaatacctaaaaaagataaaaaacaaacattgatgagccgaaactttatgcgaaaatgcattctcctcccgagactttcagcagaatcatgacattccgttataggtacagtcatggtcataagtgttgtcccatcatgctttgaaaaaaataattgcgtataaaattgtcattttccaatttcaacagataagtagcataccattggatagcattttttatgggctttccaatgataccatatttgcatttgtgacataaacatttatttgatttattttaccatattcacaatttgatcaaaatataggtggtcaaaagtgttgtcccatttcatttttaaaatattgcttctctggatcagcattaaaaaaatctaaaaaaattcaggtaagcataattttggatg

SEQ ID NO: 99369 - DNA, 991 bp, Heterodera glycines
  misc_feature (14)..(14): n is a, c, g, or t
  Promoter: Source sequence=SeqID_31254; Location=1..991; Strand=+; Gene=SeqID_61627
ttaaaatgcttccncatggcgcggcccaactttcgccaacttttcgcaagacagctactctgcagcgccaggcgctaggcgccatttgcgaaaagttagcaaaaacaggttagcatatctcggcgcaaagcgcccggcgccagacggcaatttgttttcccagcctttcagggtgcgggacgcgcggggaaaaaaattctgtctctctagcatcgctggcgcaaaagttggctctctatggcgcaaagtgggcaccacaagttagcatatctcagcgcaaagttgtcgtagcgcgccaaacttttttttaaaatgccccccttgggatggcacgcatttagtcaagcggcgccaaacttcagcgccgggcgccacgcaaagttagcaaaaacaggttagcacaactcagcgcaaagcgcccggcgccagacggcaattttttttccaagccttacggggtaccggacgggcaggggaaaaaaatttggcttcctagcattgacgtcgcaaaagttggctctccacggcgcaaaaccggctcgggcgcgcgcccatttcgacccttcagaattgtcgaatcgcgccaaatttttttttaaaatgctccccacggcatggcacgcatttcgccaagcggcgccgagtcgctatctgtgcgccgccgggcgctatgcgccgattttcgaaaagttagcaaaaaaaagttagcatatctcagttcccaaatgtttttgctgtcttttgcacggtgaagttggagtagggggagatcagttggctaacgcaaaaggaattgggtcgataggtgcagaattcgcaatgtgcgggccacatttgcagagagccccccccgtttttatatatatagataactagccgctctgagggcatgcgtggggagcgtgcacttgcttaccctagccggtcgagttgtagccagtaacgggtgcacagtccaggttggctgggcagtagcagctaccgaaagatg

SEQ ID NO: 99370 - DNA, 307 bp, Heterodera glycines
  Promoter: Source sequence=SeqID_41783; Location=1..307; Strand=+; Gene=SeqID_69832
tttaaatatgtttttttaaaggaaaattttatagggaaatttggtggaaaaaaaaaattccaagggggtgccaaaaattttttaaatttacgaaatgcatcaacaccaagacaaataattacattttccttatttagcatcacatacatctcaaatgtataaagcaaggggtaaaattttcatttttcgattcttctacaatttttgtaaaaaattttatttagcaatttcaaattacctgcaaatgcatgccctatatgtcgtgcagaagtatcagagaatttcatggggttattaagaaaaaatg

SEQ ID NO: 99371 - DNA, 1003 bp, Heterodera glycines
  Promoter: Source sequence=SeqID_13817; Location=269..1271; Strand=+; Gene=SeqID_47156
aaatagatgatgagagagagagtgggatagagaaagagggagagagaaagagcgatggaggttagagttgttgggcatggaaggaattgctcgcatctgactaatgatttgtgagcggcctgacaaaggaggggtcggcaagtgaccgtgggatttccaaatgaaatttggtgggtgggtaaatcacccctagtttctattatgaaattttaaccatttttgccaaatgagcatgagtgccgagatatgacgtgccaaagtttttacgcttttttaattagaaaagatataattcttttcggccaagaaagaagccattggtgtagaggtagtaggttagtcaaatcttttttatgtcacaggttcgaatcccatgcatgtatatattattttataatttttatttttaattttcatgcaaagttaactatctaaaaatttttagtaaaaacattttttattttaaatttttttccattagaaatcaaaaaattactacattaaacataaaggtgcaataaatatcctgtcgtattttttaaatattttattatcttatgtacatatcaaaatgaaagtaaaattaaaaatattttttattatcatatgtaccaaaataaaaagtaaaattaaaaataaagtctttttataaaactaatcttttgagaattgacttttcataaaaagcaaaaataaaaatttaaaaaaaaaaattgcatatagcggattctaacctggtgcgactgttactaacgcataacctctacaccatttgacaatgcgaatggttgcaaataattatttaatttgtttgttcattaaaaaagtttggcacgtcatatctcggcactcatgctcatttggcaaaaatggttaaaatttcacaatagaaactaggggtgatttacccacccaccaaatttcatttggaaatcccacggtcacttgccgacccctcctttgtaagaaataatattaactgtaaattcagtttcaaatcatg

SEQ ID NO: 99372 - DNA, 350 bp, Heterodera glycines
  Promoter: Source sequence=SeqID_1896; Location=1..350; Strand=+; Gene= SeqID_76635
acagacttatcaggtgcgaatgttcttgtaaattatcataaccactctttttcattccattctaagttgggtcttccatttgctgaaccctctccaaagattgcactctgtcgatgagtttcgaagtgccgttctttcgtccgattttttggttgtcggccatttttcattggatgtgtgtcatttttacccaactcactcagttttaattcgaactttttgcttttgagggccttcctttgcctcgttcttaccacgtttttctcaacacggcttttaaattggcaaactttcgctcgtccgtggcttttgccgtcgttctcaaccgcgcattggcacttggccaaatg

SEQ ID NO: 99373 - DNA, 120 bp, Heterodera glycines
  Promoter: Source sequence=SeqID_6934; Location=1..120; Strand=+; Gene= SeqID_63335
gaaaagagtgaatcaaaggttctcagcgctaagagtcaacttcaatgtgacatttcactcgaacaattcgacgaaggatttggccaacttttggattgttcttctctctccaaaaagatg

SEQ ID NO: 99374 - DNA, 528 bp, Heterodera glycines
  Promoter: Source sequence=SeqID_4570; Location=989..1516; Strand=+; Gene=SeqID_54928
cacagtccaacctccggcacttgtgcaccgcagcactttcattttggcgaatcgctgacggcggagggccatttgacgcaaaaaattcgccaatgccgaagcagcgggcaagtagtttcatccaattttttatggcatttttatgttcagtttttatgacattttgtgccttttatctcacaaaatttgggattttttttataaaattacaaaaataatccttcatattataagcaatcaattccatactttgtttatttattttgaaaatcacctttcaatcgaaatttttctgttttattgcactttgagtccaaaaaacgcatttataataatccagcaaagtccctgttcaaaaaaaaaagttcatgccgaacttactaataatcatgcaaacttagaacccgtccctttatctgaattttacaatacatctttataacaaaaacagggtttttctcctcttccagttcccccatttcgttggaggacattgccgcggtgaaccgccaattccatcggcaaatg

SEQ ID NO: 99375 - DNA, 227 bp, Heterodera glycines
  Promoter: Source sequence=SeqID_19712; Location=513..739; Strand=+; Gene=SeqID_84457
agccaactgatctcgcgtttcccacggggaaaaggatcagcgaaaaagctgatccttaatcccgccctttttgttactgtctgtgggggggaaataaaataggggtactgtacgtaacagtttattagggttgaatcatgtttaatgtgataaataatttgatgttttcattgttttggtttaagaaaagttcattataagttttatgtttattaagtctgaaaatg

SEQ ID NO: 99376 - DNA, 303 bp, Heterodera glycines
  Promoter: Source sequence=SeqID_20387; Location=1177..1479; Strand=-; Gene=SeqID_50909
ggtgttcggtctccatttgcattttgctgttactttctcttttagcatttgtaccaacaacaaataaatcagcaaagggttcaacaaatccaacaacagcagcagcaacaaaatgcatttattttcgggcctggcggaacttcggcaatttctggacaaatgaatcctcatcagtcagcaattgtcggtgccgcttatcagcctccccacccttcgtttatgctgcaatcgcaattggcgcatcagcagatcagaccccatgggacgcccagtggtggtccctctgcttctcctcatgggatg

SEQ ID NO: 99377 - DNA, 163 bp, Heterodera glycines
  Promoter: Source sequence=SeqID_3175; Location=2742..2904; Strand=-; Gene=SeqID_83536
ggtaatgggggaaaaggagggaaaatgtgccaattaaatatatttttaatttgcaatgcttttccgtcttttaaataattaattagtctttcatttccaaatgcttttgcaggagaattactggtgagtgaattgtcctccgttcgtttccaccgaatgaatg

SEQ ID NO: 99378 - DNA, 448 bp, Heterodera glycines
  Promoter: Source sequence=SeqID_41063; Location=1..448; Strand=+; Gene=SeqID_69271
atttatcaatatattgtttgagtttgatttagtggttgttgtttctcagtttgtttgtttgttcattttttgtgttcttagcgtgaaataattatgctaaatgcttaggcttaatgtttaatctcttattagatttttgattctttgtctaatttttccgatttagcaaaattgaagtgcttaattaaaataaattgtcaacaggtttaaaaataatgttctgctctgccggttcggcaatatcttatcataatgcttagcatttcggaagaaaaagtaaattgcttttgtactcagaattatgtaaaagagtgctataattcgtttttgtggtttaaattgatttagatttttcttatgtaattgtatttgcaaaatttagataatgagctaagtgggatggcctaactttttgttgaatgccttgggattacgaaattcccaaatg

SEQ ID NO: 99379 - DNA, 489 bp, Heterodera glycines
  Promoter: Source sequence=SeqID_1117; Location=1657..2145; Strand=-; Gene=SeqID_68076
tgccgagcaatttctcgccatttttctcgttgcattgcactctcgccagactctcgcccccctgccactcgctgctgcctactctcgcccccactgccactcgctgctgcctgctctcgcccccctttccctgccggtgacgtcattttttccctttatgagagcaaattaatgtttgtcatccgttgccaatgtggccgagtggttagtgcgtcagtctggccgccccctctggagttctcggatccgctcggtgcggggaatttttgatgaattttaaatgattttaaattcaacatctttgacctttaagacgtttaaaataatttaaaattaaatttaaataaatttaaataatttaaataaagtcgctcagtcaaaaaagtcgcgcatccctgcacccaagtttaattgcgttttcactttccatctgtttttcacgcccgaaccagaaaatcaaaataaatttgacttattccacaaaaaatg

SEQ ID NO: 99380 - DNA, 1003 bp, Heterodera glycines
  Promoter: Source sequence=SeqID_10038; Location=1179..2181; Strand=-; Gene=SeqID_73096
atatacataaattctcgaaccaagaaatttgtatgaaaattggagtaaatattagagcaattgaaagatggaagaaacattttgttctttaatggggattaaaacattaaggagataattttagctccatgtccgcatttttaattaaccattccgataaaaaattgatttgctttttatatatattttaaaaaaaaatttcatttttttataaatttaaaaattggtttcatcaaaagtgcttgaatctgcctttttcgttaaaggttttatttaaaaatcaacaaaaggattaaataccattatttataatcaaagttgggttcgagaaactttcttgcttatttcggcacagataaacaccaagtttcggaccctaatgcccaactaaaaataggtcggctttagactcaaaatccctaaggtaaaaaatgccataacactgaaaatttaatagggataaattagtttatctattttcagaacttttaaaatgtgaaaatgatgaaaatcaaagatgctgatttgcgactcgttatataaaaaccatcaaaaaggggggtcggggtcgtttttgcacgggccgttttcgtacgagaacaagtttttggctataacttttttctttgccaaccaaatttaacattgttggtgccattcgatagccctaattaattatttgctttttctattaatgtacagctttccaaagtgaaatttcttcacggatttgcaaatcgtcacgtccaaaaagttcacacaataaattttggtcagtttgcaaaaaagcatcagctttgaacaaagtgtcagcatttttgtcaatgtaactcaaataacaatgcacaaagtcctaaattacatgggtcaatgtcaactcgtacaattttaaattgatgtggccataacttttgtttagtcggccaatttcttaaaacttggtatcattcgaatgcttttcatgtttagaacagatgattaagcagaagctaagcgattgatg

SEQ ID NO: 99381 - DNA, 100 bp, Heterodera glycines
  Promoter: Source sequence=SeqID_26693; Location=1..100; Strand=+; Gene=SeqID_57459
agtccagtacattcgaaagcattcgaaacctgaccccattgcatgcttgagtatatggcaagagctatgtgttttgagggaccgtgaggcggacgaaatg

SEQ ID NO: 99382 - DNA, 378 bp, Heterodera glycines
  Promoter: Source sequence=SeqID_21584; Location=872..1249; Strand=-; Gene=SeqID_52190
tgtccttaattaattagcctaattatttcaaatttaacacaattacacttttattttatatctgatttcgtcgtcgacaacatcgcccttttctccttttcccattttcattgctaactctttgtggttttgtccattttgcctccgcttgtgcaatttgtctgccaattggggtgtcctaaatcattttgaaaaaaggatatttgtattaaatttaaatttgtttggtgttatgttttttcgaaatttatttccaaatgaaaaaaaatttaaaatcctaaatttttacgggtcttttgttcaacttttgctgaatttataatcataaaattttgttacgcttctcagacgagcgattttataaataaatttaatatg

SEQ ID NO: 99383 - DNA, 278 bp, Heterodera glycines
  Promoter: Source sequence=SeqID_16916; Location=2511..2788; Strand=-; Gene=SeqID_81350
gctgctaaatttgcagacaaaatgccaaacaattgaaatgtttacacaaattaaaaaaaattttttcgggaatttttcgtgccattatacgataacagtgtggcttacataatgctacacaaacccgaatggttttttgggattttgtttgccgatatacggtaacaatatgacctacagaattttcttaccatggcctcgtagagtgcccgctgctcttcggcatcgtcctcatcgtcgacggttatgccaatttcgccccggtcctcccaataatg

SEQ ID NO: 99384 - DNA, 722 bp, Heterodera glycines
  Promoter: Source sequence=SeqID_30634; Location=469..1190; Strand=-; Gene=SeqID_61042
ttctatagaccttaagcttttgtttaataccaagaattccttattgaccaagtaagaaaaaagttatggcctaagaaactgtgtatggtcattcatgggacgcataatatgacatgggaccataaaaccgactagaaccttttttttcttaaaactataccagatccagattttgccctacaaccaccaccgcaaacacatccgctccaatcgctcccttaatttggcaataatttgtttaatgattatttaagcgaatcactttttttaatagattaaaagtgcattttggccacattgtgttcttcgacaaattggtagtttaaataactaaagaagtttttggtagagtgccacgggaccgggaccgggccgggaattcccggtcatccgaggtcccggtcccggttcccggtcccgggttttgaaaagctcaggtcccggtcccggtagggcaaccgggaaccgggaaaaacaagtactggtaagaatggggtctgagtgaaaaattagtgaagaaaattggagtcaaagggaaaaaagatttaaatatttgaactgatgaacatttcgccaagttttctttatgtttcatacattttttacttttacatttcgcatttaagctttacctagcttattttttgtgctaattttgtcttttactattatttaggaaaacgacaaatttttcttatttagtttatcaataacagaaaatg

SEQ ID NO: 99385 - DNA, 413 bp, Heterodera glycines
  Promoter: Source sequence=SeqID_24966; Location=810..1222; Strand=-; Gene=SeqID_55701
taattcgttttagtatcaattcatttttttacttcgaaaagttgaactttatgtgatggccaactttttggattccattaatttccccttttaaagcaaaaaatgagtcgaagcaaaacagaaattgtttgcgactttgtgccaatttttaaagaaaaataagggttttgggggtccagcggcgcagataggcgccctggaggaaaaaattggaaattttcaacatagacctattgccgaaactcccatcgattcgacaatgatgtctttttgacaagaaacacaataaaaaagcagtttcttaccgacttagtttgaaaattaaaaaacaaaaaaagttaatgattattcatgaaataattccaaaaattttaaacttttttccgtaaaattgacatttttcagttcatatg

SEQ ID NO: 99386 - DNA, 302 bp, Heterodera glycines
  Promoter: Source sequence=SeqID_27662; Location=933..1234; Strand=-; Gene=SeqID_58338
gattcacaaaaagtccaactatccgaacaatctgaaaagcttacgcaattggtagcggaattgcaaagcaaaaaagatgagcttgaaacatcattagcccaaaatgagagtcaaatcgaaaaatttcgtgccaatttgaaatctgcggaagaagtattttcgacaattagtgtgtaaatatgtaatgatgaaaattttcaggaaaattcaaggcttttttatgttatcgatgagttgaaaaaggtgacatgaatctctcaaataaattattacaacaaattcaggaatcccaatgtcaaatg

SEQ ID NO: 99387 - DNA, 676 bp, Heterodera glycines
  Promoter: Source sequence=SeqID_28947; Location=109..784; Strand=-; Gene=SeqID_59520
ggtatgccaccaatttttgaattgataaatttgctgggtgcggaaaaataacccgaaaaagtcaggatttttaccaatgcttttttttgtcttacatcaaatgttttgtttcgcaaatacaaattatgaaaataaaattaataaaaatgaacttttgcgagaatttcctccatttttcagaaacccgaattgaactccacggtcgcacattgtttcttcgattttgctgtcgtaccacgaggcaattgcacattttcagaaaaagtaaacgcttttttatgtgctcgagcgtctcaaattggggcaattggaaaatttaaaccaaagatttattgttagctaaatttgtccatcgggtcaatcacaagcccttagaaaattcgctcaaaattgttactaaaatttgaggctttttgtgccaaattttcccctgcggcgccacgcaaccaattaattttgctattgttttaccaaattatttactacaaaattttgttttccttcgaaaaaatgttgaaattttggaatttttcagtgtgtgtctgcatttcaaattaatgcattctgaaaaattgaatctatgggcgcatgaccgaaaattagcgaaatttttgatccaacccgatcattacacgcactaatttatttttattttaggcattttttgctcaaaatg

SEQ ID NO: 99388 - DNA, 75 bp, Heterodera glycines
  Promoter: Source sequence=SeqID_28700; Location=759..833; Strand=-; Gene=SeqID_59281
ccacaaaagttttgcctaatttgtttatcatgttcaaggtgtgcacgtcatgtcaggagctgatccatcggaatg

SEQ ID NO: 99389 - DNA, 855 bp, Heterodera glycines
  Promoter: Source sequence=SeqID_25956; Location=1..855; Strand=+; Gene=SeqID_56708
ccccccccccgcccacgagcgatgtgtttgctcttcggcctcttatttaagtagcgaaattttcaaaaaaaaaaattttttttttttgagggtagattaggccaagtttggaattttttttgtcaatttttgaacagatttagacgaaaaatgagcccttgcaagcgcgcacgcacagaaaaggcaaaggtggagaacatcgaccaagaaatttttttttaattttctaagtcatttctagaagtatgtaatctgatgcactgagacctcttcttctttttttttttgggggggggtgataatttatctcaaaatctgttcaaaaatcggccaaaaatttcttaactttttccgatggcctaaccctacactcaaaaaaaacttttttttttggaaaatttagctaactaactcaaacaaagttcatgttcttatcccaaaacaaaaaatgaaaatatgggacccccattcttgatgattgccgttttcttaaaattaagaaaaaattcgggaccaatgaattttctccgccattggccacagaaaatttattattgaattactcaatttggaggaaacagaagcgaattttgttgggcatctcgtggcacggaaactgcttatcttttccaccgatctgcaatggaaaaattggtaataaataatattgtggtctcccaatttttcgaaaaaagtcatgtaaaacatcttcccggggttttcgaaaatttgaatgttctatgtttgttcgaattcgggattcgctatttgtcaagcttatgatcagcgacctcgaaaccccaggaaaaggcgttttacacagattaaaaaaaacatttttttttttgaaaaatg

SEQ ID NO: 99390 - DNA, 239 bp, Heterodera glycines
  Promoter: Source sequence=SeqID_16123; Location=1296..1534; Strand=-; Gene=SeqID_80486
tttatttgtccgtccattcgttcgtttttcgggcaattcccctccccccccgtcaataattgacgcttttcgtcctttgcgatgccacaatatgatttaatgacggagaatttgcttttgctgccggacaatcgttcgctaatggcattatatgatcataagccgtgattatgtgccaggtgcaatttgcgtttgggcaattatgccaatagtcaacgaaaagattgggccaatgaatg

SEQ ID NO: 99391 - DNA, 1003 bp, Heterodera glycines
  Promoter: Source sequence=SeqID_6413; Location=309..1311; Strand=+; Gene=SeqID_61464
aagttacctttaagcttggcaggtttaaaattttttagttcttatttttttcatattgaatcggcatttgatctatcattaaaaatcacgtctttaaaactattttctttaaacattttacacatttgtctgattttactttttatatattcttatttgaaattataaaataatattttcttgttggaacctgtccttagtgttgagtgttgaacgttgacatcattttgattttaattttatcgaaactgtaaaattataaagatcaaataattctaatggcacaaaaataaaaattaaactttttatctttatcttatttttaactatattcttgcttttcttttagttaattgcctttaaatttatcggcaaagataaaaacaatctcaatgacatttaaaatcatttattgtaatattttaaaaattatacttaaatttttttaaataaattatttaatgcctatcagtaagtatatcatttcattgtacaaatgtctttttttaattgtatattaaatattggaaatctttattgtattatcattatttattttcatgtccaatcgttctttctgttcattcgtgcattatgcgtgtatatttttcattatttgtatttttctgttttgagttactatggttaaattaccttttaaataattttatgttattaaaatgtgagatcaactgaattaaaatgcaccttataaaacaattttaattttttatctataattattttaataatttaaatattttatacataagatagaattttttagccattataaattaagaattgtaaaatattcatttttccattcattaaatttatgattattttctaaacattgaaaatgctagagttccatatatatttatttttttaaataagttcttttgaaatttagatttaaaaaatgcgcagacgattgatttacataagcaaatcatacccgctggcaaaatgaaatattttaagtgagagaaaaaagatg

SEQ ID NO: 99392 - DNA, 1003 bp, Heterodera glycines
  misc_feature (877)..(877): n is a, c, g, or t
  Promoter: Source sequence=SeqID_15911; Location=1051..2053; Strand=+; Gene=SeqID_80254
aaatggaaatttttctgaaaataccaccaatcgatgcagcacgaaaaactatgttttggaggtggtctcagttttcccaggaaaaatcggcaaaaaataataaaattcaaaaaccaaaaaaccgacttttaggcctagctcgaaaatttctgaaaatttcagaaatttaaaaaattgacaagatagagctcgccgagctgtacaaaaagttcagcggcgccaacacgctcagcgcaatgcccagcgagttattcccgaaaaacacaaaaaccggaaaattggaaaaaaatttttacaattttttgcaggccagggctttggtgctaggggctaggtcaagaagaaaaaaatttcccaaacattccaacttagtcgcctcccagcagaagttttttgctccaggttcccagaaaaaagttatggccccaaaactgcatgcatttttcctcaaaaagccgtttcagcgccgctggcgttcaactgtccgtcggatcgaaaaacctatagttttcccagatgcgcctcaaaaagttggttaagcaatgtcacacttaaaacccacccccggcgcccgttcccgagattttggttttagcaacgaaacacgatttgattttatagtatataaactagcgggtgcgtgaaccgtcggatctgggaatgggataaagcgcttcgcgctttgggagcttcgctacctaggctgtaaagcgattcaaatttatcgaattggttgggagaggtttttttgaatttttaaaaaattattaggggtttttagtccacatcgaggctcaagacgggcgcttcgcgcccgtttttttagttattaggccgcttcgcggcctcagtcgggcgcttcgcgcccgtttttcanaattttgttggccttggacgggcgcttcgcgcccgtttctaaattttgttgaacttggacgggcgcttcgcgcccgtatttaaatgttgttgagctcataagaggtacaaaaattgttggaagatg

SEQ ID NO: 99393 - DNA, 160 bp, Heterodera glycines
  Promoter: Source sequence=SeqID_29119; Location=792..951; Strand=-; Gene=SeqID_59665
cttttattacatttggtgcgtttcagagcacgtctctaaaaaatatttatgaattaattttgcaaaataataaataagtaatgaaaaagtcagaatttcgaaaaattttaaaaacaacaagcgttggcattttttcaggttaagttagtcctttacaatg

SEQ ID NO: 99394 - DNA, 344 bp, Heterodera glycines
  Promoter: Source sequence=SeqID_14117; Location=732..1075; Strand=+; Gene=SeqID_78103
tttagtatttttgaaataattgctaaataatctaaagcaaaaaaagtatatgttacgaaacagaaggggagggtgtattgtttctcagcaaatggagcgaatgaaggggagggaacggtgctagcttcttttatataaaaactaaaaaaaataaaaaggtcgtaaactgtaacaatgaaaaaattggagcgaacatatatttgtttggtcaaagtgaactgacaaacgcactaaatcagagtccttttatactctttacgtgtttctctgcgtaggaaagaacacgctgaaaagtgaagccagtgaaaaatgcaagcacgcagggacctctaggtctcaatatg

SEQ ID NO: 99395 - DNA, 879 bp, Heterodera glycines
  Promoter: Source sequence=SeqID_4647; Location=1117..1995; Strand=-; Gene=SeqID_55222
cctgcacacaaatatttataggttcaaaatttgtttgaacgcttttggtttttgaatttgtgcctaattagcagcgcttccatttatatgtaagaaaaatcgcgaaatacatataaaaaatgctaaaatatgtattaaatatgtacaaaaaccccctaatatgtaataaaaaaatgtaaataaaatttttaaaatggttatttttggaaaaaaattattagtaaaaagtgaaataggcataaaatgccataaaaattatttaaattggcttagaatcaccttttagtattttaaaaattaatttttgatatctctttttttgaaaaaaatcgaatttttggggtacattttcaaaaaatttttaaaaaatgaaaaaaaaattgcaaaatatgtacgaaaaaatgcgaaaaagtctaaaatatgtataaaaatatgtacatatgtaatatgtagaaaaagcccgaaatatgtaaaaatatgtaaataaaagtcccacttttgttcgcaaacacaaaaaagaaagtgtttttcctactaattaggctatggagaatccaggaaaaaaaacatgtatttacataaaaatggaagccctgctaagtgggaattttgatagttgaatctcttaaaaaagagagagagcactgacatgagtactgtaacaaaatgagtttacaaaatactgtattggattagtaattgaaaaaataaattggtaatcatgcacctccatcacaatgcaatggtcaaagtaattgcgttccgacccgccaaactccgccggaacggtgacgcccaaaagtccgttttggccaagtaatcgccaaaactcgcggagcattgtgaattggtcctgacggtcaatttcactggcgaatg

SEQ ID NO: 99396 - DNA, 547 bp, Heterodera glycines
  Promoter: Source sequence=SeqID_40443; Location=290..836; Strand=-; Gene=SeqID_68777
attagtaattttttatttctcttggtgttacgttttaatatttaaattattatttctttttgcaatggttggtaccttatgtcaaaaggatgttcgatataggaaaattttgattggacgcgtaaaagtcaattggacgcgtacttttgattggacgcgtaaaatgcagtagaaatggacagagcggaagagtgaatttgatgaattcaaacaaaaaaaaaatgcaaaaaatcctaaaaatttctacaatttatacttttttgaaaaatgactgacaaatttatgaaattttctccgtatttaagcgctgaattccccaccaaatgcatccattcattcaattgcattcacttccattctttcccccatcggtcgaatcttcatcttgcttctgaacaataaaataattcccgtcagtttttttttgtttcattttttaaaatgaaataaattttgtgcgctttttcaaggatggtcagagcaacaacggccaggacaagggcatcagcagcgcgagcacggagcatcaaaatcaatcgtcgaaatg

SEQ ID NO: 99397 - DNA, 433 bp, Heterodera glycines
  Promoter: Source sequence=SeqID_16880; Location=846..1278; Strand=-; Gene=SeqID_81312
ttctgctggtcattctcatcttttggcttcgcggcgttcttcaatatgaagagtaattccctttcccgcgccggcaatcattttcaaaaaacgaaactgcaaatgtgctaattattcaaacactttctccactttgtgtcctccccccccctgccctcgtttctctaattcttctcctctctctctttctctcgtctctctctctctttctctcgtctctctctttctctcgtctctctctctctcttttctctctctctctcgtctctctctctttctctctctcatctctctctttttctctctctcgtctctctctctctctctctttctctctctctctttttctctctctcgtctctctctcttttctctctctctctttctctctctctctctctctcatgcaccatatcttttctccgtccaaatg

SEQ ID NO: 99398 - DNA, 73 bp, Heterodera glycines
  Promoter: Source sequence=SeqID_8235; Location=1289..1361; Strand=+; Gene=SeqID_67393
aatttttccaaatttaggctataatttctcaaaatttcttcaaattcgctaaatgcaaagtaaaacttaaatg

SEQ ID NO: 99399 - DNA, 546 bp, Heterodera glycines
  Promoter: Source sequence=SeqID_2708; Location=1..546; Strand=+; Gene= SeqID_81187
tggggggggggggggggtgacgggggcggggtccgaatcctagtattgaggaatcagtgtgtgttaccacaaaaaaaggaaggtcggattgtttgagggggacagccccctggaaaaccagggatttttttggtggaaatcgcaatgccaggcttaatccacatggcttagctggtatggaccagggatgtatcggcatgccgatttccgaatttagttggccgtcggaattattgccgaaatttttttgatggcgtcaggatgccgatgtctgattgctgaaaaattttctgggtcgtcggaattgcgatttccgaaattttttgagggcgtcgacacacatccctgttattaatgggaaacaaaaatctccttagtttctggcgcctattggcaaaatccaacacctagttcgcgggatttaaattaaaattatcgattattaattagatttccgagaaatttttgaattcctttctaattaaaaaaaatttccattttaaggattttattttttgaatttcttaaacaattcatagaaaaatg

SEQ ID NO: 99400 - DNA, 873 bp, Heterodera glycines
  Promoter: Source sequence=SeqID_3340; Location=1389..2261; Strand=-; Gene=SeqID_84280
ctattcaatatttgcttaaataaacttaaaaatacaataaacaaccaaaaaatgaatttaaaatttaaaaatgcaaattttttattgtcgtccgttgtataaaaaaacacctccagtttggcaatttcaaaaaaaaatttgcatttaaaaaaagaaaagttcgcaaaaaatggtgaaaatatttattaaaaatgccaaaatgacgacgaaaacccaaatttttcatatttttgggggtgtaattttttaaattttcaaaaagtcgagatttagaggtgtattttttgctttttttgaatttttcttatgtaaatttgccaagaatggccgaaatatggactaaaatggcaaaaatggcaaaaatgtcgaaatatggatttattcccgaaaaccccctaaatatggatttatatggactaaaaaccttcaccaaatcaaaaaatttaacgcagaaatgctatttttgagcctctttcttcatagcacatgcgcagaaaaaatatgttaatccatataatttacaaccctattaatgatcttccgaaataatttgcctaagaatgttggtattaagatgtttgccgattagaaaatacaatggtcctttatctgggtgaaaataacacaaaatttatttattttcttgatggcgaaccattgcagaaacaaaaggatttgggcattttaatcaatcaaatccttttctaaccatattaataaaattttaaaaaattccatatttttcttgttatcagcttcaccgagcgttaaaaactcgaagcttgaaactttaatttcggcatataaaagctatagcagaccatagttaaaatacgccaaagaaacttggaatctattaaaaaaagaaaaatg

SEQ ID NO: 99401 - DNA, 1003 bp, Heterodera glycines
  Promoter: Source sequence=SeqID_6836; Location=2425..3427; Strand=+; Gene=SeqID_63048
tgagtgtaatctaataccgtatctaatctaagtggaaaacagtagggagatttacaattaggtctaatacagtatccaattcgatgataccttatccgatccaggcaaaaacaatatacttactttaaaaagcagaatcaaataccgtatcgatctaattaaaaaaatataggatgggagagttaaaattaggtccttacagtatccaactgatgcagaaactaataccataagctatcgttcgggccttcatcatactgtagcaatgaataaatctcaaatttattgttctcaccaatttttctattgagctccctcccccaacagatgtccactgtttttgcgccaaaaaatgtgcccgtttttgttggcgttgcgtttgtgtactgtttggtgcagtccgtgctgctctattactccaaagttgaaccatctgtgagtaaatcatgtcaaattgggtgaacaactaattgactctgggactgaatcatctccatgccgaaactcgaacaaaatttaaaaaaaattaaaaataagactgacatttagaaactgaattttgctaagaataagcaaagccggaatggacctcggcccgtgttttcgggatcatggctctacgggaataataaaaaaaattcacattgacaaattcttaaaatgaaaattgggattttcctaatcgactgaaatcattaagcctaggattagagtaagattttctactttttaaaacgtttagtgacagatattacagaatatctgaaaatatctaggtaatcgaattttgatttccctgattactcccgcttccctcggtccaaatttttatgtttaaaaattttagagttttttttgggggttattggcctagacacaaagccaaatgccaacacaaaattcaaaaattcaattggaaaggggtagaatttccaaaaaatgaagggtgggtacggcctgaaaaatttccgaatgtctgagactcttgacacacccaaaaatg

SEQ ID NO: 99402 - DNA, 447 bp, Heterodera glycines
  Promoter: Source sequence=SeqID_17363; Location=428..874; Strand=-; Gene=SeqID_81847
ttgtggttgcagctccttgcgcagtaatacccccaaaaaccaagttttggtgtatccatttctgtccttgtatgttgtttgaatatgctttccatagaatgctttcacaactatttcacaatccgatggatgatttagacgatcacggagctcattaattcgacaattcaaaatttgtgcaattttttcagcaagaaggaccatttttctaattaatctagatttatattaattaattttatagaggaaatttgcaaaattattttgtaaaagatgattaatgaaaaaaaagaaattcaactgctatttataatagttaagaatataggttaagtaaacattaacaagtataaaaacagattttcattcatttttagtcactttaatattaatataaataaagttgcattttttcatttctgattttcaaacaatttattaataatg

SEQ ID NO: 99403 - DNA, 185 bp, Heterodera glycines
  Promoter: Source sequence=SeqID_15684; Location=2241..2425; Strand=-; Gene=SeqID_79995
aggacaccgaaatcagtgtgacaaaagtctcattgtccatcataagggaaatggttatggtatttttaaaatttacatcaaaattcaatttctcctcaaaaggttggcgctccgtcttcgctaaatatccgattgtgctgaataagcatttgtccgactttttttactacgaaatttcagttatg

SEQ ID NO: 99404 - DNA, 396 bp, Heterodera glycines
  Promoter: Source sequence=SeqID_36647; Location=313..708; Strand=-; Gene=SeqID_65903
tttcggattttctcaaacttctctgttagaatcactccctctattaaagcgcccttcctttaaatcaatttcttaaatttcaaaaaatattttatgaattataaacgaattttagtaagtaatactggcgatctcctttcccttttttgaagaaaaattttgtccgtaaaaacaatggcggtcactgctgaacatgaatttttgtttttttttctaaaggggtcaatgtcatatttggtcattttagaggttttagcttaaattttatggatttaggtatcgtttcctaaaaaagcttaagaattttattttatgcagttcttttcatccccactattctatttagtagtcaattagaacaaaattttaaggaaattatttgttttttagcctatg

SEQ ID NO: 99405 - DNA, 322 bp, Heterodera glycines
  misc_feature (23)..(23): n is a, c, g, or t
  misc_feature (68)..(68): n is a, c, g, or t
  Promoter: Source sequence=SeqID_30086; Location=1215..1536; Strand=-; Gene=SeqID_60527
tcggaaatcatgcttccactcanccaaaaaaatgacggaagttgaattccgtggcactcatccaaatnttcctaattagccttcgggggtgggaggggcggagttggaggagggcacgtggcgccttttaaaatgccaatgccatcccacgcaacaaacagcagcaaatatttacaaacgttgaacatcgattgcagcatataataatggccatttttagcaatataaaaattgtacatttgtataataataatttggcatattttatgcattaataaaaaattctaaaacaaaaatgttaattttcgttgcagaaaaaatg

SEQ ID NO: 99406 - DNA, 59 bp, Heterodera glycines
  Promoter: Source sequence=SeqID_18449; Location=122..180; Strand=+; Gene=SeqID_83046
tgcattggaggagggtcccaagcacttgaaaaagttgcgcatttaaaacactcaaaatg

SEQ ID NO: 99407 - DNA, 1003 bp, Heterodera glycines
  Promoter: Source sequence=SeqID_17628; Location=1728..2730; Strand=+; Gene=SeqID_82155
tttgtatgtatcattagaatagtaaatttacaatttgattttaagttttgtactgatttgtttcgatttaaattatatttaatttgttttgaacagctccgccagccggactccgtcagttaggcccccgcaagttttcccactgtagcttttttctgtatcatccaaatccaacattttttcttttttttttgaaactttcatggaaaaatttatattaagaaaaaactttaaaatttcgactttttcgaaattttcatgtataactttttttagaaattgcctaatcgcgcgaagaattatcttagaaatcgtttctaaacatgttaagctttcgaatgataccaagattattgaaaaataattttaacaaagaaaaatgaatgaaataagagaaaaatgaatttaatgggggggggggaattcgtgctctgattgaagtggggtcatttaacgattagtcatgaaggtgaacgtgaacactaattagggccatttatttatgaagaattaatgacatctctaagtgggcagcgaaatgacttcgcccgtcccttcccatgcccttttattctctgttgggtcatttctttgcttttggcaaagagaatttataaaaatgcaagccatcagaagacagaataaatgcattttattaaggcagggctgccatccgtccttggattcggtgctgggcatttcctaaaaaccgccacccatgcgcgtttcctaaatccgccaatgggtttgaatacaaaaaatgggtaatatttataaatacactcaatttcaaccaaataaatatttcatgtatcatttaatagctttaattgttctctttcagagtataattttctataattttttccttaaatataaaaaaagttataaagcattgaatatgctatgtttttgaaatggtattgcataccgtttatatgaaattgttctttaaaagaattgcgctccgtctttgctggacattcgattttgctgaacaatg

SEQ ID NO: 99408 - DNA, 997 bp, Heterodera glycines
  Promoter: Source sequence=SeqID_40615; Location=719..1715; Strand=-; Gene=SeqID_68887
tctgataattattagattaaatgttttaagtactttaacaccaatattttcctatatttgattttttaatttatctttaatttttttaataagctaaatttggattaaaaatcattttcattttgctaaaatattttttctcaaagcgctagaaaaaataataatttgtttgatcgatctttaaataaaattttaaaatttaccatttaaaaagaaaataaacaaatataaaaatgaaataaaatgacaaaaaatttaatgttatgtctaagcttataagtttatgcactaaaaaaatgccaattatgcacataaaatatgcaccaaaaatgcctaaaatatgccctaaaaccccgaaaaatgaccaaaatgcactaaaatatgccttaaaaactgccaaaacgactttgaatccacaaaaaaatatgccaaaaatggtgtaaaaattcagaatttactttaaaaacaccaaaacaataacttttagactattacaaaaaaaacgtgattttaaaatttttatgcaatttcgaatttttaaactcttttggactattgcaaaaaaacgtgattttaaaatttttatgcaatttcgaatttttaaatttttattatatgctaaaacaaaattaaataaattttattcaaaagttctcacaaaagttcataattttttaagggtgtgtttttttattcccaaaaagtcgattcttaggggtatattttcgttttttttgcacttttcgtatgaaaaaacagaaaaaatgccgaaatatgctccaaaaatggtgaaatatggatctattcccgaaaacccccaaaatctgggtgtatatgcaactaaaaaccttcaccaaatcaaaaaattttaacgcagaaatgctatttttaagcccctttcttcatagcatatgcgcagaaaaaatatgttaatccatataatttacaaccctacatattacttttgaaatggatttgtttgtcacttcatctaatg

SEQ ID NO: 99409 - DNA, 89 bp, Heterodera glycines
  Promoter: Source sequence=SeqID_8152; Location=935..1023; Strand=-; Gene=SeqID_67150
tctgaaacagaacaaaacagtttttatacttactttaaaaaaaaaatttttttttttgatagacactcagccgattctttgggacaatg

SEQ ID NO: 99410 - DNA, 483 bp, Heterodera glycines
  Promoter: Source sequence=SeqID_13223; Location=2394..2876; Strand=-; Gene=SeqID_47115
ttttgctacgtgaacaattgggtctgttgctcatcctttagtgagtttcaatattttttgcccattttcttcagatgggacgtggtgcgaatttgccgagggggaacccttaagcgaatattttgatggataattttactaatttttgccatttttaatgcccattgcttctttttttttctcatattgtattgtacgtagtcaagttgccctcctttaactttcctaatttgtgattttcacaatgatttgttcagctcatttgccctttcgcgctgcttttgcctttttaattgtgctagtcaacctcactaaaaacttaatttagtcttccattagcttgccttttacacattttttgctttgattttcaatcccggtaaagttttatgtattctcttttgaaaaaatcggcatttttttttgtctgttgtatactttcattaaaaaaatgattaatttatttaatctatgttcgagatg

SEQ ID NO: 99411 - DNA, 116 bp, Heterodera glycines
  Promoter: Source sequence=SeqID_23017; Location=432..547; Strand=-; Gene=SeqID_53717
ttaggggacacaaatcattgcaaatggccaaacgcttcgtgatccctaaagtcacaacagacaggtactaattagatataagcaacaaaaaaagggatgggcaaaaagcacaaatg

SEQ ID NO: 99412 - DNA, 117 bp, Heterodera glycines
  Promoter: Source sequence=SeqID_6038; Location=3879..3995; Strand=-; Gene=SeqID_60110
attttctcgggaaaatgggtaaaagattttcgggattcaaaatttgcagcgtcaaaccaaaattattttaaattagcccaaaaacaagaatttattattttaaaagagaaggaaatg

SEQ ID NO: 99413 - DNA, 958 bp, Heterodera glycines
  Promoter: Source sequence=SeqID_1571; Location=322..1279; Strand=+; Gene=SeqID_74520
acccctctgtcttttgcataaatggcctccccttccctcctcagttgttcttctccattcatttcatttatttgttccttatatttgcaatcgatatctctgaccccgttcgcccttgtccttttctcttttgaataaatattgttttattccctttggactttggggcgtaacagatatcaacccgaaaattcaaccaactcaggaatcaagaaccaaactgggaaattccaaaatcgagaatcgagactataaaaaaacctagagaaattcgaaaagagacagaaattagagaagttaaacagagactccaaaaatcttaatcctgagaaattcgatatttttctataattttcctggttcaagaataacccgaagtaaataaaattttattcattttttaaaattttaaataatattataattttaaaaaatatttccatataattgatgaatttaaaattatatgaatttagtgaatagataattaaattcaataatttaatcaagcactgagtttttttttaagtcgacctagcaccgaaaaaaagcactttcaaattttttttaggaaaatcgagggcaatttttatataataaaaacctattttttaatccatttttaatttccaccttaacaagctacttttggcattttgcaatacgaaattttataatttttgcatatttaagatttttttgaaaaatatagcaaaaattgccaaaatcgacaatttaataaaaaatataccattgaaatctatgtatcgcctgcattaatgaaacaatttaaaatttctaaatatcatacagtgccccaaaaaagtcttgcctcaaagaggcaaaaattgggaatattaaattttctatcccacgcataaaacaaattctctttaattgacttttttctatagctcgtttgatgctctatcagatgctgattatttaacacaaaatg

SEQ ID NO: 99414 - DNA, 741 bp, Heterodera glycines
  Promoter: Source sequence=SeqID_17615; Location=1..741; Strand=+; Gene=SeqID_82126
ttgcttaaaatttcaaaaaaattacttaaaattttcatcaaagagtcgttcatagtcaaatggataagtgtgccgacgactcgaccgttcaaatgaaaaaccccagcaaaaaatgtcaatttgattcagtttttcctatttaaattttttaaaaaacgaatattttgctcaacaaattttcagtttttgtaaatttcactttacctttaatgagtagtaattaattaaattgtttgaattttactcctttataactagggcttatttttttggtttttatctatttttttctgagctcccagtggtctgaaaagcacgaaaaacgtataacttgaggttgtttttatgctacttttcgcgttattagggccaattctaggtttttacaaaatttttagaacataaaaattttaaaaatttgaaaaacctattttggcgttttgcacataacctttataaattataactagagcgccacgggaccgggacctggtagcggacaactgagtaccaaggtcccggttctgacaggggaccgggactagtcccggttttttcccggttttcccagccaaaaattcccggtttttcaacccgaaaaggtccctccctgtcccgggtttgcccaaaattcccggtcccgtggcactctaattataactttttttcttttctctatttttttgccaatttttgtattattttttgctctttttttcactgttttcctcctccaaaatg

SEQ ID NO: 99415 - DNA, 101 bp, Heterodera glycines
  Promoter: Source sequence=SeqID_72; Location=1..101; Strand=+; Gene =SeqID_62107
tgtccattaagatcgcaaaaaacaattatttcttgctaattattcgtcatgaagcgaaccacgcatcaaacatcactccacctcgcgcaaaacgttcaatg

SEQ ID NO: 99416 - DNA, 1003 bp, Heterodera glycines
  Promoter: Source sequence=SeqID_3670; Location=931..1933; Strand=+; Gene=SeqID_51374
ttatttgtgctcaaattatcatactgaaatgcgacacttactaccactcattattgatgttagcaatttgtattttccattttcaaataaacttatttacatttttgggattacctttgtaacgttttatatttcaaaatttttacctactttcattaccccaaaacccattaatgcttccgatgtcaaaaacggggctatccgcggcaattgatgatgaattcgaccctgacattgatctttcacagaggtccaggtcggattgggtgagtgaacctcttaatatatcggctctaatgcagttaaccgtccaattaatgaccatcctcggtttctgaagccttaacttttttcttacttggttaatccatatatccttcgtatcaattgaaagctccaagtcccgggaatttataaatactatacaagaaaagaacaaatacttgcattaagaaaaaattgcaatgaaaaaacctgaaattcgtcatttttcgcgaatattcaacaataattttatgtctgttgcctttatcccagaatttttttatgcgtaaacttctgtggactttaagctctcgattgatacaaagaatgtaagttttgagcaagaatgaaatatgacttaagaaacaaaccgaagatagtcattgattgttgcgtaaaagtcgactggactgcattagagccaaatatgtgctttttaaatttccttttctaggttggttcatttgctggtaatccgtccacagctccgacggtttatgcgatgttcaacaacagcgtttggacttttatgcttgtttacggcgtgacaggccgatttatttccgcaaggtcccaccatccgcggaaagagacacatgggtcaccctcggttttggttttcactaatagttgtactggttgcgcgaaattagccgtgcccagttatcgcccaccctcagccgttttgtttttccctactttttttgccccttccagtgttgtaagtttactcacgatg

SEQ ID NO: 99417 - DNA, 71 bp, Heterodera glycines
  Promoter: Source sequence=SeqID_14230; Location=1..71; Strand=+; Gene= SeqID_78248
tgcatattttattttttatcacttttttacccattgaatcggtgcgtcgggtcgaaaatgagcaagaaatg

SEQ ID NO: 99418 - DNA, 118 bp, Heterodera glycines
  Promoter: Source sequence=SeqID_10002; Location=2615..2732; Strand=-; Gene=SeqID_73053
ggcaaaaaaatgccgcggcccaaaatggggcaaaaaatggagcagcaaaagggggagagggccgggaggagtgaccacaatagaactgagcaaattgaggaagtcgtcagaggagatg

SEQ ID NO: 99419 - DNA, 116 bp, Heterodera glycines
  Promoter: Source sequence=SeqID_4255; Location=3956..4071; Strand=+; Gene=SeqID_53777
cctaaaaacgtgcaagttatcgcccataaagtcgtctattaaaacagactatcaaaaaactgtgaagacacattcacagcaaaatatccttcggccgccgaacaaacggacgaatg

SEQ ID NO: 99420 - DNA, 176 bp, Heterodera glycines
  misc_feature (7)..(7): n is a, c, g, or t
  Promoter: Source sequence=SeqID_34642; Location=1157..1332; Strand=-; Gene=SeqID_64381
tttattnagagagttaaaaaactgaataaaaatatcagacttatgagaaattaacgaagggattggcacatcgcagcttaaagtgtgtcttcgtcgacctcacggaagaaaatgctttttagagcccttctgggaccaaaataacacttaacatttttagtcagagtgattttatg

SEQ ID NO: 99421 - DNA, 204 bp, Heterodera glycines
  Promoter: Source sequence=SeqID_5533; Location=227..430; Strand=+; Gene=SeqID_58364
ttcggacgatttgggatggaccaaattgcggaggacaaccccaaggaatttttggtgtaactgtgggagtactgttgttgtgtccattaatattttgaggatttgttgccgtttgtgcgagaagggttgccaccaaactttcaatttttctaagcgtaaatttagctgatccaaagaatttgcagcaaatttctcttttccatg

SEQ ID NO: 99422 - DNA, 151 bp, Heterodera glycines
  Promoter: Source sequence=SeqID_30229; Location=209..359; Strand=-; Gene=SeqID_60661
tttcgacgaggcggacgtccctgctgtgaatgaaattttgaggatttgtctctatgaaatgtattatgaagaccagcaaaagataaccatttattaatagaaaaaatttagctccggcaagtgctaccaagaaaggtcgacccacagcatg

SEQ ID NO: 99423 - DNA, 1003 bp, Heterodera glycines
  Promoter: Source sequence=SeqID_2177; Location=2185..3187; Strand=-; Gene=SeqID_78294
aagcatccgtaaatgtggtaattcaccaccaccaaccacaatggcatggcacatttttatttactatgctttgtgaattaaagaatttttcaagccaattattatataaaaatgctgaaattgaattgaggtacattttatggcatattaggagtaaaaataaaaaattaaataaaaaaataaaaaagatgttttagaatgttttcagaaaattttgctcgataaaattagtaaaaaaaaaaatcaaattaatataaaaaaaatttttgtggtagccaatataaatttacgagggttcatattaatacggtcaaaaaaatcttagaatttatttttaatttcttgaaatattttattgcgattttttcaaaatattatgctgaattgttagggttttcaaaaaattttccaaaaaagcacgctggtttttattgtgagctgacaaaaacgcaagaaaaaaaagaggaaagtggcacataacaacatcgaaaagccttattttgcccaatttaaaaaacatccatttgttaatttttttgtttgatttagggcttgaaaaatttctctttttaaataaatttttctgtttaatttcttattataacataatgataaatctcttctacaccttcaatattttgtgtttctagtatttgtttcttgttttctataattcatgagaaacaaatttaactcagtttttaaatgataagacattagtgtactatgtataattaaataattatcatttatgaattggcgtttgtgagtgagttactgtctaatttgctaattattgtagattcagtcccattttaattatcattcataatagtgcttttgattgactaattagctaattagcatctaatgagttgaatgactaattagctaattagcatctaatgagttgaatgactaattagctaattagcatctaatgagttgaatgactaattacctaattagcacccttttccgttttgtttgttttgttcagatg

SEQ ID NO: 99424 - DNA, 60 bp, Heterodera glycines
  Promoter: Source sequence=SeqID_44350; Location=1..60; Strand=+; Gene= SeqID_71848
cccccccccccccccccccccccctcgacagacaatattcaacaaaaatttttaaaaatg

SEQ ID NO: 99425 - DNA, 185 bp, Heterodera glycines
  Promoter: Source sequence=SeqID_2589; Location=2671..2855; Strand=-; Gene=SeqID_80584
agaaaaagacaaagcgataaaatggaaaatttttgttttttaattttattttgttatttcttgataaagaaaactcggctgtttaaacgacaatttgacgtatatattggcactttgtcctctcatttcgttgttcgtttgcaccatttttacaaaaataattgaatggttaagccaacaaaatg

SEQ ID NO: 99426 - DNA, 159 bp, Heterodera glycines
  Promoter: Source sequence=SeqID_34823; Location=550..708; Strand=+; Gene=SeqID_64523
atattaataatcaataaaataaaacttcaaattaagaaattttgaatttggaagtttttgtggtccaactttcctctttttttgatcctaatttggtgtcaacttgcccttggggatcagattacggttgtacatcgattctcccttggggcccaaatg

SEQ ID NO: 99427 - DNA, 230 bp, Heterodera glycines
  Promoter: Source sequence=SeqID_27257; Location=545..774; Strand=-; Gene=SeqID_57946
agttattagtgcctattttctaggcttttatttttagcgcctaaaaagcctaaaaaattttgaaagagcctatttttgcctattttggcgttttgcccaaaatttgttaacaaaaatgcaataaaaacggaaatctttggggaaaataaaatccggaattgcttaattaatttaaaaatatttgtttagaattctttagtgattaatattcaattttagtgttaaacatg

SEQ ID NO: 99428 - DNA, 128 bp, Heterodera glycines
  Promoter: Source sequence=SeqID_3459; Location=2000..2127; Strand=+; Gene=SeqID_84757
tttcgtcccacaggcattcgtccacatcgtaacatttgctgccgttcccgaaaaagccctaaaaattctcccaataaatagcgttaatctgtatcgatgaccattttgcattgacaaattggcgcatg

SEQ ID NO: 99429 - DNA, 237 bp, Heterodera glycines
  Promoter: Source sequence=SeqID_9453; Location=1..237; Strand=+; Gene= SeqID_71474
tcgtttaatccaaacacaaaatagaaacgtgcaaaaaccatttaactttgtgcgcggcatttctctttctcacgttaaatgccgtcatttgccaaaaatggggacacaaattggcacagttttattttaatctttgttgcatcctatttgtccattccattcctttttattcggttctattttaatttttgatcatttcccattttggcccctattttctcctaattgtccctaatg

SEQ ID NO: 99430 - DNA, 1003 bp, Heterodera glycines
  Promoter: Source sequence=SeqID_16545; Location=1168..2170; Strand=+; Gene=SeqID_80948
cggtcaccattgtggacaatggcggaatcttgaaagaaaaacaaattaatttttaaaaattaaataaaaataaaaacagggcaaataggtaatttctctatgtttttacaaatctgccaaaaatttcataatcaatcaacggcggtgaatgtcggcatggcactgccggacctctcttttctattttttttttaaattcgcaacaaaaaagaaaccaaaaatccaaaataattgtttgttttttatagaaatatcagatttttaatgttaaaatgaaattttcgaaaacattttgaattatgaaaacttgcactaaggattaacaaaattaaattaaaatatactctaaaaaagcgaaatttgtataaatatttagccaaataaaacctcgtgaatatgtttataaaaaaaattaaaaaaccaaaatagtgcaaaaattaaatggaaaatatcaaattttttttaatagtgaaaattttctcaaaaaatgtttattaatcagcttaattaatctgaaaacttcgttctatttggaattgaactgctgtattattcgacggggttttttatgcgataaaaaatgcaaaaaaaatatgtaaaaacaataaatccagtgcttagatcctcaataataattgaaatttgtactcattaaaaattttttaatataatgtttataaataagttttatcatttaagtaaaatttacatgaaataaaatggtaattaataaattctgaagaattaaaaacaaaataatttcatccaattaaaagaagtataatttaaaaagaatcgtaatatagaaattttttctagattttcatcaaaatatatttctttaaatctataagtagaattttgaaagaaatgtaaatcgcattataaaaaaacaagtagaatttcttagtgaagctatgtaataaataagcataaatatggaaaataaaaccaattaataaaaggatttttaatcattttaatggctttattcagaaatatg

SEQ ID NO: 99431 - DNA, 97 bp, Heterodera glycines
  Promoter: Source sequence=SeqID_32131; Location=1213..1309; Strand=-; Gene=SeqID_62459
ataaataattaattcttttcaagtaaatatttacttcagctgtcgaattgttgaccaacttttggcgttcgccactcgccatttaaaatgaaaaatg

SEQ ID NO: 99432 - DNA, 653 bp, Heterodera glycines
  Promoter: Source sequence=SeqID_12974; Location=1..653; Strand=+; Gene=SeqID_76735
aaaaaaataataattttttatttcctttttttgaaaaaattttggagtttacatgaaaaattgaaaaaatgcttaaaatatttttaaaaatattagaaaatccaaacccaaacatattttttccgatatttttttggaaaatttctcaacaaaaattcaagaaaatcaaaaatacacccttaagaatcgacctaaaattttcaaaaaatacactcctaagactgacctaaaatttaaaaaaacaaaaattggggcaatggtaaagttctgtggtttcttcgaaaaattatttaaaaatttaagaaacacattttctaggctggaaaaatgtgctgatcacgactgacggattttttgcaaaataatttattttatttatgattttttatcaagtactagatttttccaaaattttaagaaattagtcgggcgtaaaaaacacacatgttgtatagctcaaaaagagctttcgagtgagctattgaatgtatggagaagtcatgtttttagttatttacgattttttgaaatttaattactagcccttaaaggtcatatgagacgggggtctggggttcgagcctgcttggctgtgtttattaaatttttaaacttatttttcgaagaaaccacaaaacttattgccaaaaatg

SEQ ID NO: 99433 - DNA, 101 bp, Heterodera glycines
  Promoter: Source sequence=SeqID_31021; Location=909..1009; Strand=-; Gene=SeqID_61377
aggtggcattaatataataaacttataaaataggatggattgcatcagcacggctggaagaagctagcggaaaattgcaggcggccagaaacttggtcatg

SEQ ID NO: 99434 - DNA, 701 bp, Heterodera glycines
  Promoter: Source sequence=SeqID_13408; Location=987..1687; Strand=+; Gene=SeqID_77293
gtttttaaatttcattaattttaaaggaaattcagtcacttagaattggtaactccctccctccctcccacttcggcaaaaatgtttgataatttataaataaagaaaactcatttatgaaatatctttttttgaaaggttattcggcaatttgccagtcgaccagttgccaccaccaagcaatttaattggttttaaagagatttacatcaggtagataaatacttttattttgtatataaaaaattcttatcccccatgctgcccctataaaaaatgtaagaaaaattaaaaacaaaataccttattatgtatatagcacatgtttcggaacctaaatgaattcgactcaatccaatttgaaatttttaaaataatttttgctagattttttaaaaaggaggacacgtagagctctagctgcctgcttcttacaataccaagattgattatttgattaaatttagctaaattatgatttattattttgcaaacaaataaaataataatgaaatttaaaatattactatcattgatacttttgtagtttcttctctccacggacaccacaccggtggtccgggggtttggagatttagtaaataaataaactaaattaaaaacatttaaccggcacgttcagttactttgacaactctgtgctctcattgctccattgcttaacgccgcttttcaaaatg

SEQ ID NO: 99435 - DNA, 525 bp, Heterodera glycines
  misc_feature (119)..(119): n is a, c, g, or t
  Promoter: Source sequence=SeqID_37066; Location=496..1020; Strand=-; Gene=SeqID_66240
aaaatcaaggcaattgcaacgttttaaagccattgaaggcgttcgcaatcattttcaaatttgctaccctccaattgcaaatcagacaggaaaattggtatgtttttttggaaaacttntaaaaaaattaaagtcaaccaacaattcacaaaattccaattcgaaaacctgacgtttttctggaagatcatgccaattcccgattcattaatttttaatagccccggaatcccggtttttggctataccttttagtaaaagcctttttcacaagagaaggatggaaatataaattaaaatttaagcatatttcattaatggacgaagagatgtgttatttgaacagaattttaagacaatgttattcaaagaaaccaaactgaaaatttttacaacggtaattcatttaaatttataacaagctttcagttaatttttcaaaatatttatgtcctaaaaattcaaaaattcctgtgccaggttttcaaaaactaattataggacgccttaaatggcacaaatatg

SEQ ID NO: 99436 - DNA, 362 bp, Heterodera glycines
  Promoter: Source sequence=SeqID_13268; Location=1..362; Strand=+; Gene=SeqID_77103
tgcgagaaagccgcaattgattgggggcagaatgccaagtgtcccgcttttagggttttacaatttcgaaaattttgtgaagccaagaggaagcggattgtggaaaaaatggaataaaggagcacatgggagaacctcaaagggagcgcccgtagttcagtcgtgttagagcattcatgtggaaaggccgtgggttcgagtcccaccggggggttaaccttttatgttctaaaatttatcttggcacccattcagacttggaaactctgttaaacccatatatttttaagggcattgagggcccgcgtggtgcctccggcaatgtcggcccggctggcccgcccggcttgcccggccccatg

SEQ ID NO: 99437 - DNA, 302 bp, Heterodera glycines
  Promoter: Source sequence=SeqID_42517; Location=1..302; Strand=+; Gene=SeqID_70382
tttgaaatgctaacgaaaaaatattctttccgaaaaaaaggcttatctcttttttctcttggggatttggaccgccaacttggtaccaacatttccttttttagtctggctctatcaaacactcacacgatatttaaaatacaaacgaaaaaaattcttgcctaaaaaatggctatctcttttttctcttggggatttgaccgcaaacttggtaccaacattttgccttctctagtctggctctaccaaacactcacacgatatttgaaatgctaacgaaaaaaattcttgccgaaaaaatg

SEQ ID NO: 99438 - DNA, 414 bp, Heterodera glycines
  Promoter: Source sequence=SeqID_426; Location=7452..7865; Strand=+; Gene=SeqID_52251
aattataaataaataaaaatattattgtgtaatgttaaaatgaataacaccaacacaacaaaacacgacatacaaattttgaattccccagaagagcctaatgaaactcttttgcatgtactgcttttttctcattatcttcttgcatttcctgtgtttttgcttttttggttcgttttaattcggtggcttaaaagtcacggtcacctctcgcccagcgaggccgagacagtaatggaagagatgaaaaatatcccccgacacccaccaatattttttgcagcaaaatgatgcaagattagagaaaactgacactgaactctctcttcagtatgacaaaatcgataatgactcatgctgatggagcattctcaaagctactcattctttttcatcattcattttacaaaaatg

SEQ ID NO: 99439 - DNA, 457 bp, Heterodera glycines
  Promoter: Source sequence=SeqID_11771; Location=1..457; Strand=+; Gene=SeqID_75267
cccccatcgttttcccccaacaaatttttttttaaataaccaattaagaaatttttcgaaaaaaattttttaagaaattgcggctctagtgcactttatgagtccaatcgacttttatgagtccaatcaatggtttttatacaataactttgtttatgctcgaacaaaccctatctttttggtatcattcgaaagtacgaagtctaaataatgtaataatacgagaaaacaagaaaattctaacatttcaagaaagttacaaacgaaaataataagtatttacttaaataatcaaatcttttttggtaattgcctaaacgctgcgattttatatattttagcttcgttagactttgaattttcttgctaaaaaattctcaatatttttttttttttaattttttgaaaattctgttaaaaaattttctttaaattttcttgctaaaaatttcaaatg

SEQ ID NO: 99440 - DNA, 489 bp, Heterodera glycines
  Promoter: Source sequence=SeqID_10486; Location=1490..1978; Strand=-; Gene=SeqID_73698
aattttatccaaaaaggttacaacaaacttaagccaaatcaacagttgagataaaataatttttaaaatgaaaattgtcaagaaaataaataaataaattttaaaggataatgaaaactaatctttacaatacttgtattataaatttttaatttgttatttgagaaggaaaaattatatttaaatgtaatgattattttatttattttttccaatatttgttcagtagaataaaatttaataaaaaggtttttctgatctctatgaaatcaatagagttgcgatttttgttatgtaaaaaaacatattaattttaaaattattattatttttaaataaatacaattttttctgagaatttttaaataaaatgaaactccacctattaatcgttttatttatatttttgatcactcaaattaatcaaatcggaacagaaaagaaaaagttggaactaaaatcatttgatgaaatatttggagaaaaatg

SEQ ID NO: 99441 - DNA, 64 bp, Heterodera glycines
  Promoter: Source sequence=SeqID_12731; Location=1229..1292; Strand=+; Gene=SeqID_47075
gaacattaaaaaaacaattgtttttagctagaataccgtcattcgccttttaagatatcaaatg

SEQ ID NO: 99442 - DNA, 267 bp, Heterodera glycines
  misc_feature (7)..(8): n is a, c, g, or t
  Promoter: Source sequence=SeqID_4939; Location=1..267; Strand=+; Gene= SeqID_56295
gcatgcnnctgcaggtaaaattgttagagcgatcaaacgaactctaataaatgagaatgctcagtttttttatcaccaattcagttatacggataacaaatttgtgctgttaataaatgcgccggtcggtgggccaattgagcagacaatttttgtggccaattcatcaaatgccaccactaccagcgctgatgctcatcatcatcaatttatgaccaccaattttgctttgacccgtgccgcaccgccaaatattttttgcaaatg

SEQ ID NO: 99443 - DNA, 90 bp, Heterodera glycines
  Promoter: Source sequence=SeqID_39895; Location=1..90; Strand=+; Gene= SeqID_68356
ttgtataccatctcaaaattcaatgatggaagtgtctcttctcggcactttaactttttcacttctttttaatagcaagttgaggagatg

SEQ ID NO: 99444 - DNA, 1003 bp, Heterodera glycines
  Promoter: Source sequence=SeqID_1442; Location=2239..3241; Strand=-; Gene=SeqID_73579
ataataataataataataaaattctaatgatataataggttgatatagcgcgataaatatttaaaaatttttcttcgtgaaaaaaaaataattttacaatcgaagttaataattcttttgagtgcgtttaatttcccccctattacctcaaacaatccaaaatgatttttttaataatttttatttatgtgatttttccattcgtcccttgtcgcttgttaattagagacattgacaatgtgactttgtccaatgtgccattggcacaaatcactgtgttggcatgggacacggagggggcaaaagtgatcaaagaagtgacgacaatttgatgtatttaagaaaatattgaatcatacacattttttggaatttttgaggtttaaaacaaattttttgacagtttttatttactccatgttttggtcatatttgagctttttagtccatgtttcgggcttttttagtcaatattatgtccatatttaaaaaaaataataaattacgagaaaccaacattaataaacttcagcaatttataatcatcggacgaacagatttttctgaattaatattttatattttttatttgaatatccaatattcaattttcattttttcgttatttatcagattatgctgaatcatccatctgctgttggtccattttccatctcttctcataaatgatcaacgatgttttattgtagttgatctgtgctttctcccattaatatggaaataatttttctaatgtaaaagaaatattagttaatatttaaataattttataaaaaaataaatcgaaaaaacaaaaattttttatacatttctttcttttttagtgtaaaaatgtgccattttttgaatgtgaatttaatccttttgttattcactgtgttcaatgtgcggttgaccaccgttcaactgtatttttattattatttttattgaaattacatttaaattttcaatttaaagttttcaacaaactgatgaaatg

SEQ ID NO: 99445 - DNA, 283 bp, Heterodera glycines
  misc_feature (20)..(20): n is a, c, g, or t
  Promoter: Source sequence=SeqID_24552; Location=2047..2329; Strand=-; Gene=SeqID_55272
ataatgacataaagattaantcgattaaaaaatcattaggttatttaagcgtaggcgaaatatgaaatattttactgcttacgtgtagcttttaatttctatttgtttaaaatgggaattaaattataactgtttctatatgtatgtatatttcccttatgaaagaaataataattatacaacatcatcatttttaaaaagggtataattaaaatttttcaaaattagtgaatttagttaagctgaacatttacttaaagcgttcttttaatcagtgtaaatg

SEQ ID NO: 99446 - DNA, 265 bp, Heterodera glycines
  misc_feature (129)..(129): n is a, c, g, or t
  misc_feature (155)..(155): n is a, c, g, or t
  Promoter: Source sequence=SeqID_12373; Location=1..265; Strand=+; Gene=SeqID_75977
aaatgagttagagatgaaaaaaagtatttacaaaaaaatagttcaacaacaattgatatcgcattctttcacatagttatattagggatgatacccctaagaaataaaaaattagattttaaaattctntatttcaatactgatttggcttaatntagcgctttatagataaaattttacgcttttatacccctaaatttgagactttttagactctattttccatttttagtgcctgattttggggttttccagaacctatatg

SEQ ID NO: 99447 - DNA, 163 bp, Heterodera glycines
  Promoter: Source sequence=SeqID_15988; Location=1250..1412; Strand=-; Gene=SeqID_80346
cgccgacttccacccaatcccttgggatgtttttgttttatccaatgcctgattttgtcttaaatttttcaaaattcggactcaatatttttcggttctttacttctttaaataggtagttaagttatattttcactacataattttgatttgctggtaaatg

SEQ ID NO: 99448 - DNA, 402 bp, Heterodera glycines
  Promoter: Source sequence=SeqID_44766; Location=612..1013; Strand=-; Gene=SeqID_72199
acaagaacgatcgcagaattgcaaatggtcgccttacaacgcgcactttgaaattgcaaagcccatgcgatcgactgaaatgtttcggctgattgctgaacgaactgacgaccagtctgaaaaggaagaagcatttggagacgaattagaagccaaaaagcattttgggatggaaatggaaatgaattttgctaatgggggggggggtaattagcaggggggacggaaattgggaccaattggcaaatttaatgggaaatgcgacggatggcctaaggccatttgattgaaatgccataaaacaacgaaacatttgcaaagaccgaccgtcgaattgagtaacgcgcgaatggaggccaaaaggggaagggcgagaaattcggcggaagggccgtggcaatg

SEQ ID NO: 99449 - DNA, 81 bp, Heterodera glycines
  Promoter: Source sequence=SeqID_20218; Location=2593..2673; Strand=-; Gene=SeqID_85019
tttcaaatgtcgaactcttgtttaatatgttttttaataatctttacaaacctttgagtaaaaacatatataaagcaaatg

SEQ ID NO: 99450 - DNA, 58 bp, Heterodera glycines
  misc_feature (16)..(16): n is a, c, g, or t
  Promoter: Source sequence=SeqID_25538; Location=1655..1712; Strand=-; Gene=SeqID_56278
acattagacttaaatntggagggaaaaatttaaaatttattcaacaaaagaaataatg

SEQ ID NO: 99451 - DNA, 59 bp, Heterodera glycines
  Promoter: Source sequence=SeqID_10784; Location=1831..1889; Strand=-; Gene=SeqID_74039
attaattaattataattattttctttatttaatatttcatgcatttatgcttaagcatg

SEQ ID NO: 99452 - DNA, 69 bp, Heterodera glycines
  Promoter: Source sequence=SeqID_16830; Location=1089..1157; Strand=+; Gene=SeqID_81250
cctgaaaaaacaaatgaaattagttatttttaatcgaataattaattaattagtacagctttccaaatg

SEQ ID NO: 99453 - DNA, 1003 bp, Heterodera glycines
  Promoter: Source sequence=SeqID_5344; Location=1624..2626; Strand=+; Gene=SeqID_57737
attgatcaatcgtcacccatttttggtgcattttttggcccattgatcaatcgtcacccatttttggttcattttttggcccattgatcaatcgtcacccatttttggttcattttttggcccattgatcaatcgtcacccatttttggttcattttttggcccattgatcaatcgtcacccatttttggttcattttttggcccattgatcaatcgtcacccatttttggttcattttttggcccattgatcaatcgtcacccatttttggttcattttttggcccattgatcaatcgtcacccatttttggtgcattttgtggcacattgatcaatcatccctcatttaacccatttattccactcaaatttattttcacctaattcttgattttttttaaaaaggaaatcttagtgtccaattttctggtgttcaattttccggtgtccaatttaccggtcccttttgaaaagggatataagaagtcagtacattgaaatatatttctataatccgaagcaaccatttcaatgaaggaaataattaaaatcaaagtaaaatattaaattatttcacaaattgtcttttctctgatttaatgttactatgttttttgaagcattttttttattaatttatttttaattaatatttgcccatttgttattcttttgagtcattcccgcaaattataccaatttatttgattcatatttttctgtaatgttattctattaaaaaaataaaagaaattattattttattcattttttcctaatgttattataatttaaaaaaataaataatttttataagaaatgattgaaaattaatacatacatattcattgatttttcgtgaattttattaatttcatcgttcctgtctctttaaattcattttttttttcataaatttacaattatgctaaaaattagaaaaaattttattgtaaatttttatgctttatattttttcagattaattaattccatcaatg

SEQ ID NO: 99454 - DNA, 150 bp, Heterodera glycines
  Promoter: Source sequence=SeqID_28711; Location=1750..1899; Strand=-; Gene=SeqID_59287
ttattttttaaaggagttggtaaagcggtgaatgctctcgagaaaacatcatcgtgtggggcgaaagggcggccggattggtgtccaggtggaaggaagtggcaaaggcggagacggcacgcgcggcggaagaggcgcaacgacagaatg

SEQ ID NO: 99455 - DNA, 175 bp, Heterodera glycines
  Promoter: Source sequence=SeqID_10143; Location=2188..2362; Strand=-; Gene=SeqID_73241
tgggaacagtgacaacaagtggcaggcagcaaccgagaaagatagactatctgatcaagaaggtcagccgaaagcccaaacggttgaatgagatttaatggggaaaaatatggtttcatgcgtgaccctttttcccccttttctccttactatcccctcctatttactagaaatg

SEQ ID NO: 99456 - DNA, 390 bp, Heterodera glycines
  Promoter: Source sequence=SeqID_34409; Location=344..733; Strand=-; Gene=SeqID_64207
aaaatgtctaaaatttgtgtttatattaaacaattccaaaagaatgctcaatgcaatcaaacatctttgaatgtttttttgaaaacctaagaaagataaattttaaaattaattttttaatatttttgaaaattttagtttcattcttttagaaaataataaatctatagtttcttttttactcacggtttactcagtgattacccatttcacttattaaaaaaataataattttatagaaatcttttagagcatgcttttctcatcattactgtcaccaccatcatttgttttttaattccgcctaatttgtccattgaaatatgcgtaaggccaaacactgtcttgaattatattggggaattgatgtgcaatgataagaatggcatg

SEQ ID NO: 99457 - DNA, 118 bp, Heterodera glycines
  Promoter: Source sequence=SeqID_6961; Location=1..118; Strand=+; Gene= SeqID_63409
atcttttttattaaatttattaattctttttaaatgatatgtatttgaaataaataaaatgcaaataataataataataaaaaaaagaaactttaaagattggcagagacaaaaaatg

SEQ ID NO: 99458 - DNA, 179 bp, Heterodera glycines
  Promoter: Source sequence=SeqID_9682; Location=1..179; Strand=+; Gene= SeqID_46794
gtattaccggcttaggcgccggctttgagattaattttaggatgatgtaattaattctgaatacttcataacctttctgaaatattaaagaggtgttgatgaacctctttaattgagcctatatattgtgatttacaacagtatttcctctccttttttcttaattaagctgacaaatg

SEQ ID NO: 99459 - DNA, 212 bp, Heterodera glycines
  misc_feature (35)..(35): n is a, c, g, or t
  Promoter: Source sequence=SeqID_791; Location=1..212; Strand=+; Gene =SeqID_61378
catttgaacactttgtcaggtaaaagtctaatttntggaattaatttaatttatcccacaatttcaaatggatttgtaaatcagtcaaacagttcttgttttttttaaattagcatatccatctgaatgactttctgcgaattctttgcaaaattggctctgttctcgtggaaatattgtgcatttaccacgcaattttgaaatttcacatg

SEQ ID NO: 99460 - DNA, 770 bp, Heterodera glycines
  Promoter: Source sequence=SeqID_1846; Location=1..770; Strand=+; Gene= SeqID_47064
aaaaaaaaaaaattttttttatacgttaatcataagtcatggatataaaatgaaatacgagcccatttgatattataattcattaaaagctcatggatttatctaatcaacaagtaaacatactcagtttctcggactaacttaaaagaggacaaataaaaatttgaaaacgttatgccatttcgaatttagatgataaatagggatgcaatttttaggctataaaaaacgccagaatgcttaggtaggttttaggacctaaaaaacccacactaaaaatggaaaataggcactaaaaagcctaaattaggggtgtaaaatgactaaaatttattcaaaaataactaaatttaagccaaatcaatgttgagatatgtacataaataatttttaaaatcaaaattcttgtcattaaaataaataaataaattttggaacttcttgagaaaatttccatttctcagggtatattttcaaaaaatttgggtcgatgcttagggatatatttttcggaaatttttggggtcgatgtgtatttttcatttttattccatttttgttgaaaaattctgggcaaaacgccaaaataagtcaaaataggtttttcaattttttagcaacaaccaccaaaaaactcgttttccatgcatttcagccacttggagctaagaaaaaataggcaaaaacctaaaaaatctatatgttatatatatataagaagttagcaaataactaggtcctcaacttcattgtatttgattgacaacatg

SEQ ID NO: 99461 - DNA, 412 bp, Heterodera glycines
  Promoter: Source sequence=SeqID_26532; Location=404..815; Strand=+; Gene=SeqID_57271
acctgaagggcaagaagcggctctgcttttatccgcacacaatcatcctttggtgggttggcaaaatgttcaagttcaaaaattagagtctttacattaattgactggttttaattaattgttgagcattaactaattagcctaattaggctctaatttcgtcattccgtccagtgacctgtcttcaaacaaaaatcttcttaaataatttgtttaaaaaaacatggaaattttcaaagagaatttaacaaaaaatttgcgtttttattatgaaaatgaagaatttcttaaatttattaatttaatgcttagaattaatcattggtaattttacccacaaatttttcgaaaattgaaaaaaattcgctttaattaatgacaattattttaatgcctgcccttttcagcaatg

SEQ ID NO: 99462 - DNA, 554 bp, Heterodera glycines
  Promoter: Source sequence=SeqID_10215; Location=1476..2029; Strand=+; Gene=SeqID_73343
gctgccgagaatggaaggaataatgaatgacaattaaatgatgcaattaggcttaagccccaacccttcggcgagtagagaaaagtcggggaatcgaggatgaaattcaccgacaaaatttgtcgtggatttctggtggaaacttgcaaaaaagtcttcgaaactcattcacagcaaaaaaataaaataaaataattttttatttgtttttaaataatttttatttatttttaattgctatttggctatgatcatttgtcagaaagagtgatcaaattgtactgtatataaaaaaagcaagtcaaaaatgattgaattttagttcctaattcggaaattaaatttttggaattttagcttttttctatgatatttttaaatcaaatttgtaattaatttctttaattggtctcgaaataacaaaatcatgtctcaatttctgaagggatcagcagctttaattttttttaataaaaggaaaaaaaagtaaaaaaaattttattattttttaaaatttttattatttttatcccacctgttgctgttgcccaatg

SEQ ID NO: 99463 - DNA, 1003 bp, Heterodera glycines
  Promoter: Source sequence=SeqID_426; Location=8259..9261; Strand=+; Gene=SeqID_52252
cagaactgcggaggagaatggaaatggatgatgggggggggggggactaaaactcgcgcacccttgaccgatttacttcaaattttactagccgtcaactcacacccccttaagctgaacggcgaaagaatttcgcctctagcacaattttgagcagtactttcccgacgccccgcccctcccccatcccgagacttgcgcagcaaaactgtggtggtaagaggaagttcatgccgttgaagaggaggtccgcggcgacggagagaggggggtccgcggcgacggagagagggggtccgcggaagagagggggccccgatccgacggagagagggggtccacggcgatggtgagagggggtccgcggcaatggaaagagaggtccgcggaagataggggggtccgatccgacggagagagggggtccgcggcgatggtgagagggggtccgtagaaaagagggggtccgcggaagagagggggtccgcgctgcccaacgaaatggcggaggcgaccagcggggaggcggccgagctatttaacgcaaaatatcgctggtggccgactggttaacgcgtcgacccaccaccatctcgggttcaatcccgcgcggcgaaactcccgcgcatttaacacccacagcccaaaatctcgcgcaaaccccatcccacacccccaaatcccgaccccacaccgtcccgcgcaccaaccaccatcccgaacccacatttcccgacacccccccccaccccctccccgcgcaccacacgtcagagacgcagacacaaccacccattaggcacgggcacgcccgctcatactctctgcgctcagcggagaaaatcaatcgatatttaaagtaggcaccctatgtagtaatcgggaaaattcgcacgtcggcaaagagagggtggccatcatcccccaccttggctacgagaagcgtgggaagcagagtgccatcgcacgaaaatacctcaagtggcgtgccgaggaagagatg

SEQ ID NO: 99464 - DNA, 66 bp, Heterodera glycines
  Promoter: Source sequence=SeqID_2544; Location=1438..1503; Strand=+; Gene=SeqID_80309
ttattttcatctgaattttatcaaaatgtttgtctctccaaggtgtctctgtacccgtactgcatg

SEQ ID NO: 99465 - DNA, 82 bp, Heterodera glycines
  Promoter: Source sequence=SeqID_23740; Location=506..587; Strand=+; Gene=SeqID_54432
ttttgccacccatttgcgcaaaatgtcgaacattttgacaatttgtcgcaatgttgggtgttcgtctgcccgtgccaaaatg

SEQ ID NO: 99466 - DNA, 127 bp, Heterodera glycines
  Promoter: Source sequence=SeqID_988; Location=2502..2628; Strand=-; Gene=SeqID_65467
tgatcaacagaaaaattcgactgatcgatcatgttggcgttgcggtaagacccattctcccaaatcgtatccgcacagcagtgttgtctgcaaaaattgcatcaaatcaggacatttggagaagatg

SEQ ID NO: 99467 - DNA, 125 bp, Heterodera glycines
  Promoter: Source sequence=SeqID_35376; Location=328..452; Strand=-; Gene=SeqID_64941
gttatttgactaaattgttcaaaacgccaaaaataactatttacatttaaaaataaaaatttttatatttttttggaacaattatatttttcaattcgtttaccaaaaaacagtcagctaaaatg

SEQ ID NO: 99468 - DNA, 950 bp, Heterodera glycines
  Promoter: Source sequence=SeqID_10060; Location=2613..3562; Strand=-; Gene=SeqID_73126
tgcaatttcatttcgtgggtactgtagataatgcttccttcctttaacatttttaagctcggaaaccgttccgaatactgctcagaaatctgactccatttaattgcatttttgttaatatttttgggaaaaaactaaaataggctctaaaaactcgaaaagtagcttaacaacaacaaccgaaaaaatgcttttcgtgcttttcaagtcactgagagttcaggaaaaaataggctaaaacctaaaaattcatccttagtcattgacttttttgaaagttaacgaaatattttgaaaagacagaaaaaacgctgaaacgatcattaatagaaaaatgatcattttgttattgattttttatatatattttttgttttaaatgatgctttttgactccaacgaatgaggcttttttggaaaccaaatgatttgagaatttttatctggcaactttgatttaaactatgatgaaaaagaagtaacgttgcacatttttgaatacattttcagaaatatccagaaataataatattctaatttaaattaaaaaacgatttatcgaaaatcatattgaattactaaacacagcggcccaattttgggctctcagtgcaaataggtttattatttatttagtaatcagaacgccaaaactttgcaaaacttaaaattttccggggattttcccttgcaaaagcacaagagccgatctcgagttagaaaatatactttcaaaaaacaaaatagaattcgatagatggggtcaaaaaactagcctgggcaaaatttcaagaaaatctgacccgaggaaaatttttttgaccctagtgtaaatttcaataaatttctatcatttttaagctaaaaatggtcttgacgcgcaaaaaaagcgaaaatttaaagaatatgagcaattctggtgtagaggcaagacgaaaacggaaggaatg

SEQ ID NO: 99469 - DNA, 1003 bp, Heterodera glycines
  Promoter: Source sequence=SeqID_22557; Location=868..1870; Strand=-; Gene=SeqID_53226
gtgataaggccatatttggcgcttaaataatgtgttgaacaaaacaatttggacagcaattaacgacgaaacatttaattacataaattgtgcaattagcaaatcaattatttgaccgaaatgcaaatttttaaatttttcatttttaaattatcttgacgatttcgtgtcaattaataaaaattaaagctgaaaaaatgcctcaattttttttcctatattaactcaaattatacagttaattatcagatttacagtaatttttgttgtacgcatgaacctgtgctgttatagctgctcaagcaaatggatgtgtttgtgcggctttcacgtgacaactgtgggcctaattaattaattaatcattaaaacagtgttcactaaataatgaattaataattaagcttaagtaatttaataattgattaatctcgaattgattaattaatcactgataaactaaattagttaatgcctaattaatgcctcatgaaatttgattaaattatttgtcatggctcattgtctaattgattaattaattattgcctcattaaaatttgcttaaatttattttatctgtcagggctcacttgtcgtcgcgtggatttatttgttggccggcttttttggctttctatctgccataaatttatttttttatcgcatttccatagtccactttattaatatgatttcggtaattattatttattttttaccatttttgtaaatgacaaaaaaattttaagaaaataattttcttaaacaaaaaatcgttaaaattttttcctcgaaattatataaaaagcaaaatgttcggcacagaaatgccgttaatttaattttggcaccaattttggcacttttcaacaatctattttttaggtgtaaccgttttttgcaatttttgcaccaaaatccgtcagaaaaaattaattaattaaatttgttttttcaaatatttcatttatccctttcttttaagggtattttgcttatg

SEQ ID NO: 99470 - DNA, 182 bp, Heterodera glycines
  Promoter: Source sequence=SeqID_21599; Location=866..1047; Strand=-; Gene=SeqID_52198
attattttaaaaaaatgaacataaatattccataaaataagtcaggaaaaataactgtttctaaatgttaactttgaacaaaatttattttcaaaaattttattaataataacctttaacttaaaagaaatgaataattaattataacaaattgaaaatatttaaatatttttttagaaatg

SEQ ID NO: 99471 - DNA, 305 bp, Heterodera glycines
  Promoter: Source sequence=SeqID_32404; Location=1261..1565; Strand=-; Gene=SeqID_62712
ctgttgctgattgtctttgccgcctttttcatcagccaatgccacgggcaaaacgaagacgaaacagcggaggaaaagagaaacggggaggaggagggaggacgcgcccaactccaccagggggagcaatgccccgcgggcgatagcccaactcaaagtgagccgtgccgtggcgaacggaccgatcggcggggagaattcccccaaatgccaaaccgacattttcagaatgttcgagaagttcgacgtattgtggcactggtttctactgcaaactattccaacggaattcgggcaataatatg

SEQ ID NO: 99472 - DNA, 307 bp, Heterodera glycines
  Promoter: Source sequence=SeqID_38520; Location=619..925; Strand=-; Gene=SeqID_67302
gcagttaaaggcaattaaataaatgttagtatgcaatcaaatggtaatgctaaaatgcgtcaatgtgtgaaaaaaatggcatcacattttgacgggccgcggatggcatttgacgcgtaataattgggccggccgaatgtcactagacaattttttttagcttttaattgctcaagtaattggctatattagtataaaaatattagtgacgtttaattgcgtagctaaaccattcaaaaaattatgccccaaaaacggtattttgtagaaaaaataataatttttttatttgtaggtagcacaaatg

SEQ ID NO: 99473 - DNA, 64 bp, Heterodera glycines
  Promoter: Source sequence=SeqID_25574; Location=496..559; Strand=+; Gene=SeqID_56316
ggtgcgccatggccattttatttttcaaataatttttatatttaatagatattccagaaaaatg

SEQ ID NO: 99474 - DNA, 136 bp, Heterodera glycines
  Promoter: Source sequence=SeqID_2356; Location=1..136; Strand=+; Gene= SeqID_79290
gaaaaattcaaattttgaaattgaaggccccgataatttatccggtgaattgccttgcccaaaatttcatggttttttaattttggctcaacaccgaatggaagaaaattaaagaactttttctcttggaattatg

SEQ ID NO: 99475 - DNA, 331 bp, Heterodera glycines
  Promoter: Source sequence=SeqID_30645; Location=1496..1826; Strand=-; Gene=SeqID_61054
acgcatattccaattaaagtgtgtaaattaaaaaaaacacctgatttttatgtataaatctatttaaaaactccaacaatttgtgtaccgtcgcttgtgtcactccttcagaaattgacaaattttacgctatatttaattgttgggtaaagtcttaattttttttaggatgtcggggataaaaacattgttttaccggtgctattagttttcgacagtgttgatttcgacagtaaagctttttttaaaaaaaacttcttctatatggtataagtatcgaaatgttgaaatttaaaatgataagcaatggttcctatacattgccagaatg

SEQ ID NO: 99476 - DNA, 811 bp, Heterodera glycines
  Promoter: Source sequence=SeqID_9635; Location=1..811; Strand=+; Gene= SeqID_72148
atttaatgatgcattaaaataaaatgggactgaattggacgcgaggcaaaaaatcgtatagtatttttcatatgcttaaacaatcattgccatgtcttagtgttgtttgtcagatgcataagtgcaatcacatttttatacacacattggtgttggcataaatctcatttttatgcgaatttccccttattaggctgtcagcaataaattggcactctgccaaaagtgggcatgccaaaatgcttacaggcaaacaaagatttatggctatgccaaaattgggcgcatagttccatagcgtgtatagtgtgggctataatagtcatagaagtatattattatgagaaaaacagaaatctatttctctatatgaatattggcactgtattttgccgatctctttcactggtgtatctcataattgcaggaacattttacttatgtatgactgtgcatagatattttatgtatgtatggcttaacaatgtatattagacacatggccaaatcattgggggggggcaatgatttcgcaaatttggccctgcgcaatgtgccaacacatcgccaactttgtttgtttctctgcccactctcttcattggcatgtgctatctgatttttgtttgaccgtcttccatgtgctattgcttcgcatttgcatgccgtgcagtcttttcgctgaaagtgccaatataaaagcggtgccaaactcagccaatggcacttcattttcaaactactctctctcactaactgttgcacatcccaattttatttcttccttagtaagtagtattggtgcacaatg

SEQ ID NO: 99477 - DNA, 248 bp, Heterodera glycines
  Promoter: Source sequence=SeqID_36343; Location=744..991; Strand=-; Gene=SeqID_65680
attgaaccttaattaaggtcattccgtggcaccgttaattaccttttggcactttgttccttttttgaaatgctccatcagtttggccattttttatttgtttatacagcattttcgggacaaaatttcattgagtatcgtttggcggcaaagattttaatgattcctttgtttgggttaggtaatttactcaaactaataattaaattttatcataattgactttaggaggcattcctcctataatg

SEQ ID NO: 99478 - DNA, 124 bp, Heterodera glycines
  Promoter: Source sequence=SeqID_17844; Location=1764..1887; Strand=-; Gene=SeqID_82378
agtgatgcaaattttactttattatgttttaattccaattttttgcaggaaactcttgtcccatttcactgttctggacgggagcaatgtgtttgagaaggaatttgtgtacaaaaccaacatg

SEQ ID NO: 99479 - DNA, 485 bp, Heterodera glycines
  Promoter: Source sequence=SeqID_14618; Location=1..485; Strand=+; Gene=SeqID_78699
ttattttgttcatcctttttttttcatacatggcaaaaaactttcccgtcggtgaatcatttcttcatttccaattggccacttttggccaatccttcgtttttcattttcattgattcattttacatccgcataaattgttgcataatattaaatgacatttttccgaaccaaagtcttcaaaaatgttcaatttcttttttctgctgatcttcgcttcttctgcccaaaattcgtttcaacaaaatgtaaaataaattcgacattattttgtttaatattttattttttcgtcaaggaacatttttgccattctctccatggtaccgatgtctgtgttgaatgtggcccattggcggcggacaagcaaaaatgtaaattgaaataaacaaagaggaaaaacgtcattgtttgattcacaaaaaaattaatattttgaatcaccaggtgatcagttgcgcgtgcttttccctccgtcaccaatg

SEQ ID NO: 99480 - DNA, 746 bp, Heterodera glycines
  Promoter: Source sequence=SeqID_8918; Location=1..746; Strand=+; Gene= SeqID_69639
aggggaccagagcgtttgggcccccctttttgggccccggggtcgtttgggccccaacccaaaaatagaaaaatgtgcttttttaaaaattaagattctaaaaactaagcctgagggatccctcgccacttggcataagttaggtttaattaacattcgctcattttttacaattttacttattccaaatcctattattttttaatagttaaccaatttgatgtacattctgatttggacatttttcagaaatggctaacccaattgcaaccaaaaaacaaaaagtaaaattgtcttacgaaggccacctttacaccttcgctaaaatgagttctgatgggatgacaaaattttggagatgcgagttcaaaaaatcaatttcacattattttggagtttctccggggaatttctcgcaactatcgaatgaacccgtgaatttctgttaatttttacattttttattgttaaaattattgttgaatttatttttaaaatgtttattttacatttttatgctgaaatttaaaaagttgtttttactgtgatttttcatttttctgtacttggggcccaaacgaccctggggccaaaaacgagggcccaaaaacgggggcccaaacgcccccgactcgggattgagatccaaaagcaaattcccgcgcgagctctcgtcccgccgtgctgctttttacactttaaaatattgtttcctaaaatttagcataaaaatttaatttgaaatg

SEQ ID NO: 99481 - DNA, 421 bp, Heterodera glycines
  misc_feature (30)..(30): n is a, c, g, or t
  Promoter: Source sequence=SeqID_8058; Location=1..421; Strand=+; Gene= SeqID_66846
ccccccccccccccccccccccgtcctccncgcgcttccggacatttggacactggacaatcgacagtggacacatttcgactgtgaagtcattttggaaataacctggcaattggacagtggacatgaagacaatgagtgaataatttttttactattataaatggctttggcagtattaaaaaatttttttttatattgtataaattgcattttctttagtctgatcaggcattaaaataggtaagtgattccttctagtcacagaaaaattttttaaaaactaagattaaatttattgttgtttattaatgagccgggcggttataaattgactaatcggttcggaggaataatcaaatgttctattaaaataaaagccatttataatagtaaaaaaaagtcatttactgtcgtaatg

SEQ ID NO: 99482 - DNA, 100 bp, Heterodera glycines
  Promoter: Source sequence=SeqID_7864; Location=1084..1183; Strand=+; Gene=SeqID_66218
atgtcagcgaaacacgagggcaaccaacccgactctctaggccagacgcttactacggcaaccaaacatccaagctcgttggatcggcgaaacgacaatg

SEQ ID NO: 99483 - DNA, 114 bp, Heterodera glycines
  Promoter: Source sequence=SeqID_15925; Location=684..797; Strand=-; Gene=SeqID_80273
agcgccgtaattcagggtgattcttcgggctcagaggaagcgaactgtgccgaacaaagcgagagggagcgtcgtcattggctaatccgacaaaaacggcagctccgaaacatg

SEQ ID NO: 99484 - DNA, 712 bp, Heterodera glycines
  misc_feature (335)..(335): n is a, c, g, or t
  Promoter: Source sequence=SeqID_22598; Location=1719..2430; Strand=-; Gene=SeqID_53266
tttttgttgaatatttcataataaattttttgttcacaagcaagtagaaatagttgaaaatagtccggcggtgtcgacaggcgccgcccaggggaaattttgaaaaatgtaaaatttctgccaattttcggttacattatgccaaaaatttgaaaattgtttattcataattttttttgtttatatgcaaaaattacggcgcccccacaaagtgtccaagccacgaattgttcaagccacgaattgtccaagccacgaattgtccaagccacgttttgtccaagccacgaattgtccaagccacgaattgtccaaaagagtaaaaacccacgaanttgtccaaagtctaaaaagctcataaaaagccggaaaatgggtctattttagggttttcggggtcgctgaataccaatacgacatttatatagccccttgcctaaccctagacccacccgaataagaaaaatctccaaatttgattaaaaatatgtgctttttttgtcttcagattttgctattcattaattgaacaaatgattcgtaataaactagaaagtctacaaaaaagtcggaagaagctttgtttgtcagcatttcaaacccaactgaggaggccgtaaattttggagtggagattgacgaactgcatgccgtgataacttccgacaatgttgaacaacagactttgaacgaggctgaactttcaacaatg

SEQ ID NO: 99485 - DNA, 179 bp, Heterodera glycines
  Promoter: Source sequence=SeqID_4678; Location=2432..2610; Strand=-; Gene=SeqID_55345
cataaaaacttgtttacacgattttttgaaaattttccattaaaaaaggggggggggagtggacaaaccaaactatacccaatatttgcttcggtcactcaaatccacgaactctgccgaatacacctttttcttactttttcctttagacttacgtctccgctctttgaactacaatg

SEQ ID NO: 99486 - DNA, 229 bp, Heterodera glycines
  Promoter: Source sequence=SeqID_30860; Location=581..809; Strand=-; Gene=SeqID_61250
ttccccacattcatttgttttattccaattatattgtgacccgctccctctcctcgctttattattatatttatttgtgttgaaataaatcaatatttatttcattgactgttgacgacacaaccgttattggcgcagtcagcaaacgaagacgagcgaaacaaaaagcgaggaagaaagagcagcgcaccgacgcagcaaatgcaatgccaccgatgtgggaggaatg

SEQ ID NO: 99487 - DNA, 1003 bp, Heterodera glycines
  Promoter: Source sequence=SeqID_10701; Location=2805..3807; Strand=+; Gene=SeqID_73955
attgacaatttttaaattaaaaattttgtcaagaaaacaaaatttgggggagaatttttgaaaaaattttccaattcttagtggtgtatttaaaaaaaaaaaaaaaattatttttggtcgattctaggggtgtatagggaaaaattttaatgctgaaatgcgttttttgagctcctttcttcaaatcaatcgagcaaaaaaaaaaagttttttcactagaaatcgcggccctatttatgtttatgttgtaattaattcattaattgtgagtaatcgttgataaaattgctgatgataaaatggagttgatttaactgtgccaacacaataaatgccatggcacaacaattttagccaaaattttgaaaaaatcaagtacttgacgaaaaaacatagacaaatgcaatgattttcaaaattcgagctcgtattctttatcagtgcattttttactagagtgccacgggaccgtgaattttgggcaaacccgggaccgggaccttttcgggttgaaaacccgggaccgggaccttttcgggttgaaaacccgggaccgggaccttttcgggttgaaaacccgggaccgggaccttttcgggttgaaaacccgggaccgggaccttttcgggttgaaaacccgggaaaaaaccaggactagtcccggtcaaaaccgggaccttggtactcagttgtactcagttgtgcgctaccaggtcccggtcccgtggcactctatttttgaccatagaaaaagtgattttgtaagaaattttttttaatttattttttcgggcggaacacccaattccgaaagattaccaacaaaaagatacaaaaacttcatcaattccttttaatgactataaaaatgtttgttttttcgcttttcctcgcatttgaaaaaaaataaattttctaacgcaataattctgcaattattcttccctctgtgacgacgacatcattcggactcggccaaaattgtgttaattgccaaaaaatg

SEQ ID NO: 99488 - DNA, 53 bp, Heterodera glycines
  Promoter: Source sequence=SeqID_18548; Location=1..53; Strand=+; Gene= SeqID_83181
cagctacgtccaatgcactgttacagtcgccgggttcccgtggaacaacaatg

SEQ ID NO: 99489 - DNA, 208 bp, Heterodera glycines
  Promoter: Source sequence=SeqID_39630; Location=170..377; Strand=+; Gene=SeqID_68150
aattttttttttttttgcaaataataggccccttttcctttgaattttttttcggcggggcgtgcaattatttatgggcctgcaaataaacagcaaaaaacaaaaatttttcccacaggcaatcgctgtgaaaatggcaaaatgccgttgctgatggagtgcccgtcaccgccttcctcctgcccaatggacgcgtccgttttaaatg

SEQ ID NO: 99490 - DNA, 141 bp, Heterodera glycines
  Promoter: Source sequence=SeqID_19939; Location=2020..2160; Strand=-; Gene=SeqID_84699
agtgagtaattattttgtataaattattgtcgtcgcccgcgggggaggaaaagccgcacagcagcgggggaccctttgtgtgaggcgcaagcggcggcttcttatttattggctgtaaaataagaagtgttccctgccatg

SEQ ID NO: 99491 - DNA, 296 bp, Heterodera glycines
  misc_feature (57)..(57): n is a, c, g, or t
  misc_feature (120)..(120): n is a, c, g, or t
  Promoter: Source sequence=SeqID_26117; Location=1..296; Strand=+; Gene=SeqID_56866
tttttgtctcaaaatagaaaatggacattccagttttttacccatagaccaaaaatntaagaaataaaacttgtcagaaaatttttggcaggaagagcaaaaaaaaaataccgaaatttnttttctgcttattacgcgcgctaacagtgtaaatttaccacagtaatttctccatttgaaactttttaaattttggcttatccataattttcaaaaaagtaaatcatttttcagaattctaacaatttcagctatgggcggatcagtttatcagaattttcagcatttttcagatg

SEQ ID NO: 99492 - DNA, 871 bp, Heterodera glycines
  Promoter: Source sequence=SeqID_7208; Location=2206..3076; Strand=+; Gene=SeqID_64152
attgaaaaatgttatatttttccgatatattaaaaaaacatgacttttaatatacatttcaacaaaaaatttttttatcaaatttagggccgtgaatcgatgtcatctcccatttataatgcccattggacttcgactgaaccgatttggtctttgtgcttcaattcgcaccacatgaaaatttgcgttggcatggaaaaatgtgccaaaatactgaacgtactcagtggacaaaatttttatgtcggaagcggcggaaaaaatgtcatttcgtgtattttttccaaggttactttgttatgtttttttgatgatacctaatgatttctccaaggacggaaataccctttttctgggccggaaaaatgccgatgtttccatgttggacatgcgcatgacatcgaaccataaagttggcgaattggcccagtcgccctctaccggatacatgcatttgctacagacgcgtcctcacactttagtcactgagaattttgaaggaaaggtccgccattttttgtttttgtctaaaaatgataactgaacagatcaaactttgggatgtgcgtggccgttgtcaacccttggccgaattggagattgggcaccgcaattcctcacataaattaccttgcttcgttgatgcttcagaacgctttgtattcgccgttggtgaagacgcgacagtccggggatggtcacttcacacgggcgaagttcgctaatgaaaaactatcataagactagggcgtatttttcttgagccgaaatacccatcctgaagattctctggctccgaatccgaccctcgaaaaattattgtttttttctttttgtaaagctgctgtgttcggtcacaagtccaaagatg

SEQ ID NO: 99493 - DNA, 138 bp, Heterodera glycines
  misc_feature (68)..(69): n is a, c, g, or t
  Promoter: Source sequence=SeqID_7809; Location=2361..2498; Strand=-; Gene=SeqID_66032
aaatgttattaagcaaagtaatcaaataaaataattctataagtcattcatttaaaaatatatatgcnnaatacaacttatttataatttattttttttaatattattaagcaaatttctctcagataataaaatatg

SEQ ID NO: 99494 - DNA, 141 bp, Heterodera glycines
  misc_feature (38)..(38): n is a, c, g, or t
  misc_feature (53)..(53): n is a, c, g, or t
  Promoter: Source sequence=SeqID_12550; Location=1..141; Strand=+; Gene=SeqID_76201
gcgcaagccttgctacctgataagccctcgaagtatancacagaagtcctcanccagttgaagcgtgccgttgaacccatccttcccataaaaggcaaaaaaacagcagattatcttcattaataattattttaagtgatg

SEQ ID NO: 99495 - DNA, 1003 bp, Heterodera glycines
  Promoter: Source sequence=SeqID_23029; Location=774..1776; Strand=+; Gene=SeqID_53731
ttagttgctgaattttttggcacatttaaaaaactatatggcaaagatccaaaaattacgagaaaggggaaaaattggaaaaggtaattaactaaaaaaattattcgactctgatcaattatgcgtctcctccctttttatgtcaatttcggctctatcagctcatctgactcaccttttttctgttaatttcaccctttgatcattccaattcgcccccttccgtgctagtttcgactctgatcagctcattttgtcacaccctttatctacgtctatttcgggctctgatcgctcatctgtctcatatcttttctatctcatttcggctctgatcagctcatatgtctcaccccttttctttcgactctgatcagctcattttgttacatcctttatctacgtctatttcgggctctgatcgctcatctgtctcatatcttttctatctcatttcggctctgatcagctcatctgtcttaccctttttctatgtcatttctctttcatctgtaccacactttctatgtctatttcggctctgatcaactcatctgcctctctagccctttgatcagcccatttatccctcttccatgccaatttcggctctgatcagctcattttgttaggcctttgatcagcccatttagccccattcggagtcaatttggccctgatcggttattggcattaccctatttcctttgcaatttcacccttggatcaatacgattcgtcactttcgtgctaattccaggtctgattacttcatttgttttacttcatttccgttccaatttcaccctttgatcagtccaatcaaccttccatgccgatttcggctctgattaaatcattttgttagccctttgatcagcccattccgatttcggctcagaacagctctttttcatcccctttcccaacccatttcgcccttttcgcgccaatttttcgggaccgatttcattaacttccgcttcccgcatcttaggaaatg

SEQ ID NO: 99496 - DNA, 324 bp, Heterodera glycines
  Promoter: Source sequence=SeqID_5078; Location=252..575; Strand=+; Gene=SeqID_56813
tgttcggcgccctctttgaacttttttgccggctccacggcactctgttggtgccactaattaagcattagttagctcattaaagcattaattatctcattatctattaagtctgctggtccctgaccacctctctgtccgttctgttggccttcgagcgttgcgtggaacagactttgcccaatttggccaagtcactgttccaagggtgccgaatttggggctggtgtttggccattttggcctattccctttactacggcttcttcacaattccgctcacattcagcggcatcaccgctaattggcagttcgacccgcatg

SEQ ID NO: 99497 - DNA, 536 bp, Heterodera glycines
  Promoter: Source sequence=SeqID_14386; Location=473..1008; Strand=+; Gene=SeqID_78421
tcttcagcttcgattgccgctttggcagtctcctcgtttaaatataggttattacttatgacccaagggtgggtagcaaccataaatctaaaaaagcagatcattcaacgcgtatcaaactactagaatcgtataattttttcgctttttgatcactttttttgttcctcatttctaagagcattattttgttgagtgttatggcatagcagatcgattattttctcgtactgatacaatttatgaaattttgtgtttttaactcgcatttgagaatttaaattttttaccaacccagaaaccagttcctggcccggcaatttggaaattcgaattgacctgttttccagtataacggtcttggggaggtcggaaccggaaaaccatatttgaaaatgtcgtcttgaaatctcggtcttatacgtattttaaaaaaaaaacaaatttttttaaatcgacaacttgcgcttgttcaaattttcttgtagttttgccccttcttactatagcacataatctgctgttaaaaccaaatg

SEQ ID NO: 99498 - DNA, 253 bp, Heterodera glycines
  Promoter: Source sequence=SeqID_12447; Location=1108..1360; Strand=+; Gene=SeqID_76075
agaaatgactatttaatttgaaaaatagaattttaatttcaaaagtttggccactttttggacatttaattttatgtggccactttcacaaaatttaaattccaacaaaagtcaagtatctcgctttttaaaaattaaagccagaagactttgctgttttcaaaataaaaatttcaaagtctcaaaattaacaaaaattcaaattggttttcctgatcagcgagtgatcagcccaaatttacaaaaaactatg

SEQ ID NO: 99499 - DNA, 196 bp, Heterodera glycines
  Promoter: Source sequence=SeqID_26292; Location=1..196; Strand=+; Gene=SeqID_57038
ttttgatagaaaaagcatcagagagccttatttaacttttaattaacatttggtgcgtttcagagcactttctgaaaaaatacttatgaattaattttgcaaaaaataaataagtaatgaaaaagtcagaattttgaaaaattttaaaaacaacaagcgttggcattttttcaggttaagttagtcctttacaatg

SEQ ID NO: 99500 - DNA, 523 bp, Heterodera glycines
  Promoter: Source sequence=SeqID_8580; Location=2996..3518; Strand=+; Gene=SeqID_68593
attaatgacgacaaccaaattttcaaggaagtaaatgtttgggttctaagaataattttttcttagaattttttgttacatttaaataaaaattattgggcaaaatttcagcttattctaaaaactatcgttttaatttgagataatttatttcacctaaaaaatgttatcacctaaaaaatgaagtccaagccttggatgaataaaaaatttcctgagaaaccgataccattgcgagagaaaatttaatctcatattttattttattatgggagtgtggtcggcgtatttatagcgaataaaagtttattcaaactaagtagtgaaaaatgaataaatattcataaaatattaaaataacggtaaaatacatacgattatgtatattttcataaaaagcagtaaggctaagacgaataaaaataatttttttttgtgaataaatagaaaataataaatgcgattgaagttgaagacatgaaaaattggtagacaaaagcggacaaaaaagcatataaatatg

SEQ ID NO: 99501 - DNA, 563 bp, Heterodera glycines
  misc_feature (42)..(42): n is a, c, g, or t
  Promoter: Source sequence=SeqID_3542; Location=1..563; Strand=+; Gene= SeqID_50802
gaaagcggaaaaagaaagaaaggaacgacggatttaaacttnttcattatttattttgtgtatttcaaagtgattgatgattttgaatgttcggaaaattattgtttttcattctttgtgccggttttatgcatgtattgggcaaaatgacagaatctgtgttcatccccccccccctggtgagaagtctcttttgggacagttcaaaatacagtaggtgctgaataacaaaagttagaaaccaaaaatcactgtcatttgctcaattcggcattgattgtgagttctatcagacagtcccagtcggaaacaattaaacaattagcctctaataggagaaaaaaatttggcatgcctattaacatatgtaggaaggcttatttggtgcagtgataaaatagagaaaggatccaacgacaaatgccccatagagacaaataacccacagacgaagcaggacagctgtaaaaattttaaatttatttggcaaaacgtctcataataaatccaataaattattttgggataaataatcaaaaaaatttgttctgaaattctaaatg

SEQ ID NO: 99502 - DNA, 118 bp, Heterodera glycines
  Promoter: Source sequence=SeqID_16298; Location=1..118; Strand=+; Gene=SeqID_80687
cagttggcaaaggaattggaggcggaccaacaagcgcaatgtgtctttctaattattttctaaactaaaaaaaaaaatttgtttagcttctaacaacaccgttcctggctggtcaatg

SEQ ID NO: 99503 - DNA, 150 bp, Heterodera glycines
  Promoter: Source sequence=SeqID_7492; Location=2030..2179; Strand=+; Gene=SeqID_64990
tctcgacacagagcaaaaagcaaatgtaaactgtgggaacaaatgaaaatcatttaaaaatactgtaaaagtgccacaaataatttgtgccatttttccccgctgctcacattgtgccaccgccgaagagggcaatttggcgggatcatg

SEQ ID NO: 99504 - DNA, 156 bp, Heterodera glycines
  Promoter: Source sequence=SeqID_24061; Location=2195..2350; Strand=-; Gene=SeqID_54758
aaaaagtcatatatcattcattaaatgatggcccatcatttttttctccgacgcataaaatttaattttcaattagttgggcactaacttttacaattttcaattaattttgaactttgcacaatttatttgcaggcccatcagatcaaaaccatg

SEQ ID NO: 99505 - DNA, 326 bp, Heterodera glycines
  Promoter: Source sequence=SeqID_5560; Location=1..326; Strand=+; Gene= SeqID_58465
cttaaaaagcaaaatccctcacgaactttgacttttccatgcctcactttcttctccgatcagtccaatcagtttttgaatgtttgtgggcgttccctttatcactgcttttctgctgctgtcttgtcaatttgagtctatttttgccgttgtcggttggttctcttggcacgtttcctttccctcccctccctttgcttctccgatgtgtgccttcccctacctcccccccccccctccgttctctccccctccttttcccttcttccaatttattttgtctgttaagccccgcccgcctcagaaaaaaaagatgagaaaaaatg

SEQ ID NO: 99506 - DNA, 409 bp, Heterodera glycines
  misc_feature (100)..(100): n is a, c, g, or t
  Promoter: Source sequence=SeqID_30240; Location=1..409; Strand=+; Gene=SeqID_60670
caatttaaatgcttcaaattgggggtcttttttttagagttttaacggtacgaaaaaaagagattaaatttgagagaaaaaataataatttgaatttatntactcatctttttaggtacgatgtgacatcagtaagttcttcaattggcgtcaattatttattttaattaatattttttgccaggaaagttcgtttttgaatgtgcgcaattggattgagtcggtgaaggcgggcgttgacaatgaaagtgtgctctgtttggtcggcaataaggtcaacaaatttaagtcatttaatatattattatactattttgtaatttcttgcaatttaaaaataataaaaaatattaaaaattggaataaaataataaaagaaatcattttcaggtggacctttacccaaatg

SEQ ID NO: 99507 - DNA, 147 bp, Heterodera glycines
  Promoter: Source sequence=SeqID_15286; Location=1758..1904; Strand=-; Gene=SeqID_79508
ttttttcctccagatcaatcgctgttcagcaaattgtgggaaatgaacaaaattcaaacaaatatttaaatgcaaactttccaaaattttcgcaacaaataaattttgccgaaagcatcaaaaatgatacacaaaacgtccaaaatg

SEQ ID NO: 99508 - DNA, 292 bp, Heterodera glycines
  Promoter: Source sequence=SeqID_40769; Location=1..292; Strand=+; Gene=SeqID_69013
tttctcggggaatctcaaaaatgaaaaattattaaaaagtattttttcctgtgaccgaattcgacgttaaaatgacattttcaaatttttaacaaataattagattttcttggagactttgtttatataaaatatttatttgccattttttggagtgccccaaaatgccaattttatacgcttttaagaattagtttaaattttgcttctctttttttttttgtttgtttcttcgcttccctctcattgtcaggtcattgccattgcccttttgtacatgtccttcaaaatg

SEQ ID NO: 99509 - DNA, 770 bp, Heterodera glycines
  Promoter: Source sequence=SeqID_2216; Location=1..770; Strand=+; Gene= SeqID_78521
tcggattgtttggcatggtggccggtttatacgcgagcgtcagcaatttgataagtcatggatcgaatgaatgcgatgcgacgacgacgactgggacgccaactattatgtggaacctttataatgggacaactttgtctagcagtattcagtgatcgcccttctgtttcatttgtaaatatgttgtatttgattgtctgtacataaacatatgaataataaatttatctttgttaaaatgcatattttatcaatggaaaattttattttttcctttgggaattttgacgatgagcgaatataagggagagaacgatagttttagggaaaagtgacaaaatatatttttaaattaattttaataaattaacacagaatttttcgtttattcttttgatattttctctcttccgtccgatgattcaattgaccttttcattttaagttttcctttcgttttgcgccgtgaataaatgttttctttctaattgatttggtcctttaaattccctcgagaaaaatgggcaaaataattttcgattgacgtcgaattgagggaaaacgaaacgaacgaattaaacgcatcagccaaagcaaacgatttgttgtttttgtatacattttaatctcccaattagtcaatcgccttctttcgtctgatcgtcgcaaattaacgcccccaaaatatttatggtccatttaatttaatttgcccccccccccctcagtcattcctttcaatttttagtccaaatattctccgaattatg

SEQ ID NO: 99510 - DNA, 123 bp, Heterodera glycines
  misc_feature (5)..(6): n is a, c, g, or t
  misc_feature (20)..(20): n is a, c, g, or t
  Promoter: Source sequence=SeqID_35938; Location=1..123; Strand=+; Gene=SeqID_65393
atcanntgcgcaggcccatnagccgaaaaaaagaaattcacgttggcgaaaagccgacgttgttttttttttggtccctaagaattttttctctgatataatttttcagaattaggccttatg

SEQ ID NO: 99511 - DNA, 1003 bp, Heterodera glycines
  misc_feature (911)..(911): n is a, c, g, or t
  Promoter: Source sequence=SeqID_18953; Location=1180..2182; Strand=+; Gene=SeqID_83683
ggaataaacaaaagcaaaaaattatcgaaaatattctaagactttttttacaaagaaatttaaatatccagtcaatttgattttcacatttttaacattaaaaaatcatattttgtttagtgaagatattattccaaaattgtttgaattctccttttcattttaatccaccaattttgtatcacttaaatacgaattactggttctctcattaaaaaaagaaagaaaaaaaataaaatttaaaagagaattaattaatgttcatatttaaaatctcgactaaaattggacagcaaaaaataataaattaaattataaaaaacagcaaaattagttttttgcggtaaccgagtttcagcctcacaaatcaaaacaaaataaaacaaactttcttttgctcctttggattattaaattcttttcctttttttttgtccacaggtttcaaaccaaaaacaaacactttattactatttttgattaattaaccaattaattactcccgatcctcccataatttgctgctgctaatgacactggccactcccctcaaattagtccaaaattacaaattacacacacaatttcctgccgcccatttcgaccacttttgaagtgcacccaaatgggttccttctcccccccccgcacattccctcgggggatcgttcgtcagcaatattttgccaccacttcacccctcccccccccaccactggcgaagtgttcaaaacgccacagttggaccaaaatttggaggaataaaacagcaaaaaaaagaaaaaaattactaccgacaaaatcaagcacacaaattgggccaacagaagaaaaaaatttgtttgttaacttggctgaacaccaaacaaaactttacgattttataattggaaaacgggcaaaaaaactanaaattttgtacaattaaatatacaatcactaaataagataaaaattggcctaatttattaacaagcttggtcaaatgatagtctaaaaaatg

SEQ ID NO: 99512 - DNA, 654 bp, Heterodera glycines
  Promoter: Source sequence=SeqID_27268; Location=606..1259; Strand=-; Gene=SeqID_57954
acctcataaacatcacaatttgcatcacttttttttcatttgctaaaaattatttataattaaaatttaattttgaatgggcaaagtgttgggaaagggctttttctaattgaaggctgtcaaatttcaatttaaatgcgattgacgcaccaaccttaataaaaactaacaaacggtggccgatttgtttgatttggccttccaaaatccttcgccgttttcggttagtcaatacattaatcttttctgcttggctaagcaaaatcttttggcgaagctgattaaacaaaaatggactgaattcgcaaagttatagaggataaatttagacgacaaatgaaaaggtttgaatagtttaaggccaactgcgatgggtgtgagtgaatgaatccactgttggcactatgcctacctcatcggttggcatttcctctcaaaaattggttggcatttgccaccaaattcatttgttggcatttccctccccccaccgtccattttcccactttttccccaattttcgtccttcgcttttccttcactcataagtttgtctattcgatttctatatcttcaaaaatccatttggttgcatctttccaaacacttattatatccatttattaaagagaatcactcagacgccccaaaatg

SEQ ID NO: 99513 - DNA, 378 bp, Heterodera glycines
  Promoter: Source sequence=SeqID_16897; Location=833..1210; Strand=-; Gene=SeqID_81324
tgccaaactgttgccgttccgcgccgtggcacacactggtgaaggagggcgaatgccgcctgataattgcatccgaaatttgcagccgaatacgcgttcactttgggcgtgccattgctgggcaatttcgaattggacgaggatgacagaagagtacgcgcagagatggtacatgcctacggcagttttgtgaagaatgggtaagccaacatgctcattacacctttttggcatttgagatgccataaaatacgtccagctgctgtgtttcacaattccacccggcttttttcaaattccattcttttctaattgttagccatttataatcgcatttttaataattgatctcgtctctcaattagtgtgccaaatatg

SEQ ID NO: 99514 - DNA, 190 bp, Heterodera glycines
  Promoter: Source sequence=SeqID_4058; Location=85..274; Strand=+; Gene=SeqID_45712
gagacataagtgcccgaaggcctttggactgaggaagtggcctaatctcgaactccggagctgtcgtgtgagtgcctgtgcactcgaccacgattgctgatgcagctcgccgtacggctcgtctgcttaccctcgcaggacagcatatggtggccccctgctagctagcatccctgtggtgctgacaatg

SEQ ID NO: 99515 - DNA, 452 bp, Heterodera glycines
  Promoter: Source sequence=SeqID_3313; Location=456..907; Strand=-; Gene=SeqID_84178
taaaatccggcatttgagcgattttctcgacaaaacatggcataacattgcttaaatgcaacaaccaaaatttacaacattcttggtatcattcgatagccaagctttttctcaattagtttacaaaatttaaaaaaaaattgatcaactttgcaatcaagtacaataattctgccataacttatttttgaatttgatatttttatttaaaattttgcatgcttatagagaaaacgcttggatatcgaatgataccaagaatgttgtaaattttggttgcttttaagcagagttaggccatgttttgtcgaaaaaatcgctaaaatggcggattttacgaaaggacccagcacgattgccgtttgaactaattgtaagtgaaaatttcaaatttataatatttattttttcatttaagccttttttacattgggctttcaacccggcaaatg

SEQ ID NO: 99516 - DNA, 156 bp, Heterodera glycines
  Promoter: Source sequence=SeqID_21947; Location=1239..1394; Strand=-; Gene=SeqID_52584
acgaagagacttaaactttattatttttaaacttgcctaatttattgataaattatttcccatacgactttaataaagttaattatggtcgtttttccaatttaatgtttcatttttactattgaaaatatttgtttgtgttttgtgactctgatg

SEQ ID NO: 99517 - DNA, 88 bp, Heterodera glycines
  Promoter: Source sequence=SeqID_16563; Location=1486..1573; Strand=-; Gene=SeqID_80969
tttttaaaattaaagcaatttattctaatttcttagcaatatgaaatgttagaaaatatatttaaatttttagctgaatttactaatg

SEQ ID NO: 99518 - DNA, 65 bp, Heterodera glycines
  Promoter: Source sequence=SeqID_24240; Location=731..795; Strand=-; Gene=SeqID_54957
ttgcagcaattcgcaaattgccaaaacccaaggccaaatacaatctcacccaaaatggcaaaatg

SEQ ID NO: 99519 - DNA, 247 bp, Heterodera glycines
  Promoter: Source sequence=SeqID_7969; Location=1..247; Strand=+; Gene= SeqID_66538
agggattcactttcgcaatttgcctcgccggccaagcgcgcggtgcgcacccattttgggggtattcagcttttcctttcgaaatttgccgaattcggttactgtcttttcattgatttgttccatattaggacatagatccatgcctacgtttttccgtttcttactttcaatgctttttttaactgcaggataggcttcctcctctattatctccgcatttccgctccgatttattcggatgatg

SEQ ID NO: 99520 - DNA, 152 bp, Heterodera glycines
  Promoter: Source sequence=SeqID_42671; Location=1..152; Strand=+; Gene=SeqID_70502
ttcatgaagattttgtgaaaataaatttttttttgtattgttggggaatagccgaggatgggttattattcagtcccaaaaaatattttaataaataaaaaaaacctaaacattttaaaattgacacggaaatttgccatttttacgagatg

SEQ ID NO: 99521 - DNA, 405 bp, Heterodera glycines
  Promoter: Source sequence=SeqID_29308; Location=1160..1564; Strand=+; Gene=SeqID_59819
ctgagaaggaaagtgccaaacggagagaaaaagccaatcaaacggaaaaaatgccaacaaacgaatgaatgaaatgatcgaccagcataatgtatcaatgattatgccataacaaatgaaaagccgacgaatgattaattatgaagatcaaattaattgtccgattattacgcactttgtccaaaaatcagcccaaaatatgaaataaaagtaaaaatagcaacagaataatcaatcgaatatttaacttcgcataagcgaaaacattttgggacgggcggagaatggagggaattcagcggacacttcaaaacacattttcccttgtgaattcatatacataaatcaattaaccaaaaattgtcgaccaaaatatttctcccaattaacgctaatagcccaatg

SEQ ID NO: 99522 - DNA, 1003 bp, Heterodera glycines
  Promoter: Source sequence=SeqID_12992; Location=993..1995; Strand=-; Gene=SeqID_76762
attaaacattggatagaaaagcatcagaaccaattgaataatattcactgatggacgtacaaattaacaagtccaatcatcaattcacaatcattttttgcattggaaaataattccaaaacaaaaaatgcattaatgtgattttagattataatctatttgtgccattaattcaaataaatttgaaaccaattaaattctctcgacaaacgattattcctagaaatttaaatttataaaaaaatttttactttattaactttctttgagattgttttcttaaaaaattctaaaaaaaaatttctttgagagaatttcttgcaaaaaaaaattttaagtgcgagtttgaagcattaaatttgtttatcaaaattattaatcgtttttcaagctaacttatttattacagcagctcaactaatttacaaaccaaaatgaacacaaaaattgcacttataatttttggcactaccatctgctggcttttgccacgttcatttggtaatcgtttttttaataaaataaaaaaatgaattttttaataaagcattgttctgcaaaaaaggatttgccgaagaattgtctggtgccgtgtaccgcaacaaaaagggtgtatgcaaagctggttttcagcactgttacactgtcacctgcacagcatgtcaatggatttattatgcattaaccagattttttttttagaattttaaaattcaaattttccggtattttttttttttgcatggactactgaatcattttgaaaaatttattgaaaaataccaaaaagttaaccattttctcatgcaaaaaatgacttgagtagtgcaaaatagggaaaatgaatgatgaaaagagggatggattttggtactgaagtcgaactttttttcaaattatttaatcaacaagaaacatttggtctgatcattttgctgtccattttttaggggatcagcctggaaacacttttcattattggggttgtgccaaatccgaaatg

SEQ ID NO: 99523 - DNA, 560 bp, Heterodera glycines
  Promoter: Source sequence=SeqID_3098; Location=1843..2402; Strand=-; Gene=SeqID_83189
agcagcaacagtcgcaacagcaggccaaaattgacggcaccaaaacggtcaagcaacacaacaccgtgagcaaaatgagcatgtcccaaaacaggatttttttttcatcataggatagacctacccaaatttaaagtgtatgcaaatattttctggaaatttccttgcattaattatataatacatgaatttccgccagtttttcgcgcaaaataatttggatgaaaaataaatttttaataatgcctttattacgaaacatttcaaacttgaaatttttatttttgaaaatatgttgtcgaaagaatcttctaccgaattatggtctaacatattttattataaaaaaaagtttggcatttattttttgcagataaatgcaaatattattgagaaaattgatgttgtgttgtacatttgtggagcacgtgaaatgcttgttaaataaaagtggcattttaaatgaaaacttatataataatttaaaaggcttaaatatattttttaataaaatgtgccaaatccctttcatccacctatctcttcttctgataaccatg

SEQ ID NO: 99524 - DNA, 348 bp, Heterodera glycines
  Promoter: Source sequence=SeqID_7208; Location=374..721; Strand=+; Gene=SeqID_64153
tttaagaagaaaacgaaacaggcttaattaagtttttgatgctatttcatatgagttcataagctattggaatttgacaattcttctatgttgtattgtaccacaccttgtcaattttggggccctagcagttcaaaaaagatttagatgtttggcgaagtggtttttgtaatatagcaaagttaaaaattttgttttccaactgtgtttggctctcgaattttgtgtcattttgtagcattttttgtcggcttaccaatgataccttacttcactataagagcccaagtttttctagtatgtttttgcataattaagaaagttgtggatgttattcaaacaaaaatg

SEQ ID NO: 99525 - DNA, 198 bp, Heterodera glycines
  Promoter: Source sequence=SeqID_1008; Location=5302..5499; Strand=+; Gene=SeqID_65977
agcgtaaaactaaaaatgtacatttagttcttaaaaattggttgcgatcaaatactgtggagtcaattaacgcaagaagcgttgaccacggaggaaatacgcctttgatttgcgccatacagcggaatgtttgttgttttttctatttaaaaataatttttatttgcacttataatagcacctcttgcgtgcacgatg

SEQ ID NO: 99526 - DNA, 84 bp, Heterodera glycines
  Promoter: Source sequence=SeqID_31827; Location=1..84; Strand=+; Gene= SeqID_62133
tgccgggggtccgtcttcgatcgctgtcatcctccaccggcgaccagcacgtcgacagtagcaacgacaacagcctcggagatg

SEQ ID NO: 99527 - DNA, 1003 bp, Heterodera glycines
  Promoter: Source sequence=SeqID_2695; Location=305..1307; Strand=+; Gene=SeqID_81124
ttctctctctgtttctcattttatttctctctcactctcctctctctttctctctctctcgttctctctctgtttctttctcttctatatctctctctacccctctctctcgtttttctcctctatttcctctctctctctcactctttctctttcactctctatctttcactttctttctccctctttcctctctctcccctctgttgtccctttctcctctctctttctctctctgtttctttctcttctatatctctctctacccctctctctcgtctttctcctctatttcctctctctctttctctctttctttctctttcactttctccctctttcctcactctcctttgttgtccctttctcctctctctctctctatttctttctcctctcccccttcctctctatactcgctctctctctcactctcttgtttctctctctccacccaacggcaaaaatgttttttttcacggtttttaaaaatgcattgtttattttgatctgtcttaaatcggttaatcaccaactaaactggacaattctagtatcgctctaaactttcaattttcatgtccctataggcatgcaaaatttgatttgaataacatgcagaaaaagagttatacaagtacgtcaaattgagagaaatgacaaagaaaaagagaaacgaggagatattatcgaatgaatccatagtgtatagttcatattctcctgaaagacccctctttatcatttaggcctaagcctggattccttgctcatatattattttttaatcgaaaattattaaagaaacaagagcatttcatttaaaattactcttgtttcttttccagcaaaatctcttcagcttctacactctatcgttggtttatttctgcttcttttccttatgaggtttttttttttaaatttaatctatacccatagaatttttactttaatttacccgtccgcttttcagtaatattaaatttatattgtatcaatg

SEQ ID NO: 99528 - DNA, 94 bp, Heterodera glycines
  Promoter: Source sequence=SeqID_14789; Location=416..509; Strand=-; Gene=SeqID_78932
tgcattttaagcgtccaattgacttttgcaaatcaccgaattgctcccccgttttattttcaccatacaataataaatcttggtttatacaatg

SEQ ID NO: 99529 - DNA, 254 bp, Heterodera glycines
  Promoter: Source sequence=SeqID_25227; Location=1980..2233; Strand=-; Gene=SeqID_55975
ataaacaaatgcataagccaagaaaaattttatttacctccccatgattggcttttattgctgtaattaattggtcacttgaaaaaatttgggtggagaatttcgggagggcctcttttggatttattgaataaattaaaagataaaaataggggattcatttttaaaacatcctcacttacccgggcccgaatttttgaaaatccaaacccggtgccgagccggttggtccgcaaaaaatcccggtaaaaatg

SEQ ID NO: 99530 - DNA, 262 bp, Heterodera glycines
  Promoter: Source sequence=SeqID_7841; Location=1..262; Strand=+; Gene= SeqID_66133
tgttttgcgtgatgatcaaactgaagaagcaccaccctcgatgaataccaatgatgaagtgttgaacaaatttgctctgtcacgacgcatcgaaatcatcaaaatcggacggaaaacggttttttttcttcaagtttttgcttgtacaattatacaaatttaactatgttagacaaatgttgtggacgatgatgaggaggagggcttggttggcattccgcgaattgtggaatccattgaaactgtctgttggccgaacatg

SEQ ID NO: 99531 - DNA, 167 bp, Heterodera glycines
  Promoter: Source sequence=SeqID_713; Location=7521..7687; Strand=+; Gene=SeqID_59589
aacttattctgctgccgtacgagcactaaaaggggctggttggagcgagggagacaaagaatgacgacgacgacattgctgagcggacaaacttgggctttgtcaaacgacaagtgaccgctgcagtacagaagcggaagggaaacgtcagcgaacggaacgcaatg

SEQ ID NO: 99532 - DNA, 996 bp, Heterodera glycines
  misc_feature (900)..(900): n is a, c, g, or t
  Promoter: Source sequence=SeqID_8226; Location=4013..5008; Strand=+; Gene=SeqID_67363
tccctgcggcatttattacagcgccactaaatttttttattaaattcatttatgcgttaaatttcaattaccgtataccgttattttttggtttttcgaattacggtagtcaaaataagcgatgcaacttccattaagcgtttcaggtgattggtaattattgggagagattacggtaattggtgcgaccaggaaaatgaagaaaaaaagcatttttatttaaatgtaacttttgtcaaaagaaacatgctttaaataagcaaaaactcttcgtattttaatcgcttagtgtaaacaaacgactttattttcttgtcagttccaatttttaaaacattttttaacataacgtgagatcgccaacttcagttttatctaaagaacaaacacaatgtcttctagcgcatgcgcaaacaaagtgaacttttttatttattcatcttattgtggaatgaaaaaatctcctaagttgaataaaattgtaaaatgtactttattcacaaattttagctgacccacaaaatgtccagcccacgaaatgtccaagtctcgaatttgagttttttattattcagatgggcctaaggttaggcaaggggtaatataaagggtatattcgtattcagcgactccgaaaaccctaaaaatcctaaattagactcattttgtttttataaattttgaaaaattttggacatttcgtggcttggacactttgtggtggcgcccaaatttttgatcggactcataaactctgactggacttacaaaaaaatgattggactcataaagggtcattggactcataaatatttgattggactcaaaaactctgattggactcataaaactcgattggactcataaaactcgattggaactcataaagtgcattagagnccgatttttcagagtaccaatcatcaaacatggatcagcgcttgtaccattttaatgactggcattatttacttaattgttggcattttaataatg

SEQ ID NO: 99533 - DNA, 320 bp, Heterodera glycines
  misc_feature (173)..(173): n is a, c, g, or t
  Promoter: Source sequence=SeqID_34105; Location=583..902; Strand=-; Gene=SeqID_63983
tgtcgatataaagcctttaaaaagacaaatatcaaaattttcggccaatgtaaaacaaatgggttgtgctttatacgttttaataatataattaaattgctaattagataacaatacattcatgtacacttttatacaactgttcttcaactttctgttttgtccactagttntaatacacgcaaacacatgtgtagatacgcgaaatacactccttaaaatcggcggaagtgaaagtgtgaaaggcgtataaaaatcgatatctcattctacagtatcctttttatgtattggttgctgcaggaggcagagaaaagatg

SEQ ID NO: 99534 - DNA, 395 bp, Heterodera glycines
  Promoter: Source sequence=SeqID_15779; Location=617..1011; Strand=+; Gene=SeqID_80103
attttattaatttattaatataaaaaaaattaattacacaccggaaatgttaatgtatgggttgtgaaccccagcaaaatcaatccggtccgcaccaacacgaagtcgggaacggcgccaacgatagagaaaacaaatagacacaacattagtgaatgaaagaaataaaataatcaaataaagtgccgaatttggggatggtgaatcgacggggggaaaagcagcgacagcaacggccgaatcattattaaggcaatatgtattacaaaattttgtaacgttttgaaacatttttctaaatagaaaaagtaatgaaaaattaataaaggcaataaaattttattaaatacaatttgttctagacaaaatatttaggaactaaacggaaatcaatg

SEQ ID NO: 99535 - DNA, 67 bp, Heterodera glycines
  Promoter: Source sequence=SeqID_43323; Location=707..773; Strand=-; Gene=SeqID_71028
aaactagcggggtcagcgccttcggcgcatcccccgctaggtagtacgattgtattataggattatg

SEQ ID NO: 99536 - DNA, 379 bp, Heterodera glycines
  Promoter: Source sequence=SeqID_2239; Location=3918..4296; Strand=+; Gene=SeqID_78647
ataagagaaataaatttaaaaaaaaaacataaataaatttggataaaattttcaaagattaaagctaaacttaagtgaaattcatttaatagccaaacttattgaccctcttttcatttctctccaatcgttggatcttgcacccatttatgccaacattagccccttagtttaatgatgcattatgtacattgccccgccttcttctcaccaatcggtcaataaattctctccatagccactcattttcattttctgttttctttttcatcttgctcgtttatgaacatttttttttcactctttttagatctgagcaaaaattaatcccaataataatctgaaccccttcgcctgcgggcaagaaacagaaaatatg

SEQ ID NO: 99537 - DNA, 221 bp, Heterodera glycines
  Promoter: Source sequence=SeqID_11793; Location=1441..1661; Strand=+; Gene=SeqID_75294
aagcaaaacccaaataaaggattattttcgagcaaagtcacaaaaatttcgattacagaattcattttctgatatgtttgccgagttttaagttaaaacggtcccctaatgacataaccaggctcttcacttatttaaattatcaaagtaaatcgtaaaagttaaacaaatgagaaatattaatgttttgccttttacagaacatcaatttggccggcatg

SEQ ID NO: 99538 - DNA, 88 bp, Heterodera glycines
  Promoter: Source sequence=SeqID_21101; Location=1951..2038; Strand=-; Gene=SeqID_45622
cgtgcgttaacattaatggattttctgtggtttcggtccgagagtcttggtcttgtgactgagtcgaaattttcaactttttaaaatg

SEQ ID NO: 99539 - DNA, 1003 bp, Heterodera glycines
  Promoter: Source sequence=SeqID_19306; Location=1327..2329; Strand=-; Gene=SeqID_84046
tatttgagtattaattcaaaaaaaatcaaatatatgtagtggcacataagtggcaatagatttggactacccttcggacagtgcactggaatgacttagcaaaaaatggtctatcacgtgcaaaacaagaggctacttcacccaaaattgtaataaatattttaattcataattttttactgttttctcatgaaagtaaattaaagtttaatttataaagaataatgcatatttacttaaagcaaaaaacttttcaatattagaaaaaaatatacattttcataatctaaaacaaactattgcctcgtctcacactatttctttaaatgtgaatgaattgactattttacagaaaataaagcattaactttgcttgaaaaaaatttgtattgaaataaatataaaattttaatctaaaaatgaccaaatattaaagaacataagattcaaaaaaacaattaccgataaacatcaatttaaagcattttgtaattaataatgaagagaaattaaatttttgaatttacaatatgaactcaggattataaccggctagctcagtaatcaactaaaaacaaataaaaacaaagtaaatacagttaaatgaaattgaaattattttgcaatggattcaatacttaaaaatttaataaataaaatcaattagctaaaatattcaaaaataagagcattctaaatttaaagtattatttacttattttaaaaatcttatgacattaatagggttatattcaaataaaaagcatttttcacaaaatgaacagcccaaattcaaaagcacgagttaccttaaaaaatgtaaaaaacttgagcgtttgacggaagaaaagattaaaaaattttaactataatcactcaatccaacaaaaattggcaatttttttttgtaaacttttcgccaaaatacctgttttttgagatttcatctacctacctaattatttttagtttcttacttacctttttggtcttttaaatgatg

SEQ ID NO: 99540 - DNA, 177 bp, Heterodera glycines
  Promoter: Source sequence=SeqID_4289; Location=880..1056; Strand=+; Gene=SeqID_53907
tatgcaaattttttcggagtttatgcaactgccaaaaacgaaatttttcggaaattgtaattccgagggccaaaaattcgccataaatttgttttttcgagggcccggttcagtaaattgtctgtcactcaatcaatgctaatttcttttttccttttccaggaactccaggacatg

SEQ ID NO: 99541 - DNA, 420 bp, Heterodera glycines
  Promoter: Source sequence=SeqID_4973; Location=1050..1469; Strand=-; Gene=SeqID_56418
actcaactgtttacttccaaccgtgacaatcatttataagataattttttgtcaatatggatctctaatttatttatgaggacatcagagataaaagttagcagcaacaatgatatccataaatatggccgaatcggaaagtataaggaatattgtcaatagacatcgtagtttgcagttattttaaaattaacgactaatctattccttttgtcttaggctacaaaataaaaaacgaaaaaacatgcaaaattattcgctgctgaacaattcgggctaaatctgaaggcttcctgcttataggaacccaaaggcgcgttcaacacgaagcaaaaaattcctttatttattccaaagctgtgttataataaatttaattatattttgtatttttacaggaactcagccattgttattatg

SEQ ID NO: 99542 - DNA, 91 bp, Heterodera glycines
  Promoter: Source sequence=SeqID_11196; Location=2349..2439; Strand=+; Gene=SeqID_74548
gctttacatattttaatgattataaattatattaagtatcatcacaagtgcaataataagagaaggtcaattagaccgaactcacaaaatg

SEQ ID NO: 99543 - DNA, 85 bp, Heterodera glycines
  Promoter: Source sequence=SeqID_1481; Location=1172..1256; Strand=+; Gene=SeqID_73828
gaatcttacggtaccgtttgcaattttctgcttctccgataggcaccatgttcatctgcacaaagacacaatgcattccgccatg

SEQ ID NO: 99544 - DNA, 186 bp, Heterodera glycines
  Promoter: Source sequence=SeqID_14954; Location=1..186; Strand=+; Gene=SeqID_79116
tttagcggtggtcagcgtgtgccgttggacaagcaaacgccaaaactcactgaacagatgatcgagaagtggcaagttctgcccatcgacgtgccgcgtggcattgacacacagcgcgacaaagcaatgatacagaacgccaacccattttttcatgcgcactcagtgcgtgtcgaaacaaaaatg

SEQ ID NO: 99545 - DNA, 397 bp, Heterodera glycines
  Promoter: Source sequence=SeqID_27; Location=6783..7179; Strand=-; Gene=SeqID_83722
tttagtgaagtgaagtgccattgagtgaagtgaagtgccattaagttaagtaaagtgccattccatgaagtgaagtgccattgagtgaagtgaaaatgaaatgaagtgacattgaggaataaccagtggctttaaagactgataaattcaaatcgctccaataaatctatgagtgccgtactgacgaggcccgctcatagaataaattatcaaaccgtgtatacggcttgatgggccgaaacacacctttcaggttgtggtaaacgctacgataactcaagggttccaattatttattattgcgtgccatcaacgcgcagcataaataatttaatattttatggacaatatattaatgtttcccttcccatttaggtattacaattgaattgcaatg

SEQ ID NO: 99546 - DNA, 216 bp, Heterodera glycines
  Promoter: Source sequence=SeqID_15338; Location=3432..3647; Strand=-; Gene=SeqID_79582
ttcatatttcgctattagcagcttttgctcttttcagtttatgattttgcaaatgatttttgttttgatttctcctctctttttgcagttttttcatgcctttttatttgtcgtttgattatttaacaaaagtaattaatatatttatttgaattataattgaaaaattttttgtaaatttgtatttaatgattttctaaatttgttcagaaaatg

SEQ ID NO: 99547 - DNA, 1003 bp, Heterodera glycines
  Promoter: Source sequence=SeqID_17250; Location=972..1974; Strand=+; Gene=SeqID_81720
aaattttgccgtttttcctttttcgttatttatttttttatctaattttttaaattaaatttgcctctcaaaaaagaaatttttacaacaacagtttcaaccggcgttctgacaaatgcggaagtgatcagtgtgtttctttcctgccgtgctggcgcgtttcttaaaactgccatccttgaaaattgttcaaaaaattttcaaaaattaattttttttaaaaacaatgaaaattttcaacgaaaattctaagagaaaattagaatttttgaagaaatatttctaaaataaaaatgtaaaaaaattcataactttactcaactgcaaccaatattttatggtatcattcaatagctttaattattttctattaaaatattaatacttaaattttttacaaagtatataaaaaagtttgtattaaaatttaaaaatttttagtttttgaaattctagtgtttaataattatacaaaaggttttaaactccaaaaagaaattaaatttcaagtcattaaaatgcaattcaaatgattttttttagaaaagttcataattttttatttattaatttacgaataaaaattaattttcccatgtttttataattataatattccaaaaatttttaaaaatatttttcgttttcaaaatttttcaagaattttcttgaaattagggggggtggcagtttttaagaaacgcactagcacccgagagaatgagggaaagggggaggggaaagcaataattaaaatatgaaaaaagtttggagtttggataactatttataagtgaaaataaaaagatgaatttaataaatatatgcatttaatggataaattttggggtgatatttttgaaatgagacgggccaatgaatggggagggggggggggacggatttaacggacagcacaaagtccattaaatgcaaaaaaggggcccgccaattttcgctaattttattttgcacaattgtattcatttaaattttgcagatg

SEQ ID NO: 99548 - DNA, 307 bp, Heterodera glycines
  Promoter: Source sequence=SeqID_22219; Location=1249..1555; Strand=-; Gene=SeqID_45701
ttaaaatactttttgtctaaagttcatgaaagagatgtgtgtggagcagcgaaagagtaaaaatacaacaataattatttgttcactatggaaaacagagacaggtcgggacgggatctggcgcgggatttcagtctcaactccttttttagaagttacaagggtagacagttcgccaaaaaagaaaaatttaaaaattgaaaaattaaaaaaataaatgtgatgatttttaattgaatttttacggagcttaaattttaaatgcctaaccgctttttgtaagcttgattttagcaaataaactatg

SEQ ID NO: 99549 - DNA, 876 bp, Heterodera glycines
  Promoter: Source sequence=SeqID_26395; Location=1..876; Strand=+; Gene=SeqID_57126
ggaacaattttgagaaattttccacttcttatggggatattctaaaaaattaggtcgattcttagcgggtgcttttttgttctattgcattttatcgagaagttttccaaaaaaaatgtcgaaatagtgaaaatagtgacaaacgccaaaatagtgatttcgataatcgatttaaaacgacccaaaacgatgagaaaaatggaaattagggtgcttggcattttacaaataagaaaatcgggtactgagtgcccaaaaaaggaacataaaaatggcataaacaaatcatggagagaaaattgttggcattggcactatttccgagctcaaattttagaaaaacattccaatttcaaagaaaataaaaagttacaatactttgttaaaaagaattcaattagataaaaaaccccattttgcagatttatgctcttttggttgctttttggctttgccactttttagggcatctccatgttttatcaacaaaaattgaatttttaaggtaaagaccggtttaattttgtgataaaatttacatgatctcctaattattttaaaatattgaaagatttgtgaaattaatggactaaaaattttaaaatttaaaaaattataaataaaagaaaatatacatatttcaaaataatatattgatgaagaaagagcaaaataattatgaaatcacaggaaggaaatcgaacggcatagacaaatcaatggaaaaatggttggcattggcatcatttcctgacaaaaaattttggaaaaacatttccaatttcaaagaaaataaacgatttttggaggatataaaagccaaaaaaagaaaagcaaaaaacataattaattaccttttcaaatcattcaaaaatg

SEQ ID NO: 99550 - DNA, 573 bp, Heterodera glycines
  Promoter: Source sequence=SeqID_16007; Location=1..573; Strand=+; Gene=SeqID_80359
aaaaaaaaataattttttggaaggcaaattcttttttataaaaaaaaatattttaccaggaatatttcagaatcccaatttcggattgcgatttagggaattttttgagccctgggaataatttccgattgccgaaattttttgagcccgaggaaaaattcagattaacgaaattttttcagccataggaaaaattccgattgccgaaatttttaagccctcggaaaactccgattgccaaaattttttgagccttcggagttccgattgccaaaatattttgagccttcggaacaagttccgattgccgaaatttttaagccctcgaaaaaactccaattgccaaaatttttaagccctcggaaaactccgattgccaaaattttttgagccttcggaacaagttccgattgccgaaattttttgattgagccctaggaatttccgaatttgttgaaggcgtcgccacatattgctgatttctacaacattttgaaatttttgatgtccagaataatcaaagtattttttaattacatttttttagatgaagagattttgcgacatgtaatg

SEQ ID NO: 99551 - DNA, 441 bp, Heterodera glycines
  misc_feature (78)..(78): n is a, c, g, or t
  misc_feature (86)..(87): n is a, c, g, or t
  Promoter: Source sequence=SeqID_38216; Location=1..441; Strand=+; Gene=SeqID_67103
gatgaaaaggaggaaaaccaatcaaaaaaaatgaaaaacagcggaaggcatttggccatttcgccaaataaatgagcnaacaaacnnggattttttgaaaattttttgtcatcctacggtaataaaggtacagagtatatagagaataggtatgtaacggaattttgatactgagttggcaatttaactggaactcaataaagccacatatagcggcgagtaagccataaacaaagtgcggcgagttggccgcggtgagttaagcgccgcggcgataaatttgcgacgaattgtccgcgccaagttgggcggtttctaggaaaaatctgaaaaaagctaaaagcgctgaaacccataaaattttgagcctttttcaaattttggatagtggtaaattttatgcttaacgaattcgtatagttttaaataaattttttgatg

SEQ ID NO: 99552 - DNA, 156 bp, Heterodera glycines
  Promoter: Source sequence=SeqID_27446; Location=431..586; Strand=+; Gene=SeqID_58144
tttttgttgagaaaatattttgtggtaaagcttttttaaaatcattttaaattaattttaaataaaataaattaaaaattattttaaatgcatttaaatgaaatgtttttattcatttgtgtgggaaggaatgtaaaaaaacaaagtgaaaaaatg

SEQ ID NO: 99553 - DNA, 125 bp, Heterodera glycines
  Promoter: Source sequence=SeqID_7471; Location=1549..1673; Strand=-; Gene=SeqID_64932
gacagctttcattattcataattttaaagtatttaacaggaaaaaatgattaatcgccgcccattttgaactgaaaatgtatataaatgacaaagacaaattacaaattgcaaaaaataaaaatg

SEQ ID NO: 99554 - DNA, 155 bp, Heterodera glycines
  Promoter: Source sequence=SeqID_31276; Location=1173..1327; Strand=-; Gene=SeqID_61645
tttttttttgagttgagcctaaactaaatgataaataatttaattatttatttaattatttaaagtgggaaatggaaaatccgtgcctctgatgggaacgaaatcattccggctctaatgcactttatgagtactatataacttgaggatcaatg

SEQ ID NO: 99555 - DNA, 317 bp, Heterodera glycines
  Promoter: Source sequence=SeqID_8941; Location=816..1132; Strand=-; Gene=SeqID_69740
ctgatcattccttttgcaaattatttctcatttcaatgcttgacagctaaaaaacttgccccaaatgtacagtttgctaatttgcagtccaatttgcgtaaaatgattatgagtaatgtttgatattaatttacttgaaaatttatgtgcaattgctgcgcattcatttttaaaaaatgttcttttttactacaaaattttattttttgaatatttttttgaaactaagatttttcttttcaatactgaatgaatatgtttataaaatttcattcttttcgagaaactgagtctatttttcagaaacctaaaaaatg

SEQ ID NO: 99556 - DNA, 175 bp, Heterodera glycines
  Promoter: Source sequence=SeqID_16847; Location=273..447; Strand=+; Gene=SeqID_81270
aaaaataaaatggtttttagctgcctacctgagaaagtttaaaaatgtctttctcttcaccatggttttgatgaaagagtcgatctaacatataatttcgtgattaacctctaattacaaggaatacttatgtggaaattgtggtatagagcagaatccgggaaagccaaaaatg

SEQ ID NO: 99557 - DNA, 289 bp, Heterodera glycines
  misc_feature (11)..(11): n is a, c, g, or t
  Promoter: Source sequence=SeqID_43090; Location=1..289; Strand=+; Gene=SeqID_70852
ggcccattttncgggaacatggatttttcctgggcctggattttttgtccaggaaattcaggttttttcaaaatgttaaactctaaatttttgaactcctcctcccaattcaatgctccataacttggcaaagaaacaaccaataaaatgctcttctgttcattcaatagcccaaaggaaaaagcttaaaattctgaaaccagtatttttcaacaaaaaataatttttttttttttttgtaaatgcaaagctaattaaaaaaccctatagggttagagttatccaaatg

SEQ ID NO: 99558 - DNA, 97 bp, Heterodera glycines
  Promoter: Source sequence=SeqID_1974; Location=1..97; Strand=+; Gene =SeqID_77115
gatgagtttgcatcgtgtgttatttaccacgagccagtgcccgtgtgcaaaaacgataaaattgaattgaaggagccctttcctcccttcaatgatg

SEQ ID NO: 99559 - DNA, 149 bp, Heterodera glycines
  Promoter: Source sequence=SeqID_34420; Location=1..149; Strand=+; Gene=SeqID_64217
ttcctggtgctgctttttggcatatttttaacgccagctgcagtgaatggtgaaattgatacgttcaaatatcgtccatattttggcgaacctgtgaaccatcattatcatcatagctcggcagaggtctctgacctcggggccggatg

SEQ ID NO: 99560 - DNA, 596 bp, Heterodera glycines
  Promoter: Source sequence=SeqID_4390; Location=1155..1750; Strand=+; Gene=SeqID_54272
attttttccctttattttagaaaaaactgctaatttgtaaaaaattagaaaaataagctaaaaaatttttagcttttttaaattttctctgggcgggggcgagtatataactttaagcatgttaatttattatttagaaattaatttttcttcaaagtttgggtttcgtttaggttcttcctcctcttctgccgctgctgctgatttttcgtccacttcattcattactacagcaatgttgactttagcctcacaatcagcaaaaactctttgctgcagtgaatgtccatttggtagaaaaaaaaaattttaaaacgaaaaatttataaacaatttttttcaaaaaaaaatcaataattttctcaattagacacccattgtgcaacatatgctagaaaaagtaccgataaattaggggttttacgattaataaatttttctgaaaaattcttcttttgtcatttctacattccgcaataaaaactcaaaataatatacaatattaattattttttaaatttcctcatattccaattaattacattaattattgtacaacagaaacggtgcactcggtgctgctcaaactgcacatg

SEQ ID NO: 99561 - DNA, 506 bp, Heterodera glycines
  misc_feature (16)..(16): n is a, c, g, or t
  misc_feature (35)..(36): n is a, c, g, or t
  misc_feature (43)..(44): n is a, c, g, or t
  Promoter: Source sequence=SeqID_3268; Location=1261..1766; Strand=-; Gene=SeqID_83974
tgcagcataaagaaantcaatgggtgaagaaacannttttgtnntttttggaaaaataaatttaaatttacgaatcatttcattcgcccaaaatgttcaggaaaagaattaccttctttagatggaaaatttaataaattttcttgtaaatgaatgactaaaattccaatttgagggatgctttttttcctttttaacaaaaaatggcctcataataaaatttgaaacaaagacagtaaaactaacggaaacaacggaattctgtccatcactgctctgcatgtttggcaattatgaaaatgaattttagcaagtcaaatgaaattttggaaattttacgaaaaacttcagcgaacatttgagtgccaagctcaaatttatcaattgtaaagccgactttgaaatttggttctattattacagagatgccaagtgcacttatttctagttataccgattttgaaggcctaaatcttaaaattaaaatgtacaggtttctaagaatg

SEQ ID NO: 99562 - DNA, 680 bp, Heterodera glycines
  Promoter: Source sequence=SeqID_9705; Location=610..1289; Strand=-; Gene=SeqID_72428
gcttaaaatgtaattcaattcaattttatatttatttaattatataatgccaagcggcaaatgcctaatttgtcatttaatttaattagtctaatttcattagccctgtccttaattgatttggtttgatcacttttaaaaattaaaatatttgcaaaaaatagaaaaaaatcgatatattaaaaaataataattaatattagcctaatgattccattgtagcggcgaattttccaatcagtttttgtgattgattctatttgttagttaagtacttttgatcagtgaatgaaaagtccagcttggattccaaaatgatccgttgcttttccgcttcgcgatgtgtacacaaacggatgcgaaatccgtacgcctttggcgcgcgttttggagatgttcttggcaaaaatatttaaaaaacaattggagtggcaaaaataggaaattataatatatgattaaaagcacaaaattccatttttttcaatgcctttaaattttttgagcactttgaaagttttttgcaccaaaaagaacagtttttttaaatattcaagataatgggaaaaataaggacggaatttctgaaaatttaaaatcatagaattaaagactaatgacagtcctcgaatttgtacattggttatggtttttttaaaataattttatcacagataatg

SEQ ID NO: 99563 - DNA, 263 bp, Heterodera glycines
  Promoter: Source sequence=SeqID_13287; Location=1665..1927; Strand=-; Gene=SeqID_47120
gaagaaatcaatgatttgtcactccttccgtccgttcaggatgggattttctccttgtgttgcatattggtggagagggtgacttttgttattccataatattcccgggatgggaatgttagggccggggaacgcttggttttggtaaacagggggatttatctgtgcataaaccatttcgggattttgttggaaatttcttggattcggaaattggccatgattgcgtcggttatcattttcggagaattgcaggttcaatg

SEQ ID NO: 99564 - DNA, 1003 bp, Heterodera glycines
  Promoter: Source sequence=SeqID_20412; Location=737..1739; Strand=+; Gene=SeqID_50935
ttaaaatctaaatttctccctgaatccaaaaaataagatgaaaataaggacaaagagcttaaataaggacaaatcttacaaataaggacatttcaaatttggaccctcaaaataaggacaaatcttacaaataaggacatttcaaatttgtaagatttggaccctcaaaataaggacaaatcttacaaataaggacaaagggtaaccctggtattaacagtttttgttgggatgattttttcaagatttgcttgaagaaagacgggtcggcacgtcgatagagtttttatttttaaagaaattttcgccaaaaaagacttttcttgaatttggcaaagagttctctttattaatcaattctaaagtattatctttgtgacacattgggatatttacggacaattttggggaaaaaatagagtttctttgatttttttttattaattagaaaaaattctatatcttttttttcggccgacatttttaaatttctccagccattcccgacaaattttattggggaatttcctccctgaattttaaaaaaatattttttttcaagcaattttttttcaaaatccaagactcaatagactgcgttttgaaaaactcgaaacttttctcaaagtcgagactctcaaaacgaatttaaagattctttcatttttttttgaaaaatttcgtcagctattttctcaatgtttttgttataatatgcaacattaatgccaaacattgtcatagattttttatttgcatcataattttgtattgcgcataaactgcagcatttacgtcatcaaaatttgtgaatattattataatttatgtacatttcctcccatagacgtaagcaaaagcctatcaatattaattatccaattttaatatgccaattgattaatttaatagcgacggataatggttacttaaataatcaggcagtgtataatttttataaatttcatttcatttttttctaaaaaaaagtcatcaaaaaatg

SEQ ID NO: 99565 - DNA, 121 bp, Heterodera glycines
  Promoter: Source sequence=SeqID_26543; Location=833..953; Strand=+; Gene=SeqID_57281
ggtggccggcctaccatatttcgttaaattgttttgttttatcaattttgtttagacatttctccgtgccaccacttctgtcagttacaatattcaactttatttttatacgacaacaatg

SEQ ID NO: 99566 - DNA, 161 bp, Heterodera glycines
  Promoter: Source sequence=SeqID_11019; Location=1618..1778; Strand=-; Gene=SeqID_74345
agtttgtttaaatttaaaaccaaataattaatgctgtgttaaaggcggaatcaaggcgacagaaaatcaaagaaagtgtcctggccgagccgtgtctgaagcccacgcgacttttggcaaaagtgaggcgatcagcaacagatgaagcatttgtggccatg

SEQ ID NO: 99567 - DNA, 631 bp, Heterodera glycines
  Promoter: Source sequence=SeqID_23490; Location=645..1275; Strand=-; Gene=SeqID_54187
tcgtctttctcgtagttaaattattcgtaacataattatcacagccattctattttatcgtaataaaaattataaaaagttttcggtttttttttttattccgtcatttttcgttttcgtcatctaaaccttctattccctaatttagacccgtagccagaaaaaaatttggaaggaggaatccgaataccttttaaaatttcatcaccaaagcgaaaaacccgggctctttcgcgtcaaagaatatttttcgtcaactagtgactggcggcagggatgtgtaaaaataaaaataaaaagcggaagtgagaaggcgaaagcgaaaaggcgaaattttagattttggggtcgaaaatcggaaaattttttcaaattgcttcaaataaattattttttttaatttatttcgaacaaaaagtttattaaattagtattttcgaatccctttattaattttaacagattttgcggcgtatttttcgaaaaaacttttttgggacaaaggaggaggagggaggcatgcggtgccgataggcgccgcctggaaaaaatttgaatacaatacattgtcagattttgttttgtctaaaaataaccgctcccgtaaaaattccccgttaaccgaaaaatg

SEQ ID NO: 99568 - DNA, 132 bp, Heterodera glycines
  Promoter: Source sequence=SeqID_9553; Location=2196..2327; Strand=+; Gene=SeqID_71869
atttattgtttaataacatcattttgaataaatgacgccttacaatgtttttggtgtaacgggagtttttcattcgctattttttatcagttttataacaatacacctaattaggttttaagcataaaaatg

SEQ ID NO: 99569 - DNA, 457 bp, Heterodera glycines
  Promoter: Source sequence=SeqID_3016; Location=152..608; Strand=+; Gene=SeqID_82797
tttccccagcaaaatgttttggatggagaattggacacgcttttttggtcggcacgggatggagccgcttattgcaaattattactagtaaattcaaaaaaaattttgactcactaaatttgtccaaaacttatttcaaactccataaaattttctgaattttcacagaataatagaaaaatgtttgagctatcttttcgtaaatcctccaaaaaaaaaggtcaaatgtctcacatgttttaagacaatgatgatatcggtattcggcttggtcgtcttgaaaatttctcaacccatcgatcaacgccacaattgtcgagcggctgggtcgccttgagcagcttatacagaaacggtcaatgacaacacaaaaaataatcgatccggggactcaatgtccttctccacctcctcacccagtgttctctgtggtcaaccgccgcctcacatcggaatg

SEQ ID NO: 99570 - DNA, 67 bp, Heterodera glycines
  Promoter: Source sequence=SeqID_35387; Location=316..382; Strand=+; Gene=SeqID_64949
ttccaatcactggaactcaattcttaggctttccaatcactgggactcaacccaccaactttcaatg

SEQ ID NO: 99571 - DNA, 606 bp, Heterodera glycines
  Promoter: Source sequence=SeqID_16418; Location=1..606; Strand=+; Gene=SeqID_80821
ccagcatttcccagccgttaattcatttgtgcatggcttttctatcgaaaatggttggcattatttagcaaatttatttatttttatttttttattaattttatttgccgtttaataaacttcctcgttatttggtcaatgtcattcgaaagcccagcactttaatagtctttttttctatatttaacattcctttgaatatttttttatatttttgatcccctctttacgaattatgtatttatgaatgaatgtaaccaataaaactcacctatttgatcagaaaatgtgctgatccattgtttggccggtgtcagccgaagtgtgtgcctttgcctggcctatttgatgaccgtgaccaatttggactatcccaatgctttggacttcgtttgtcgtcgccatttcggtgcgaagccaaattttggtttcaaaatgcaactgaccaagttcggccagcaggtgactaaccatttattttatttattattattttattaaagtgttatttttcaacagtttgtccaaagggaacggcgccgacttttcgccgaattttctcatttcaccggccaattgcgtgaccaatttcaaagcgattgcatg

SEQ ID NO: 99572 - DNA, 332 bp, Heterodera glycines
  Promoter: Source sequence=SeqID_10085; Location=1..332; Strand=+; Gene=SeqID_73149
ggggaggagcaaccagtaagcacaacattgcacaacggctgaggtgccggggcatcgtcaatcgggacaggcccaatttggagtgccggaggcgcaaattgctgctgatgctgctgctggtgttgcaaatacggttggaaagcgaactgtagcggaggaagtaccaaaggcattgtgaatggtgggaagacgggcagtggtggcatgcgcatttgcaaagtgctgatcgcctgttggacggcagctgaaagcatcggcggcggttgttggtgctgtgttgccggggcgcaatgtgtcaattgttgctgctggtgctgctcctcctcgacatg

SEQ ID NO: 99573 - DNA, 860 bp, Heterodera glycines
  Promoter: Source sequence=SeqID_21612; Location=992..1851; Strand=-; Gene=SeqID_52210
tcacttccacatcatataatcacttctcctttcttcaaccgttgccttgctctgcgtcaattttttaatcctaaccgcctcctcccccctttttttttgcttcaaataaattgttgttgaaagaggtgcctttgggtaggggtcgggaaacacgggaaatgtggacacagacggcgagaaacccccccaaaatcgaacgagcggcacaccctttctctcgccttctccatcgccaatctgcgtcgccgctcttgtgagcgagtctcgaatcccctcctacccaatccctcccccagtttgtccccccttcctcgacaaactttctggtgccacgacccgggaccacgaacccttcgcccttcaattcactttcgaccatccgtcactcttctctctgccgccagccgaccctttaggctcccggcaactcaacccttcgctgtccgacgaccatcttaggcctccggcactcatcactcaactcaagtcgccagccgccctttaggctcccgacaaaccctcaccgagtcgtcagccgcccatttcaggctttcgaccattcatcactcttctcccagccgccagccgccctttcaggctcccggctttcatcactcaactctttgtcgccagcccccctttaggcttccgacaagccctcaattgagtcgtcagccgtccttttaagccgaccctttaggctcccggctttcaccactcaactcttatcgtcagccgtccctctcgggctctcggctaatctccactcaacccaccaaccgacagccgccttctctaggctctcgaccaaccaagcccgactcttgcgtcaagccgccaatcctagactttcggaaatg

SEQ ID NO: 99574 - DNA, 1003 bp, Heterodera glycines
  Promoter: Source sequence=SeqID_12123; Location=1274..2276; Strand=+; Gene=SeqID_75692
taattgggctgatccgcaatttatgatatgcttttaatgatttttcttatacattttcatatcgaataaatgggcaatttccaaaaataatttctcccatttaaaaatttatttttaaaaatttctagtaaattaataatgcatatttctaatcatttttctctcccaaaatctgatcgcaatgatttttcgtccgattactttttttccggtcccaaattgcgctttttgttggctttgcttttggccggcgccattaagccatcgccgtcgtccatcgtttcttcagctgttcagctgcacattttcaattccggtcggtcagcgccgaccaaaataatgcaaacagaaaaaaagatggaaaatgggggaggcgcaagatttgttacgatttttgtggccaaacgatgggacggacggacggaccggacgaatttggcccaaccatttgatatgaagcatcaaaaaaagggtaaatatgggaccaaaaacaatcggatgagcgaaaatgagagagagagagagagggacggattgggcggcgacggagaaaaagtcggacgtacgaaaattgggaaaaaagagagggagggaatggccaagggatgggccaagtgcagcttaaaagagtgcttcagcccattggctttatcattctttcattgttgctttgaaaatggctttttgttatttaattaataaaaaattattttagtagcggtatttctttaaaaagcgcctttttggatttgcagttttttcaaaatttatttgaagcaaaaattaagctaaaatattatttgagttgccctaactttccgcttttaatcagctgtcaaatgcttttctatttttaacgaagaattttatgggttttcattttttagattaaattctagtgggctatttttcattgaattttttttcgtccaattatttttgagtttttttaaattccaattttaatttttcatttaatttcgcttaaaagttttccaaaatg

SEQ ID NO: 99575 - DNA, 99 bp, Heterodera glycines
  Promoter: Source sequence=SeqID_16949; Location=1427..1525; Strand=-; Gene=SeqID_81378
aattaaggcttgacaaaccaccaattatgattaattgtccttttccatttcaattatagactagcgaattgggcatagtcggttactttttggacaatg

SEQ ID NO: 99576 - DNA, 55 bp, Heterodera glycines
  Promoter: Source sequence=SeqID_25524; Location=920..974; Strand=-; Gene=SeqID_56267
tggccattttatttttcaaataatttttatatttaatagatattccagaaaaatg

SEQ ID NO: 99577 - DNA, 374 bp, Heterodera glycines
  Promoter: Source sequence=SeqID_18037; Location=1150..1523; Strand=+; Gene=SeqID_82622
agaagttcggatggaagtctatttgcttgttgatatgcaattgtttccattgtataatatgtaatgtggttaacgggtattcattcatttaacacatacattggcatatgtcaaccatactatttgtttcaataaaatatatcgcaatattggatgacatcattttgtaaaaatgttaattttacatgctttactttgtttgccttaatatttacaaaaattgcggttttggcgggctaaaaattattcttttattttcaaaaatatcctaaaaataaatgagttttagaaattgcccgaatattttttttaattaaaaattttaaatactatttgtgttcgcttgtatgccaaattctgcttcaacaccgatg

SEQ ID NO: 99578 - DNA, 285 bp, Heterodera glycines
  Promoter: Source sequence=SeqID_36354; Location=384..668; Strand=-; Gene=SeqID_65691
gctggaaaaaatttaaaatttttttagttatattaaatttaaaaaatattataataatgcaataaaaaatgaaaaattttcgagataaaattttcattttcaaataatttattttttgaaaaaactttacataacaatttataaataatttgataaatttaacttcaatattaatatttccctaaaaacgaagatttttccattttaaaatttgtaagccttgggtaaaacaatttttaacaaatcttttttattcttttttcagtccaagaggagaaggccatg

SEQ ID NO: 99579 - DNA, 466 bp, Heterodera glycines
  Promoter: Source sequence=SeqID_11984; Location=1847..2312; Strand=-; Gene=SeqID_75507
ttcgttagactttgtactttcgaatgataccaaaaagataggtttagctcgaacatgaacaaagttattgtataaaaaccgagtattttcaattgattgtactcataaaagtcgattggactcataaagtgcactagagccgattgtacaatttggttgtgaaaaccctccaaaaataattcccaaaagtcgtcattttttaattttatgcacaaaaaaaataaaaaatattaatgttgcacaacggactcgaattgttttttggtgactaacacatagaccactgagacaaaaattcaaatctttttggaactgggaggcaaaaactgaaacggtgtgttaaactaacacactatgcaaattattaattggggttcagcctgagcccatgtccaaatcgaactctaataaatatgactattcattattaattatatttttttagcgaatttactaaatagaaatg

SEQ ID NO: 99580 - DNA, 120 bp, Heterodera glycines
  misc_feature (35)..(35): n is a, c, g, or t
  misc_feature (44)..(44): n is a, c, g, or t
  misc_feature (71)..(71): n is a, c, g, or t
  Promoter: Source sequence=SeqID_28969; Location=1..120; Strand=+; Gene=SeqID_59542
aatgacagattgcggattgtgatcccgcaaatcanttcatgatntatgccatgacataataaaagttattnaagctttttattttttactttgttttaccaaggatacaattaattaatg

SEQ ID NO: 99581 - DNA, 405 bp, Heterodera glycines
  Promoter: Source sequence=SeqID_4207; Location=1365..1769; Strand=-; Gene=SeqID_53602
ttatctggttttaatgcgcaacccttcaggacaattacaagtgaggacactagggtcacaactgttcccaaaaagactgaattatttcatggatgcatatcatgatgcgaccaataatcaatttagctatctcatgattaacatgcacccaaattctgatgaggaatttagtttggcaatcgttgaaatttgtgcaaatatattgagttttagttttaaactaacgaacaaacaaaaaagaaggttggcacaatacgccgatttttatagggaaattgccaaatctcgttcagataaaacggcaagaaaaaggatacaacaggggagtggtatagccctgggagctgtcttggtcccggtactgagtgttttagctcaacatttattagaaaaaataacatcatg

SEQ ID NO: 99582 - DNA, 252 bp, Heterodera glycines
  Promoter: Source sequence=SeqID_3359; Location=4947..5198; Strand=+; Gene=SeqID_84358
tgtgagtgcacatatgccataacgctgaagcacatcccgggtcgatgaaacaggcaaagcttgataagtttgagcaatggtaatgagtttaagcaaaaaaaaatgggatgcaatagattggctcaacaggtacctggaaaactgtcaaactcccttctttttaccggatcaattacgcagctactgtcttaatgacacagaaatcctgatgaaatccgttctacaatttcgccataaccaacggttatgatg

SEQ ID NO: 99583 - DNA, 460 bp, Heterodera glycines
  misc_feature (46)..(46): n is a, c, g, or t
  misc_feature (69)..(69): n is a, c, g, or t
  misc_feature (81)..(81): n is a, c, g, or t
  Promoter: Source sequence=SeqID_41228; Location=541..1000; Strand=-; Gene=SeqID_69413
cttgttttttcgtaaaaatatattcgaattattttatttctaaaanttattaatattttaatatctaanaaataatatatnctcacaatactcggctccccttttttttgtcaattgtcaattagtgtgctcaagacaatgcttctgatggaaaatttcttgcatttgtccaaactctctcagcaaatgagcatttttatttggaaatgaaaggcaaacaaatattaacggcggaagtcaagaaaaaattaacatctgaggtttgcttgctaattggctttttaaacagaaaagtataataaaaaagaagccagccataatttaataccccctttttttctttttgcagcgctttttccaaaaaaacttttggggaaagcagcagggggtccggtggtgccgataggcgctgggaaatttttttttttcttggcattgtctatgtgctgcgatggaaatg

SEQ ID NO: 99584 - DNA, 53 bp, Heterodera glycines
  Promoter: Source sequence=SeqID_24667; Location=1085..1137; Strand=-; Gene=SeqID_55406
aacaccaagattgctctattgaagaactgaatatggtccttcgtgccacaatg

SEQ ID NO: 99585 - DNA, 323 bp, Heterodera glycines
  Promoter: Source sequence=SeqID_11622; Location=659..981; Strand=-; Gene=SeqID_75069
tacactcaccaggattgaaattctagcaggcctaaaaattagggaggcgacattcaaattaaaaaaagggtttccaatgaataattaaaatctatttacaataggttttggcccatggcggtttggcccacatcaccgctttttccccatgcaaccaacgcgtcgaggagcaggcggccggccgcgtggcgcgcaagggtcagccgggctccggctgtctgatcgtccgcaagtcgcacgtgcggacgctgcttggcgtcgcaggagatgaacaatggacggacgaagaatggtcaaattggcgcgataagcgcgatgaaatg

SEQ ID NO: 99586 - DNA, 1003 bp, Heterodera glycines
  Promoter: Source sequence=SeqID_22611; Location=1274..2276; Strand=-; Gene=SeqID_53282
tataaaataatgaaaaataaataaacagttatttgtcattgggactgaatctcagctcctaaccatgatatttggagaaataaatttacaaataaaaatacagtggtatatatataaggaaattaatgaaataatacagattctttattcctttagaacaaattttaataatacaaaagaaccttgggggataaaaatgaaatataaaaataaacaattaattaaataagtaatattaaaaaaagataattaaatatatttttttaaataaagattattggtataaatttctggctttgaatgctagtggaaaaaatgtaaaatttgattctaaatgcccaaattattggcatgtaaataaattgaaaaaactttcggtctcaaaaaaatgaatttatattatcaagtcaaccaattataataaaaagtaaaaaaaactttgttatttattatagaatttgtgcaaaaatcaagatttattcaaacattaacttaatgaattaataatttaaattagggttgctccccgaccccgagccccccgacccccgacccgccccgagacgtttttgggacctattccccgacccgacccccgacatgtgccccccggcggtccccgacccccgactttttgccccccgaccccccgacactaattcgggggattggggactccgaacgttgtaaaaatttaaagctattcaaccatttaaattataccaatacagcaagccaaacgaattttttatactctttaaaaaattaataaaaaatacttttttaataataatttgcagcttgcacataattttcaatttttctgtgattttatagggttcacccaatttattacttcaaatgacttcaaaagcatctgatatttggaatgtttttactaaaatttcttcggaatttgccaagtgccagctttgtgaaaaccaattagcatgtaagcaatcgtgcacaaaagggttgtgggggcattttaaaacgaaacatg

SEQ ID NO: 99587 - DNA, 551 bp, Heterodera glycines
  misc_feature (209)..(209): n is a, c, g, or t
  Promoter: Source sequence=SeqID_41400; Location=908..1458; Strand=-; Gene=SeqID_69530
tgacgcaattagcaggatactgtaggcaaaaataccgtttcataattgataaaaaacaattttacacgcttaaagcggtgccctgctggaaaagaggagaaagagggaggacagcaggggaggggaagggatgattgggggggggccattatttttccaccttccttccgttccctcgcccaacttggccttggcttctcccccccccnccctcgcttcttcgattgtttggcttaatcattcatcgttttccttattaaaaaacattatgtcgtcctcaattctctctaaatttctcccccattttaaattattttgtaaattcgagggaggggggggggcggcaaatgacacaattaatgcgaatgcgttttcattttttggctaaacattctaaatttgtgacatttaattcaatctttccatttgaagatccaaaaattagggacattttatgtttcttattttctaaaaatcctatcactatggaaagtgtcgaatgcttcggcatacgcattgcaaaaagaaaaaagccatatttttaaaaaatg

SEQ ID NO: 99588 - DNA, 595 bp, Heterodera glycines
  Promoter: Source sequence=SeqID_1137; Location=1455..2049; Strand=-; Gene=SeqID_68457
tttgcgccgccgacacttgcgccgcgacaagtttgcgccgcagacacttgcgccgaccagccaaaatgacacttgcccgccgacatttgcgccgcccccccccccattttgattatttaaagataattttctcaatcaattttaatgtttaaagttaatgtagcattcggaattaaaacttccattccaattacattttaaataaaattcaacattaggtaattatcaacaaattttactaaaactataaattaaacgcaaaatgacaactaattaaaaaaacacaacaataaatcactaatcacaaaggtaaacacttaattttttgtctttggtcaacgcatacagtaagagcaatgacaagtttttttcttcttcactgccgagagtagcaagaaataaaaaagaaatattttcatttttgattatttttttaatgaactcaatttcaatttttccggcttttaaacacaattttgaatggtctgatcaattcggaataggttattaactatcgaattttatattaaactcaattagataaattttcggaaaatcccacttaaaatattatgtcagattcataaaggcaatg

SEQ ID NO: 99589 - DNA, 415 bp, Heterodera glycines
  misc_feature (33)..(33): n is a, c, g, or t
  Promoter: Source sequence=SeqID_12254; Location=407..821; Strand=-; Gene=SeqID_75842
aaaattttggcgtttccgttgttcgcaaaaaanccgattttgccttgggccgcaaatgcgggccgcaaatgtccgattttcactggggccgcaaatcatggcccttaaaaaatcgactgcaaatatcggtttttgactgagaccacaaatgtctggaccgcaaaagtggggccgcaaatatcggaaaatggcccttaagaaatcatctgcaaatatcgggcgccgcaaatgtcggtttttggctggggccgcctatgttcgggacttgttttgatcaaacagttcaattcttgactttaaaaataagagagagagagcgagacaattagaaaattttaaattcatatttaaaatattgcaagatttcaagaattaagtaattagccattggtaattgatacatatcatgaagatg

SEQ ID NO: 99590 - DNA, 1003 bp, Heterodera glycines
  Promoter: Source sequence=SeqID_12194; Location=2256..3258; Strand=+; Gene=SeqID_75770
attaatatcatcaacatggtgaaataagtaattttgaaggatttaattaaaatttaccaagtgactattggcaattctacaaaaaattatgaaatatacttagtaaataacaaaaaaaaaattgtgtttggtgaccaacccaccttaatagtcaagtctgaactagtattagaaaaattttaaaaaaaatccatttttttctttaaattcacaaatttttttgaaataattttatagtaaattcttaatttttaaaacatttttcatcgcaaatttcatataaaaaatttctattggcaacgccggcctaaaacctaatcattattttaattttgaattgcaaggagttctggaagcgactttttggtcatttttaggccaaaatctgctaaaaaaaatcggaacaaaatttcagtcatacttttgttttttgtaaaaattttttaggcaaaaataaaattttcacaactcaaaaaagccagcaatcccgcgcaggttccctcaaatttgaaatttccaggcactaataataaattggaagtagagttgagcggaaccagaaatttttggaaaaaccgggaccgggacctgaaaagcgggacctaggttttcgaaagggtccgcgttttcggcatttttataatagcaaaaaatgttttttcattcattttataatcacgcaatttactcgtataattattctttcttttaaaaattattattttaatttttttttaattattatttttattctactagtgttattgaattatttgattctacttgttattagaattattttatttcatattcgacatagcttttttattggtgctgattaatgatttcatttaatttttctacttggcagggttttcctataaaaccaaataaatccaaaaattaaatttaaatatccaaaattattatttcatttttacagaatctaatacaattctttacgtttaaaatcatttaattgctttatttccacaagaatatg

SEQ ID NO: 99591 - DNA, 1003 bp, Heterodera glycines
  Promoter: Source sequence=SeqID_18562; Location=899..1901; Strand=+; Gene=SeqID_83197
tttttcaaacaaaattttttttcgaaagatgccaaattgaacttttcataatcgtcattggttttcgaagttctctgctgaaacttcttcaactgacagcttttaatttacaaaacaattttatcagaaaaagaacaattttaccccaaacacctccgaattatttggtttgcaattgtgcgggcgaaaatgataaaaaaatgatacttaattagaatttttatgcataaagataccggatttttccaatttatagcacatattttttggtttttagcacatatttcagcattttttagcacatattttttttttattaaatttacaggatttttaaaacataaaaacctgagctctagtaattatgcaagaaatctcccaagaaaaatgtttgcataaacttttaaatttgggcacttaggtaggtccatactacgttgagaaaagtcctgttttttgggacaacaaattccggcaatgtttggccaattgtgtgaatggtcgttttcacatttactgtcccccccccttccctcatccgttcaattaatcaaataatatgtgacaaattgttacaataattgggtcatttggaagtgatccgggtcatttgcgggcctgatctgctgatttgtgctctacatctctgctcagtgctcgcgtgtaatatctcgataaaagttgcaatatttacatgatccagatcattttcaggtcattagcccaacctcctgatggtattagctagaccaatttgatggtaaaaaaaaaggaaaaaaatcaaaggacggatacgttaatttctacggtgggaaccgccgtctccacctaataaatcacattaaatttttaaaaaattaaattaaaaatttcataattacctttttcgaaattgcaggcccctatttcttataaattttaaatatttaatcaaaatttagtaaattgcctttcgtgaccaaccaaacatttgtcatttgcaaaaatatttggattaccaatg

SEQ ID NO: 99592 - DNA, 177 bp, Heterodera glycines
  Promoter: Source sequence=SeqID_39641; Location=786..962; Strand=-; Gene=SeqID_68157
ttttctaaaaatgctgacgtagttttaagaataacaaaaatatcacatatgtttattataacatatacctatcatctattcgtaaacataaaataaccgaaatagtgctgaatatttataataatttttttacataaatttcagcttgcaataaccctattcaccaaacgcaatatg

SEQ ID NO: 99593 - DNA, 85 bp, Heterodera glycines
  Promoter: Source sequence=SeqID_45339; Location=359..443; Strand=+; Gene=SeqID_72652
ggttatttgtaaaagggtcttaactaatttttattgatttttttatccattaaaattttgcagaattattaaatactcagcaatg

SEQ ID NO: 99594 - DNA, 85 bp, Heterodera glycines
  Promoter: Source sequence=SeqID_26128; Location=1..85; Strand=+; Gene= SeqID_56876
cggaatgggagagaaggaagagtgatcggaataggacctttggaggagtgaacggaatgggagcggaggaaaagtgatcgtgatg

SEQ ID NO: 99595 - DNA, 784 bp, Heterodera glycines
  Promoter: Source sequence=SeqID_7239; Location=1177..1960; Strand=-; Gene=SeqID_64229
ttttgcaaattttacgtccattttcctctttattacaagctttctcaataagtttgttaattgtttttttaaagttttcttcagccgactctgtataggcatttttaaaatagaattttgtaacatgccccgtaatgccgaattttttgttttccgttatataactctcaatttcctcgaaataatttgtttcgtcatttttttttgggaccgttttaaaaaaattaattacatttctttttgctcttacttcttttcctgttttaaggaattttttcggacatatttaattaaaaataatcaattttaatttttgctgctttaataaagtgagtaatgtgctacaaatcccttccttaaatacacaaaaagagacgccggccactgtccgtgataaacggtagcggctggtaccgagtttagcgaacaaagtatgcgcatggctgactgagtcacgcccctttcactattgtttggcgtgtataaggtacggacagacatcataaggcacgataattggtggacgagaaaattgtagcatttggtgatgatgaaaatggttagcgcacgaatcaatagtgaattggcacctagccaaaaactcagcccacctagtcaaaactcagacaattgattataccgcgcactctatatcaccaggcactgaaaatgcattctaagcaatatgtacaaacacttaattaattgcctatcacctattttcaccatcttcatagtatcttcacccgtcacactattttcattaacttttccctttaaaatg

SEQ ID NO: 99596 - DNA, 166 bp, Heterodera glycines
  Promoter: Source sequence=SeqID_30108; Location=1147..1312; Strand=-; Gene=SeqID_60549
tgccgtcatcaatcaatgatcatcattttaaatatgaaattttcattctgatctattttgaaaattgttcccccaaatttaaacagtttctcccgctgcacattctcgtcacggtgcttgtctatttacgcttcatttgccggcaaagcagcgcccggagggcatg

SEQ ID NO: 99597 - DNA, 214 bp, Heterodera glycines
  Promoter: Source sequence=SeqID_4553; Location=1..214; Strand=+; Gene= SeqID_54872
agggtgatcaattctatttaagccgtcaatgggaaaactgactcattttttactaattttacattaaaaaaaacaaaaaattcgttagctaattggatttataaaaaatagatttgtaaaaaaaattgtggcaaattgaatgccggaagttacgctaactcgaagtcgaagcagcagccaaggcagtgacgcgcaacggaatgccataaaaatg

SEQ ID NO: 99598 - DNA, 678 bp, Heterodera glycines
  misc_feature (33)..(33): n is a, c, g, or t
  Promoter: Source sequence=SeqID_8203; Location=1..678; Strand=+; Gene= SeqID_67296
atcactttttgccattttcaccattattatttntctgtaactaaaaattcacgccctgatcttagccaaaagcaaatagtgtaaattttcttcctcctcatcacactgccatttttcttgccatttatcagtcaatgattatttttatgccctctcccctctctcgagtctttcgtttaccattaattagttaatcactattacatcactcacaaatcagtgatgacgtaaaatcatttttatttattatatttttgtctacaacttgatattccatggcttcttttagtgttgatcaattagtgaatgagtactcatcaatcctatctttcatgtttaatagtggcgacatttttatgggtcatgttttaattttttataaatttgacaatcttctaatatgtaataaagtgcttctctaatgagtcatcattatgttcaaaacattcgattaatttgtaaattctctgatttactttaatgatgaccattttacaatttgagtcttttttgtttttgtttttttgctcttttcgaccgaccattttccattttcgcttatgaacaatttataataaaattttagccatttaaatatttttcttttaatttattttcttaattggttttagcattcgccgtccgctgaattcggcggcttagtggcacacgaaaatg

SEQ ID NO: 99599 - DNA, 185 bp, Heterodera glycines
  Promoter: Source sequence=SeqID_12568; Location=2190..2374; Strand=-; Gene=SeqID_47050
cacgaatctgacgtttatttttttcatgtacctcataaaatacgtgacagcctcaaataaacgtcagattcgttttcagcgcctaaattaccctagaaaaaatatagctatttcagggggtggcaaaatccgcgaaaaagtcccccgcagtgtaggattaagttgattactaattaaaatgaatg

SEQ ID NO: 99600 - DNA, 253 bp, Heterodera glycines
  Promoter: Source sequence=SeqID_27684; Location=283..535; Strand=-; Gene=SeqID_58359
ttaaaaaatttggtcaactttaaaaaagttgtatgaaaataagaactatttcagccataacttagtttaaatttgataattttgtttgaaattttccagctaagagagaaaaagcttggctatcgaatggtaacataaatctaaaatttggttgagcttaagcaacgttataccgtgttttgcgaaaaattgcaaaaatggaggattttacgaaacgcccaaggtggcggattttacgaaatgacctagcatg

SEQ ID NO: 99601 - DNA, 621 bp, Heterodera glycines
  Promoter: Source sequence=SeqID_18740; Location=1326..1946; Strand=-; Gene=SeqID_83410
tttcagagagaatcggacagaaatttttattcgaatggactgaatgtttaacacttaaacaaatatcgaattggaaagcgatagtaaaaaggcgttaattacaagactagtaagcaatgagtaatctttccgatttccgaaattttttgggtcttccgatttccgaaaatgtaggcaaaatttagtgactgaaaaatttaaaaatcatcttcaaatttttaaagttcgccaatccaaaaatggttttttgtttattataccaaaaaccaggcttttgctggttcgaaaaaataacaaaaatttgaatttaatttttcgcttgcaactatttttttctttttaaataggtcggtcggcggtagtatttcttaaaactacatatgtagtatgtatgcaaactttccattataaaagcagttgatttgagaaaattcttcacaactcatctataccaactcatccatatacccaactcattcatgcacaaaaaatgccacgatacagagccgcatcgtgctgtagatgagttgggttgctttcttcgttacctatgatatttcctaatttgttcatttttccttcaggcaaaaattttttaaaatatttttttgtctaaaaatg

SEQ ID NO: 99602 - DNA, 1003 bp, Heterodera glycines
  Promoter: Source sequence=SeqID_146; Location=982..1984; Strand=-; Gene=SeqID_74913
aaccctaaaaaacaattcacttttttgccatcgaaatgtttgtccaccagcgaattgaaacgggacgaaaacagtgccaatttgagccgagttgaatgctgggcgatttggacggagaagcaattttaatgccatttgttagcgcacccatagaatttgtcttatatctaatgagaaaaagaaattaaaaattgtagagccttaaaatttttagagaaaataaagtttggcttgaggttaaaaatgttataataataataataatataaaaaatctgcttttaaatgaatattgtaaaaaaggtgagaaatggaaaactaagataataaatcttctaaaaaaataatacaattcttgttttttaaataggaaaatttatttattcgtatatctgtgctaaacttagcaaagagaattttgaaaataaactctaagtaattgtatttttttcctaagacgagtgcaaaaaataatgaattaatcaatagcacaccgtgcgcttaacatgagagatgcgtcaataaagagagtgtgtagagaaaatgagcaaattttattaattattaaacagaataatttttagaaattccttagtataatttgtttttaaatgaattgttcaacttttgcttacaaataagtctaaagaaatttcttgtttttcaaaaaaaattaaatttattaaaaaatgtaattattattaattagtaaaataaaaaccattttcaattaagtagaataggctcaaaaaaagaggcacgaaacaacttttttagtggtgccaacgctttttaaaaaaggttaaaaaaggaaaaatcaataaacaaaaacgccatccctactgatcattgatttttcaaaccctaaagaactcagcttgccaaaatttgaaaaattcgcgtttgccataattttaaaattctattaaaagctcaatcaaaatttttagggcaaataacattttgaaatcaattgaaaaaagtaaaaacttacagcatcaatg

SEQ ID NO: 99603 - DNA, 761 bp, Heterodera glycines
  Promoter: Source sequence=SeqID_17204; Location=968..1728; Strand=+; Gene=SeqID_81673
tctgaataaaaaatactcatctttttgattttttaagatatgtttttcggttttttatgaaaaaggggaggggcggggggtcaacgaaatttttgcgaaagaatccgtccggccatgtaaatcggcacgtcctttttttttgttttgtttttttagttattgcctaagaaactgaggattatcattggattggacaaacagagttcaaggcgctgtttttgttgggccatacaaatgtttttggcaaaagatgccccacgctaaatctagtttttcctagcccattttaaaaccctaacaggcttctggactagttaaccgaggacaactcagctgatatgggtcaagatggacaactcagccgtacaataattttttttttaaataaagcctaagcctaggcctagcctaaagcttaggccgagcctaagctattgtacaagttgcctttatacgagtttgtgtacaagttatcatgacacccgaaagacaactgttaaattttaaaaaatttaacattatctaaacttaaatttaaaaacttttagtttaattaatttgtttaaattattatttatttttttttcaatttttataatttttttaaattctcgtaaagctgagttgtcccatcagcagttgagttatctccagctgactgatcctgacacgccctgataaatttttgaaattttaaatccttaccccacccacttttccctctgtgtgcacagaaaaggcaatggaaacggcgcaaaatg

SEQ ID NO: 99604 - DNA, 323 bp, Heterodera glycines
  Promoter: Source sequence=SeqID_3735; Location=2603..2925; Strand=+; Gene=SeqID_51669
tttccgtaattcagcattcccagtacacatccacgcgattgcaatatcttctgatgtactccatcctcttgccgtctcgctcccgcacttgtcccgccgtttttccattgggaagcaccatgttgtcatttgggcaacatttcttacatccgtgccacgttgtcgaagcgaccaccaaattgtgaataggcataagtttcgtatttctttggcagtttgtagacgagccaatccacaaatgcctccattgggttttcgcccactatttgtttgtcaacaacagtgcccgtaaaacggagctggcagaaagcgaccacgcgatg

SEQ ID NO: 99605 - DNA, 1003 bp, Heterodera glycines
  Promoter: Source sequence=SeqID_14267; Location=3371..4373; Strand=+; Gene=SeqID_78284
aattcgaaattttaaactcccttcctccaaaaaagtatattggatttgtattggctcttccaatctctctcaaatctcagtaatttcgttgatttgttgtttttttaaaagccaattctgtaaacatttcattaaatttgagcaccaccttgaccatactcttctggaactgaatgagtggtcaaggcgtcgaaacaaagggattttctgcagttggtccggcctcagaaaaatgctcatgattcaactgctgtccacaaatcgcagatgcttctcattgcggcgactgttgcattttatgcaatttattagtgatgctaaaataaaatattgaaaattcgaatactttatgcctcttttgtgaatttgtgctgatttaattgattggaattgggaaaatgggtcatttctgagaagaaatgaacatttagttgcgtccgcaacaaattcgcttttctggcggagattttatcaaaaaccatatttgttgaccaggaagtgtccgtcttcaagaaatgcgtcttgctcatctcaagatttgacttaaaacggcataaatgtagggaaaaacaaattatgggccgagattctaaaagtatgattaagattaccgtaatcaattcttttttagaaaatgagccctccaccccatcccttataaaattgcctccttttttgattggaagataaaactgagctcccagtaccgtatttcaatataggtacattaagataagtgcttaagcagagtttacacagcttaggtaattcccgaaaaaattaggaaatcagaaaaagccatttaaatttaaaaacattttgccaaaaaggtaatcatttaaatttttttattttgtaatcaaaaagcaaggagtgctgtcggttttttttttactttgttttgtattttcttcctttttttgccttacattttcatagtctctaaacgacaacttttatgcattaatttacaaaatctaagagaactgtttgctaattaatg

SEQ ID NO: 99606 - DNA, 910 bp, Heterodera glycines
  misc_feature (328)..(328): n is a, c, g, or t
  misc_feature (420)..(420): n is a, c, g, or t
  Promoter: Source sequence=SeqID_16316; Location=1376..2285; Strand=-; Gene=SeqID_80707
gggggagggggggggggccgggggggggggggggggggcggccccacccacaaaaaaaaaaaaaaaaaaaaatttattttttttgttggtggggggggggggggggggggggccccccccttggggggggggggggggggggcccccccccccccccccccaccacaaaaaaaaaaaaaagggggggggggggggggggggggggtggggcccccccccccccgccccccccccccctccccccccccctcctctcttttttgggggggggggggggggggggggggggcgcggggggggcggccccaaacacaaaaacaaaaaaaanaaaaaaataaaatataatattatttttttcttttgtgtttgttttgtgggtggtgggggcgggcggcgccgccccgccgccccccggggtgngcgggggcccccaccacacacccccccccccccacaacaacaaacaaacaaaaaaaaaaaaaaagagggagggggggggggggggggggggggggggggggggggggtgggtggctcccccccccccccctccccccccctccccccccccccccgccgggggggggggggggggggggggggggggggggggggcggcggggggggggggggggggaaaaaaaaaaaaaaaaaaaaaaaaaaaaaaaaaaaaaaaaccacaccccccccccccctccctcctcttttttttttttttgtggtggtgggtttgttatgtggtcgcccccccccccgcccccccccccccccacccccgaggaaaaaaaaaaaagaaaaaaaaaaaaaaataagaaaagaaaacaccgccccccccccccccccccacactttttttttttttttttttgtttttttttatatcaccaaaaacaaaaaaaaaaaaaatatg

SEQ ID NO: 99607 - DNA, 423 bp, Heterodera glycines
  Promoter: Source sequence=SeqID_34664; Location=338..760; Strand=+; Gene=SeqID_64398
attgttttttttattatagaccaactcacaagtcctttttagtacaaaaattataaacaaaagcagctaaattttcaaatttttcccagcggcgcctttcggccttcccataaatatgcaagacacaaaaagtgtttcggaaaaaatatcaaattttgacagatttttggtcaaattataccgaatttgagttcatttggaaatctgaattatttctgtttagaacttaaaagcagcagcaattgtcgaagaaatttactgcaaattttgacggaggaagacgcaaaagaatttttaaaaataaataaaataaaatttgaaaaaagcgaatttaaaattcaaaaaaataaaattagtgaagaaaaaggaaataaaaattgggcaaaaaataaattgtcgaaaaaagaaaacaaaaagaaaatg

SEQ ID NO: 99608 - DNA, 485 bp, Heterodera glycines
  misc_feature (7)..(8): n is a, c, g, or t
  Promoter: Source sequence=SeqID_7589; Location=1..485; Strand=+; Gene= SeqID_65326
agtccanntttcatagccttcaaaaacagtcatcgttttgcttttcgttgtcctcttatcgggttctaatcggtctgaaaattgatttcgattttttgtttgcttaaactacaaaacttgccttgttgtggttgaacatgacataattgaagcaaaattaaaaaaaaaactttgaaatacattctataatatttataagtgggttggtaaaaaatattcaaataaaatcgtaaaaattctacataaaaacggtgtttttcttttcatttcccgctattttcctctttttgccagccgtccgcctctcttgttattgccagccgtccgcctctcttgttattgccagccgtccgcctctcttgttattgccagccgtccgcctctcttgttattgccagccgcccatttctcttgttattgccgtccgcccgcactttataactatttcttttatgaaacgtgaaaatattattgaactctaaatg

SEQ ID NO: 99609 - DNA, 933 bp, Heterodera glycines
  Promoter: Source sequence=SeqID_600; Location=2979..3911; Strand=+; Gene=SeqID_57361
tattcctcaataacaatacgaagcaaaaagttttatcctgaacaagcaaaaattagagaccggaatttccaaaaatgccgggccgggccgggctgatttttccagaatcaaccgggttccgggcccgcctctcaaaacccggtcaacccggttagcccggtcaacccgggtttccccaaaaatcgccgggccgggttgccgggcccgggaaaacccggtaccgggcccggcccggtccggtctctagcaaaaattatgatttattgaaacagaaaaaaacttcctttcaaatttaaacaagcaagcggagaatttcaacttgaaatgtacatgggcaaaaacgaaaagcctatttaaatttattttgctggtgatatgtctgtctagctcttctttaacttatttgttagagttaaagcaaaaagagagacaagaaaaagagatgaacgatggatggacggacggatgacttgagaaggagtccgccgaggtgacttaagctcaaacgaagcattggaggaacgagcaatggacggagaaaggaagcgaagagcaaaggcaaagcagcggttgtagggaaaatatgttttaactgggctatgctatgccttcctttctgtttattgaaggtacataaggaagggaaatgttgtgttaagaaacggaaagaggattacggggtgatggcgagggccgggcccctgggggaggggcgattggatattgtgggtgaagaggaagacccaattttctatttacctactttccttgctgttgcccacattctcacaaatataatttgcccttgagataaattttcccattgcctgtgcctgtcaatttgccttttgccatacataaatattattgactttcaattttaggttttcactttttcaatttttatcaattacaaagttggaagtgaatatg

SEQ ID NO: 99610 - DNA, 971 bp, Heterodera glycines
  misc_feature (128)..(128): n is a, c, g, or t
  misc_feature (196)..(196): n is a, c, g, or t
  misc_feature (308)..(308): n is a, c, g, or t
  Promoter: Source sequence=SeqID_8440; Location=1833..2803; Strand=-; Gene=SeqID_68077
atccggatcccgaccaacctccccttttcccgttacgagtgggggatcacaatgatgtattctttgtccttacgcaataaagatcattattctattattcgccaattagggataatacatcacttcanccattatcaccattaaaggaaagcggggagaacggcacgagatcagatgggccatgggccgctaaacngacggcaccgcttttttgacgtgagacttacccgccacatttttgtttttaacgataatttaatagaaaagttattttcgacttgataatattgatttttcacaaccaatcnaattgttacatcgtgatcagatcaccattctttattcaaaatttaaataattcaaaaataatttacaacgacaaattttgaagaaattgaccaatgaaattaatggaatgtgattggaaatataggaaaagaggcacaaataaacagaaatcaattttgagacattttggtcacattgtttgaagccagacgaattttttgaaactttgcataagcacaagaacacaaatgtttttgtattgcctttatcattcaaaatcgatgtccatccgatttagaatctttttttctgtaaaatttagccccattttacgacaaaaaatcaccatttgttctttcccaatagtgatcttttggacaattaaattcatttcatttcgcccaataccaactcagtccatcccggtcgtctgttgccgatttgaattttaattggtcaacaaattgatgttttggcccgagaaatttggcatcttttcgcgtcaagcatttgccgcttagattttcataatgctgatcatttggacaaattgcccgactcattttgccaacaattctctctgatctgaacctgaattcaagcagttcacttggtccgtttcccgatgtgcttgctgatgatgatgggccaaatacaactgctggctacgcgttgtcccaatg

SEQ ID NO: 99611 - DNA, 118 bp, Heterodera glycines
  Promoter: Source sequence=SeqID_37570; Location=461..578; Strand=+; Gene=SeqID_66609
ggtaaaaacggtagacggctcttctctcccttcgaattttgaccctattactccaattaattaggagtaggaaatttaattgaaataaaaatttttcctccgtttttggcatcgaatg

SEQ ID NO: 99612 - DNA, 285 bp, Heterodera glycines
  Promoter: Source sequence=SeqID_31692; Location=1..285; Strand=+; Gene=SeqID_62000
caggtttttaatagcatcgacccaggcctggaaaaggatgtctatttaaatttattttacaaagcaaaaaaagtataaaaatcatttaattacttaggaacttttctataatatctatttatcaataacaatgtttttaaatttatttgtatttttttgattttttcaaatagcctcggtcccattaagaaacaaattttgagaattatccaggaaatcccattttttcatatttatctgaacctgtattttctggacatgaatctataaaatttcaggcccatg

SEQ ID NO: 99613 - DNA, 59 bp, Heterodera glycines
  Promoter: Source sequence=SeqID_2052; Location=3044..3102; Strand=+; Gene=SeqID_77526
aaaaaataataaaaaatatattaaaattaaatattgtcagagttgaacaaaatgttatg

SEQ ID NO: 99614 - DNA, 488 bp, Heterodera glycines
  Promoter: Source sequence=SeqID_17445; Location=2088..2575; Strand=-; Gene=SeqID_81931
ctcaaaatttaaaaaggcaacaaaggcgttcgaaaatgcacctctcactattttggaggcataaatgacataagcgacgccaaagtttgaatgctgctgcttccatttcattttggattttgggataaggaaataaattgaggaatatttgtggtttaaaattaaaaaaaatgtaaggcggtacttattgctgcgctaattgatgcatatgggaacgtggcacaattttcattttttgccgtccttttgtttccttttttaagttttaaagtgtaggcacaaaacggaaaagtaccatctttcctaatatttgtttcttactccacgcataattcagaaaatatgtaatttttgttcttcaaatgtcccatttatatcttattggcagctcttaagcacgaattatttttcatttggcgactaataattaattaataagactaataattaataaaataattttttatagattaaatattttcattatg

SEQ ID NO: 99615 - DNA, 424 bp, Heterodera glycines
  misc_feature (56)..(56): n is a, c, g, or t
  misc_feature (86)..(86): n is a, c, g, or t
  misc_feature (104)..(104): n is a, c, g, or t
  misc_feature (114)..(115): n is a, c, g, or t
  misc_feature (120)..(120): n is a, c, g, or t
  misc_feature (125)..(125): n is a, c, g, or t
  misc_feature (127)..(128): n is a, c, g, or t
  misc_feature (147)..(147): n is a, c, g, or t
  misc_feature (149)..(149): n is a, c, g, or t
  misc_feature (170)..(170): n is a, c, g, or t
  misc_feature (172)..(172): n is a, c, g, or t
  misc_feature (229)..(229): n is a, c, g, or t
  misc_feature (250)..(250): n is a, c, g, or t
  misc_feature (261)..(261): n is a, c, g, or t
  Promoter: Source sequence=SeqID_13942; Location=1..424; Strand=+; Gene=SeqID_77896
ttttttcaaatatttaatatattttatttattatttttaaattaattatattccanaataaacaaatataaaatatatttaaaatnctttatccatctcccatntaatctaatnnttaanatttntnnttttcacccacaccacccnanttctattccccacataaaaananattttttttcaaatatttaatatattttatttattatttttaaattaattatattcnacaataaacaaatataaaatnaatttaaaatnctttatccatctcccatgtggtctagtggttaggatttgtggttttcacccacacggcccgggttcgattcccggcatgggaagagatttttttcaaatatttaatatattttatttattatttttaaattaattatattcgagaataaagaaatataaaatg

SEQ ID NO: 99616 - DNA, 212 bp, Heterodera glycines
  Promoter: Source sequence=SeqID_3356; Location=1..212; Strand=+; Gene= SeqID_84353
caatttattaaatatttcgaaagttcgatcagcgtagtcatttttggtgtaaatctagttttctaaaaacaacaaatttacgagttttcccagggtgccttcggcactgactaaccttttcccctaagaatcggactaaaaattttcaacctaaaaatcgactttttcaatccttaattatgtttaaattttaattaattattcactttatg

SEQ ID NO: 99617 - DNA, 114 bp, Heterodera glycines
  Promoter: Source sequence=SeqID_31873; Location=557..670; Strand=+; Gene=SeqID_62183
attaaaaaacaaataaaaaataataattcttttaaatctctccccccccccaccgcccccttaggctccgcgcgactgcgcgtccaacgcgagttggaggcggtacaaagcatg

SEQ ID NO: 99618 - DNA, 1003 bp, Heterodera glycines
  Promoter: Source sequence=SeqID_11089; Location=444..1446; Strand=+; Gene=SeqID_74421
gaactctagaaaaaaaaatgttttttagtccattttcaattttttgtctccaaggcaaagccaactgaggtattttgccaaattatgaaagaatcgaaggtaagctcattcggcctagattacgaatgaatcactgtgttcgggtgtcttttttttgtgagactcaaatataaggccgcaaatataggaatcggattctccgaccgtgaaaacctctaaaatgacttcactttgtgaaaaaaattgaaaaatttttttgagtaggggttggggtactatcggcactattacctttttaagtttttcacgtaaatttcacgtaactcacgttgtagctaaaattaaacgtcagattcgtgatcagcatcaaaaattagcctagaaaaattattagaaaagaaatttcagggggggtggcaaaacccggaaataccctttttttcatccggcggcgccatcaccgctacttgactccctaattactcaaaaacgcaaaagtggtcatttgggaatttgagcgtcgagactaaagagcagaattttggaaaaccccgttcccggacaaggatccagacacccaagatgggcccggacaaaatcccagattaaaagacctgttttaacatcactcgggccttggccaggacctgggaaaattctatagtatcccgccctctgtccggtctctagtcgagaatacgttagtgtccctccattgtcatttaattttcttttatccatttctgattcattttaataattttgtcatggacacttcgaatttttcaactccaaatgctcttctaccgtattgcaaaacgatcgaagaagtactgttgggctccgactattacgtcatgcatatccaaatgtttttgctgacttgcgtattaattttgattgttattttggttcgtcaatatttcaaacttcgaatttccatccacggaaacttaagggtattttattgaaaaaatgcaatttaattacaaatattaaaatg

SEQ ID NO: 99619 - DNA, 88 bp, Heterodera glycines
  Promoter: Source sequence=SeqID_23077; Location=1445..1532; Strand=+; Gene=SeqID_53782
acaaaatgacgaacagcgtgccatcaatcaacaaacacgcagtaaggcttggcaagaattggcacgacaatttgactacgatctgatg

SEQ ID NO: 99620 - DNA, 72 bp, Heterodera glycines
  Promoter: Source sequence=SeqID_31049; Location=1172..1243; Strand=-; Gene=SeqID_61421
aagaatttttcgaaatctcgtttaatttatttatatttcttttttgtgggggcgtcgtcgttttatggcatg

SEQ ID NO: 99621 - DNA, 542 bp, Heterodera glycines
  Promoter: Source sequence=SeqID_1767; Location=2142..2683; Strand=+; Gene=SeqID_75834
ttttatcgcaaaattttctggagaatattgaataaacttaaattttcttaaaaattgataaatttattttaaaaataagcaaaaaagctaaaatttcgcttttcgggttgattttcgttaaaatgaataaatcatagcattatcatgtttttttcttctaaaatgatttttaataccatttttgtccgtattgtggccattttatgtccatattttgtaatttttggtccatattttacgattttatatccatatttctccgagccatacaaatcacaaggtcatgtattcgacttttattttgccctatctcgaaacccggaccaaaactcgaaaaaaagtcgcacagattcgtacataaaagtgatttatgaaaaattctaattttcgacttttgtttgaattcgggtccggaattcgaaataggccaaaatagatgccataaaaactcctgaatactgagggtccaggcgggtccattaacattcccaaattggtagcggtgttgttaacaatcctttattcaagagtattatacaatg

SEQ ID NO: 99622 - DNA, 1003 bp, Heterodera glycines
  Promoter: Source sequence=SeqID_20245; Location=1709..2711; Strand=+; Gene=SeqID_85045
ctttccattgccaaacaacaattcaatgatgcatttgacataaaattggcagaaattgaacaacaatatgttaaggtagaaaagtgcaaaatttttaagcaaatcgaaaaacgcagtttcgacttagtttttagattttctgggataacttatagaattccatatttttatgggttcccaattttaccgaaaaaatccaggaaaattccaaagctaagaaatcctggttttttcctgtttagcctggacctgaggcctgaacaggatctttttttttgacctggacttgtatttcctggacaaaattccaggtcaaggaaaatccagtgccgaaaaattgcaggcctgggtccaggaaaaacccaggcctaggtcctggtcgagctctaatttttaagtatttgattttcaaattttcaaaaagtttactacgagcaggaatgcatttgaaattacgcaaaaattacgtagttttccaaattaatttttaattttttctgcttatttatttatgtgcctttttgcgacctttttaatttttaactctataattaggcaattttttctttgaatataaataattaaattatgtgtaaattaagacatatatttccacaaaattggatgcaattgactgggccacagaatgcattggtattgtgcattatactgtagaaaatacagtaataccattggttggcgaagcttacaaaacgttagataaattcggtgaattggtttctgatttgtcaaaaaataagaaaaattttgcaaaaattattatggagacggctaatttggacatgaaaaatgcttataaaattactatacagaacgcattgtcacatcaaaagtaattaaatacaataatttgaacattcaaaataatttttttttcaagaaaaaaatttttctaagaaaattaaaataaaatccaatcaaaaatggaattatttttaaaaaaagtttatttaaaatgattattttttttaatgcaaaaatg

SEQ ID NO: 99623 - DNA, 1003 bp, Heterodera glycines
  misc_feature (724)..(724): n is a, c, g, or t
  misc_feature (767)..(767): n is a, c, g, or t
  misc_feature (779)..(779): n is a, c, g, or t
  Promoter: Source sequence=SeqID_629; Location=1108..2110; Strand=-; Gene=SeqID_57750
cctttttttattttatataaaatgcatttgcgaatttacttttttcatttcttttattttaatagtatttttgagatttcttaaaaatattatctcccaaatatttttaacataacattgatatttttctaaaaataagaaattggaccataattttagttatctcttctaaattataagctaccgataattttggcaaagcaaacataaaagcagtcaagaactttgtacttttttggagtcactaatttcaattttaaaaattttctgcttcctaactacaaatttacaagctattttttatcgaaactattgaaggtcctaataaaacataaccatcaaaaaagctttttaaattatatgttcaaaatatataatttttgtttgtatgatataaattcaaaaatctctataacccataatttcattcctataattatctaacgcttcaattttatgaacttcttccaaattgaaaataatcatttaattaaaagaattttacttaagtcagaactcaaactttgaataaaatataataatatcagggctcggattcgtacttggatttcggattttgtgcttggaaaattttaactgtacttttttccaaaattgtacttggaaatcgggatttttgatttgagtacgaaagtaaaaatatatattttattaaaaaaatttaaaattttggattttgtcaacaaacattaatttttactanatctaacctagaaatagacaagtttcagtcaaaatctgtttanaaaaggtacaanagttctaatttttctcccggcagcgccaatggcaccgcccaaccccaaaaaataacgcacaatttttcttaacaattgatccaaaatcgcaaaaattttgtcattttttggtgaaaatctgttaacaaattacaccgaatttttaaaattttcccggcggcgcctatcggcactgccggacccccccccccccctcccttcatgaaaaaccgccacaaaaaatg

SEQ ID NO: 99624 - DNA, 297 bp, Heterodera glycines
  Promoter: Source sequence=SeqID_11; Location=9277..9573; Strand=-; Gene=SeqID_69059
ttttttggagagaagcaatgttgtggttaaactcaccataacaataaaatatcatattgattggcccattagatacccgggcatccacatttctcaaaaaacgtataacccattctgattttccacttcctgtgctaccggaaatcgtcaatgtaaatggatgccgaaattttgtgtccgtcacattgaatgattgaaaattttgctccatttatagcaaatcaataaaaaaacaatttaggtttaggacaattcattatatattgcttattgtactgctcaatggagcgcattatg

SEQ ID NO: 99625 - DNA, 390 bp, Heterodera glycines
  misc_feature (9)..(9): n is a, c, g, or t
  Promoter: Source sequence=SeqID_18003; Location=1..390; Strand=+; Gene=SeqID_82572
ttataatgntcaaatttcacttataattgctactttttgccaccgttatccaacttatctctgtccatcatcatatttttagctattcttaatgtattagccatccattcatttatggttcacgtgattcatggccactcaatgctctgtggcaggagctaatgctttctcttaaacgagattgttccgccatttcgttgatttcaaactctgcccataatccacagatctccgctcattttttgttcattttcaatatgcttgctcatttatttatattttcgacaattatttatttatttatttttcactttcttttaatttccttttattttcaatatttatttctctttcgcttgtataataaaaataaaatttagctttaaaatg

SEQ ID NO: 99626 - DNA, 75 bp, Heterodera glycines
  Promoter: Source sequence=SeqID_37088; Location=694..768; Strand=-; Gene=SeqID_66251
ggtttttttttgtaaaaaaaattctttttttttaaataatgttttatcctttttcagggaattcatttccttatg

SEQ ID NO: 99627 - DNA, 230 bp, Heterodera glycines
  Promoter: Source sequence=SeqID_9185; Location=851..1080; Strand=-; Gene=SeqID_70528
tgcaatttcaacccgaccacaaaaacttggggatgggtcttcaaaaagcattccaaacccaacaattttcgtcctaagcaaccaaattcgggaaattcaaatgctaccaaaacatttacaggtaaatatcaacattctcaggcaccagttagtcaaaagtgtaagcggtgtggtcaagcacacgcggtgcgagactgttcatttcctgtggacgtcaaatgttttggatg

SEQ ID NO: 99628 - DNA, 68 bp, Heterodera glycines
  Promoter: Source sequence=SeqID_13306; Location=1..68; Strand=+; Gene= SeqID_77153
tttatggaaattcatttaaaaaatttattcatttacagtaaagcaaaaaaaaaagaaaagaaaaaatg

SEQ ID NO: 99629 - DNA, 109 bp, Heterodera glycines
  Promoter: Source sequence=SeqID_24399; Location=41..149; Strand=+; Gene=SeqID_55123
tagatgcttgtaaaatttataggatatcccaatcgggaccggattcatgaatctcagcttgtataaaagcgatcacatttttcattttgttgtaataaattcaaatatg

SEQ ID NO: 99630 - DNA, 115 bp, Heterodera glycines
  Promoter: Source sequence=SeqID_11449; Location=117..231; Strand=+; Gene=SeqID_46958
ggtgactaaaaaagctctggtcttaaaaattcatttcaatttggctcttgtcgtttaacatgtcaaggcttgcaacgagtttacgcaacatgtcatctcactgttgcgggacatg

SEQ ID NO: 99631 - DNA, 197 bp, Heterodera glycines
  Promoter: Source sequence=SeqID_8250; Location=3774..3970; Strand=-; Gene=SeqID_67435
ttttttgatggatttgtcatgcaaaaataatttgtaaagacatccctcaataattctaatcgaaattaatcgtttcgcataaaaaaatcaatataaaacaatttcaatgaaaatgccattttaatgttaacattaataacaaacattatatattactcaaattatccatcacaaattgccaaaaaaacattaaaatg

SEQ ID NO: 99632 - DNA, 389 bp, Heterodera glycines
  Promoter: Source sequence=SeqID_8320; Location=110..498; Strand=+; Gene=SeqID_67679
ggtaactttttgggtttggcaccgtacgaaattttcaagaaaaaaatcttagaaaattctatggaaacaaaatttttttgaaatttttgtttcttcgaattttttcagaaaagtttttctaacatttttttcttgaaaaatttctgtttgaaaatttttagacctgtccatactcaaaattttggaagaatggtattttgtgccgaaaaattttcgggttttcctttatgatatcccttccaagactcttttacccaaatttttccaaaaaccaaaacaaacttcctggaacagtccctgattcagcggtcgagcagaacttggcattgtggaaggaaatgcaggagggcagcgagcgtggacagcagtgttgcgtgaggatcaaaatg

SEQ ID NO: 99633 - DNA, 762 bp, Heterodera glycines
  Promoter: Source sequence=SeqID_15796; Location=28..789; Strand=+; Gene=SeqID_80116
agtgcgttttggtgatgctgcgagatggacgacggcgagcaattcgagaggacagaggcggcgggtggagaaggggagacctgttgatgtggaatttttttcgttttttttgcgctaccgtatccctcgaaattcgagacagtaatgcaattttttactattgcgtgaactactgtaaccataaaaaagtacgatgcgataccgtaccagcacactactgctgatatgaacagcttataaaaatattatgtacaaaaaatttgccgaaattttggatttttgaggattccaaaaatttacctagataaaaaatcctcaaaatatgtaaaaaatgaaatatgttagaaaaaagtccaaaatataaaagttaaagctaaattagattaataaaaattttcaaacaaatttctttaattatttcaaacaattaatattttttggactaattcccggttgccctaccgggactgggacctgagcttttcaaaatccgggaccgcgacctctgaggaccgggaattcccggtcccggcgcactctagtttcttatattgtttaagaatttcgattcttaaacccacttcctcagttttttaatttgtagtaaaatggtcaggttttatttacctaattagtattaatgggccagtcaattttgaaatattcgaactcggtccttttatttgtcttgtcgacattttttttttgatcgtcaacttatccaagagcgtgtccgacggtggccaatgtcccagccgaatg

SEQ ID NO: 99634 - DNA, 833 bp, Heterodera glycines
  Promoter: Source sequence=SeqID_5950; Location=3232..4064; Strand=+; Gene=SeqID_59780
ggtttgaaaggcaaagacctcttgaagaatttagggatgaatttattgcttataaaatttaagaaaaaaataaaaattcgagaaaaggaaactgcatgagaatcaaaggttgtgggacataaaccaaaaacaggtgaaaagggaaacaggtgaaaatagatgaaaaggaaacaggtaaaaacaggtgaaaataggtgaaatttcacctaaaaatatataggggcgtgtatttaatggggcatattagagaatgtctcaactagtatcaataaaaagtgccaaaggaaaattttgtgatggttatcgctattacaaacataaaacgaccaagttcaaactttggtggaaatgtgaacttaattcacatgggtgccagggctggggttttgaaaaggaagggttttttacaatgacgcgccgacacaatcatcatccagacactatattgattgaaatcgaagaggaaataaaatatcataatttttctgcgggggcaaaatgttttttgggtgacaacaagaaatagttgatgatgctaagaaaaatccgagactccaaactgaatttagagatgaatttattgtttgtaaattataaaagaaaacaaaaaaattaaaataaaaaaagatgaattttgaaaaatcagaaaaactaattccatattattggaagctgcaaaaaaagagacagaaagagcatggcgggatgtagctacgctaacggatgaagtaagcgattttgccaaatcttctcgcgaaacacttaatcgtgcaataaaatctagagaaaaggctccttacgctaatggtattcgagaattatatcttagaatg

SEQ ID NO: 99635 - DNA, 222 bp, Heterodera glycines
  misc_feature (17)..(17): n is a, c, g, or t
  misc_feature (92)..(92): n is a, c, g, or t
  Promoter: Source sequence=SeqID_39742; Location=1..222; Strand=+; Gene=SeqID_68243
ttttatgataatagggncccggatttatatggacaaaaaaacccaaaatatagattataatatggatgaaaaaatcgcaaaatatggacganatatgaacaaaaacgcagaaatattgacaaaaaacacgaaaatatggacaaaaaaatctctgaaaatttgtttgaatttagaaaaaaaatcataaacccataaatttttaagaaaaaaccatttttcatg

SEQ ID NO: 99636 - DNA, 1003 bp, Heterodera glycines
  Promoter: Source sequence=SeqID_5608; Location=3089..4091; Strand=-; Gene=SeqID_58631
gatattagacctaatcctgatcatttttgtagagttcgaacaatgttcgacttttagaccttttgttcgaacttttattttcaataacccagggctcccagtcactgtacaaacatttaaagtctcttttgaggtcttacaagtgctctgtgagcgaaaataacaaatgaaatttgttcgaactccaaaaagtgggtctaaacgtcgttttggagcaaaaataacaacatttcgaccccccttggagtaacccctgtctggaaatgtcttcctgatcatttttgtagagttcgaacaatgttcgacttttcgacattttgttcgaactttttattttcaataacccagggctcccagtcactgtacaaacatttaaagtctcttttgaggtcttacaagtgctctgtgagcgaaaataacaaatgaaatttgttcgaactccaaaaagtgggtctaaacgtcgttttggagcaaaaataacaacatttcgaccccccttggagaaaccccctgtctggaaatgtcttcctgatcatttttgtagagttcgaacaatgttcgacttttcgacattttgttcgaactcgttattttggtctgaatagggctctaatccattgcgtaagtatttttgacgctttattttaatttgtaattaaaaaaatatatatatttaaattaatttttgaatataaatattagaaataataattagcgaatgggagcgccgtagcatagtggttaacgcttttgattaaatgctttgaggttctagtctgcacggcgctcccataattaggtaggaattaacatcattacattacattacattacattacattacattacattacatcacacattttttttataaagtttttgttataacaaccaacattttggtatcactacttcattttagtactaatcattgtcattaaatttacaaaagctcgtttttatttattatttattatttagtttagattttattaaaaaaatg

SEQ ID NO: 99637 - DNA, 911 bp, Heterodera glycines
  Promoter: Source sequence=SeqID_21115; Location=1..911; Strand=+; Gene=SeqID_51704
aatttgtgttatttcccagcaatttgtttaatttaatggaaaactttaaaataattagcgaaaagcacaaaaaatgtttttatccattaaataaatttaatttcaatttaataattgcctcattaattattgagagtacaataatttgttttgttttcaagaattcaaaaaatgctaagaattggtttgcattgaaaagggcaaattcggcggggcatggaaatgcttaataattcgttgtacttgaagctgttcggtgggcaaatatttgatcaaaaaaggtgggctgaaaagcacgcgaacggagtgatgagtttgaagcggtcatcagaaaagtgcaagaacaattcactgaaatgcttaacacaccgtttcaaaaaacgagatgtgtaccaataaatagagagtgccagagaaaaacattatctttttttctctaattttttgtctccttttggcgtactatctaatatttttattattaggaaaaacaacattcacttcgtgatgtttaactttttttctgcatgttaaatccacaccaaattttgcaaatcgatagagaaaaaaattacgaacataattggagggtttttatgaataaaagtgggttaactaaaaagttatgccgattttagcgctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttgaaaaattttggacatttcgtgggtttttactcttttggacatttcgtggcttggacactttgtgggggtgccgattttagtggtaaaacttttggatg

SEQ ID NO: 99638 - DNA, 239 bp, Heterodera glycines
  Promoter: Source sequence=SeqID_5003; Location=279..517; Strand=+; Gene=SeqID_56515
gctaaaaccaaacattattggttaacccattgctaaaatcatggtactttggttttaaattataaaaaaacgcaaaaaatggcaaattggcacacttaacgaaaggggaagcgggggtaaagccgaactgtgaaaactcggatcagaaaagcgtcgatatagccagggacaacattgaagtcaagttttaacaagactcctaagtttttgggtgattatcatgctatttaaggtcaatg

SEQ ID NO: 99639 - DNA, 858 bp, Heterodera glycines
  Promoter: Source sequence=SeqID_20707; Location=1568..2425; Strand=-; Gene=SeqID_51267
ttgacgaaattaggtttttaaatacttatatttagggagttttttttaaagtcaaattatgaaaaaataggagttttgggaggccgggacggcccgcccgcccaggaaaaatttgaaattttaccatttttagcagattttcaccgaaaatgacaattttaaagtcaaattttggaattttcgaggaattttaagagatccggctgtaatttgttcaaatttttaattattttcaatcatttcgccggtgaccccaccccccccccccctccccaacttcattttggttatgtttcaattgtaaatgaaattttaaatattttgaagttattttccgaataagaacaatttttaaaccaaaaattttataaagaaaaaaaatttgggggaccaatttttggtaattttcaattcttcggggtgtattttcacgcgtcatttcttaggtttatttttgtttgtttctttttttgcattttgttatgaaattttcaaaaagccaaaataggcgccaaaaatggcgaaataggcaaaaaatacgcgcctatgcattaagcataaaaaccccaaaataggcgaaacaggcattaaaatgtcatcgaagaaacccctagcgaagacattttaggcctttgcctaaaaaacaaagacatttatagtttaattttttagcaattattatttttatattttttgtctttaaaaaaaatataaaccttggatttatttcgtctacctttgttttaaaaaaaatactgtttataagcaaacatatgcacaaaaatctgtattaaaaagtatataaccgacattcaatgtgtgctcctttttagttctagttttgaatcagaagtaatg

SEQ ID NO: 99640 - DNA, 1003 bp, Heterodera glycines
  Promoter: Source sequence=SeqID_1512; Location=30..1032; Strand=+; Gene=SeqID_74102
gcgtagaatttcgatagctacgcgccaaaattttttgtaggcataaatgctatgccacaatttcagctaagatttcttcttcgaatgggtctgcaattctactcgcccgctgttgattttaaaacaaaattcaaactttgacgcaaagcattttaaaaataaaaaatgatttcatcgattttaaaaattaaagaaaaaatttaaatttatttattgaaacagaaaaagatattatgagttaatgaaagaataaaatgaattttattgaaatagctaatcaagatgcctattggttttttaataaataaaaattctttcaaagaaagtttaaaaaaatagattgattgatttttatccaacaacggacagataaaagggcaataaaatttaatcaaaagcaattgcaaattaattttaaaaaatcaaatgatgtaattactgtaattactataaaaatacacgaattaatttatctactaaaatctaaatccatttattgctttattaaagggattcttaaaaattagcaataagaaaaataatcacaaattaaatgaaaattattatttatttagtcaatatttacactaaaagaaaattttatcataaattgatcatggtttgaacagaccgagtaaattgccatgcaagataaaagcgaatgtaaaactgaaaaaaagaaatctaatcttaatccataatgaattaaacggaatgtcaaaaggcgttcatggtgcacgataggaaaatatttatagaattaataaagaaaaactacagtttttgtttatctacgtcaattaaaatattaaaactaataataaaaagatagcatttgggaaaaaagaattataattaatttttatgtgattttgaaacataatttactaaatttacatttctatgagaataaagaggtgaacgtaatattaaaaattaaacattcactactgacaaggcaccgataattgaaaaaaataatttattaacaaaacaaaaaatg

SEQ ID NO: 99641 - DNA, 642 bp, Heterodera glycines
  Promoter: Source sequence=SeqID_41644; Location=643..1284; Strand=-; Gene=SeqID_69729
ttcttttaagaaatctcccgaatgatttttttcgaattaattcttaacagtaagacagtgggtgcttaatttaatattgctaattatttcgttgttcaaatgaattttttgttaatttgttgtttcaacttttaaatatttattaaatttatttattcttcattcgctattttttcctaattttcgtaaaacaataataataatttacttatttataatatttattaatttctctcataattaatttaataataaattttgtaaatccgtcaaaagtttgttcaaaattttatatcacagaaataccaccaggtttaacgattaagattgaaaaagtaaattttttttaaaaggacactgatttgtgaatcttcgcatgatttattatagtttaatgttttatagcttttaattattaaagcattttttaaattattaatttagcttttttttattgaagttgagttaatttttcatagattaccttttaaatggcacatatcaatgggatatataaacatttaaatacattatttttatttacatttttctaacagattgttttatttcaaatcatattcccattttttataattatttcaagttttataatttcaattttaagtgtatattatcaaaatg

SEQ ID NO: 99642 - DNA, 77 bp, Heterodera glycines
  misc_feature (11)..(11): n is a, c, g, or t
  Promoter: Source sequence=SeqID_17268; Location=1..77; Strand=+; Gene= SeqID_81734
tagaaaaactnattccaaaaatttcataattttccgtaatggtagaaacataatatctagagctcgaccttggcatg

SEQ ID NO: 99643 - DNA, 344 bp, Heterodera glycines
  Promoter: Source sequence=SeqID_315; Location=7664..8007; Strand=-; Gene=SeqID_81965
atcccattgaattacggttgggaatgggtacggtaccgagatgaccagtgaatgtttggtcaaatattttcatagaaatatgatcagatttggaatgtaaaaattcggcatttctcccggattttcatcaaaaaattaaaaatccgtccgtaagtggcaaaatggtcaaactggagaagaatggacacaagcaaattaatattgaccaaatcggcgcattttaggtacagctgatcaaacatgacaacaacctttgggtgaagacaaagtgtgaagagccgcgcattggccaaatgataatttcccatttaaaaagtccgacgacccaaggccaaattcacatg

SEQ ID NO: 99644 - DNA, 109 bp, Heterodera glycines
  Promoter: Source sequence=SeqID_40095; Location=307..415; Strand=+; Gene=SeqID_68528
attaatgaataaagtatataattaagtatatcattccatattaattaatgaatattaagcctaattacataattaagggtatcattccaatcttcaattgcttgcaatg

SEQ ID NO: 99645 - DNA, 429 bp, Heterodera glycines
  Promoter: Source sequence=SeqID_34259; Location=285..713; Strand=-; Gene=SeqID_64091
gtttgtaacatcaaagcaatcactttttaaagaatttgatcaatttaaatgtttttttcaaaatttttaatttttctaagaatttaaaattggtttttcatgcattttccattaacccgttggacagttaaaacaggtaaaaaaaagccccaatttgtactatgccccgattcactgttttcgataaaaaattcattaaaaaaacaaacagaaaggattatttgctttttagagatgagaattgaacttttgagtgaaaattggaccaaataaatgggcataagccactacgaaaaaaagagaggaaatgcccaccaagcttcatcctgaagctccaccaaagcgcaaaaaaaaaaacttattttggaattaacaattttgggaataatattttttaaaaaatatttttaaatttcaggctaaacaatg

SEQ ID NO: 99646 - DNA, 297 bp, Heterodera glycines
  Promoter: Source sequence=SeqID_14650; Location=1638..1934; Strand=-; Gene=SeqID_78749
atttttgcatgaaattataattttcaagtgttattaaaattttttctataatcagcagcaaccattttatttagtcaatttcctgaggaaaagaagaaggataccgaacgttttcaaataatacaaaatttatttgattgttggaaagctgctgcggattactttgtgacaggctgttggtcccatgcggatacacatgcggagacaagtacaatttttggacggactatattaacggtaagtgatatagaattatatttttttatctaaaaaagaatttaagtattggacaccatg

SEQ ID NO: 99647 - DNA, 154 bp, Heterodera glycines
  Promoter: Source sequence=SeqID_5209; Location=390..543; Strand=+; Gene=SeqID_57276
attttgccgattatgcaggccgatcggatcagaaacacccccccccccccgcaggatcgaagcggtgatcgaaagcgcacgtcggatgaagcaggtccatgcgactctctccgccggcatttgtccgtccgtcatttccaattccgtgccaatg

SEQ ID NO: 99648 - DNA, 495 bp, Heterodera glycines
  Promoter: Source sequence=SeqID_4857; Location=1..495; Strand=+; Gene= SeqID_55974
taattacatttggctaatttttcaggactttttttgatttatttagtgcttttttggtatttttataagactttttggttattttttcataacttttttgcattttttgtgactttttggcgttttttatgactttttcgtgactttttggcgatttttcttgactttttaagtcgacttttttgagatttttcgtgacttaaattcccatccctagtgatcagcgaccctcaaatccccataaaatgtgttttcacgactttttagaagaaaaaattttttattccaaaaaggggggggcaccagcttcactattaccaaaaatcctagtcatactagtccaattattataaagaaaatgagtggaggttcgagtgtgctttacaacactaatattttgttttttcgtctgtttcatattacattatttcccatgatttttttgtttttgtttccagattaaaacatattttaaatttttgtcgttcaataatg

SEQ ID NO: 99649 - DNA, 281 bp, Heterodera glycines
  Promoter: Source sequence=SeqID_10830; Location=597..877; Strand=-; Gene=SeqID_74097
ttgaagaagagacaaaaaaagagttataatcaaatatgaagtattcttaaaagaagttatgtaaatagctaatttcgaagctagtgtgtaagtacgtgcgcaggtattttggtgtttgttcaaaaaaaaacgatgcctacaaaacgccaaaagttcggataatttaaagttaggttagctccgttccgaccattcttttcggttgcattaaatctttttattttattttttaatgttcacataaaactgaattaatggtaatttagagtcttttcacaatg

SEQ ID NO: 99650 - DNA, 478 bp, Heterodera glycines
  Promoter: Source sequence=SeqID_6721; Location=627..1104; Strand=-; Gene=SeqID_62630
tgtaaaaccttcattggaaattcagcacaattctgtgcgtgaaggaggatttgacattaaggtaaaaagggagagaaaaacaaaatggaaaacatttaataatcaaaaggatcactggtataattaattaattaaaaaatggcaccggataaaaagcaattaaaacataattattggctaatgtgtcaattgcattgtcattaggcaactgaaaattggataaaataccataactatggaaaaattttgacaaaatttctatttggatacctgggatgagcaaatggcagcaaaaacataagaaatttattatttttctttttataaattgtggaaatgaagcctaggtctagcgctagcctaagcttagtccatgcttaagtctaagtctaatgtgcaaaaaattattatttttctccgtttgctaaaaaaaagttgacaaatttaattagccaaattttcaagattttcaagaatg

SEQ ID NO: 99651 - DNA, 225 bp, Heterodera glycines
  Promoter: Source sequence=SeqID_2443; Location=4162..4386; Strand=-; Gene=SeqID_79752
aactttttgcaataggttgtcataattggtggcgactggaaacagctggcaccggtcatccctggtggagccgatcgagaacaactcgaggcgtctgtcaaaaattcgccgttgtttgccgacttcaaaacagtgcggttgcgggcgaatcacagactgaagtccggccagcagcactaccgtgcgtttcttaaacgcatcggtattggcgcgctgaacaacatg

SEQ ID NO: 99652 - DNA, 79 bp, Heterodera glycines
  Promoter: Source sequence=SeqID_9729; Location=1..79; Strand=+; Gene =SeqID_72503
cccaaggccattgtcaaccactccgatcaggcgccatgcgcgtgttcgtgcaaaaactgccgaaaaagcaacacaaatg

SEQ ID NO: 99653 - DNA, 59 bp, Heterodera glycines
  Promoter: Source sequence=SeqID_3298; Location=953..1011; Strand=+; Gene=SeqID_47580
agaccaaaaataaacgtctgcgtattgactcattaggaacctactaaaaaaaaaaaatg

SEQ ID NO: 99654 - DNA, 630 bp, Heterodera glycines
  Promoter: Source sequence=SeqID_567; Location=846..1475; Strand=-; Gene=SeqID_56335
aattttgagaaggctagaaaaagttttttgagaaaaatttggcggtgaaatttttcccggcaaaattttggggtgcgcacctgggttaattgtagtgcacccatattttttatgtttatttttatttgccagagttgaaaaccatcaatcgatgggttttgcgtgtgcgaacagtggtggacaattatgtgacagaacgccaacgggcattgtcaattgcaacaaacgatgccgtcaatcaaaatgctgttgagcaagcggaccgaacatttctgaaccatcatacaaattacgtgaaaaaggttgaaaaacggaggctatttcaaaaaagagtatgcttcataatgagtcaaattccacccaaatttcaaaattttcccaaattaaaaaaaaattgaatgtttggctcaaaacctgaattccaaggccgtttgtgctgaatttgaaaacaaaaagcggggggggggggggccatgatttcaacgtttgaatgcaaaaacattttacccctttttattttgtcacagacattttatgcaaaaaggggtgtatgttcatgaccaattataatttgggtgtttttttttacagattagctcttatttggacggtttccaatcccacaacatg

SEQ ID NO: 99655 - DNA, 64 bp, Heterodera glycines
  Promoter: Source sequence=SeqID_7365; Location=326..389; Strand=+; Gene=SeqID_64618
tggctaaccaatcagcgatttttgggcacaaaaaatttttcaaataaattttcagtgaattatg

SEQ ID NO: 99656 - DNA, 410 bp, Heterodera glycines
  misc_feature (222)..(222): n is a, c, g, or t
  Promoter: Source sequence=SeqID_18847; Location=867..1276; Strand=-; Gene=SeqID_83541
aattaaaattccaagcttcaatacaataaaattttacctcatttgtccccctcattaccttccaaaaaggtaattttgtatcatttgctaaaagttggcattctaaaaatgattatgctttgttttttattactaaattttttaaatttaaaaccaccttttattagagtatacattttgataaaagcctaatgggactgggctggggtcaatgcttgactnggtttcctacacaaaaattcagcaaaatccaggtccatgaaaaatctaggttgctgaaaaatggactggacctggactacgagaaaggcctgggtccaagtccaggtcgaactctaagtttatattacaaattacggccacaatgtttatatcaaatgccaaaaaaaaacaaaacaattcaggtgatg

SEQ ID NO: 99657 - DNA, 858 bp, Heterodera glycines
  Promoter: Source sequence=SeqID_7831; Location=305..1162; Strand=-; Gene=SeqID_66103
gtgacttcagaatcgaaaatttcaatacagaaatgcttttttgagctcctttttttcaaataaaagcaaaaagttttttttatgaatttttaaatgtatgcatatttttagcgccctttttggcaatattaagaatggtgtcccgacgaaaaaaatgttaaaaatttgtcgggtattttttctaggcttaaaaatgagctgatcacgaattaggcgccgccgggaaaaatttggtaatttataatacgatttgtttacagattttgtcaaaaatttttctaaccgaaaactaagcaatttgattttttagaaaaaagttgtgtgactcaaattttcattacgttataactcgggtcataaactgccgtttaattaatcatttttctattaattttaaatgtccaaattgattttatacctttataagcaaaattattagaatttgcgaattccgtgttttttcatgtgttagagacatgaaaatagtacgtcaaaatgagagaaaaagaaatcttcaaatattttccattatacccaaattttgtttgttattcttctaactatcgatatgcaaaatttagtgaagatttattaacatagggaaaaaaagctgcacatagaaaagtaaatgttgtttttacaccataaaaatgaagagatagtaaaagagaaacgacgagatagtattaggcttttctctgcacagtggggttgacccatagtgtaggtatctataaattttaaaatttgtttttaaattaatctgcatttgttgtacttattttatgtttgattctacacttttttaggaagctttgaatttgctgaggtttacattttcattattgaaacaaaatg

SEQ ID NO: 99658 - DNA, 969 bp, Heterodera glycines
  Promoter: Source sequence=SeqID_5022; Location=928..1896; Strand=-; Gene=SeqID_56602
ttgatatgggtgattaaattccgatggattaactcaattgtacacatatgtatgtcatggtgttgtgtatatgtatatattgctgtattatattgtataggctgtataaatgcgtcaatcgacttttaggcgattaatcaatgaccatcgtcaatttcttagggcataccttattttttcttacttggtcaatgttgtgtatttgggtaatactaccgatggtaggaatgaaattcttaggccacaaatttttcttcatcagtgtcaacatttcttggttacgcttttttagtatatcataattagggaacggatttttaggggcgaaaaagtttcaaatataagggtgaaatttattaaaattgcagtttttgtataaaataatttaaaacataaaggaatcaattttaaattacaaattttgattaaaggctcaaaattctttttaagtccattttcaacacaaatccactcaaatttatatcaaacaccgtttgttgatcagtgacaagaaaaacgaaaattaagggtcaaaatgatcgctttttgtttcaacctacctatttcacaaatttcattttaggaacaattcgaatttaattaaagtcgggaatttatttacctatttatttatttaattagcccgttttttcctttgaaattcgtataaaagacagagaacataataattgactgtcattctctgcaaaatcataaataaagtattaaatgtgaattttcttgtgctgttttactcaatgtcccatttttttccttgttaattttttaaatggaatttttggcgctagtttaaaagagtacaattttgaaaattttttcaacttttttttggtcaaaatttttttttgtttttttacacataatgatggatattaagtatccgcacaatttggcaacgggatttggactacgcaaatcgaagcgaattttatgagaccgaggaaaatg

SEQ ID NO: 99659 - DNA, 416 bp, Heterodera glycines
  Promoter: Source sequence=SeqID_39923; Location=617..1032; Strand=-; Gene=SeqID_68382
atgtatgtagggcctgaggtgtttgaacaccccatgacttggccatacgctaaactcccttggtccgtgcgtcaagacgagcccaacagatgaccggcttctacaccgacgacgactactgagagcccgagctggaccgaactggttgctggtacgtgtcgcacgcgaccgccaccgacccccagctcgagtcaacacggacccgaaaccattgcacaattcacccagagtaaacagcactcccccgatccgggtaccagaccccgaaaggctggcctcaagaccgagctcacgcagctactccgagcatctcagcgcactccgcctgcaaatgccccattcgccactgaacagaaggacagcaaaccccagtctggaggctagcaggccaacgtacagcaacaaacgggtgaatg

SEQ ID NO: 99660 - DNA, 180 bp, Heterodera glycines
  Promoter: Source sequence=SeqID_13624; Location=676..855; Strand=+; Gene=SeqID_77532
ttcgctacgtgcgcagaaccaaaaagccatcaatgatcttacaaattgacaaggttgggtaatgaaaattttaaaatttaaaaaaaaacaaaaatttaaggataatgtaatcaattttttaggaaattttcacgccaaatttttttttattaattattcaaaatttattcgcagttaatg

SEQ ID NO: 99661 - DNA, 424 bp, Heterodera glycines
  Promoter: Source sequence=SeqID_35398; Location=1103..1526; Strand=-; Gene=SeqID_46428
aaatttagtcttacacttgacgagaatgatttttcattgcgtctcgatcaaaaacatgatgttgctgttgtgttcaatcagcaaaatatgcttagcgacaacgcagatttaatggaagttcgacggactattgaacgatcgacggcgatcgtaaaaaataaataattatttttactaatcatttaaaataaatataaaataattatttgaataaataattatttatataattgaacagaaagcaccatcgcttgttgccgcatttgcacactcgaaaaaaatgcaacaggtcacattcattgtccaatatttgtatgccaagaaaataatttttgattttatttttctaattcttttaaattatttcaaattatttttcacattcccattttttaattattaggtgctctctgagcctgggatg

SEQ ID NO: 99662 - DNA, 809 bp, Heterodera glycines
  Promoter: Source sequence=SeqID_17622; Location=1432..2240; Strand=-; Gene=SeqID_82149
ccatacggacttacggactaaaaacccgtaaaacccttactcagtataagtccgtatcggcccaaaaaaatacggactacggacccgcaaaaacccgtatagggtccgaaccgtagccgatctttaatctgaattataaaatttattttttatgtaaattgcctttctgttcctgtctcttgtcaacgctggaaatcaaattactgttacgccacagaatcacaaattattcattcatttgatttgacaaataatttttaattaacgaaaattaacggcaatgtttcatcgtcaaaattggcaggtgcctttttttgtctttgtgagtaaaggcaaatcgccatgttagcattaaaaaaaatcttgaagtccaattcacagcggatgcatgccacaatgtcccttttaacatcggagacaaccttccggactggatcctggtcaactaactatcaactcgatcgcaaggaagcggccctttactagttcacaattccatcccttttttcatcgtcattcgcttttagtttattttttatgctctgaaattcttttaattttatactgccctcaattttgttttctaaaatatcggcgcttcccaatttttacttgaataaagttttattccagtgttgactggacaaaatatatttggcccatctccaattccccaaatttattaacagattttttatcaacaataccaatttttgcgattttgaactaatgttttaatgttcatatttgaatttcgaaagaaatatattaagttttttgagaatttttaattgttatcggaagaaatg

SEQ ID NO: 99663 - DNA, 107 bp, Heterodera glycines
  Promoter: Source sequence=SeqID_5003; Location=693..799; Strand=-; Gene=SeqID_45953
actgcaaacaaaaataaaaccaactaaatttttaattattttatttctcttaaagcccattttcaaacttttagggtgtaaatttaaattaaatttaaatcgaaatg

SEQ ID NO: 99664 - DNA, 481 bp, Heterodera glycines
  Promoter: Source sequence=SeqID_24156; Location=446..926; Strand=-; Gene=SeqID_54862
tgccctcatgtgtcccttgtttcgggaccagcgtacccaagcgcgggacccgtatttggaacttgagaagtgctttgaatcattccagcacctgggtcaaaggaagcaacgtcgacagcagcagcagctgccggtcacagtaaagcaggcacgtgtgcattgggccaccaaggcaggcaccccgaaggcaagatggacgactcaagtacgtggacaaagagagagagcgtgtgtttgtgtgtgtgaagcctggtgatggaatgcgaatgtggcgctgcagtctctgtgtgtgaggttgaagcagcgttggctgctttattttgggggagaagcgctggtgatgcactcgctttctctgtgtttatgtgtgcttgcgcgtgcatttccatggtcattgtggttgtcgctagtgtactttatggcgcaatactgatggtacggtgcctgctgtgcagtgtcggaaggcgatcgacggggcatg

SEQ ID NO: 99665 - DNA, 114 bp, Heterodera glycines
  Promoter: Source sequence=SeqID_13214; Location=1481..1594; Strand=-; Gene=SeqID_77041
attagatttttaaaaataatcatatatataaattttaatgtttttttttctctaactttttaattttctttaactattcctttttcgggacgacgaaagctaaggcccggcatg

SEQ ID NO: 99666 - DNA, 68 bp, Heterodera glycines
  Promoter: Source sequence=SeqID_21626; Location=655..722; Strand=-; Gene=SeqID_52221
tttcaattttatttcagtaaaaatttataggtaaattaataaataattagtgaaatcttatagccatg

SEQ ID NO: 99667 - DNA, 158 bp, Heterodera glycines
  Promoter: Source sequence=SeqID_9978; Location=4257..4414; Strand=-; Gene=SeqID_73020
tgaaaaataaaaaatgtcataataattagttatagattcttctaagctgacgaaagctttgccttataaaaaagcattgaaattttaattaggcgccataaatataattctaattaattaactgctttctccaaataattacacctattattacaatg

SEQ ID NO: 99668 - DNA, 326 bp, Heterodera glycines
  Promoter: Source sequence=SeqID_2436; Location=1..326; Strand=+; Gene= SeqID_79708
atgaagtcacacccccaaggggaagacttgcttatgctatataagcatagtgccatggggcagaggacaattcgccctcccccactcaaaatggacaattcttccccgtccccacgatcaccaagcgaaggagacacgactccctatgactcctccgctcctttgtccccgctctcgcctctccctctttgtcaaagagggatcaaagacattaatgtggaaatggaggatgcggcggtaggtccaacagtccgccgaaaagggaaggatttgaccctcctcgaaacggaggccaaagaggtctccgaacggagacctccaacatg

SEQ ID NO: 99669 - DNA, 1002 bp, Heterodera glycines
  Promoter: Source sequence=SeqID_11555; Location=2160..3161; Strand=+; Gene=SeqID_74998
acctcgcctcattaaaattaaccattccttcgttttgtgcccaattgtcttcttaatattatagatgaggtcataaataaaaccgtcaaattatgctgctaaataaactcctaaatccccatttgtcgtgaattttaatttacgtagcaattcaagataccatggttcagcaagagagaagttggaatgatgacgcggaaaatttttatttttttcaaaaggggttttccactatacgccacaaatgaataagtaaacaaaatctcaaaaaccggaaaaattagtaatggaaatcaaattgtttatgagatattgtctcacgaggctttgatcgtctctagcaactgatgactcaaaaaactgatcgccatctgcacgtaaataacgtacagacaacacattttctgttccttcttttttttagtgaacaaatttaaaaatttcatgtaaagttagaaaaaaaaaatagggggctggaaaaaaattcgctcactggtcgccccactcttgccccgtcatctcatgctcactaccggcgggcactccgtacccttgttggtgatccttaatttagcatttatgctcaaaaacacatttatctcgatgagaatcatcattctcggctcttaaccccttatcttcacttacttgacttttaaccatgatatttgattatacagttaaacattgagagtgactatttagacccaatttggctatttttttcctaaaaaaatgatgaatgaaatgttatgcctaaagaatataattgaaatttctcttccaaaaaaccaaaacaattctgatggaagttgtcgatggattgatgttcttattaggcatgggataattatctataccgccggtcgagtgtacccgatacctgggcaaatatttcagtatctgatcaaaccaatgtatacgcgaccggtcggcccttttccgaatgcttgaaaatttccaatgttctacttaattatacattatatagccttaattatg

SEQ ID NO: 99670 - DNA, 484 bp, Heterodera glycines
  Promoter: Source sequence=SeqID_12006; Location=1475..1958; Strand=+; Gene=SeqID_75530
ccttttcaccggttttataaaccgatccgatgccccgtccctttctctttgttctgttctctctaatttagaccaaattggccattcctttcccttcccttttaattgcgcaattcttgccctcttctcttctcttacgaaagactgaccttttttggtcgtttcataaaatagccgcagaatcagattctctttgcttaaatttatgtttttttaattcttatttatttccttcattaattaatacaagtacaatgtttttactttgattgtccggttcaggaaacaaaattttgcttcccatttctgtgcttactctctcagaatatttgtgattttctatagctatattcttttcctatttgtccatttgattcattcctttaaatgacccggttaattcataaattttatctttatataatttatctattgatttaaatatgtaaatgtctagtaaaatgtttaatacagaataaaaatg

SEQ ID NO: 99671 - DNA, 137 bp, Heterodera glycines
  Promoter: Source sequence=SeqID_7498; Location=2945..3081; Strand=-; Gene=SeqID_65017
ttttgaaatggtaacaaaaattcgcttgaaaaattataaaagttacataattttagaagaccggggcttaggccaattttcaaggggagagggtgttcgtaaaaatgaagtgggtgtgatagagaaaggagaccatg

SEQ ID NO: 99672 - DNA, 612 bp, Heterodera glycines
  Promoter: Source sequence=SeqID_15681; Location=706..1317; Strand=-; Gene=SeqID_79990
aaattttatttttacatattattaatagggctgcgatttttaggcaaatgcctaaaatttttgcacttgatacgcacagataagcacaaaaaacgcgtttttcgcttggtttggggtttttatggtgacttttagaattcctatttttacctatttgtgctttttatgtttaatactaaggcaaaattgttcttattcgaaattacagaatatttaataatttatttaaattgatatataatctaaattaattttttgattaaatttttatgtgttttgctccctaaaaatccttaaaaattttatttgcctattttgcgttttttctgcctttttaggtgcctatttcgcgattttttgtgcccaaaaatcgcagtccattgcaaaactgcaatttttgaatttatttgttagaaaattattgtaataaatttataaatttacttagaaatcaattaaatcaatacgaaatttcctaggccaaatagaattgaatttagctttcattaccattttttaaattttgaattattttaactttccgcttgattaggtctttcatgcaagtcccttaaatgcggttgacattgatgggaagccgataaaccaatg

SEQ ID NO: 99673 - DNA, 227 bp, Heterodera glycines
  Promoter: Source sequence=SeqID_27695; Location=949..1175; Strand=-; Gene=SeqID_58367
aaaaataatttaattttaatttgaatttttaattaatgcggaaatatcacgcggcattttttcccgcaaaaattgacacatttagatttaacagcacacatttttacggtgattatctccatattaaaatagacatttgtttagccgaagtattttgaataattttctctacaataccgatcttttgcatgccgcgttccgccgcttctcatccgccccataaaatg

SEQ ID NO: 99674 - DNA, 131 bp, Heterodera glycines
  Promoter: Source sequence=SeqID_1316; Location=1252..1382; Strand=-; Gene=SeqID_72417
ttgcttagttttgtttttccgtcccaatgaccgtactcccattccctacccatgcacttattaccgtaccctcaccgatcttcccctaaggcgagatttgctctcgtctgaatgccgactgtcagacaatg

SEQ ID NO: 99675 - DNA, 314 bp, Heterodera glycines
  Promoter: Source sequence=SeqID_28980; Location=1103..1416; Strand=-; Gene=SeqID_59549
cgccaggatagattttccaatattttttacgctgatcattttcctcatttcgctgtatgtacgcttttttgcggcgcgttttttcaaaaaatctcgggtaaccgggaggggggcggggtccggaaaaattttgaaaattttaggcaatttgttaacagatttagtataaaaacacacctgatacaaaaatatgtagcaaaattaatgaatcttaaacttgtttcaccaaatggacatttttcactttcgtatgcaaaataccgattgccaagtacaatcttggaaataagaacagttaaaattttccaagcatg

SEQ ID NO: 99676 - DNA, 375 bp, Heterodera glycines
  Promoter: Source sequence=SeqID_4240; Location=1..375; Strand=+; Gene= SeqID_53725
ctatagaaattttaaataaattaattgaaatgctaaataaaatgttatatgttcgttatattattcaaaaatgcttagtttttattttttgttactcgtgcttaatacaatgaataacaattatttaaatgaaagatgaatttcataaaaatatatcaatgatatcaagatggcaaatttgttttttgatttttctatctggaaaaacaagcaatattattttcatgaataaatttaaaaaatggctgaacgtggaattcctcgccttttcacgtgttttctctttttgtgggtcagggcttaatcatactcatatgcataacaattgtctctaaaatcctcgaaacttctttcagtagcgattattctaagatg

SEQ ID NO: 99677 - DNA, 895 bp, Heterodera glycines
  Promoter: Source sequence=SeqID_39509; Location=1..895; Strand=+; Gene=SeqID_68062
tttcaaaaatttttcgagctaggcccccttagaaattttcgaaaattttttttggggtgaaaattggggtccaaaatatttttctgggggtattttgatgtgctgagcacgaatatgaagttcatttttcgtttcagaatttttggaattttttaaaaattctttattttttggcaattttttggccctcgggatttgggcctaatatttgaaaattcataactaacctcagggtaagtcaattttcatacaacaaagctttaaaaatagcaaaaaatcaggagaattttatggcttttatttagattctctatcatgaatataaaaaaagttattccagaagttctggaaaaattcgaattttcagaaaaaaattctgaacacggttctgaaaagttattttggaaaagtaaaataatacaaaaatccgcaattttttgctctattttataaattttattttagctttttatcacttttttgaaaaaagttatagaaataaaagtgattttgggaatcgggaccaaaggggtgagtataggatttttgagttgaaaaattttttcaccaaaaatcttcaaaaaacatgtcattagggctattttatgacgctgatcacgaatacgtgatcagattttacttttgacatcgttaagacctcagaatccctgtgtgattggggattctgaggcatcattttgaagggggagggggcaggttcgaagccgggcggtgtacattatttttctaccatttttttcgtgtttttcaatttttattcatttaaaatatttttgagttaataaataaaaaattatattttatttaatttttttttgataaataaattttataagtttaaattaattatttttttaattgatagaatttcatg

SEQ ID NO: 99678 - DNA, 401 bp, Heterodera glycines
  Promoter: Source sequence=SeqID_45207; Location=1..401; Strand=+; Gene=SeqID_72549
gcttggctatcagtaataatgcatttgccgtattttcttttaactccctgggttttttagccccctcggcgggggggggtgctctaatggaatgagccttataatagaagaaatacagaacattacaataaaatgccacccgagaccttccccctttagaagaaatacagaacattacaataaaatgccacccgagaccttccccctttagaagaaatacagaacattacaataaaatgccacccgagaccttccccctttttaatttattttttaatagctgaaaattgctgtaattcattgctttccaccaacagaattgtggaagtgtccggcgacaacacgcccgagccacacgaactaaacagggcatccattctgatcacaacacccgagaaatg

SEQ ID NO: 99679 - DNA, 697 bp, Heterodera glycines
  Promoter: Source sequence=SeqID_31; Location=12930..13626; Strand=+; Gene=SeqID_50790
ggtacttcatcagctttgttctatctgttggttaaagaagaaaaaggagtatggacagcgcgcagatttcgactattttgaggcaaagtcgggaaaccgcacgagttttccggggctgtttcccaagtgaccagctcccagcgccggacacgctacggtacccagcggcgctagttgtgaacaatgacccacactacaaacaaggatcccattggtgcgcgatttatgccccttcaaagacggaggaagcggtcatttactttgatagtctcacaaaaacaattcctactattgtaaaaacatcatttctggataaatttccaaaaggttttgttacaaataagcacccgtaccagtccccactgactaccacatgtgcaattcactgtatagtgttcatttatcatatggccttaggtcacccatttgatgcatttctgcgcatattagacgctagtgaaagccccgacatgtattctttgtgcattttgaataaaatgattaatccgtatttgtgtgtgcgtgccaatttttatctccctagggcaaagcgcataagggaaatgattgattagtttattacacaacggcgcacggtgcgcgctgttggtgccgccgcatatatacagcgaactcacgcgggaaaggctcacttttttcacaaaaataaataaaatattaataaataataataatg

SEQ ID NO: 99680 - DNA, 233 bp, Heterodera glycines
  Promoter: Source sequence=SeqID_7913; Location=2555..2787; Strand=+; Gene=SeqID_66359
taggaatacaatcaacaaaataataattatttaataataataataaggaaatataaatggcgaaaaaaacgctgaagaaatttaatttgtttgccaacgcaaatataattttatgatctttgcataaattgaataaattctgcttgcgttgccaatgccaatatttgttgaagtctactttttaaaaaatcaatgtattttatgaaaaaaataacaattacaggcgaaaaatg

SEQ ID NO: 99681 - DNA, 58 bp, Heterodera glycines
  Promoter: Source sequence=SeqID_32569; Location=643..700; Strand=+; Gene=SeqID_62877
gctgtgattttgcttattttcagcagcaatttttgaaatccaacaattaaatttaatg

SEQ ID NO: 99682 - DNA, 348 bp, Heterodera glycines
  Promoter: Source sequence=SeqID_7208; Location=372..719; Strand=-; Gene=SeqID_64154
tttttgtttgaataacatccacaactttcttaattatgcaaaaacatactagaaaaacttgggctcttatagtgaagtaaggtatcattggtaagccgacaaaaaatgctacaaaatgacacaaaattcgagagccaaacacagttggaaaacaaaatttttaactttgctatattacaaaaaccacttcgccaaacatctaaatcttttttgaactgctagggccccaaaattgacaaggtgtggtacaatacaacatagaagaattgtcaaattccaatagcttatgaactcatatgaaatagcatcaaaaacttaattaagcctgtttcgttttcttcttaaatg

SEQ ID NO: 99683 - DNA, 190 bp, Heterodera glycines
  Promoter: Source sequence=SeqID_3665; Location=1777..1966; Strand=-; Gene=SeqID_51341
tctgaaaaatggaggacgggcgcataatcattttttcataagaattccttttaaacgttttaaaggttttaaagtaatttaattaattcaatttaatgaggcgccggcgccgataagctcggcaagaaatttttttaaaacatttgatgatttttaacgccttaaatagtttcaggcttcgtagccaatg

SEQ ID NO: 99684 - DNA, 357 bp, Heterodera glycines
  Promoter: Source sequence=SeqID_40476; Location=527..883; Strand=-; Gene=SeqID_68799
ggtcggcaaagaagaacaaaacgggggaaatttagcagattttaaagctaaataaattattaaaaatcgaacaaatagtgcagttaatgcatttgaccagctctgtccctgctcacaaccattaacattaatccctgccctcccgctgcaccattgaagcaggggaaaaagaactatgcggtgactggcaatcctaacctaacttgtctcatttttgaataatctaaaaaatctttttcaaaatttcctttgaattttttaaatgactcaaaaatgttcatgatcaaaattttccagcctgacactctagcctcaaaaaacaaaaaaattttttttgaatgaggagaaaaaattatg

SEQ ID NO: 99685 - DNA, 209 bp, Heterodera glycines
  Promoter: Source sequence=SeqID_15457; Location=1586..1794; Strand=-; Gene=SeqID_79720
atttttttttgacacaaaaatttattatttttttatttgtccaacaatgatcggggtttcatttccttactattttttgtccattttttattatgcatttgttttccgttaatccccctcccctttccccttaaggtacgccgccgagcggctcgcgttcgtttgacaacgctttgcgcgtgttgcgcctgctgcacacggcgcggatg

SEQ ID NO: 99686 - DNA, 58 bp, Heterodera glycines
  Promoter: Source sequence=SeqID_24827; Location=1..58; Strand=+; Gene= SeqID_55576
gaaaaacaaaaaaattcgattttttcaagtgtgcgtttggggtactcaaacaattatg

SEQ ID NO: 99687 - DNA, 260 bp, Heterodera glycines
  Promoter: Source sequence=SeqID_24581; Location=977..1236; Strand=+; Gene=SeqID_55311
aaaggataataaattgagaattaaaacttcgaactttttttgtaattcattaaaaaatcgtccattttacatcaattttgggctaatatccggtaatattattccataggactgggcccgatattcggatattttcatgtttgggtcaagttttttcaaaaaataaaggtcgattccgatcccttttaaccctctaaaataaaatatcacagaatttttctccctatgaaagttaaaataaaataatttaaatttgcatg

SEQ ID NO: 99688 - DNA, 91 bp, Heterodera glycines
  Promoter: Source sequence=SeqID_20643; Location=1101..1191; Strand=-; Gene=SeqID_51195
attattttattttaattatatatatttatttgttttcattttttattttaattagagtaatgttgtaacggaaaaaggcgaaacggagatg

SEQ ID NO: 99689 - DNA, 227 bp, Heterodera glycines
  Promoter: Source sequence=SeqID_37504; Location=1..227; Strand=+; Gene=SeqID_66560
aaattctacggccaaaatgaccacttcaacttcggcaagaagcgcaaggaagtaccggccggtccaacacacaacattcggcccgactttgacaaggcggattggcgagacattgaaatattcaaacatgtgcgcgaatacgagcggaagacgaagggggacaaggaggtgcactggaaggaggaggaacactttgtgccgaacagaatgaaggggggcaaatgatg

SEQ ID NO: 99690 - DNA, 397 bp, Heterodera glycines
  Promoter: Source sequence=SeqID_5676; Location=1..397; Strand=+; Gene= SeqID_58881
atctgactctcatttcggtgagcagaagacaccgaaagtaactcccacagataagaaaatctgtggctgttacataaaaaagaatggtgttgtgagccattcagttttttccattcgtattaatcgaatggacaataaatgggaagaaactcttcctaatcgaacagagcaatcaatcatagcattgacgctttgtttttacatcagcataagcctgatggttctctcaattttaaaagccctttctattgggcgtaaaaccattgcttggctaatgatccaactcaaagtatcattactttcttttgaggatcagagcacgccttgctttcaagaaggaaggcaaagaggggcaatccctcaattttgtacagcgcgccatattttgcaaataatg

SEQ ID NO: 99691 - DNA, 539 bp, Heterodera glycines
  Promoter: Source sequence=SeqID_3174; Location=415..953; Strand=+; Gene=SeqID_83535
atatgatcatttttaatagaaaaacattgggctggacagaaaaactgcaaatgataccaattattacgctgcgacttcatctcacaatcagccgagggcaaacgaaagagaaaacgcaaaaagtagcaaaacggagcagagggaaaggccgatgggacgaacggaacactcattacacacaggttgatgattttcgaaattgggcagtattcatttgtaatggctattcccccaaattgggaccttttttgtcttcaaaaatatttaaactaatgtcaagtttgaagacatttttttggacttggtagctgaacatggatctgacacccgttctgacaaataataattccgaaattggataaattttatcatatttattccgtgtttttcggaattggggcggggattctaattagttaaatggttgttagctgattcgtgataagtgagtggccacgaaaacccctgttaatggcaaataaaacctgagattggaatttttagcaacaattgctaattctcgcggttctgttgggatg

SEQ ID NO: 99692 - DNA, 370 bp, Heterodera glycines
  Promoter: Source sequence=SeqID_7267; Location=693..1062; Strand=-; Gene=SeqID_64304
agtaaggacggggaaggtacagtaagaaagtgtatataatacagtaagagaaatcgtggaaatgaatgaataatgctcgattgttctgtgtaggtacagtaagaacctgaggaacgttttggttaaaaaatcccgccccccaaaatgctagggaatctcaattcaggtcctaatatgtagattaccgtaaataaacaggtaattcaatttcttagagaatacagtatttctgacccatttataacgggaacgccggttctttcttgggatcagcagcagtcccatttcatcatgttcaaaaatgatgatttgaaaaaaacatttccccccccccctccctcattttttttttaaatttcaggcggcaatg

SEQ ID NO: 99693 - DNA, 549 bp, Heterodera glycines
  misc_feature (77)..(77): n is a, c, g, or t
  Promoter: Source sequence=SeqID_42378; Location=1174..1722; Strand=-; Gene=SeqID_70283
acagggaaacacagagagaaagaggagagagagagagagagaaagtagatagatgagagaaacaaagaaagagaganaggtggagagtgagtggagggggagcgtgaggatcctagacaaatttgagagaagccaaaaaggagagaaagaaagagaaaggttatgcgaattttatcattaggattaagcgctagtttttttttaaattcatcaattaaataattattaacaaatttttagcggtgatacaatttgcacaagcgttgaaagtaattattcaattatcaattaaaattaaaaaatcagataaatgacacagaagagaaaaattattctacaaaaagtttaatatattcgaacgaattcaaaattttaaaagcatatattactgagataagcgatgaaagcaatgttaaaaaaatgaaaaattacgcggaaaagcaaaaagaaaaactgtcttattcggagaaaatcttttcgctaaatgaacttttgaatattttggagcaaataattacctattaaaatacaattgatttatgcaaaatg

SEQ ID NO: 99694 - DNA, 540 bp, Heterodera glycines
  Promoter: Source sequence=SeqID_12589; Location=1..540; Strand=+; Gene=SeqID_76250
ttccttggatacatttggcctaactttgctcaactttgccaaaatttttgaaatttagatgagctagtagagaagtcttagggctatcgaatgatatcaataatatttaatttggttgacatttacaaaagttagagagaagagagtgagtgagtgagagagagagagagattgaagattcggaggggtagagggaatctgatattaaatgtacaatatgtacgttggccattgaactaatttatttttcactggcaaatattcaacgagtaaaacattgtttgttttgtccaaagtttcgcggttttgctttggaaatttgaaatgttattttttcaggaaatgtattttaaaatagcatttaacaaaaatgaattttatttaaaaaaataatgaaattattcattatgcaaatttatttatcttttctattttttcgtttatcttatctttcaaaagtgagccacctatcaaaaaatcagattaatttcattcccaggcggcctatcggtgttatgtcgttcttcaaaaaccataatg

SEQ ID NO: 99695 - DNA, 243 bp, Heterodera glycines
  Promoter: Source sequence=SeqID_23053; Location=1905..2147; Strand=-; Gene=SeqID_53755
caaaatctttaaatatgtgtcaaactccaaaacattcagaaaaacatgcacatttctactcgaaaaatcccgaatatatgtaaataaaagtatccatttttgaacgcaaatacaaaaaaattgtacttactatttttttgtaatgttgaatattttcagacaaaaacatggccaaaattgactgaggagcacgttcttcaacttttacaccgttcaactgaaatagtagggccaggtgaaatg

SEQ ID NO: 99696 - DNA, 293 bp, Heterodera glycines
  Promoter: Source sequence=SeqID_20181; Location=1203..1495; Strand=+; Gene=SeqID_84969
aaatgtcgatcgatgaccgatttgttaatggtgatgtggatatatgatcattttttgggacatttaaaaatttgtgctaaaatttgtccaaataaataagtggtggtgaatgttttgaaaggggaaatttaaaattgatttaaataatagttaaatatagctcatgttctgcaattttattgattgaccctaaacactcagtgaggtggggatgagtttaggcctataaaaatgaactgaaattgacttccgcgcattttccgttttcattcttgaaattttccgctaaaatg

SEQ ID NO: 99697 - DNA, 1003 bp, Heterodera glycines
  Promoter: Source sequence=SeqID_18755; Location=1074..2076; Strand=-; Gene=SeqID_83430
ttaatttgttgaaaatgataaagaatggatagacaaggatttatggaatagtaaggacaggctagaccggtttttaaaccttttttattttcaaaaaaaaattaggggtacaaaacctgattgggacacttactaattagatgatactctcgcaaaatggccatccattgagcgtttattttggaaggtttcggcgttgttcaaaaacaacgactttctgatgcgttcctccacaatgtccacgtaacccaaattgaactgcttaaatataagaagcaactgaacatcggttcattgctccttcgaaacgcacctttttccatctccgaagcgtttccctggccaattgttcactttcgcaaagtgacaattcgtcccaatcgccgtacaaaaacacccaaaaatgacgaattattaatttactcaattaagtatctctctgtttaatcacctccaaaagcgtgcccaaattgccaagcgtactaaaattggatgtccttagcaaaagtagggccgttttacgcgcctccggcggacatttctataaaaaaaataaagttaaatgtcctaattaatggataatgggcaaatctcgcacattcactcccgaaaagcggtaaaacagaccgggaaccaatcaagcaacaatttggcggcacagcgaacaattttcagcgaaggattggacagttgccgaaaagccaacgaaagtgcccaatgccaacaggggaaggtgggcaaatggccaagctgttcgagagagatgaacacatccaggaaacgggtggcccatttttggatggactgtaataatacagacaaaataattggccgtattaccattaaaaggattatgaaggcgcaaaaaacccaagaaagagtaaaagatatgcataataataagccatgccaaagagccaaccgcaaataaatcccccccgtttataccaaaaccacatgatttggcacatgactttgggtggtgactttttcgtatgccatg

SEQ ID NO: 99698 - DNA, 783 bp, Heterodera glycines
  Promoter: Source sequence=SeqID_9211; Location=1..783; Strand=+; Gene= SeqID_70614
gttaacaatttacattaaaaattacaaaatttttcccggcggcgcatatcggcaccgccggacccttccttccccacagtttctcaaattctctttggataaagcgcgccgcaaaaaaagggtgtaactttcccaaaaaaaaaatccaaaataatgtaaaattacttaaaatattttgatctttttaaaaaatatagaaataaactaaaaacagtttgttttacatggttaaaaatttaaaaatttagcctattaaatattttttaaaaaatttattatatttttttttgaaaaattccgagttccgacatttttggggtcggaattccgacttccgaaaatttttggggcatcggaattccgacttccgaaaatttttagtgcctctgaactccatccctgggacaaaccatataagagccgaaacatatcctcaatcccgcaataaaagattaattaagccgtttctgaatcaaaatgctaaatttgaactttcgactttttattcaaatttgggccgggattcggaatgttttcttaggtcggctccgtcgttttgttttccctccttttccttttcaccattttttcttctatccccccccccccccccctcccgatgaaattcgccggcaatggcaaatgccatggcgccgacgacggtcacgtcactgtgccggcgttgcgcggcgaaaatgagcacattgcggctagcattgaactgtgaactctgggcatttcttctttgttgtttttaggattgtgaaattataaaataaaatg

SEQ ID NO: 99699 - DNA, 229 bp, Heterodera glycines
  Promoter: Source sequence=SeqID_37647; Location=1212..1440; Strand=-; Gene=SeqID_66665
taatttatttaaaccccaaaatccatcgttaacatttaaaaaggattctaatgacttaaggaaatgataattcacttggaaaatccttttgtgcttttcctctctttgtgcttcgtttgggccgttgcgccgcctccgccgccaccgccgccgccccccggggcactgtttaagtcaagtgcgaaccttaattaccattaaagtctttaattactctggtttactcatg

SEQ ID NO: 99700 - DNA, 107 bp, Heterodera glycines
  Promoter: Source sequence=SeqID_12495; Location=1..107; Strand=+; Gene=SeqID_76132
gataatgatgatgatgatgaaaattaaaataggattttgtgtattttgtgttgcatagatgggagccaatgcgaaaaacaaacaaaaaatttttttcaggggaaatg

SEQ ID NO: 99701 - DNA, 625 bp, Heterodera glycines
  Promoter: Source sequence=SeqID_3612; Location=902..1526; Strand=-; Gene=SeqID_51107
ggtcggtagttcagctggtagaacactggtccggaaagccagagacgccggttcaaagccggcccaccccatagtttttccctcaaaggcttccccgctcgttcatatatttcagacgcgtaaaaatttatgtgacgtgtaaaatcattggacccgtaaaaattgaatggaataactaatttttttaaggacgtgtaaaaattttattgacacataaaaactaggacattaaaaactactgtggacgcgtaaaaatttatgtgacgtgtaaaaaatgggacgtaaattttatgtgaaatgtaaaaatttatggatgcgtaaaatcattggacccgtaaaaattttatggaatatctaatttttttttgggacgtgtaaaaattttattgacacataaaaacggttagccgactcttgcgccgcggacatttgcgccgtgccatttgcgccgcgacacttgcgccgcctaacaaaaacgacatttgcgccgtacagcgaaaaaagacatttgcgctctgattaaaataaatttatgtgctttatagaataagaattgatagatattcattattaattcctttttcgaagcctttcatgtcaattccatattgaagtgcacgtaatg

SEQ ID NO: 99702 - DNA, 838 bp, Heterodera glycines
  Promoter: Source sequence=SeqID_15317; Location=1..838; Strand=+; Gene=SeqID_79555
ttccatttccccctctccccctattgccccgggacgaatcggttcacccttccccagctaatcacacatattacacattatatattgtattgatcacccttccgaataaaggatattattccatcccactcgtgtaattatggggaggggctaagcaacgaatgccaaagggcatccgagatattcatggaggtcccgccacggggcaaaaatggggaagaatttaaatagaactaattatttaatgcctttattaaagaattagaaaataagcaatgcgatttatgattaaatgaatattatttaaggggatattttaaagccaattgagaaaattgaattaaaaaaagagagagaggaaaatgtgatcggaatgtgaataaaaaaattaacaagtgaaggcttgagaagtggcgaatgaattggcacaaattgctgcctcagacagaagtggccatcaaatggggcttaaaaactttttggaggtgctgcaaaatttgattgaacttacaaccgaaattgagttcgaagagcgcaaagccgccctatcacgggctcctttccgagccgatgtggtgatgccaaccgggttatggcgagactaataaaatataatattgtaaggaagaagctggctgggcggttaaaacgcggaaagcgggggttaataagatccataaaagaaagggcggatgtgcctcggtagcttaatggtagagctgcccacggaaagggtgcatgagtgggttcgattcccacccgaggtttaacattttgcccatttcttattggtagcaccggatggttgccccaccgcgccagcagcaattaactaatg

SEQ ID NO: 99703 - DNA, 902 bp, Heterodera glycines
  misc_feature (60)..(60): n is a, c, g, or t
  misc_feature (65)..(65): n is a, c, g, or t
  Promoter: Source sequence=SeqID_11239; Location=1..902; Strand=+; Gene=SeqID_74597
agaaaagagtaggaaatggtgaaagaaggagaaatttttgataaaaaattaaattttatntcatntagtcatgggattacacacatgcacatgtggtgtagtggttaaactttctacctttcataatttttcgcctgggttcaattccccacttggatagaatattcctcacattttctttaccattattttaattaaaattttaattttaaaaaatattccaacttttttctttcatgttaagcatcctaaaaacccaaaaattaatcaattggtcattttttttacaaattctgtttgaaagcaaaaaagatcattgatttacattaatttacatggccggagacccttcgcaaaattggaaaattggccgctgatcccttgttttgcaataatctgaattttgaggtctacatctgaattttagtgttctttatcctgaatttgaaaaaaaaaacttggtcaacctgaatatacatatacttctgaacaattctaatgctaaaaaacaggcactcgcgcgaaaactgaataaaaattttgtatttggaaaattttgtccaaaaatttttatgttctaaaattaccggtttttaccggtaccggttgaaaaagttggtaccggtaccggtaccggtttttgcagtaccggtcagtaccggtaccggtttttttgcaattaccgattaccgctcaactctagctctaaccaactgagctacacggacacattctacactcctctcaattccatagataaggaagagagagactcattcccaacatgagggaattgagccgcatcacatggaaacaagctgatcagaatttcttacaagagagaggcattgatcagcagttctttctaaaaatgaagatcagggaaagcggtctaagagatg

SEQ ID NO: 99704 - DNA, 256 bp, Heterodera glycines
  Promoter: Source sequence=SeqID_5890; Location=2929..3184; Strand=-; Gene=SeqID_59578
aggagggatgagaaggaagtgtgcgcaatccaagcggaagatgaaaatatattgtggatgaaataaatattcattgtaaatgtgccgatgaactttaatattgatcgtatgcatatttgtgtattgaattgtataacatactgaaacatatatatatatatatatatatatatatatatatatatatatatatatatatatatatatatatttgtcatcctaatatacctctttttttcattagcaaaaaaaaatg

SEQ ID NO: 99705 - DNA, 236 bp, Heterodera glycines
  Promoter: Source sequence=SeqID_20723; Location=1320..1555; Strand=+; Gene=SeqID_51285
aaattatataaggctagggaatttaaaattttaaaaaagaaaaaatttaaaatcggtgatatcgttcgtattaccaaggaaaagggaaaattttcaaagggatacctcccaaactttaccgaagaattatttaaaatcgttattgtcgacgacacccgattcatacaggatcgaagatttggaaggaaatttaataaaaggtatattttataaccaggaattagtgaaaacagatg

SEQ ID NO: 99706 - DNA, 61 bp, Heterodera glycines
  Promoter: Source sequence=SeqID_31703; Location=1168..1228; Strand=-; Gene=SeqID_46268
ggtttagtgtattccgaccacttccttgggcaagactatttaatttcagaattaaaaaatg

SEQ ID NO: 99707 - DNA, 607 bp, Heterodera glycines
  Promoter: Source sequence=SeqID_17463; Location=509..1115; Strand=+; Gene=SeqID_81951
tactttgttaattagtgcgtgtaatcatcaaatataattcacatgaaaaacacattaattaacaaaaaaatgaatatgcttaagtaattcaacgaaattttattcgcctattaaatcattttttataattttttcttcaacaaacgtaaatataatcacacaacggaaccagtccatcaattaattacgatgtaaaacataaaaatagaagaagaaaatgcagtaattagcatttaattcatatgaaaggcatgcccattaattaacggaaaatgactatttaaattaggcgtaaaaattcaatttcttataattaatgacgaaatgtaaccatcaattagtcttttttcctgtttggaagcattacagaataatatcaaaaaaaattccattggctttaattttgttttgtcttagtgccaaagtcagccaaggtctttatttatgtaaagaattttcaaaaaaacgaatactttttgtcacgattctcgaaaacaaagtcccaaatctcgagaccgaattagtccaattacaggataaatttaatattttaaattatttgattcatttagaaagaaaaaagttatcatctataaaactgataatg

SEQ ID NO: 99708 - DNA, 233 bp, Heterodera glycines
  Promoter: Source sequence=SeqID_43517; Location=1..233; Strand=+; Gene=SeqID_71155
tccgttcgccttctccggtgccaagcaaatataatcaatttgatagtgggacaatttagaaaaattaaatttttcaccaaaattaacaaatttttgttccattttttaaatgggaatttgggattaataagtttataatgttactcggttcgattttcaaattgtttgaaatttggtcagagttacctaacttaataatatgctcttttttaataaattcagttttttcaatg

SEQ ID NO: 99709 - DNA, 239 bp, Heterodera glycines
  Promoter: Source sequence=SeqID_5822; Location=1069..1307; Strand=+; Gene=SeqID_46132
ttgcctttctttcccttcctttgcttatgtctttgtctctatccccttttaactttctctaactttctcatcgaacagtaattttcgctttaataactaaattttattttacctaattgaaaattttgctacccctatttgtctttctgaccgcctaaaaattgggaaacaattttttagtccagttattttctttaatgttattcatagattcagtttctttttattacaaataaatg

SEQ ID NO: 99710 - DNA, 70 bp, Heterodera glycines
  Promoter: Source sequence=SeqID_36927; Location=880..949; Strand=-; Gene=SeqID_66128
atcaggaaaaagtggcgccagggattgctgcagagcacatgccctgcaaggcgtgatgcggcaaacaatg

SEQ ID NO: 99711 - DNA, 146 bp, Heterodera glycines
  Promoter: Source sequence=SeqID_13033; Location=949..1094; Strand=-; Gene=SeqID_76813
ttttcatttaccacgagggcactcggtttgtttggcaaaagtttattttgaaattgtgtgaaatagttttgctatttctactcagaaaaggtggcatttccgaggttccccaattgactaaacgcattttgttcgcatggataatg

SEQ ID NO: 99712 - DNA, 616 bp, Heterodera glycines
  Promoter: Source sequence=SeqID_38786; Location=653..1268; Strand=-; Gene=SeqID_67502
aggtcagcccaactaatcgttaattaataactagggatacgatttttcggctctaaaaattgccaaaaataggtcggctttaggtcctaaaaacctcaaaaataggctctaaaaaatggaaaatggcactaaaattacctcatttctaaggtgtgtaaaatgacaaaatttattcaaaaaagtaaaaaaattaggccaaataagtaatgagctaaataaatttaaaaaaaaattttggacatgaatttttgagaaatttttcatttcttaggggtgtatttttcgttttcttacgtttttgttaacaaattttgggaaaaatgccaaataggtcaaaatagatttttttcagcattttttgatttttggaaattttttgaatttaattgaaattttttcgaattttccaaaattccgcaataccgcacgggatcccgcaaattcgaaccctactaataagcatgcattaaaaaggggaaaaatttttaatttttttcgacccccctattttttgtatgctaacaatgatgtcttttttctgatagccaaattcaggcattaacggcagaattcagtggtgacagtttggatgcattcattgccattgtgcaacatg

SEQ ID NO: 99713 - DNA, 162 bp, Heterodera glycines
  misc_feature (60)..(60): n is a, c, g, or t
  Promoter: Source sequence=SeqID_40071; Location=520..681; Strand=-; Gene=SeqID_68509
atttgtgcccccgtcaaatctcggcatatgcattctaatgtcgggatttgaaacccgtanattttatgccggtgcctttttcccaatcccgttcacagtttcccaattgcaattaattttttcttttttttttgtatatgcaggaatgtcgtgaagcgaatg

SEQ ID NO: 99714 - DNA, 1003 bp, Heterodera glycines
  Promoter: Source sequence=SeqID_16112; Location=520..1522; Strand=+; Gene=SeqID_80470
tacctttttgttattcatttttttttctctcgagcaattaccaacggcttttagtttttcttatcaaaagggatttttccatttaagccaaataattttaaaactactaaaccaaaacaccgaagttgtcaaatcatcaatttttgatcgaacggaacatcacacagtcgaaagtgggcgagatcggtactgatcagtgatcacagcggaacatttgcggtgcggacgtgacttttcgaagaaggcaattacggacggcgtgttcaactacgaagtggaccaaattgaagcagtctctcgaacggacaaaaaggtgaattcagtttttgaaaaaaggagtgattaccgtaggccaatcagagaaaattgccaacaaaaccgaaattatgcgagaggtggatataatggtggattcgcaccaagaaatcctaactttatcccgcttggtcaaaggagaatgtggaatggaaataattcaaattctaacagatttaacaataatgagccaaggggaagaggattcggtaacaggggcaattttcagaataatcgtggtaatttccaaggaaatggtaatgaaaaacagagataccgaataaatatggtgggagatgaacaaacacagtcaagttcatcgagacgttctccgactccgacttttacatttttaacaatttcgatggttttgtctattttgtttggtacttttagtctgtcaaatgcacaatatcaaatttgttctgaacgagttcagactaccccaattctgttaccaaatatcacgaattgctctataccaaaataccaaaaggcggctgaaaacaaaataaccttgtttttaccagtgcgcttacctaaacaatttgtcgtttataaatgctatcaaaaattaaccaaaatatgcaccggaaactttttgtttttatggaaaggagtaaatagtcaggagacaacggtgaggggagtgtctcacgaaacttgtcaaaaatttaaacataaaatg

SEQ ID NO: 99715 - DNA, 1003 bp, Heterodera glycines
  Promoter: Source sequence=SeqID_11516; Location=549..1551; Strand=+; Gene=SeqID_74941
tttttcttgctctgctgagtttgttgtgctctgtgctctttatcttttctttcaaaacaatttttctcattctttattttattttttagtcttatcaataattttcctgagtacacaaatttgtacatttttacttaaataattaattaattcttctaactttaaaatgacattcttttttaagcacaattatccgagccgcacaaaaatctttgaacacactcacttgtgttttgaaaagagcagaataatttgttatcccgtactaagtacgaataaccccattttaaccggtgcaaaagtctgacagaatgatcgggataccacaacaaaaaaaaaacacttaaattcgggaaaatttttgaaaaaaatcccttgggattgcaaaaatttgttctgtaaaaaataaagaagcctatcaggggtggggcgcgcacagaaaaaaatcgtgcccgcgcattcaaattgccgcggccgcggatcgcgcaaaaaaaacgccgcggatcgcacatcgcggcgcggtcccagccctgaagcctatcagaaataggacaaaattctctactgaattgccttttgatggtgggtcaacgacttatacttctgatgctgataaaaaaacctttttggatcaactttatagtagccccattggaaaaacataatatttgctgccaaaatttttggaatgggttatctacaacatttcattaagagttatggtatttgcatacagtaaagctgaataaattatgtatgcatttttacagtagttggaagttgagccaaacaaactttaatgaaaatgtttaagaaattccacgctaaaaaggaatttcgtgcattaagctgaaccagaaagattaatttcgaccatataaatccgcgcccattaataattaattataaggctcaaataattaatttttgaagtgtgaatgatcagcagaattgactattttgccttgtctccgattattgatttgtctcgcttttagcaatg

SEQ ID NO: 99716 - DNA, 622 bp, Heterodera glycines
  Promoter: Source sequence=SeqID_3970; Location=1..622; Strand=+; Gene= SeqID_52625
gggtaaaattaaaattattatttaataattgataacaattgaagggaaatgagagggatataatattagatataaatttattaaattattatgagtgaaaaaataaaataatagaaaaaattgttattttaaattcaaaattggttaacaggaaaaaagctaaattcatataacaatgtaaatgcataaacaaacaaatgaagttccataaaaaacaacttaattaggtaattaagaagataaaattttaaaaattggacagtattaaaaaactatatcataatttctgcttcactgaacaaaaaataccttcttattaattgaaaatttggatatttttaaactaaaacctcaaagcaaaaatttcaacatatctcttaagattttgctcaaattttccgcttccgtttataaaataaccaacaaaactctcatggagagacgatatctgtcccatatgccgccgcacccataaaacattgagtcagttggctctagaaatattcaaataaagacaaaatgccgaaaattatggacatcacgatatttggtgcctcccatccggtgagcctctacatttgcgccccgaactaattttgggatttcattgaaataaaaaatg

SEQ ID NO: 99717 - DNA, 105 bp, Heterodera glycines
  Promoter: Source sequence=SeqID_3217; Location=957..1061; Strand=+; Gene=SeqID_83742
tctcaggtccttcgacaggaggccccacaactttttaccaactttccgttcgtgttcccaacctcgtcactcttcattcattttatttttagtggggcggacatg

SEQ ID NO: 99718 - DNA, 689 bp, Heterodera glycines
  misc_feature (40)..(40): n is a, c, g, or t
  Promoter: Source sequence=SeqID_25249; Location=1..689; Strand=+; Gene=SeqID_55997
aaatagtggcaaaaatagtggcgaacaagttccaaatttnaggggtgtaattttttaaataggctgttttttaatttgaaaataatttaaaataaggcaaacaactttttcactgattgcagttacaaaatattttcttagcaaatattgaacaagaaaaaaaaatttgggggaagaatttttgtgaaaattttccaattcttagggggtgtatttttgaaaatttttaggtagattcttaggggtgtattttttgaattttttagatcgattcttggggtgtatttttcgtttttattgcattttttgggaaattttccaaaaaatgccaaaatagtggcaaaaataatgacaaaatgccaaaatagtggcaaaaaattattttagtggccaacttccgaaatagttttttttagtggcgaagctccaaaatagtgattcctagtgatgaatagtggcactaaaaacgaaaaattttcgaaaaagaatgtgtttttcgtgcatttctcgtcgagttaaagccgcagaaaaaatagttaaaaaactaagaatccgatccctagtcatcaccaaccatttaactttttatgaagccaaatttctcgaaaaggctagtggtgttaattgttttctttgtcatcatcgcgtgttttttgtttatttttaaagttctgtgctttatcaaaatg

SEQ ID NO: 99719 - DNA, 469 bp, Heterodera glycines
  misc_feature (34)..(34): n is a, c, g, or t
  misc_feature (69)..(69): n is a, c, g, or t
  Promoter: Source sequence=SeqID_33131; Location=469..937; Strand=-; Gene=SeqID_63291
tcagttatgcaaggggtccaacaacggccggttntgagtggaagcgacgctcggcgtacgaaacaatgnaaaaaaacggggggacaaaagggacgaagaacgaatggacacggataatacgacggaattggcattttccatttggcatttaattctctttttttattttggccctttgattgccgacctccctatttaattctgtcataagttttattattttgtaaatttgcaaatgcattcagaatgaagcattattttttaattcgtattatttgctttttttgcattagaattctatttatatgaaacaattcaaccttgtctaaccaattgttttaaaagtgaagcaaaacaaaaagtcaaaatggtccatccgatgtgcgtcactgccgcccaccgttttgccacaataaacaattttggcatttttttgaatcgatggcactcctctccgttccaccgaatg

SEQ ID NO: 99720 - DNA, 392 bp, Heterodera glycines
  Promoter: Source sequence=SeqID_37099; Location=608..999; Strand=-; Gene=SeqID_66259
ttcgataaaattttaatgcatgtgcaggcccctgccgaaggtcatgggatcatttggcatggcattggcatgactcaccttttcatgcgctttcccccccccccccgcttaacaatgccaaacataagaaatcattttgaaattgccaagtcaccagcagtgtcgtgtgtgcagccaacccacacaatccctcgccgaatggaaaaaacacaatccaagcacatttgatgggcatgcacccactcaccactcatttgcccatccatccattgatttagcccctattattggatttatcccgcttttccttctttcgctcctccccttctgaactcttatttatacctctttttgcccccatataattattctgccaattttccattggcatg

SEQ ID NO: 99721 - DNA, 1003 bp, Heterodera glycines
  Promoter: Source sequence=SeqID_7699; Location=1376..2378; Strand=+; Gene=SeqID_65667
cgaccataaaaaatttacgcaacccttaaataaaatgatctttttaacgctttaaaaaaaattgtggagggatcatgcaaaaaaaaaaaaccaaattgaaactttttgaaatttttacagactaatagataatcatagagctactgatattacaattagcatggacaattcaaaagcatttccctttctaatttaacgcattttttaggcggtgttcatttctccaaagtgaacacctccaaactgacagctgcgctgcactataccattctgatgccaagcagcaacaaacaattcaggtaaaaattggccggaccatgcaaaacagcaattttacaaatactcaacaaagtttactcaaaattttggggctatattcaactcggacaactatgaaaagatttatgcccaaaaaacaggtgttgcctgcccagttgggcatcgcccaattgtttccgtcgagggaccctttctcccccgagtatgatccccgccccccccccccttcaactatgttttatatgtgtgtgcaaaaatttcatctaaattattccatcataaagacacaccaaaatctttgttttcttatttctgaaatgagccagacccttggcttcgggaggcggggctgaattcaaaaatcgatttttggggtgtattttttgttttttttaatctcgaattaggatgggtgtgttttactggcttttatagtagtttttcgccaaaaatgagtatttttgccattttggactatgtttcaaaaatatggcaaaatatgatgtggtccggcagtgctaacaatgagacaccgccgggtttgttaagagttgcttaaaatattcaaaaagttacccaatttctcccatcggcggattgtttccaacgaaattttttttttaattccatatatttttcggacatggttgaaaactaatgatatttagagggtttaattaaaaactgattcatttcaaattgtccattgtttagttgggacatg

SEQ ID NO: 99722 - DNA, 435 bp, Heterodera glycines
  Promoter: Source sequence=SeqID_4542; Location=1..435; Strand=+; Gene= SeqID_54830
gggttgatttaaatttaaattcgtcgtccgatcggtgcatagataattaggggaatttttaattttgcatatacatcaaaattttgtgggtattaagtaaagcaaaatttcaaatttaccgacaacactaaacaataaaaatgggtcaagaattgtgattaattagattttttggatataaaaggcagtacgaagtttttccgttcataaaccaaattcataattcccttcaaatattgtttttatgcaaaaataaaatatattttaaattgactcatttgcccccccccccaccctgctcttttcgtttcttaaaatttttcacatttactgtttacattttaccatattgcattattccaataaatttaaaaataaaattttgtttagcatttattcataaactacatttatttatttcaaattttaaaaatg

SEQ ID NO: 99723 - DNA, 157 bp, Heterodera glycines
  Promoter: Source sequence=SeqID_22084; Location=860..1016; Strand=-; Gene=SeqID_52728
ttttcgcataaaaaaccctgattctgaaaatagccatcgattcagtcgaataaaagctcccattttatcacacaaaatttaccaagtttgtcggcattaaagactaagttgaattagattgacaaaatatttcacagctttcattcacttcgacatg

SEQ ID NO: 99724 - DNA, 157 bp, Heterodera glycines
  Promoter: Source sequence=SeqID_24410; Location=142..298; Strand=+; Gene=SeqID_55135
ggtgaatggtgtcggtgttgtgcgttacggtagatgctcggccggggccataaacatgagaaatttgatcactgatcacctgtgcttatttgaatagtgccgagataagcaaaagcctcatggtttatttgttggggttttgaagcacttgaaaatg

SEQ ID NO: 99725 - DNA, 848 bp, Heterodera glycines
  Promoter: Source sequence=SeqID_14710; Location=285..1132; Strand=-; Gene=SeqID_78838
tttcgtactaagatgaaaaagacagagtcaatgaaaggatggttagtctaaaaaataaaaatatgtaccgaataattaacgatagcacatctgagaccaagttaacaagaaggaaggacatccgacaaaagtgattagtaacagaactcatcgtcatatgtgcaaacaaaatgcagtagcttttacgcttaaaatttatagagaaaaacgggagcaggaaggttcgccgacggacgattcaccgacaagacgtttcgccgacagacgattctccgataaaatgtgggacagaatgtttttaaataaaactgaaataaatcagaaactttccgcgaaaccacctccaattaacattcactcgctgactttaaaatctatttttatctcagaatccgaacaacataatcattttactgatgttttcaattatttttgactaatttaaccgtgttttaatcaattttagagcaaacgcgcaacttttgaaaaattcgaattttcgactttttgttcgaattcgggtccgggatcccgaattggacgaaataggtgccatattcgtgatcagcgacatcgaaaacccctagttatttgttttcaggatcctttaaaacaaaaaaatatatattttgaaaaaatttgaccaaaaggcggatccaaactgtactagtaccaaaatttctttattgtgatacattaagcaagagtttgtgaaaaggaattgatgtctgttttaattattcggttcgttttttcaacctaattgtcttgtaaagtctgaatcacttagaaatgatgataattgtgacctctacaaccgaacggttgtcgtctgttacacacgaatg

SEQ ID NO: 99726 - DNA, 898 bp, Heterodera glycines
  misc_feature (7)..(7): n is a, c, g, or t
  misc_feature (53)..(53): n is a, c, g, or t
  Promoter: Source sequence=SeqID_29224; Location=1..898; Strand=+; Gene=SeqID_59755
attgganaatttgaccctttttaacagatttttcacataaatggcaacaaatntagaaattttatggagattttgtgggcccgcaacgccgtcaagcgctgccggaaagaattttggaagtttcaaatagttttgtaaaggatttttttttctcttttctctcttcgctggccaccttccccccccccccacaatgttcatcgttaacagtaaaaattctcgacctccgagaataaaaactcgagaaatttcacatccctagactttgtgatgatacctttccaaaatttcaattttttcgtttttgaaattccttctcccttaataaagttcgagttttcatgatgaaaatttgttttcattcgagtttatgacatattttggccaaacttaaaaaaaaatccaaattcgaacaaaaaaaatttcccattataaaatgcaattcttcgggataaagatgtaagatttacccatgaactcgaaacaaagtgtgtagtttggtaatttgtagatacattttcccaaaaattaagcatttttctggcaaaattaatttttttgttgcaacgcaaaacgtgtcgaaggcaaaaaaggaaacaattcaaaaacaattatgagattattatttttaatttattcattcatcatcaattaaaaattattaggtcacaattttgctgaaattattgggaaattcaaatatgaatgatttctatgggtcatcattttgccgcaatttattcttaattgaccctaaaaatatgtaagcaaaatcaggcagaagaatgaatgctcatttatttattcgatccctttttaacaaaataataattatctataaaaaaattaaaatctgaaaatgatttaaggaatttgcattttctaagaatattaaatg

SEQ ID NO: 99727 - DNA, 225 bp, Heterodera glycines
  Promoter: Source sequence=SeqID_6578; Location=1007..1231; Strand=-; Gene=SeqID_62072
acaaatgcccagacacagacagacaaatggacagagacatgcagacaaatgggtattaattcagttagtatcccagttttggtcagacagttcactgtttcttctttctcccctgtagctatgttgaagaaaagaaggaaatagtgctctgtctgcctgtctggctacactttgaaaaaatttgacccaaacccgggatacaaactgaattagtaccgacaaatg

SEQ ID NO: 99728 - DNA, 979 bp, Heterodera glycines
  Promoter: Source sequence=SeqID_15110; Location=584..1562; Strand=+; Gene=SeqID_79286
tttttaaaaaagaaacatttgtattaaaaaataatttttacaatttaaatacattaattaatcaataaatgccaatcaatgccaacaacacaaacattcattccatcatttctaagtattatgccaaaatagccttacaacagaacttaactgtgaatctgagcggattttagcgaattcaagaaaataactcgggagcggattctttggttttaactagggtaggtcgggactgggaactttgggcaaaaccgggaccgggacttttcgggttgaaaacccgggattttttggctgggaagaccgggaataaccccgggaatttcccggtcaaaactgttcaaaaccgggaccccggcactcagttgtactcagttgtccgtgttttggtcccggtccctacctagtcaatgaagaaaaagtcgtgtaaaatcccaaaaaatggttgtagataaaagctttctccacacaaatttagccccatcctgaatccaaactcacttcctttacatccctgtacgatgtactaattattcatccactctgaaaacttttgttcaaaaatttggtggccaaaagactatggtcagaacttacaaaaaaaaatttctcagagctaagctatgtgaaactcgatcgatttaccttaaacaaaacttctactggctaacttttataatgcgccaatttttttaccattgattaaaaaatttatcaaattaacaaagcataaagttattagcgtcgaattcaatgttggttatgaaagaaattatcggaaatcatatgacggaaatgaaacaattgttcaaacaaagtttattttataaagggagagaataaaaattttgccaactttcaaaaacagctaagcaatgtgaaagatgcggttcaaattttcaatataaaaaaggtcaaatgcatataaaaatctcacaattaatattggaaagaaacccaataaaacaaacggagaatg

SEQ ID NO: 99729 - DNA, 384 bp, Heterodera glycines
  Promoter: Source sequence=SeqID_15818; Location=1..384; Strand=+; Gene=SeqID_80138
attacttatttttaatttatttttgaataaattttattttattcctttgattattatttattatccatttgagaaatacaattattcaaatgctaccaaattaaaattatcgttcattttttatattttcatatttaaatgactaaatagaaaatatttaaaattatagagaaaattttgaaagtagaatcattgatggctaagtctgaaattttgccatttaagttgtcatttttttttggcattggcatccccaaaatcataattattattatttttttaattttaaataaaaatcggacacaagaaaacttcgtagaatttaattgcaatgaaatttttttaaattttttaatcatacaataattaattaagataataatg

SEQ ID NO: 99730 - DNA, 89 bp, Heterodera glycines
  Promoter: Source sequence=SeqID_34922; Location=334..422; Strand=+; Gene=SeqID_64608
ggtgagggggaagggagcacccaattaaattaaaaaaagttaattcaattaaataattaaaaaataatatcctcagggcactgagcatg

SEQ ID NO: 99731 - DNA, 175 bp, Heterodera glycines
  Promoter: Source sequence=SeqID_24085; Location=1395..1569; Strand=-; Gene=SeqID_54780
tttttgattatgcggtctcggtcgtggcattttttggttgtacggtcttagtcgtggcattaaatgccacggcgacgactcgtatcgtgctatggatgagttgggtctatggatgagttgggtatggatgagttgggtctatggatgagttgggtctatggatgagttgggtatg

SEQ ID NO: 99732 - DNA, 409 bp, Heterodera glycines
  Promoter: Source sequence=SeqID_658; Location=2515..2923; Strand=-; Gene=SeqID_46065
catagaaaaaataccaaaactggcaaattgagagggaaacgacagatcatcgatcagctcacatttgcacattaaagtgtggcacccacgcgaagcctataaataggtatgataatttgtgtttttcactattagatacattctctcctccaaaattcaattttttgagagaaacataaataaaaaaaaaaaacagtagaaaatgagcgtaattaagaagattgacaaagacagtgttgagggtctagaaggaagtctgtcttaattttctctatcgccaacaaatgtggccataaacaagacaaacgttcgtgaattgctgcctctgtctgctcttaatcagacaggtccatatttatttcgcctgttctcggacagtcaatattgtgacttgagcaaaacctacatg

SEQ ID NO: 99733 - DNA, 189 bp, Heterodera glycines
  Promoter: Source sequence=SeqID_14599; Location=1641..1829; Strand=+; Gene=SeqID_78677
ggtcgtctccgtactgacatcaaatacgagcttgttttgtccgtttagggcactttgtcgcgaatgtaatgaggcggaaaaggctgcaggcactggcaaatacgtgtgccacaaatgcagggcaataattgaagacggaaaccacattaaattccgcggggacagttaccacccttaccatttcaaatg

SEQ ID NO: 99734 - DNA, 579 bp, Heterodera glycines
  Promoter: Source sequence=SeqID_21; Location=7039..7617; Strand=+; Gene=SeqID_78597
tttatgcctcggatataatttttaaataattatattatttgatttaatcttcatttattcttttttaaaattagaaattttttgaatttgaggggtagggcagattcgtgctcagtaccgtggaaataaccaataagaattttgggcttaaccgggaccttttcgggttgaaaaaccgggaatttttggctgggaaaaccgggaaaaaaccccccgggactggtcccggtcaaaaccgggacctcggtactcagttgtccgtgttttagtcccggtcccgctctactctagtttaaactcaaaattaaaaaagattcacccatcatttaaatttttcccaatgtgtttaatgattattttttgatgactttggcggccaaaattttttgttctgttgtttttggcgatatgcacccctggtgaaatttttcgggtttcttgcattttcttaaggtttttaggaaaattaaggaaaactaaaaaagagcagatgaacaaccgaaacaggtttttaggcgccaaactaataaaaagtaaaacctaaaaacataatccttgtaaattataattaaaacaatg

SEQ ID NO: 99735 - DNA, 319 bp, Heterodera glycines
  misc_feature (39)..(39): n is a, c, g, or t
  misc_feature (84)..(84): n is a, c, g, or t
  misc_feature (313)..(313): n is a, c, g, or t
  Promoter: Source sequence=SeqID_44627; Location=1..319; Strand=+; Gene=SeqID_72096
tttgctctatttcttagcaaactttgcacaaaaatgacncaagtgctctatgaaaacaatatgcaattcgtaaactttcaattntatccagtgtaaatttttcacggaataaccgtgaattggccccgtgaatcgtgaccgtgactgtgagtgaaaaaggcatttatgtagagactacattttattaaaattaatatttttctatattaaatgaattatttttattaaatattttgtaaaaactatgaatggactaattaaaaataaaagaaaattcattaaataaataattaaggaccaaccgcaaatttanacaatg

SEQ ID NO: 99736 - DNA, 447 bp, Heterodera glycines
  Promoter: Source sequence=SeqID_2083; Location=3080..3526; Strand=-; Gene=SeqID_77761
tttttcatcccatttcccgctttgtccgcagcggttgtgccgatgtccccttcccccctcccctctctctctgtttttcatttcgcctttttgttcagcttatgtcaccaacagaggccgtctcgtaggcgtcgtcgcattgcgcgaggtacggataccgaaatgtttgaaacgcattcacagtcaatttgtctttttctccaatcagcttgtttttccgatcgatttttccgttcttagcccactgatcactttttttacttttctgatcagtccttcgttgttaatccttccgtcttccctctcattctcatgatcctttctgatcaaccattcattctttgatcatcctctctcccctcccttcattttctccccttcgcttagctccgtgcagccctcgcccacatttacacccgcggcgctttgccgaccgcccagtcgatg

SEQ ID NO: 99737 - DNA, 324 bp, Heterodera glycines
  Promoter: Source sequence=SeqID_17281; Location=1196..1519; Strand=-; Gene=SeqID_81751
catcgacggaatcatcgcgcaccaatccccggccaagccgatcagggtgatcactttgacctccataatgcaccggtgagcggaggagagggaccaaagctcggatggactgatcactgatccacgacgcccttcagattatgtggcaaccttttctcgatcgagaaggacccctccaagtgggaacggatgtttgacggcgcaaggcgctggagggcatacgccctgagcaaattcgccactgcactgctcgcccagcatttgaacacgcgcgagggcgtcaaagcgttcgcagtgcatccgggggcggtgaagacgcacatg

SEQ ID NO: 99738 - DNA, 562 bp, Heterodera glycines
  Promoter: Source sequence=SeqID_2870; Location=926..1487; Strand=+; Gene=SeqID_82064
tatttgaaaaaagattcaaatggaagaaaggttctgaatatgagttataccaaatggtgaaattttcataatatagatcctgacagtactacactgttggaaaaaagggtaatagtcaggttgttccccacttttttggtaaaaacgtgtaaaacatgttcttgtgagtggtttcggggtcgctgatcacaaaatggacatctatttcgatcaatttcggaccagccccgaattgtaacaaaattcgaactcatttttcactagaacactatgggtacgccccactgtgcagagaaaagcctagtactatctcgtcgtttctctttttctttgtaatttctctcactttggcgtactatctcttcattttaattatgtaaaaaacaacattcacttcgctacgtttaactttttttctacacgttaaatccaccccaaattttgcatatcgatagagaaaaggaaaatgagcaaactttcagtgttttgagtaaaaattttggcctagaaagttattcaattcgcatttatctgaaattttttaaattttttaggatttatg

SEQ ID NO: 99739 - DNA, 119 bp, Heterodera glycines
  Promoter: Source sequence=SeqID_24265; Location=1782..1900; Strand=-; Gene=SeqID_54980
tgagcccttttttaaattttattgaaatttttcggctatgaaaaagcatcatcaccaacactcaaaaagtcgtccatgaaatttgaaaaattttgaaaaaatgtgccgttttaggcatg

SEQ ID NO: 99740 - DNA, 234 bp, Heterodera glycines
  misc_feature (76)..(76): n is a, c, g, or t
  misc_feature (93)..(93): n is a, c, g, or t
  misc_feature (132)..(132): n is a, c, g, or t
  misc_feature (141)..(141): n is a, c, g, or t
  misc_feature (152)..(152): n is a, c, g, or t
  misc_feature (158)..(158): n is a, c, g, or t
  misc_feature (163)..(163): n is a, c, g, or t
  misc_feature (169)..(169): n is a, c, g, or t
  misc_feature (186)..(186): n is a, c, g, or t
  Promoter: Source sequence=SeqID_44799; Location=1..234; Strand=+; Gene=SeqID_72216
ttctcaaaattattaatgtcccaacaaggagaattgataggattatttagtgaggattttcccctggaattagagnattttatagttttgatnatttaaagaaaaatatagtagggagaaaagttggataanatttattanggatgtgaggnatgggntggangaaggnatagaaattttagaggngaaggagggaaagtggggtagatattgggttggagatattaaggaatg

SEQ ID NO: 99741 - DNA, 145 bp, Heterodera glycines
  misc_feature (14)..(15): n is a, c, g, or t
  Promoter: Source sequence=SeqID_7522; Location=1..145; Strand=+; Gene= SeqID_65112
tctagagtcatttnntggcacaacttagaggcaaaaacaaaaaaacaaaacttattaagtgcccttaattgcgcctccgattcgtccgcccaatgcgcgaagattcggtccaagttcagcaacgccatggatttatctgcaaatg

SEQ ID NO: 99742 - DNA, 1003 bp, Heterodera glycines
  Promoter: Source sequence=SeqID_14671; Location=473..1475; Strand=-; Gene=SeqID_78773
ataacaaactcaaattcaacggacatatttcaatcattctccaaaaagcttatctcaagagtcgaattcttttaaaaaaaattaaaaccaaatcaaccaagacttggattacagtttataaaagttatattcgaccccttttagaatacgcaaccgaatttggaatcctcgaaccaaaaaagaaataaaccgcctggaaaaattccagaaaaactacaaaaaatgttttcagaaaatgctgtcttccctatatctcatacaacgaaaggctaaaatatctaaaactttccaagctcgaaaccaggagaaaatatcttaatatcataacagcctttaaaattatcaaaaatactactcacctcaacccaaaaaacctttataatttttcaaataggaaaaggtcaccttttcctattttggtaaccaaacaaaaaataaccaaaactgaaaactcctttactaacagaaccacaaaacatctacaagaaatctgcaaaaattcagatatttcaatatcaaattcactgcccaccttcataaaaaagtaaaaaacattttacaagattaatttcaagttggagatctgacatcatcatgtttcccggactatcattctcttccgaaagtataagcggcctttgtcccttcttttggacttttattacttgaataaataaataatatttgagaaactgatggtgggaaaaggaattaataattcacgcggtgtgctgtgtttccgaaagcgccgtgggcgcatttcccccgccgccccctcaaatcaatataaataataccacaaatgcgttgtcatcccccgggggtggttgtgctgttttgtgttggcgttgtgccttcatttccttcgcctccttaatcaattcttaaaaactaaatttatttttctctttttatgcattttaaaatttctatcacttaattaatggtccatttctctatcgaaataaagagtttaactttattttaaaatattttgccaatg

SEQ ID NO: 99743 - DNA, 616 bp, Heterodera glycines
  Promoter: Source sequence=SeqID_1042; Location=3102..3717; Strand=-; Gene=SeqID_66812
ttgccgtttttactcgtcgccgtcgttgtcggctgtcagtgacgacgtccgactaattggcctgcctatttgtgaatgaatgtttgttgctgttgatgagtaaggctatgattttaatttatttaaatattttgatgagaaatttacgaaaaactatcattttagccgaaaatatttcgcttttaatgtgattatccataaattaaaaaaaatatttaatgtttgaataaataaaaatatttacaaaaatatttttaatttttttatcaatttattttaataatattttggcattttgggtttttatgaacccttaggaattgaactttcgaacaaattcaaaaatccaattttgcaaatatgcttctctatttttgcgacattgaacgatcattttccgattacaaaaatattcttgccgatgcttttcctcggaaacgcatgaaatgtactcaatttgtgattgcaaccagtgaataaaaaattcatgtaagaaaattacaattttttgttggtctaagttttttcatttttgaccaaaattttcatagatatttaaggggtttttcttaaaatatttagattttttataaatataatcccagccttactgatg

SEQ ID NO: 99744 - DNA, 1003 bp, Heterodera glycines
  Promoter: Source sequence=SeqID_15215; Location=339..1341; Strand=-; Gene=SeqID_79418
tgacctctttcacgttgttgtacctcttctaatcactgttgtacctcttctaatcacttttgtacctcttctaatcacttttgtacctcttttatcactgttgtacctcttttaaaaaattaatttcattttaaataaaataaatattattaattttcaactttgttttttattaataatttaaaattaaaatgcattcgatttttaatatttaataaaaaaaattacttatttattacattttaaatcatgttgacctctttcacgttgttgtacctcttctaatcacttttgtacctcttctaatcacgtttgtacctcttttatcacttttgtacctcttctaatcacttttgtacctcttctaatgcccgtataagcacaacaaaaatgttaaaaacctgcgcgaagcgcctgccaaagcccaataaaatttgaaaaacggggcgatcactgttgtaagcgcccctatgagcccaacaaaattagaaacgggcgcgaagcgcccgtcaaagcccaacaaagtttaaaaacgggcgcgaagcgcccgtcaaagcccaacaaaaattgaaaaacgggcgcgaagcgcctaacaagctaaaaaacgggcgctaagcgcccgtataagttcaacagatttaaaaaacgggcgcgaagcgcccgtcgtgagcctcgatgtggactaaaaacccctaataattttttaaaaattcaaaaaaatctctccaaccaattcgatcaaatctaggtagcgaagctccgaaagcgcgaagcgctttttcccagctaaatagccgacggttcacgcacccgctagttaataaaagaaatacagaaaattaagtcaaaaatagaagatgggaatttcgagtatgataaaaataattttgatgactgttctcgaatttttaataaaactaaagaaatcattcaaagaattgaaccaaattttgaaaaattaaaaattttgcaccaaaaatggcaaaatttaataaggcaaatg

SEQ ID NO: 99745 - DNA, 224 bp, Heterodera glycines
  Promoter: Source sequence=SeqID_4471; Location=3207..3430; Strand=-; Gene=SeqID_54563
tttcgaggaatatttttgtgtgttaagatgaaaatgagaagggaaaagtgtgggggtactgtatgtgacgtgatggagaggggggtgtcacgtgggaataggccacgcccactcaagtgagagcacgcagggacctccagacgggaggatttcgaaatccatccacagtatgccctcctatgccacgccccttatcattcacttccctgtcagtcatttagatg

SEQ ID NO: 99746 - DNA, 819 bp, Heterodera glycines
  misc_feature (225)..(226): n is a, c, g, or t
  misc_feature (743)..(743): n is a, c, g, or t
  Promoter: Source sequence=SeqID_29539; Location=750..1568; Strand=-; Gene=SeqID_60031
ggttggaagcagcagttgggcacagcaagaattcatagagacaaagaatccgacctagtgaaacataggaggagttcacaattagccaaatgtcttgaatgcaggatagtagagtatgtgaagagtttttgaatgaaaccaagtttgttggaattggatgtcaaagaaaagagatatagtggaaaaacatgtgccggcgtccaaccgtggcgcgcccaactgagnngtaaccgattaaaatgataatttccgggagctaaaaacctattttttcgtgcatttctcagcgaaacaaagccgctgaaataatagtttaggtggtcgatccccttgacaatttttggtgaaatcttttatttaaaatattttttgactggtgagcgacgcaaatgtccatttttgcttggcggcgcgtgtccaggcgcaaatgtcgcgcgcaaattttacggcgtaagtgtcgattttgctgagcggcgaaaaagtcgcaacacgctctatccaatccccggcaagaaatccatgtatggcttttggctaagcaattaaaaatttgcaaaatcacaattttttcacaaatttcctctgtcatttatggtccactaacttacttacttattgccacgttttataaaacagatgacaaaacaatgaaaatattttcattgattctggtcatataaatatttgcaaaataaataaatgttatccttttcatttcataaataaaaacagtactaacattntaaagcaaaataaatgaaacatttcaattcttttctcataagttttctttgttgctttcattttccatcattaatg

SEQ ID NO: 99747 - DNA, 411 bp, Heterodera glycines
  Promoter: Source sequence=SeqID_823; Location=5065..5475; Strand=+; Gene=SeqID_62118
acagcataccccgtgggtcacccaacacgagtgaacatcattggtgaggcagagcaggcggttcactggcgacgcgccgaccaggtgccggtccgaggcattctcaaagtgttcgttgtgccgccccatcacgttgatgtgcctgtactgcccgtgaaatttgatcagcggcttcttttcccgctgtgccgtacgtgcgctctgcaacatccgcatggagcggtcaatgaagactacgagtgcacgcatcgcgaggatgatgagcgggggtgggtgtccactgtgacgtcaatcgagttggaggaggcgcttcgcaacgggtaccggtgtacggcctactatcgctccgtcgagtgggacgatacgcggtggagcgaccgcgtttttcgaggctacgttgcagaattcatg

SEQ ID NO: 99748 - DNA, 642 bp, Heterodera glycines
  Promoter: Source sequence=SeqID_16383; Location=1989..2630; Strand=+; Gene=SeqID_80777
tggccaattgaagaaaaactgcacacggcagactttaatttgccgaaatcggagaaatgatgtgccgtaaaattggcttgaaatagacgataaccgtgcctcgagatttggcaaaaatcggttcttgtcgaagatgaaaccgtgccttgagatacggcaaagattcggtttatgtcgcacaaattgttgataaaccgtgccgtaagatatggcaaagatgcggtttagttgcacagattgttgataaaccgtgccgtaaaatatggcaaagatcggtttatgatgaatcaccacaagcaatatcagcacgagataaagcttggaaaataaacgctgtcgttgagctgctgactgcgccaaaatttgttatgtccgaagataacaaattaaataagtttatttgccgaagaaaataaaataataaataaatgcagagaatataaattgggaggtcaaaatcggtgggcacaataacaactgaatgaggggaatgggagggggaagatggcgaagtggcgtggggtcatacacctaatcaataattacttccttctctaacaataaactaaaaatgaaaagcataaaaactaatttttatgcccaacattgtttcattggtggcgccaactcggggccgaaatg

SEQ ID NO: 99749 - DNA, 275 bp, Heterodera glycines
  Promoter: Source sequence=SeqID_9753; Location=1..275; Strand=+; Gene= SeqID_46808
ttgctcagtgatttttgtaggatagtcagtggaaaagggtggaggtttaaatccgctatttattttattttcaaaactaaaaatagtaattttcgaaaatatttttttaaagatttctgccaaccaaattaggtatacaagcttaatacatcaaaatgctcacaatttaagcaattggatttacctgagactgaaattgttttatattatttattgattcaaattcttttaattttagcttgtttttcatagttccacggatttttcttgtaatg

SEQ ID NO: 99750 - DNA, 494 bp, Heterodera glycines
  Promoter: Source sequence=SeqID_32265; Location=315..808; Strand=+; Gene=SeqID_62582
ggttcgttttcgcgtgggggtcgttttcgcgtggttgcatataaaagataagtcattactagagtggcgcgacgccgagaattatgataaaaagcagttgaccatgacttgccaggtgatcgggtgtacgccgatctcgcaagtccacttgttctaacgtggacggctatcacatttgccaaaaactattttctgaacctaaaatctcgataatattttcaacgacaaaaataatggaaagcatttctgtgtcttaaaaaaaaattatcgcaattttttgcaaaatctttgaattttgtatacaaaaaatttttgaattctattattataatattgagtgcgatgcaaagatcgtcaatatatttttttaaaagtatggcattcccgccaatagtgccgtgtcgattaccccagggatttgttagaatcacattcgaatttaatgattattattcatcatatttaaaatattgattaattttattcagaaaatg

SEQ ID NO: 99751 - DNA, 557 bp, Heterodera glycines
  Promoter: Source sequence=SeqID_7859; Location=3057..3613; Strand=-; Gene=SeqID_66192
gaaacattaatagttttatgaatatataactatggataggatttgtatttatgaaaaatgccaaaatatttactaaataaaaaagagtcaaatattttttaatggatattggagattaaacctaagaatttcgcgctacaaaggtctttttcgtgcatttctcagcaagaatatgtattttaaaaatatatataaatcccatccctaatcgtaatatgattcggaataaatttatgttgtatattctgagaaaaatgcaaaatcaatgcacataaaattcatttgtaaaaatgctcgcccgcatattcgtattcattcatctatatgtattgccctatttcatgtgatttacacttacattattgctgaatatctttttatgcatatgcatataatgtgaagggaaataaattttcattatttaataacgttatatttatattatttttaatttacattttacttttttaaattttttataatatttttaacgttttaaaaaataaaataagttaaaattaaagcgaaataatttcaaagcgcaacatttagaaatg

SEQ ID NO: 99752 - DNA, 699 bp, Heterodera glycines
  Promoter: Source sequence=SeqID_26241; Location=197..895; Strand=-; Gene=SeqID_56991
ttattccggagtgactggagtgattacagagaaaaatggcgaacattaaatacaaatgaaagtgaaatgtgattgatcaattatcgtcgggaaggggcggtacattaagcaaaaaggaaattaaatgtgagataaattaaatgtgtaaatgttaaatcctagcgcttcggcagttaaacgaataatccaaatctcttacaaatccagactctcttacaataattttatttacatattttgagtttttgtacatatttcatgattttttttacatattcatgtatatattttgaccactagaacgaggcggtggagcctggtaaaaatgagttaaagtcgtatggtggtaatttggaacaaggaagtgaagagcaacccagcggtttaatccgccacttttaaattatttttcagaatttttaataaatataaaaaaattaaaagtggcaaaacaattacacgaaagtagaaaaattatatctaaattattaattcaacaacagttttgtcgattatgtcggaggaaatcagaaaaatatatgaaaattaataataacatcaacaaatcggaaaccaatttgttttccaacgagacaagcaaaagagagcaaatgtatataaatactgtccatatgttaactgaaaatcatccaaatcaacgcggcacagtaataaaatattaaaagatccgaaaaaatg

SEQ ID NO: 99753 - DNA, 672 bp, Heterodera glycines
  Promoter: Source sequence=SeqID_9328; Location=1..672; Strand=+; Gene= SeqID_46732
cctggacctggacctggattccatgttggacctggcttccgatttcctggacaaaaatccaggaaaatccaggtccagctaaaatccaggctcctcgagacctggatccaggcctggacctggatttttttaaactcattttaaaaatcaaaaaaatgtttgaaaaattcaattaattacttggcaacatctaaaaatatctaatttacaataataatttgtttttaaatatatttaatcattttttgaaaacttgaaaaaatatcggtcacttgaaataataaattctaaaattttgtccaggaaaatccaggttttttcctgttttgcctggacctggacctggattttttttcacatttggcctggacctggatttcctggacaaaaatccaggtccaggaaaaatccaggttgtcaaaaaatgacctggacctggacctggatccaggaaaaatccaggcctggatccaggtccaggccgagctctatttgttatacataaatcccaacttttcaaaattttgcgctatcggcaccgcctgaccaatttcaaccaaaatgaaaaaacactactaacaaatatgaacttcacatttttttcaaaaatgacccaaaattactttttcttgcttttttcagaccaaaattaatttgctccctctctaaatg

SEQ ID NO: 99754 - DNA, 185 bp, Heterodera glycines
  Promoter: Source sequence=SeqID_41107; Location=1..185; Strand=+; Gene=SeqID_69302
aatattcattggataaatatgaggcatactttggcattgtgcattatctgaaaaagaattggcattgtgacaaaataacagaggaatttgaagaataggaaaggacagaatgccacaaatatcgcaaatatttgtacattttgtacaaatatttgtatagagaatacatcggaattcccacaatg

SEQ ID NO: 99755 - DNA, 301 bp, Heterodera glycines
  Promoter: Source sequence=SeqID_11702; Location=379..679; Strand=+; Gene=SeqID_75187
gctacaaataatgggaattcgtagtaaaccgaatttgaaagcaaaagttcctggaatttttcgcataattctgaaaaagaaaagccaggtggaatgatgaaggtaacaggattttggcttaccgttttgaggaggcggcataaaaatggaccgagtttttaatcgtttttttgtgataattataagagattttagacagtttggaaaagatgggcccccaaaaaatggcgaattagagactccaacaaaaatggtgtaattccgtgactcccaaatggtggtttccgagtccataaaaatg

SEQ ID NO: 99756 - DNA, 956 bp, Heterodera glycines
  Promoter: Source sequence=SeqID_12430; Location=1..956; Strand=+; Gene=SeqID_47037
caaaattttcctcggtgcatttcaaccctcaaatgttttttctcagtctctccctctccagccgttcaaattctattgacttcataccagaaagataaaagagcactggcaatttgctttccggctgattgtccggtaaataaaccccaaatcgcattcggcactttaactgggcactgtaacaataaaataattccaatttgctttttttcatttcactaaacctgttatgttcgaaaattttctgatacccattgaaccaccgggatttgcttaattcgaccagcgacattgtcaaaaacgaagtttaaatttaaatgctttcagctgcagcggtttaacggctctttaactaacaattagccaattttaaatagaaatggatatgcaattaacgaattttataatttgtaaatgagtgcttgggcgcgccgctattatctgtaataatctgtaataaaggccagcttcttaattacacacaccattaaaatttggagtttttgatatcgctattgaatcgtttatttgccataatcactcgcttaagttttaatatccaaaaagttttacaacgaagtggcgtgtctaaataaaaattgttcaaaaatacataaaacggaaaacattgaaaaaatgtacatacacaaaaaaagagtgaacgacgtgaaagaaggggggggggggggtgattccgcgataaagcgctgaattggaatggaatgaataagcatcgatttaacaacattagcatgtttccctttgaatacataaaaataagcttcattcaattctttaattggagataaaaaacattaattcgcctttgtttaaaaatttctctgatttgatcaaattcaattacctaattaaatagtataaattacagaatgccttttcaccactaaatattatctgattgtaattaaaatttaaactaaagaatcagggcaatg

SEQ ID NO: 99757 - DNA, 852 bp, Heterodera glycines
  Promoter: Source sequence=SeqID_11333; Location=1811..2662; Strand=-; Gene=SeqID_74717
tcgcttaaaaagtgattaagaatggaatgataacctttatttgttttttcgaagatttatttaaattgaataaaaattgttttaaatgtttaaaattaattcaaaatccttcgttaaacataattggtcgaaaattaaatagcatctacatttgcactcaaaatcattttaatatttttttttaattattaagaatttttttaggtaaatttatagtaaaattaatttttgttcgaatttttttttcttttggaattgaataaaaattattttcaaatgtttaaaattaatataaatagaaaccgtgcctaattgtgctgcattttttttgtttaaatatgagcaaatctcgtcaacatgaactttttatccgttgtgaataatttttttcaaattaaattcaaacaataaaatataataaatgcgcttcaatgcccaaataaaataaactcataaatatgaaataaattttaattgcgtttatttcataaaaaaccaaaaataatttttaagctttatgaaagaagttaaaaacacacacaaaatataaaagttgttggtaaaaaatttaatcaatgtctaagaattggtgaatttaagcaataaaactatgaaatgaacagatggatttgtcgagaatctgaagcgagaaatatcttggatttatggaagtctgaccgcccaggaattcaaatttcttttttttcgatatatcattgagaatttttaggggagtcaaaaaactgcagaaaaaaattattaaaaaactgaaaatgcgttcctggtggtaataacttattaatttttacaaaatttatcagtaagtattctattttaggcacgtgaaatatg

SEQ ID NO: 99758 - DNA, 577 bp, Heterodera glycines
  Promoter: Source sequence=SeqID_17890; Location=1869..2445; Strand=-; Gene=SeqID_82440
ggagacaaaaaatttaaatttaatttgataaattatttatataacaatgacatttttctcttttatggaaaattgtgtaaaatcattgtctgttttggcataattcatttttttaatagaaaaacaggtaagctcagtcggggaattcgggtacaagtacagcaggtgccaggcttttttcaaaatgttcagctctgataattaggcaaaaaggaaattgagtaattaaaatcatttataataaatgtttaaatcatataaaattaaacatcatcagtctgatgattctttgtgcgctgactgccattttgtacgttttggcctcttttgcgtccactgttaatttggcggcgaattgagcagaaacaaagaacgccgatggataattaattatgaatgaagagacaacaaaggaacagaattttccaattcgatttgatctgctgaccgatgacttattcaatgcattgtaaaatagaaaaataattatagaacaattataaattcaatgcagttttacattttttggatttgaaacgtgaaaacgaaggacaacaaactgatcacttacgaaatg

SEQ ID NO: 99759 - DNA, 395 bp, Heterodera glycines
  misc_feature (311)..(311): n is a, c, g, or t
  Promoter: Source sequence=SeqID_9006; Location=1243..1637; Strand=-; Gene=SeqID_69975
tttgaaattgtgattttgtccctccattgaacatttgtacatttttagcattagtcactacattttgtgcacaattctctgtctaaaattgctcctcctacgtttttctgtctctacaaattgctccacccccgcattttctctccttataagcatttgcgttttcacacacacacacatcttttatatttattaaataaacttcttttatttattcggaatttattttccccctttattcctcccgcactctctccccttttgccctttccaaattgcccccctttgccgtccgagccagcacccgggcncggcctactttagtttttataaggacaaaatcaccgcactatttaattattatataattattacacacaaaaaatattcagatg

SEQ ID NO: 99760 - DNA, 616 bp, Heterodera glycines
  Promoter: Source sequence=SeqID_1042; Location=3104..3719; Strand=+; Gene=SeqID_66813
tcagtaaggctgggattatatttataaaaaatctaaatattttaagaaaaaccccttaaatatctatgaaaattttggtcaaaaatgaaaaaacttagaccaacaaaaaattgtaattttcttacatgaattttttattcactggttgcaatcacaaattgagtacatttcatgcgtttccgaggaaaagcatcggcaagaatatttttgtaatcggaaaatgatcgttcaatgtcgcaaaaatagagaagcatatttgcaaaattggatttttgaatttgttcgaaagttcaattcctaagggttcataaaaacccaaaatgccaaaatattattaaaataaattgataaaaaaattaaaaatatttttgtaaatatttttatttattcaaacattaaatattttttttaatttatggataatcacattaaaagcgaaatattttcggctaaaatgatagtttttcgtaaatttctcatcaaaatatttaaataaattaaaatcatagccttactcatcaacagcaacaaacattcattcacaaataggcaggccaattagtcggacgtcgtcactgacagccgacaacgacggcgacgagtaaaaacggcaatg

SEQ ID NO: 99761 - DNA, 82 bp, Heterodera glycines
  Promoter: Source sequence=SeqID_16879; Location=1056..1137; Strand=+; Gene=SeqID_81311
gcttaattgaagggaaaggcggcggtaattggggacgaatttggctaaactttgaaaaagagaagaatttgggcattggatg

SEQ ID NO: 99762 - DNA, 294 bp, Heterodera glycines
  Promoter: Source sequence=SeqID_41250; Location=617..910; Strand=-; Gene=SeqID_69423
tctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 99763 - DNA, 499 bp, Heterodera glycines
  Promoter: Source sequence=SeqID_10424; Location=40..538; Strand=+; Gene=SeqID_73619
ttcgtaatttagttatattgaaaattttctaaatcctctttatttgatgaaatgccattataaatcagaatttctaaatcaataagaatattgtagtctttttattataatctaaatttttttattattatgagctttgacttttaaattatttagataataataaaaatattagtttaaatttggtatttaaatttatattttgattaaatgtaatgttattttaataatattctctcgcttatcttagccttaactacagctattgtgtcattcgtgtcattcgctcactgggcacatttattttcaatttatttttattaatttttagaatttttcattctttttcaattaggtttctgtttttttcattttatatttagcttttatttaatttttaaaattctttttgtattaattggaattttaattaatagcctttaaacactttcttttaatatttagaaatttagtaaatatataaataaacttcagtatg

SEQ ID NO: 99764 - DNA, 112 bp, Heterodera glycines
  Promoter: Source sequence=SeqID_18366; Location=869..980; Strand=-; Gene=SeqID_82967
cctcaaatttgatgcaatttaaaattttaataacttttttacgctaaaaatgcttacggcccggaatttgtagcctcagggaaatcatccgccaacagaacaacggacaatg

SEQ ID NO: 99765 - DNA, 233 bp, Heterodera glycines
  Promoter: Source sequence=SeqID_11667; Location=1129..1361; Strand=-; Gene=SeqID_46973
ggtgaggagcagtcaccgcccacccccccccccccccccactttccacatttcaatgtcttttcaactttgtttagttgccgcgcgaggacgtagtggagctgctgccgaacgatggggacttcctggtgcgcatgacagaagaaatttcgggcacggagcgtgtgtatgcactgtcggtgaacgtcggcggcttcctgaaccacgtcatctttccgccgacacaagggaatg

SEQ ID NO: 99766 - DNA, 191 bp, Heterodera glycines
  Promoter: Source sequence=SeqID_24873; Location=1634..1824; Strand=-; Gene=SeqID_45891
agtttttgtgtgcatctcgcaaatccctgtataaaaaacttcgtttcatattttctaaaactatcatataaatccaacgctgactatgattcatattagaaaaaatgatgtaaccaaattcctttttaattgtctttggctaaaataccttcactaattttgcagcggacagtcacaaattggaggaaatg

SEQ ID NO: 99767 - DNA, 162 bp, Heterodera glycines
  Promoter: Source sequence=SeqID_42367; Location=362..523; Strand=+; Gene=SeqID_70275
attaatattaattaataaattgcctctccattcaatttggccaatttgccattcattcctttgccttttatcgttagtaaattattttaggcgcagcactttccaagctccactaaatttgtttttttgtgaataacagtcagcaaaaacaaagcaaaaatg

SEQ ID NO: 99768 - DNA, 322 bp, Heterodera glycines
  Promoter: Source sequence=SeqID_12684; Location=3037..3358; Strand=-; Gene=SeqID_47071
tttcggaatttctttttttttaaatttagcttattaaaatatttagaatatttgattatatttttattttttcaaaaatttccgatttccgacgtttttggggtcggaattccgacttccgaaaattttttgggcctcggaattccgatttccgaaaaaattttgacccccggaattccgatttccgaaaattttttgagcctcggaatgccatccctgatacacaccgtcaaaaaatgggacaaaaaaaaaattttttttttttcttgaaatgtcactctcattttttttttgattttttagctaattttaattcaaaatg

SEQ ID NO: 99769 - DNA, 116 bp, Heterodera glycines
  Promoter: Source sequence=SeqID_24592; Location=1777..1892; Strand=+; Gene=SeqID_55332
cctggcactgcggtgttggggcgcaacatagtcccgtctcgatcgcatgcgatggggcggagacagagcgtatgcgctgagacccgaaagatggtgaactattcctgagcaggatg

SEQ ID NO: 99770 - DNA, 125 bp, Heterodera glycines
  misc_feature (21)..(21): n is a, c, g, or t
  Promoter: Source sequence=SeqID_26986; Location=1137..1261; Strand=-; Gene=SeqID_57719
gagagttcaaatacaaccaanaattacgaccagtttttgatgcgtccgcaaaacttaaaggaaataattcactaaatgatgaaattcaccaaggaccaaaattactaccagatttgtgtggaatg

SEQ ID NO: 99771 - DNA, 167 bp, Heterodera glycines
  Promoter: Source sequence=SeqID_43213; Location=769..935; Strand=-; Gene=SeqID_70935
tcagtgtgttgtccgacgggtccaactcatccccctaattaattcccaaaattacacttaattagtgcgctaattaacaacatatatttgtataatttcggcatttctcgcaactttggcattttgtttttaacatttttaattttaaaatcctatccccaaatatg

SEQ ID NO: 99772 - DNA, 552 bp, Heterodera glycines
  misc_feature (36)..(36): n is a, c, g, or t
  Promoter: Source sequence=SeqID_2413; Location=1..552; Strand=+; Gene= SeqID_79607
ctgatttgcctattttagatcactactaatcagctntattacaaaatttttggcgtccgttacaaaatgatcatttttgaaagtgcaaaatgcggatgccttttggtttcaaaaattttctctttgtgcataatttgcttatcactttgctttgtaattagcgccaattttttattcgacaagctgattgtcttccgtttaattggttcttttcttttttttttgttactatatcttccaaaaagattcgaaccatttttaatttctaaagcccattcacagcaatgggacaatcagcttgtcgtttttgtgtaccattatattgtcccagaacagtaatcacaaattgccttttttatttttgtattcttttttgtacttgaaaatcatttaaccctttcttttattctctacattaaactaaatttaatttaaagaaatttttttatcttttttatttttgtgaaattaacatatttttatgcgcttttccctaaccaaatttagcccatagttagaataaagcgaaaacgcttttttaattcgaaaatg

SEQ ID NO: 99773 - DNA, 124 bp, Heterodera glycines
  Promoter: Source sequence=SeqID_23950; Location=1..124; Strand=+; Gene=SeqID_54643
ataactcaacacactctttttggatgacaaaaataaaacgattaattgtacgcccctcccatacaaacaaatcaatcggaccgatgggcttttgcaagtgaatgaaagcataattgtgatgatg

SEQ ID NO: 99774 - DNA, 871 bp, Heterodera glycines
  Promoter: Source sequence=SeqID_36691; Location=1..871; Strand=+; Gene=SeqID_65946
aattgaatttaatattcatttaggcatatcattcttttacttgctcataaaagttttttaaatacatcaatttataggttttgggtgccttagatcatggaaatatcatcatttaaaataggtcaattttttaacccctaacaatgaatccctaaactttatgaatcaggatcaataatatagggtttgggtgagtaagaaagaattatgacctgaaaacctagggtgatcgttttatagaacgcctaaaaaattttgatagggcatatattttggtttatttttttgaaaaatctacggaaataaagtttaagctgaaacagacgacgccaaatcaattatttttggcttttttgtgctctcaaaaatgtgatttagacaaaaaatcaaatcttttctttttaattttgaatgttttgggatttttaatataaatatatatttctaaaaaaaaacgaaagaaaaaaaaaagaataaaaattaattgcaatttaatctaagaagaatagtgtctataattgctgataaatcataaactaagtatgcagtttttcaaatatcaaaatattttcgtttagttcaacctattaccttcaatccttgtaattaactagtagaagatactgtacttagatatataaagttaattatttgataaaaaaatataaaaatataaaacccctcatctaatgtgttaatagacttttaagctctaaaaaaaattattctctaatatttcgtttttcaccggtttattaatccatagtcacaaatacaatatatatatatataatatatacacatatagatatatacataaaaaatgttttttttttttgttattttgtagttttttttattacaaagtatg

SEQ ID NO: 99775 - DNA, 806 bp, Heterodera glycines
  Promoter: Source sequence=SeqID_31860; Location=1..806; Strand=+; Gene=SeqID_62170
aatttttgggaaaattttgaaagtaattattaagtcgccctttcaaaggtaaatttccgttttggctgaaagtatgcaaattccaagattttgataaatctattataatggaaatttcgttcgatgggaaaaatgaaaattaaagattaaatttagcataaatattaaattatgataatattaaataaaaatttaaaaattaattaaaaaagagaaaaacttaaacaactctaaaaaattaagaaattataaattaaaaatattaaattaaaaaagaaattaaatttaaattcttatgaattaaactattttaaaatgataaatgatagagataatttcaattaaaacctaataaaaagaatatataaataaattattaatttgcccattttattacaaaattaatgaaataaattcattttagtaatttgtggcatttgtttttatattgccaacctattgaataactggtgtttaaataagaaaatttcagggaattaattggtattttatcccaaatttaaaacctgaaaatgatggcattgtgctatttttatgaaataatgagttgcgtttaccgttaattaacacataaaggcatcattggtttcatgtttgaaaatcaaagtttatactaattggaacattcatcattttaaaataattggctatccttttttgactttaaaattccaaaaatttaatactaatactaatgggcataggcttttttgctctaatgaactcattaaaaactaattatcttcactagttaaccctttttagcatttacattacgccaaatg

SEQ ID NO: 99776 - DNA, 370 bp, Heterodera glycines
  Promoter: Source sequence=SeqID_19895; Location=1..370; Strand=+; Gene=SeqID_84656
cgaaggaacttatgtttccaaattcttcgaaaattaccaattcggtgccaatgaagcatcagaaaatgccgccagtcaatttcaaaaattttggtaaatttcaacagaaacaccaaaatatggaacggcaattcaacaacaaatacggcgctaagcccatcactttccaaaatggagagccagttttcatttggaatttgaaaggcaataaggcaaattggttgccggcgacgattatcgagagagggcaactctccgacttatcgagttgacgttccgacgctccgttgcgcagtccaccgccttgtcaaccaaattcgccgccgtttcccagtagaaatggagaaaccgcaacttggccaagaaaatg

SEQ ID NO: 99777 - DNA, 105 bp, Heterodera glycines
  Promoter: Source sequence=SeqID_8213; Location=2410..2514; Strand=+; Gene=SeqID_67325
ggtcgcttttttaaaaaatttctcgactgatttgcagtttttttaaaattttttcattttcttttctcatacgaaattttcaatcatttttaggtttacaaaatg

SEQ ID NO: 99778 - DNA, 366 bp, Heterodera glycines
  misc_feature (72)..(72): n is a, c, g, or t
  misc_feature (103)..(103): n is a, c, g, or t
  Promoter: Source sequence=SeqID_5167; Location=2377..2742; Strand=-; Gene=SeqID_57137
gaacagacgtgccccacaaaggtactcgccgtgagcgctcaaaaaggggaggtgttcggatgagcctattgnaattatattggcgatctgtctattcaaatcnccgcattttgttgttgtcactcgcccttaaatagacggtcattccctccctcctggtcttttcctctcattcatttgattttgttatttttcctccgaccaaattgtcctccatttttattttattgttcgtcaataaacattattgatcgtgttccttgacccctcggaccgaacaacacccgaccgtcgacgttccgctccgtaaacacaggccgtggtccgttggagcagcagtggcagaccaactgcgagccggtgatg

SEQ ID NO: 99779 - DNA, 61 bp, Heterodera glycines
  Promoter: Source sequence=SeqID_1726; Location=414..474; Strand=+; Gene=SeqID_75525
agtaaaagcaacatattttttttatggtgataaaatttcaaatctttagggcaacaaaatg

SEQ ID NO: 99780 - DNA, 241 bp, Heterodera glycines
  Promoter: Source sequence=SeqID_42074; Location=991..1231; Strand=-; Gene=SeqID_46691
tttagagaaaaaaaattgctacattttcgaattttggcacaaaaaattaatattgataatatgcattagttaattatacccctcccctctcccgcctcattagggcccaattgcgcgccaatcgctcgaccaacgaccaatcaaattggcgcaggtcagcggcagtccgcaagtggccgacaatttgccaaggagatcggcaaatgcatggaagccgaagcgcgaggaacgttttgacatg

SEQ ID NO: 99781 - DNA, 805 bp, Heterodera glycines
  Promoter: Source sequence=SeqID_240; Location=3615..4419; Strand=-; Gene=SeqID_79583
tttaaataagagtagttatagatttttaccaaaaatttaccaattttgcgattttaggccaattttttaagaaaaaataggaattattggggtccggcggcgctgataggcgctgtgattgtttcaaacgaaaaatatgacagttaactgactttgttcgtaattttatgatgtttttaaaaatgaggatttttcatgccaaatgaagatttttttggggtattttagtggcaaatgaggatttttatggcggaaatgaggattttcaaaattttaagatcgaagccctggagaaaagcatgaaaaccacgttttctccaaaagtttttgaattcgatcgattttttagcaacaattttcaagaattttggggtttttgtcaattgccaacaatttttttggcatgtgaattttttaaaaactatttttggcttgtcaataaaaattttgttataaaaaataaaatacctaacagactcaaaattggataaaaaatggggggggggatgaatgaatgaatgaatgttgaatgaggaggaaagaagaaacaatggcatttttatacaaaaatattagcgtatatttgagtaccggtgtgaaaaattgatataaaatgcagagaaaattgacagttaatgtcatttgttgttttgcaatcataatttatgatgactaattaattggaagcgtgctcagctaaatgccgcaaaatagttttttactcaatccataatccacgtcttaatttttgtgctaatttgttcaaaagttttatttattttaggctaaattatttgtttaaatg

SEQ ID NO: 99782 - DNA, 698 bp, Heterodera glycines
  Promoter: Source sequence=SeqID_28991; Location=1..698; Strand=+; Gene=SeqID_59558
taagagaggatgggagctgggagagagagggggggcttcgagagatagagagacaggaaaagaaagaaagagagagagagagagagaaaacgagagagggtgggagctgggagagagaaaacaaaataaagagaggaagagagagcggaagagagagagaaaataagagaggatgggagctgggagagagaggggggggggggggagagagagagagacaggaaaagaaagaaagagagagagaaatagagaaagagaaaacgagagagggtgggagctgggagagagaaaacaaaataaagagaggaagagagagaggaagggagagagaaaataagagaggatgggagctgggagagagagagagagagagagacaggaaaataaagagaggaccagagacataaaataatagaggctggaagctgtgaactttggttctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatg

SEQ ID NO: 99783 - DNA, 1003 bp, Heterodera glycines
  Promoter: Source sequence=SeqID_17234; Location=1922..2924; Strand=+; Gene=SeqID_81703
ttttcaatatctttacttaaaatcaaccaaattttaattcttatatcattcaatagctctagttgttttctattagcatgcaaaatttcaaaaagggtgtgcgtacgtttcgcctactggacatctcgcctactgacacttcgcctactggacatttcgcctactaagccaaaatcggacgttccgcctactcacctaaaatctgacattttgcctactaagccaaatacggacgttccgcctactcacctaaaatctgacattttgcctactggacatttcgcctattgaatatctcgcctactaacctaaaatacctagctctctcgacagcaaatttcaccaaatatatattctaatttgacatataattcgctatatttataatgctaatgaaatttagccaaaaaaagcaaataaatttttcaaagaacacagaaagtgtgcatctccattagcttcttaatcactctctttgttttccatggatgtgaagcctttggcttagtagacgaaatgtccagtaggcgaagtgtcagtaggcgagatgtctagtaggcgaaatgtcagattttggcttagtaggcgaaatgtcatcgtgccttcaaaaaggtttcgttaagtttcaagaaagttatgaccaaaaatgttgtaaaaaacttggttttttgagcttctcaagttataacttttttgaaacttaacggaactttttgaaactttataggctaatagaaaacagttgggcctattgaatgatatcaatattttaaaatttggtttcattttgggtgaagttatgaataattttctgtcaaaaattttccattttttggaaaacattcgttaaatgtgattttggtgcttcttcatcaaatacaatccgtaaaaaaataggaaaaccctaaaaaccaggttttatccaacgcaattaattaattattctgctatttgtttgacctcattcggaactcggccaaattgtgctaattaccaaaaaatg

SEQ ID NO: 99784 - DNA, 130 bp, Heterodera glycines
  Promoter: Source sequence=SeqID_9544; Location=2578..2707; Strand=-; Gene=SeqID_46776
tttgcacacggacaaagtgaggcctaagcaaattcacacttgtttcttagggaatggccaaatactgcagacaaatgggacacgggaagggcacttttttgggagggggggggataaagtcccaaaaatg

SEQ ID NO: 99785 - DNA, 950 bp, Heterodera glycines
  misc_feature (384)..(384): n is a, c, g, or t
  Promoter: Source sequence=SeqID_5997; Location=2706..3655; Strand=-; Gene=SeqID_59967
aataccctaaattttgaaatttttcttagtgaaaataagtgaaaacagtcaattcaaggattgggagggaatcattaaaaactgaacaatgttggaactgggctcccagtatgcctaaattttcgattttagaggccttgtaaaactccttggggttttgctagggtgaaaaacaataaaaattaaatagcataaactaatattcaataacaaataagtttttaaaaaatgaaattgagaagcaaatgtttgggtcaaaataatctcaaaatgttgtataatttgcttaataaaatccaaaatgattagatttcactattaatgggccatttatttatttgtgaaatgattttaaaaaaataaattggctttctaacgttttanaatggagaaaaaaaattggagaggactattaaacgagccatttaatgaaaatagttgtaaaatttaaaaattatggccttttgttgtctaccttattttatttttattttgaccacatcaatttttgtattcaccgtattcttttcatctcataatttttgtattccattcaaataaaggagtaaaaaaggttagccgacatttgcggaccgactttaccaaagcatggaagtgaaacacgtaaaaattttccttggtataatagtcacttttctccgctgctttaattgcttttaattaattaggcagggacacacggggacagtcttttaattaggtcggaaggatggggacaattgattaggactttgaccaatgattattgttcacaaattatccaactccgtcaaataatattaaaactcaaattggcacagcacagcacatatccaattattctccaaattacataaaacagcgaactaactaaattacacaaaacaaaataacaaaacaaaatcataaataaaatgccaaacaaatatgatttaaaataatatcaaatg

SEQ ID NO: 99786 - DNA, 77 bp, Heterodera glycines
  Promoter: Source sequence=SeqID_8135; Location=1..77; Strand=+; Gene =SeqID_67086
agaaacagacagaaaagaaacagaaaaaagcatagtgaaagagagaaggagcagtggaaaagataaagggcacaatg

SEQ ID NO: 99787 - DNA, 54 bp, Heterodera glycines
  Promoter: Source sequence=SeqID_3643; Location=5300..5353; Strand=-; Gene=SeqID_51251
gccactgctcggctgccgcagctcagtcttcctgttttttcgggcgaaccaatg

SEQ ID NO: 99788 - DNA, 1003 bp, Heterodera glycines
  misc_feature (517)..(517): n is a, c, g, or t
  Promoter: Source sequence=SeqID_16347; Location=426..1428; Strand=+; Gene=SeqID_80735
taaatttcttttacccatagaacaacaaagaatatattaaaagctataaaatgaattttattgaaacaatgggatgtataacctaaaaaaatatttgatacgttcgatgcagaatttttttctctatcgatatgcaaaatttggtgtgtatttaacgtgcaggaaaaaagttaaacgtcacgaagtaaatgttgtttttcctaataatgaaaatattagatagtatgccaaaaggagagaaaagttagagaaaaaaagtttctctgcactctctctttattgacacatgtctcgttttttgactcggtgtgtgtgtattaacgaagttaggaaaaagttatgacctaaaaaagcaagaatagtcactgattggacgcgtaaactggaatagagccgattttttgttaaaaacatgaataaagaactgaagggacagcttttagtagagacaggacaagagggtcggtcgaaacggtttcggttaaaaaccgaaaccgacaaaaccgaagaaaaattnttcggttttttcgaatttgtttatttattttccaaaaagcaataaactcagggatggtatccgtccttgaatggcaaggacgtccttgaaaatgagcatttggaaaagtttaaaaaaaatcaaagaaatttgagaaatctttgtaattttcaacaatattttgattaaattatggcattatgtaatttaaaaatgtaatttttgagaatttttgaaattttatggcattaagtcactatttttcttaaaaaattagccaaaaatcgcaaacttggaagccgacattgggcgataccaaccctgaataaaccattcgcgccctttgttgaccttttttaaaattttgaggcgtaggcccaaaacagaaaagtaccctctgcttattcgtagtttttggctaatttaaaaaagccagattaaattaaagaataattttaaaattaaatcacaacttacgacaaaagtgtgctaattgtagaaaaaatg

SEQ ID NO: 99789 - DNA, 51 bp, Heterodera glycines
  Promoter: Source sequence=SeqID_25752; Location=317..367; Strand=+; Gene=SeqID_56491
acgaaacttcggtgtattccggaggagtgatggcctgacaaatgaatgatg

SEQ ID NO: 99790 - DNA, 321 bp, Heterodera glycines
  Promoter: Source sequence=SeqID_7644; Location=835..1155; Strand=-; Gene=SeqID_65506
aattaattaataatcagaagaatgtgcgtcaaaagtgcggttgttgttatctgagggaggagaaggagaataatcgaaatgagactgatcaatgaactcatcacaaattaaatgaatgaaatggcttatcattttttgtcacttttaaatattttcagtgttgatttgtgtttgttatctctctgttttgacagtgtaaaaaatgggcctcgttttccgccacttatcagtttgtatttttaaattctaatatctgtcgtacttcgttaatttggtgtttttattcaaattccgctttttggaatttgtcaaaagcgaatg

SEQ ID NO: 99791 - DNA, 175 bp, Heterodera glycines
  Promoter: Source sequence=SeqID_35971; Location=1..175; Strand=+; Gene=SeqID_65418
ctgttattggtcaatttcgtgcggctgaacaccgaacatccctctaagaagttgtgcccacagaagcaatgagccaactatttagtaggctagagtctcgctcgttatcggaataaaccagacaaatcgctccacgaactaagaacggccatgcaccaccatccaccgaatcatg

SEQ ID NO: 99792 - DNA, 73 bp, Heterodera glycines
  Promoter: Source sequence=SeqID_20063; Location=334..406; Strand=+; Gene=SeqID_84845
ggtacgcattgagatgagaaacagtaatcaggtcaattaacccttgaatttatttagcccttttgatggaatg

SEQ ID NO: 99793 - DNA, 179 bp, Heterodera glycines
  Promoter: Source sequence=SeqID_11258; Location=2735..2913; Strand=+; Gene=SeqID_74622
ttattctccggcacggctcctgctgctgctggtggccaacacaacgcgtatccgacgggggacggacggcgttgggacccgaaaatttttaaaatattacaaacaatttaaaatgcacaattttcttagagtttttgcattggtatggcatcgcaaaaaaataaaaataaaaaaatatg

SEQ ID NO: 99794 - DNA, 782 bp, Heterodera glycines
  Promoter: Source sequence=SeqID_20739; Location=1603..2384; Strand=-; Gene=SeqID_51306
cctccataattaggttttacccttaggggccgtcaaatggcccactaggcaatgtcattgccaaactcggcacatttttagtccttttcactgatttgctgaccaaattaaataaaactatttattatacatatatttaaatttatatctttgttttatcatttattacaatggaaaatggttggtctttggtgtcggtgtttggttagcaaatgattttctgccccgcctttgccttcgttatttttgttttcctcaaaacgttttgtttgttttcgtcaacaattttgtgtgtgttgttgcagttttctatcattcttttctttaatatttttatttaatttttcttataaataggtatgctaaaataaattattatgagttctaaaatattattggctttttctaaataaatacaacaaatcatttgtaaattcgttaaccattttatcattttgctacacctcgttgattatatgtattattggcaaattctgaagggtgtggaaaatattaagtgatgttttattttacagttgctttggggaggagtaattcttcccgaatcttttcaaaatggatttccagcattatctaatttgtcagaacaaatagcttgtacgttgccacagctttaaggatgagcttaaaccacgggaagccagcactgaataataaattatttatattaaatttgattttaaattagttgaactttttcattaatccgcagatatattgataatcccccctcactttcacttaaatttattggcgaaatg

SEQ ID NO: 99795 - DNA, 539 bp, Heterodera glycines
  Promoter: Source sequence=SeqID_31714; Location=1..539; Strand=+; Gene=SeqID_62019
ttatgatctctgaggaaatgcattactgacgaaatcccaagtacgataataataattatttgttacatttctttatttaattcatttgctaaaattttgttgtgttgggatcaaagggatggcatctgcaaaatttgttttaacaaatttcccagtaattaggttggcgtctctagtgaaaatggtaattgccagccacagaaaactaacgacaccttaagccaatggcaaacctaataaagtctccattttcatcagatataaatctttttcatgaaaataaatgtttaataataatgaaaatattttttacattaagaaaaattttaatgagaataaatatttattgtgaaagcaattataggaaaaaaataaatattttttttacaccgaaaaaacatttaaaacccgaaaaaactcctccttttttatataaattcctggcgcagcgtttttatgtacacaaaaaaacgtactttttttataaaacaagtttaacaaaatttaatttctttacagaataaacgccctttaaaatg

SEQ ID NO: 99796 - DNA, 1003 bp, Heterodera glycines
  Promoter: Source sequence=SeqID_8353; Location=5017..6019; Strand=+; Gene=SeqID_67781
taatttatttaaaatattcaagaaaaaataaacggttcattttaaaaagcaagaagtcgttcaaaatcggaatgaaccttttacaatggtctccgaaaatgcgatgtagggcttttgtaataccattcgaatcggggataccgggcgttgtaaaatttaaaagttatttcaaccaaatatttaaattttaccttaacaccatgccaaaataaacctttttttcatagccaactcacttcgaaattggtcaaaaatcataatctggtataaataattttttgatcagggtttccgacccccgacaatttaacctcccccaccgacccgacccccgaaatcttgttgttgattaataaaaaaaaaacagttttgcaaatgttttttgtaaaacaacataataaattgagccaaaattttttaatttaaaattaaatgtatgccttaaattagagaccggacggaccggggcctctccgggattttgccgggactcccggccctggtcccgttttttggacaaaccaccgcgaccgggagtcttggaaaaacgtgtcccggcccgggccgctgttcccgaatccggcatccatttcgaccaatttcgaatccggacccaaattcgaagaaaaagtcgaaaattcaaattttttcggttcatatttttagtctaaaaataatttaaatgttcttttttgttgaagcaatgatgactttcagttttttccgtgtatttaaataaagtgtgagccaaaatgtgcaagttgagtttccaaaaccgctttttagggaaaaaaggcttcattatgaatctgatcatgtctaggtccgatctctttcaattgaactgaatccccttttaccaactaaaaaatatgcataaatttcattgattttattgtacgtatagttttgtatatcaatgatttaaatttttgatgatgattatttgataacaaataaaattgatttgaatatataaattataatttgaatttcatcaatg

SEQ ID NO: 99797 - DNA, 110 bp, Heterodera glycines; identical to SEQ ID NO: 98226
  Promoter: Source sequence=SeqID_5873; Location=660..769; Strand=-; Gene=SeqID_59511

SEQ ID NO: 99798 - DNA, 265 bp, Heterodera glycines
  Promoter: Source sequence=SeqID_3429; Location=1271..1535; Strand=-; Gene=SeqID_84652
aaaggtgtatcatgttttgattacctacgaaaataaaaaaagtgggtaataaaactattcagaaatgatgatatagccggggcgttaagtactctccaccgacacggatagtcttgttttctcacatctacgcgatgctttttagctgaataagatcgacactataagcagttaattgatggaaatcgtagaattctgcactgctggtgcaaaatagtatgcgttggctttaagacgtataaatgttctacatgatgcggaaatg

SEQ ID NO: 99799 - DNA, 899 bp, Heterodera glycines
  Promoter: Source sequence=SeqID_6343; Location=1..899; Strand=+; Gene= SeqID_61220
agcatatactgcaaaaagaagaaaatttaaaaaaaaaagttcggaaaacaaagtttttgagtcccttcaggccattattttttttaaacctaatgcacgggtgtgatctgttcttattactaagatatgttctgatttcttaaacacactcataattttgaagttttatggcataatgtcaatattagtcaagaaattttcaagtttacgcaaaatttggtcatttttgggcaaaaaatcttaaaaaattattcatttaaaaatgcactgcaaaaaatgttaaaaatcaaaaaaataaaaaaaaatctgaaaaaaggttaaaaaccattttgatcacgattacactgaaattattttctgttaatttcctccacaacattgttataaatgatggaggtgaaaaatataatattttgatacttttttgattaaataaattgtaaaaaacagctgattaaagcaatttgcaaaatgttcttatttttggctttatgttcttatttttggctttatgttcttatttttggctttatgttcttatttttggctttatgttcttattttgaaatattaatggcaaaataataataaacatacagagaatattgaacaacaccaagaatgcttaatttgtattgataacggatgagaaaatttgtttttatggaaaaaactttttggaaaagtatggtaatttttaataaaaacaattggtaatttttttgcgcgatccgccacaactttttcggttccgcttctcaccccatggctctcttttctccttgaggaggaaatactttttttgaaaatgccgccaaataaaacgcaacaccaaaaaaatataagtacaattttcatttttttatttaaattttatgtcaaatgattaaggaaaaatg

SEQ ID NO: 99800 - DNA, 94 bp, Heterodera glycines
  Promoter: Source sequence=SeqID_29092; Location=491..584; Strand=-; Gene=SeqID_59651
tacattaaaatcgtttcttccaaaaaatgtcttagaaaccaatctttttaaatagatataatcttattttaagcctaattaggtcattgttatg

SEQ ID NO: 99801 - DNA, 1003 bp, Heterodera glycines
  Promoter: Source sequence=SeqID_8040; Location=1198..2200; Strand=-; Gene=SeqID_66789
tattgtttccaacccttttccgtctatgattattaatcattgattaatattaaaaaaaaaattggtccccaagccacaaaatcacaattcaatcgtccgcactccaaaatctttaagttagtcccgtgattttttaatcgcttattccgttcagattggggagggaaaaattaaatggcgaaaaggaaacaccaccgaccgacccatggggagaattaattgacaattattcccccgagaatttcatttttggataatttccaaaatcgtagagaaaagtgatttatgaattattttataaaaattaattcattaaatgtgaaattggtacgtttatgaaacatatagagctccggtctgaaatttttcgaaaggaaatttgtagttgggaaaagctaaaatttcatttttttcaacaaatcagatgtttagaggcattttttattgcctccaagcaattccgacatcgaaaaaaaatcgaacattgaatagagtctgtttttaaaaagcacttaattgcgtccggcggtgctggagaaatagcccactaattaataatgcaaataacaaaaaatatataggtatataaaataaataatgttaggataataatttagccggatatcctgtttttatgacattaaaatttgtcatagttcgtcatctctgtttcttttttttgcgtaaatctttgcatatttaaaaaagtttcaattaatttttattcacaatttatcatttgttttcaactgctcaaaaattttattaattctctaattaaggctttaattcggtttttaaacctattaatgcatttgttttaatgtcaccataattttctttcaaaaagaataagttttatttgatatacttttccaatcgtttaatacatcgatttggtcaaatataatttaatcaaaattccaaattttttgcccagcaaatcccatcgccaccaccgaaattatagcctaaaaacacattcttttagttgcttaaaatg

SEQ ID NO: 99802 - DNA, 410 bp, Heterodera glycines
  Promoter: Source sequence=SeqID_30822; Location=1..410; Strand=+; Gene=SeqID_61222
ctagagtcacttaaaaattgggcatccaaattctttttttccccaaattttgaccgtctctgccccatgttcccgaaaagtttttaaaaagcgcgccacaaaacgggttaaccgaaaaactatcgatgattttggccggaccccactcgcaaaattggaaaattttccgaaaattttcaccttttttggaggggaatttttcaaaaaacttagtaatttatcataaaattttgagaaaatcgttagaaaattttcaatttttttttttgttttgagatttgtttaggtatgtaaaaaaatttcggggttaacgaaactggggggggggtgaacttatcccgatctacatccgcacaaacaattgcgccccatcttaaaaaaaaatgttcctcatccatcttccagggatg

SEQ ID NO: 99803 - DNA, 157 bp, Heterodera glycines
  Promoter: Source sequence=SeqID_16139; Location=2660..2816; Strand=-; Gene=SeqID_80503
agtttctagaggccatcaattatctgaacggaccttttctgcccaaccgtaattcatgataatgatttattctaatatatatcgtgaggggttgaaaatatgattttttattttttttttaaatggatttccaattttagccaaaaatgtgctgatg

SEQ ID NO: 99804 - DNA, 78 bp, Heterodera glycines
  Promoter: Source sequence=SeqID_20499; Location=884..961; Strand=-; Gene=SeqID_51039
aaaatttccttaaaaaccccttaataatacagatagataacataaatgaaatgcattcattttagaaaatacgcgatg

SEQ ID NO: 99805 - DNA, 255 bp, Heterodera glycines
  Promoter: Source sequence=SeqID_6389; Location=1..255; Strand=+; Gene= SeqID_61347
ggtaaccgaagtcccgagaatggaactcattcatgtgccatgtttgtcccggtgccaagcccttccgtatttgccatcatttcttccaaccaatgcttccatttttcgtcatccgaccgttgaatttgccgcgtcccttcccattttcttcgcttttttccggcgttcatttgaaattgaaatttttaatttatttaatttaccattttaagattgattatcccactcgtaattattcattgttctgtcaaaatg

SEQ ID NO: 99806 - DNA, 367 bp, Heterodera glycines
  Promoter: Source sequence=SeqID_7904; Location=3697..4063; Strand=+; Gene=SeqID_66331
aataataataataatgtgtttttaaatttatttaatctgtttttgaaaacttgaaaaaacatcggtcacttgaaaaaataaattctaaaatttcgtccaggaaaatccaggtttttcctgttttgcctggagttttattccgtattattcatcggttgggtcccctttttggaagaaaaattctttttatatttatgcttgtttagtatgatagttaattttttatcttaaaaattttctttgcaaaaaatgaagggttttttctaaatataattatgtgatagtacaaattttaattattataataaatctatacattgaacttatttattttttaatttacattttttttatatttatagaaatg

SEQ ID NO: 99807 - DNA, 189 bp, Heterodera glycines
  Promoter: Source sequence=SeqID_33966; Location=530..718; Strand=-; Gene=SeqID_63885
tgggttccgccgccttctatttttagtaattaattataaaaaatatttcttattaaaaattttatttttagctacagcggtgtaagagtaaaggtctttttggtaacttaaataaattaatgtttaaaaatttattcaattaaaaaaaacaattaaaaggtacttctcaatccttgcaggactgaaatg

SEQ ID NO: 99808 - DNA, 1003 bp, Heterodera glycines
  Promoter: Source sequence=SeqID_15558; Location=470..1472; Strand=+; Gene=SeqID_79840
ataagtgtttaatcttacatataaaagccaaaactatatgaataatttaagcttttaaaatcaaatatgaccgaattccataaaattattagccaaaatactcacaaaatttctatataatatgtagacaaaagtctcttttaaattaaagaccgaacttttgagaatttgggattgggatcatgcagtcttaaaagtgaaaaagtcaacgctaatgatgggttcatttttaagactcgaaaaaatgataaaacctaaaaacaaagccaataaagaagttagataaattaaaaaaatataatgtgattatctggaaatacgaagaagcactcgctgctttaaagtttaaacaattatgtttaaccaatcttcttgaaaaaaatctatattatatttaccctttttatatacagggtaacaaataaaacttcctataatttaattactaaatatagtcaaattttaaaaataattataaatatatgataacaaaaaaatgaaatctactaattcgaaaaaacttaaacaaattaaaaagtttaaaaatgaatttgtgataagaatatgctcaaaaatattatatattacataaaaattaaattcacaaagattaacatattcaacatgtaaaatctcaataaatatttatccggatgaaatggtaaactcccatgaatttctaagtcgaacaaaaattccaatggagagtgtctttcttgtcttccaagggaaaagtgaaataaagtcactttgggtacaattatttattgtgaggcacagagacggaacatgattataagcgatcatcgatcactttgtgttatctttttcccgcccctttcgcttcctttttcccgttcccccgttctcgaaaaagtcagttgagtggggataggcagtcgagagcgatggagcgagatgggctttttgcgattggatttcaactgtttttatcggctaataaatgatgttgtgttttactctttctcagcatttttccatg

SEQ ID NO: 99809 - DNA, 65 bp, Heterodera glycines
  Promoter: Source sequence=SeqID_6772; Location=1..65; Strand=+; Gene =SeqID_62851
aaaaaagcaattaattagcaccaaatccaacacaattcacgttttcattaattttaggcttcatg

SEQ ID NO: 99810 - DNA, 500 bp, Heterodera glycines
  Promoter: Source sequence=SeqID_25260; Location=1..500; Strand=+; Gene=SeqID_56008
gttacccgatcagggacttttggtgccctttatggttgtttagtaggctccggcggcaaatgactgataaaatttggtagtttttacaccgttccggaggccaggcgagtaccaaatcggatattaaataataaaataatttggttgatgattaaatttataaattaatatattaaaataattaacttaattattcgaataatttttccggactgaaacggccattccctccaaattgcgcacattcattcttttttcgcttcgcccacacttattcttttttcacttcttcatagcaccattttgttgcatttacattcagattctctctttttcccctccaatgcgtttcgagcggcggaaacagcgaaactgacaacgccgcttcaatttcacaacagcagcagcagaacttttttccgcttggccaagtaatttttccgattttcttttgctaccgtaatccaccaatcgtttagcaattaccgtctttcgcgatg

SEQ ID NO: 99811 - DNA, 604 bp, Heterodera glycines
  Promoter: Source sequence=SeqID_40630; Location=1..604; Strand=+; Gene=SeqID_68899
cgggcaaagaaccggggcaaagccaaagggggataaatttgaggagagaaataagcaaaggaaatgggagaggaaaaggttgccaaaaaagattaaaacaaatgataaaggaaaagcaaagaaaaattgggacgataaaacggaagaaaaggcaaaagaaaggacaaatggtcaaattgggagaagataagagacggaagtgataagggacgatgattcatcagcagaaagaaccaaaaaacaaaacaaaagcctacacaaaactgttggtgaagtgaagcggtgaatttgggcaaagctttcaaagggacgagaaaattttgaaggatttgccgcggcgaaaagagacgccgactccgttgggaagtgagcagcggaatttcgggaggaagaagccatccgacaagcaatcgcagggggaaaaagccaatcagagggaccatctgctcaatggaccaaaaaagagaacgccaatggcgccgaaaataatccccggaaggcatatactcaattttgatctaaacactcgaataattaggtaacaattaacaaattaatcaaccaaacaactcacgccgcctctttcgcacattctctgcgcatg

SEQ ID NO: 99812 - DNA, 134 bp, Heterodera glycines
  Promoter: Source sequence=SeqID_37110; Location=329..462; Strand=+; Gene=SeqID_66267
tttttacaatgttataaaaatgtgtgggttcttaggtttcatttgtatttacctgttttttatttaaattatcacggaaaaaaacatttttagcccggaaaatcattattaaaacggaaccaaaagaagaaatg

SEQ ID NO: 99813 - DNA, 161 bp, Heterodera glycines
  Promoter: Source sequence=SeqID_43671; Location=1..161; Strand=+; Gene=SeqID_71291
aaaaaaaattttcgatgataggtatcccaaaatttcacatctgttcaatcttttgcacaatatcatgtcagattttattacatctttgttggttggaaaatgaattttcgaattttgtttgaatttgtagccagacaaatgagggcagaacactgacaatg

SEQ ID NO: 99814 - DNA, 1003 bp, Heterodera glycines
  Promoter: Source sequence=SeqID_957; Location=1683..2685; Strand=-; Gene=SeqID_64970
ctccgttgtaactttttgactgttttgcttgattttgctgttattttttgtatttctctttacatatttaatatgtaattaaatatttatctaccgttaataaggataatttactttgtgatttataaagaacatttgattaatgatcagtgatcaatgactacggtttaagttaagacactttgatttatatttgaatttattggcattttatttattacgccaatgatttattgacacttttctcttgttccgccatttgtgagtttgtgctctttgtaaagctcatcagaaatttagtttatgacatccaatttttcatcattttctacgcggattggatacgaatttgtggtcaaaggcattaatcgcgagtggtttcgacataaattgccaactgtattcatgcttttttcatttcgatggtcatcttttgcttaaggacgacattcccatcccacccaaagagatcccggaccaagactcggaactcaactatttgttggaggcagacgaaagccgttggcaggaccaaagaccgcccaatttctgtttcgaacaccgacacgcggtgaaaaaaaaatagaagaattaccacaaacaaagacaaaacgacggattgcttaacaatggaattggtttattcagtgaccgatggatttacggcgacaatttattcttcagcgatgggatcttttcctgacgacaattgcaacggaagagtcaaatcaaacggaaagttagtgacccaaaagggaaccaaatttggcaaattgggtttgaaaatgataatttattatggtttggagtaaaacaaaaaagactgccaatttcaaaaattaaacgcataaattgactgaaaatgagtcactttttggctgtcccttttggacgttggcatttctttcattttgcctttattttcccttttactcctttagcgtcccccgtcccttttccaattgactccgccactttggaccgcttaaaagaagaaaaaatg

SEQ ID NO: 99815 - DNA, 110 bp, Heterodera glycines
  misc_feature (26)..(26): n is a, c, g, or t
  Promoter: Source sequence=SeqID_34933; Location=1..110; Strand=+; Gene=SeqID_64619
caaacgaacgaagcgacagatcgtgnaaaaatttccaacggatgggcggcggcgccaattggaggcctatccaggacgtcaaaatcacttggatttcactacgccaaatg

SEQ ID NO: 99816 - DNA, 76 bp, Heterodera glycines
  Promoter: Source sequence=SeqID_21143; Location=1..76; Strand=+; Gene= SeqID_51725
taattaataatacaggtctcaactgctgtcaagtgttctacaatgttgacacgaatgtgtcgctggaatcgtcatg

SEQ ID NO: 99817 - DNA, 104 bp, Heterodera glycines
  Promoter: Source sequence=SeqID_9634; Location=909..1012; Strand=+; Gene=SeqID_72147
ggtgattgtggcttttcagcagggcacgcacatccatcggctattatcaattaaatttttaaaataaatatttaaaattttttaaagcaatttaaccaccaatg

SEQ ID NO: 99818 - DNA, 143 bp, Heterodera glycines
  Promoter: Source sequence=SeqID_7117; Location=1238..1380; Strand=+; Gene=SeqID_63888
agtgcgcggatgtctgttccacctcgtccaaaattttcacaaaaaaatttcagaatttgggcttaaacaggttgaattcatgatcatggttgacagaataatttttttagcgttatcaaagtgacccaacattcgccgaaatg

SEQ ID NO: 99819 - DNA, 136 bp, Heterodera glycines
  Promoter: Source sequence=SeqID_27301; Location=817..952; Strand=-; Gene=SeqID_57980
aattcaggcatacggattccgcgtcaaattggcgaaatgcaaatttttccgtgatcaaatcaaatatctcggacagattatcgataaaaacggacgccgaccggatccagcaaaaatttatgcaattagtcaaatg

SEQ ID NO: 99820 - DNA, 775 bp, Heterodera glycines
  Promoter: Source sequence=SeqID_42951; Location=1..775; Strand=+; Gene=SeqID_70739
cttgtttgtttaaattcatttttcatttttatgaattcttgtacaatttcaatcttttctttatctgattttgacttgtagcttttttgtattttttgattaagcccaaattctttgatccatttttgaatataatttcgatttgtccccaattttttcgctattttcgtattaattttattccattcttttgttgaatattttcttcctttttgctttattttttctttaattttataatattttccaattatttctcgttttttgagttcatttcgtttttcttcttctttttcttgccatttttccccaaatatttcatcaaatgatttctgctgaagttttttcttttctgattcaattggaataattagggcaatcaaaaataaaaataataaaatacagaatttcattttcaagattttattttatttttcttcaattaaatggcaattcattttttgaggcatttaaatgattttttttctgattaaaatctgacgtaattcataattctactgatttaacgaataaaataaggaaatcctgtttaatttcaaagaaataataataataattttatcttaatgacaaaataattgccaattggtaaattaatgattaaataaaattttattactttctactggagctcattcgaaaataataaacatattttcaataaaaataaaataaattcacaatgtaaagagattttagaaaaattaaagagattttatgaaatttcattatttcagaaaattggtgtaaaatg

SEQ ID NO: 99821 - DNA, 399 bp, Heterodera glycines
  Promoter: Source sequence=SeqID_22253; Location=121..519; Strand=+; Gene=SeqID_52924
ggtgcgcatatggcgacgggacaaaatatcgccgcagaaattaaaaaaaaattattctgaaaaagtttcagttttttttaaattttcttataagaaatttatagctttttgtttctaagtttaaaaatttttcttttaaatttctacggcgatattgtctcggcgatattttggggtgcacccgcgcatattccccgcgctttaattacctatttcaattggtgctaatcgtttcgttaaaatccggcattttagcgaatttttcgacaaaacttggcataactttacttaagggcaatcaaattttacattcttggcaccattcgatagccagctgtttcactattatcctataaaagaaaaaaaaattttggtcaattttagaaaaagttatatatg

SEQ ID NO: 99822 - DNA, 293 bp, Heterodera glycines
  Promoter: Source sequence=SeqID_174; Location=1012..1304; Strand=+; Gene=SeqID_76278
ttgctgttgttgtcgctgttgtcgggctggctttgtgggtgcttgatgtgtgatcgttgagagcgttgcttgaagtgttgctgctgctgagtgaggagaatgtgcaaaatccacctccttatatacaaaattcgggtgcaaaaattcatgcagcaaaaaaaagtgtataaaaggcgacggttttcttcacttttcaccagtgccagccagccttcaactcaacgcaacatcaacaccagtgcgcgccaagctcgtctacacatttcgtcgcgacaactcatcacttcatcatg

SEQ ID NO: 99823 - DNA, 221 bp, Heterodera glycines
  Promoter: Source sequence=SeqID_11596; Location=2997..3217; Strand=-; Gene=SeqID_75047
attcactatttttcacgtgaaaatcactaattgaaaatataattattacatcagaatcatttatgtttacataaattatttaagctttattttttataaaaattcatttttttctcattttttgcatttagatgaaatattatacataagaatttttgtaacaaaaattaaaaatgtaaaatctttcatttaatattttagaataaaatttttccgaaatg

SEQ ID NO: 99824 - DNA, 122 bp, Heterodera glycines
  Promoter: Source sequence=SeqID_4917; Location=1613..1734; Strand=-; Gene=SeqID_56184
ggttggttttgtcaactttgatcagtatatacatgaaaacatttccttagaaaaagttgtacgtttttggcggagtgattaatcagaaaaaaacgaccaacgaattttgggagttcgacatg

SEQ ID NO: 99825 - DNA, 77 bp, Heterodera glycines
  misc_feature (11)..(11): n is a, c, g, or t
  Promoter: Source sequence=SeqID_25583; Location=1..77; Strand=+; Gene= SeqID_56322
gtcccgtttgntgtcaataacttgggttaacacagcccgttgctgtagcccgtcacaaatgcaacaaacaaacaatg

SEQ ID NO: 99826 - DNA, 498 bp, Heterodera glycines
  Promoter: Source sequence=SeqID_1403; Location=783..1280; Strand=-; Gene=SeqID_73295
aatttaaaatggtttaaacattttaaatattatttttaaataatatatcatttcaaaatttttttttttattcttgaattttcaaactttgtctaaaattagcagcaaaactttctcaattatgccattcattcatttttatgtccttcaaagttttggccgtgtgcctccttttcattgccaaattccacggcaaaaagtcagttgcgatcgcccgcggccacaaatgattgatcatgggacaaaaagcataagccaacgaacaaaaatagggccaaaaactttgagtgggaagcgtgtggcaatccgtcagttgtgttcgtcaatttgtcagtgctttgaacacaaaaaattcatttgccagcgaatgattctttggtcaaatttcacttgtgaaatatttatactcactgataattgccaaaagcttcaaaagaaaagcattttaaacacttaaattaaataaatattttttttagaaaaactaaagaaataatg

SEQ ID NO: 99827 - DNA, 1003 bp, Heterodera glycines
  Promoter: Source sequence=SeqID_31309; Location=97..1099; Strand=+; Gene=SeqID_61677
aagaatgtataagacttacgtcagacctcaattagagtatgctgttgaaatttggaaccctaacttaaaaaaaagatatagaacgaatagaaaaagtccagaaatttttcacgagaaaagcctttaaaaagtgcggacttttacatagatcatattcagaaagacttgaaatctgtcagcttatagaattagccaaacgaagaaatattgctgacttaactatcgcttttaaaattatgaagggttttacgagtcttgatgctagtaaactttttactttttctgatcgatcctctcgtaggccattacttttgagaatgcggcgcacaaccgcaaaaagcaagaataatttttttaacctataggtaagaattggaataatttaccaattgttccaattcagacagttgtgactctcgcctctcgccaaaactctcgctctcgtcttttctgagacaagtcacatccctgttacagggcactgaaaaaatgcacacatttaatgaaaattaataaataattttttgacaactattctcctgctgattgcatcaaaatttctgacttatgtacataaataagtaagtgttttggtgaatgtcatttccaaatatatttctcatcaatttcactcaaattcgaaataaattatttaaaaatataaaaaaaaacaattttattattttataactctgctcaccttatgatgaaattaaactcggcgtttgaccttccaaataatgatgcgttgtgtttattggaattttttatttacccaattggcagcggcagaagggaagtgtttacctcgttatttttgtttttatttgccacatttgtcttcattcgcttttttctctttaattttctaacaattgaattgctttttttccataatgaatttaaatttgattaattacactaattactgccattagttaatctatgccttttattattggcaatttcagtcacaaagcaattatttgattttccaaaaatg

SEQ ID NO: 99828 - DNA, 687 bp, Heterodera glycines
  misc_feature (147)..(147): n is a, c, g, or t
  misc_feature (156)..(156): n is a, c, g, or t
  Promoter: Source sequence=SeqID_6585; Location=1677..2363; Strand=-; Gene=SeqID_62078
agttttttgaaagttatggcatttttgcatttctgaaaatgaaagaaattactgaaattttacactaatagagtaatccaagaattatcataatgataccaaaattattgattctagttccgtgcattttctatgtccatcgtattntagccgtcncaataactaagaagaaacatgttttattgcccggtactcagtttttactaaaaatttcggattgttaaacctaagatgttatcacaactcgtacacaagcaacttatacaatggcttacttagactaggctaagctttagacttaggcctaagcataggcttaatttttaaattttttttaattgtacgagtagccatttcaaaaaacaaactgtttttgggacgcgtaaaatgttatgggacgcgtaaaatgtcttaggaagcgtaaaaccgactagaaccaaattattgaatttggctgagttatggcgagaatttctcaaaaatctgtaatattggcactttttacgaatcgatcccgcctagcatatgggaatttatttatttttaaaaatgttttggctcttaatgaaaaattttcgcagtatttttttcaaatttaaaatccatttttattagtttcgtggtctcaatgaagaggaatcggctgcgctccaactttgtatgtatgggctgaaacatcaggcgatg

SEQ ID NO: 99829 - DNA, 501 bp, Heterodera glycines
  Promoter: Source sequence=SeqID_27402; Location=1..501; Strand=+; Gene=SeqID_58098
cttaaaaaaattgcaagaataattaagtccaaaaaagatatctcgtgctttatcattgcaatattcataatcttgacacatattaactttaaatgtataattattaattataaaataggaaatatttaacagtagaaactgcattaaaaataaaggtgtataaatttatggttatgttattcggcaatacccatatggaataatctcccgaatccgttccttttgattctttttttaaacggggcttatattcatatggtaattcggggagatagaatcatactgtctcgcgacggtagctaatgtttccacataggagagatataccatcaaagtaaagcgataatgtatgataataagatattatcgttatcctctatggttgataagcataagaaaattttcgcctaaatattggatctttgcataaaattaaaaggttttaaaactatattaaaaaaaacaatattccaactttgttttttcaaaatttaaaaaatg

SEQ ID NO: 99830 - DNA, 97 bp, Heterodera glycines
  Promoter: Source sequence=SeqID_29550; Location=837..933; Strand=-; Gene=SeqID_60035
tcgcatcaaattaatggcagtgccatttgcatgtttaagtgccattgttctgttttgacctgggtcgcgcggacgtctgagcacattgaccacaatg

SEQ ID NO: 99831 - DNA, 179 bp, Heterodera glycines
  Promoter: Source sequence=SeqID_13360; Location=2719..2897; Strand=+; Gene=SeqID_77234
atgtcacccatcccatcgtgctcaattggactcattctccgcccaatccgtcccaactcggctcttccgtttccgcttcgtccccccttccgtcgtccgttgcgcccgctttgaatttgtcttccctttctccggcatcgacgccctcccgcccattctctcccgccaccccccaaatg

SEQ ID NO: 99832 - DNA, 544 bp, Heterodera glycines
  Promoter: Source sequence=SeqID_30994; Location=470..1013; Strand=-; Gene=SeqID_61349
aaaatttaaattttgggaattgaaaataaaataataattaaaaaaaacaattggaggtcagaggaagaaaacaaccgccgattatgaacaattaaaataattactgctgattgactgactgactgatcattaagtgatcgccaactcgtaattaaattaacaacaaattttcctaattatgtttttatcattcaaatcaattaatatcaattaaataataattataataatattagtaatggtcataagatgctgacgaaattaaaactcaattaacaaaataataataattgtaaaaaatatattctatttaaggcgttcataattctcaaaggattaacgcctttcatttctaaattttattttttaaatttaaccttttcagacattaaattgaacctgtttttaattttaccgtaatttacagtaatcacaattacctatttaatttgtttcattatttaccgtattctacaataataataattacctgtttaatttattttctcatttaccgtatttacagtactactccaatcaaatg

SEQ ID NO: 99833 - DNA, 670 bp, Heterodera glycines
  Promoter: Source sequence=SeqID_14144; Location=1..670; Strand=+; Gene=SeqID_78146
aaagctttataatttgattcttaaaagtcccagcctttcacttaacttttcttcttgtgaaatattttctcttcaagataactattgccgacaaaaaagaagtcagacgtttaattgaaaaaacctttaaaaaggttaagtgcggcctgcgctctgtgtggaataaaacagaaagtgtaagcgacaaaatgattattcttaattaaaatttttagctggtgcgcaaattggtccgagtgggatcaatgaacgcagaacaagtgtatcggtcggtgatttttgttaaaaatttttcaaatttttttttcaaattttgtaatattttaaaaaataatttttttttattattattattaaattttctcaattaaataagctaaacattttaataatagcaatttcaaccttttcgaaaatagaatttaaaacatccagaaatttaagcgagattgggaatttgcgtcttccccggccgtaaacgaacaagaataatctgcccaggtgaaaattaaaatatgaataacaagaactgtataggcaagtttatgggtgcatgaaatacagataatttggttgctaaaattctgtcattatttgaaatattttaccagttttagaatgtaagctcgcgacaaattccacaataactttttttaatttttcggacatg

SEQ ID NO: 99834 - DNA, 169 bp, Heterodera glycines
  Promoter: Source sequence=SeqID_11500; Location=1737..1905; Strand=-; Gene=SeqID_74927
ttttcattcaaagtttttattcgcctcaataatttaaaccggtaatattttattttattttcattcaatcaaatgatttacaaaataattgctctaattcgtatcaaaaaaatttgaatcactaattgagtctgaatctaaatttagtcagataaaacaagcgaaaatg

SEQ ID NO: 99835 - DNA, 649 bp, Heterodera glycines
  misc_feature (77)..(77): n is a, c, g, or t
  Promoter: Source sequence=SeqID_199; Location=1..649; Strand=+; Gene =SeqID_77176
agatttcaaaattatgcgtgcgtttttttacccccgaattttcaagtttttttatatttttctttttaaactgattntaataaacaatttaagctttttcctcctaaacaaattcattaaatatgtagttacgcaaatgctcaaacaaattcaaatataaaattggattttttgaactttttctttgcttattgtcaccaaaatgaaattcatacattagtgtcacacttctttgtgaatgtgatgacattttgtctgtttttttcggacaagaaaattaattttgtcacgcaaacaactaaaaagtcatttacgtcgtgtgtgacattctgcggcaatttgttgacacttttattttgcaatttccgggcaaaaaataaaagaaaaaataaattaaattaaattgggtgggtgagagggacaaaaaatcttttaaataaaaaaaattaatttgttttaaataaaaatgtcagtagagacattttgtcgaaagaccaattcaccactcataattatctgtcactaattagggcgtacactttatgtttgtgtattagtactgatattcatgagttggcacaagcaaaacaaacaattgcctggggcgacttaatcttcctctttcggacatgtatttttgtattttatg

SEQ ID NO: 99836 - DNA, 1000 bp, Heterodera glycines
  misc_feature (55)..(55): n is a, c, g, or t
  misc_feature (67)..(67): n is a, c, g, or t
  misc_feature (111)..(111): n is a, c, g, or t
  Promoter: Source sequence=SeqID_42805; Location=310..1309; Strand=-; Gene=SeqID_70608
tcaaaacattaattatcgctaaatatattttaaaatattttatatcatattaaanttgtgtgttatnttctcataatttcctgcttttttttggccacaatcaaactttgnttcgaattcgggccggggtttggaattggccgaaatggacactgggttcgtgatcagtgaccacaaaaaccaagggaacttgtttttatgacattaaaatttacacttacgcattttcctagagccaccaaaagatttatgatgtttaaattcaaaaattcatctccttaaaataacttttcttttacaaaatttttaatttactgttagtttattttaaagaattcttaaaaatggtgaattgactcaaaagtttgccacaattaatcattggaaaaattattttatgcgcgcgtttttagttaattctttgttttttcgtataccaaaatgatgtgtctctcatgaattttgacttcttcttcttttgctaaaagggattttaaaaggatttttaaaatacttatcagtaagtttttggaccaatttaaacatttaaaaaaaaattctttaaaataaacttttttaaaaattatttaaaataaaccaaactgtaatttattttatccctataagggtgccaaatatcccacattatcccaaaaaggaagaaaaacaaaaacaaaatttttatatgaatttaacgcatgaattttgttaaataatcggacaaaagttggtggtaaaaacggaatttcgtggtcattttcttcttctacggatctaccactaacttcgtagtcatttgaccaggtttttttctacgccttttagaattaggcgacgagtacaaatttttaatttctacaaagaaatttttatggatttatttttaagaatttttagatcaattcttgggggatgtattttcatttttattgcatttttgttaaggaattttaaataaaaatttaaatcaaaaatacatgtcagatgaaatttacatatg

SEQ ID NO: 99837 - DNA, 361 bp, Heterodera glycines
  Promoter: Source sequence=SeqID_11725; Location=1..361; Strand=+; Gene=SeqID_75212
ctttgaaaaggtaacaaattttttgaactttgaatctttcctataatttaataaaaaagatgaataaatttagaaataactctttttagtttttaaattttcggaagggggggggggggttagttgttgaaaaattaatgaaacttgttaaggaattagtgtaaaattttgaaaatttcctaatttctcacaattttatggggatgaggcgcaggtggggttccatttatagtgatgctctctgcgcgggatcggtgtctcaacataatcaatactgatctgataaactgataaaaaatgattgcagaacgaatgtaaaaagcggcatttggcggtgtctggctcaaagcagcagctgatg

SEQ ID NO: 99838 - DNA, 226 bp, Heterodera glycines
  Promoter: Source sequence=SeqID_10028; Location=2495..2720; Strand=-; Gene=SeqID_73080
attttacgcgtcccaggacattttacgcgtcccataacattttacgcgtcacatgacattttacgcgtcgcataacatagtacgcgtcccatgacattttacgcgtcacataacattttacgcgtcccataacatattacgcgtcccataacattttacgcgtcccatgacattttacgcgtcccataacattttacgcgtcccatgacattttacgcgtcccatg

SEQ ID NO: 99839 - DNA, 763 bp, Heterodera glycines
  Promoter: Source sequence=SeqID_2508; Location=114..876; Strand=-; Gene=SeqID_80124
cctgaaaatcctcgtggtatttgtaatgtatcataaacaacctcaagacctaaaacatggattaattggtgccaggataaacggtagttcattaattagaattaccgccctggttaacagcaagaaaaaagtatatagcagtagaaaaaatgaaagaaagtgcatgacgcatccttttatatgccaccctgccggaatctaggtcaagtgttactatttttagaattacaagccatttttaaatttcccgccaattttttgaatttgaatttcccgccaatttttgaatttgaatataacgcgaagacttttcgtttcaataaacttttggcttcaagtatatattgtggcgttttgccctgttttgcgtattttattgcgaatgttcaccggactacagtatccctcgcagtggtgacgtcatcatctttccagcatatagtggataatttccttttgcatgcaagtgtttgcgtggcagagtggtagtgtgttggattggtggcagaccaaaagttcgagcccgctagtctgcggcagaatttttcgaataaaaaattttaaaaaataaataattttcagagaaaaattttacaaaaaaagtcgcgcacccctgcaataggttttggtttcagaaaaaaagtcgcgcacccctgcaataggtttgggttttcaaaaaaagtcgcgcaataggtttgggtttcagaaaaaaagtcgcgcaataggttttggttttagtactgaaaattttggcgctcagatg

SEQ ID NO: 99840 - DNA, 401 bp, Heterodera glycines
  Promoter: Source sequence=SeqID_3665; Location=1..401; Strand=+; Gene= SeqID_51342
tcccccccctttaccttattttttgaaaattttgaccttaaaaaggtaaaaattagtcctttaaaggatccttgttttttttttgctctccggcgctgaaattttttaaatttgaaatttttttttggcccgatggcaaaaaaattttttcgggttccgccctccgacttggtcagtgctgttcaatgcctttggcaaatgtcaacaatcctttccaactaactaattgcaccgaccaactcaaaatgctctgtgaattcttcttgaccaaattattaatcacggcttttaaaattcacaattattttgtcaatgcttttccttctagtaaattccctccttaaaaattgtaattttaaatggcttaaaagccacaaatccggggacacaattaattaatg

SEQ ID NO: 99841 - DNA, 216 bp, Heterodera glycines
  Promoter: Source sequence=SeqID_28761; Location=414..629; Strand=+; Gene=SeqID_59334
acatggcaaaggccaatgtgacaaaaggccaaaatggaattggtcaacgggcaatgggacaaaaggccaaaatgcaatggatcaacggccaatgggacaaaatacaatggaaacggccaatgggacaaaaggccaaaatgaaatggatcaacggccaataggacaaaaggccaaaatgcaatggatcaacggccaatgggacaaaaggccaaaatg

SEQ ID NO: 99842 - DNA, 190 bp, Heterodera glycines
  Promoter: Source sequence=SeqID_10443; Location=1..190; Strand=+; Gene=SeqID_73640
tttgcttttcggtgcccgcatattaatcagaacaaatcccttaaacttgcgtccaattgtctgtttttgtgaccgcattttctattccgttcagtttattactaataaatgcccagaattatttttctgaaaaatatttcttagccaaaaaaaaaaatttttaatttaaattgggatcccggcaaagatg

SEQ ID NO: 99843 - DNA, 74 bp, Heterodera glycines
  Promoter: Source sequence=SeqID_23336; Location=623..696; Strand=-; Gene=SeqID_54046
tcgccgaattcttgcgagaacggaggcgcgaattggacgaattggagaggcaaaagcagcagttggaaaaaatg

SEQ ID NO: 99844 - DNA, 836 bp, Heterodera glycines
  misc_feature (24)..(24): n is a, c, g, or t
  misc_feature (51)..(51): n is a, c, g, or t
  misc_feature (55)..(55): n is a, c, g, or t
  misc_feature (80)..(80): n is a, c, g, or t
  Promoter: Source sequence=SeqID_40946; Location=150..985; Strand=-; Gene=SeqID_69170
agtcccccccgaacccgatgcgcncagatttatggggagaccgatcgcttncggnaatagcttccctatagcctgtactntaattctgcgttggatttttgctccccataattgtttgagtaccccaaacgggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatg

SEQ ID NO: 99845 - DNA, 453 bp, Heterodera glycines
  Promoter: Source sequence=SeqID_17201; Location=1..453; Strand=+; Gene=SeqID_81664
tttaatgtttcagggattttataaatatttgctatatgacttggcttatatatttcgattgtgaggattttttactggaatttttggaaatgtccaaaaaaaattcaaaatttcgcaattttttgtacattattttttatattatatatttgagattttttgaaaattattcaataaattttttagttttcaaatgcgtcccaaatatcgattcctttttaaaaaatggctatcaaaaatcaatatttaaaaagcaccaaaaacgttattttagaaaatttagggttttttatggcattttttttgcttctttacgcttttctaataattttgactaaatatcaccattttttgaaaatatgttgatattttttgtaaaattattgcattttctgattttttaatttgtataaaatcgatttttctaaaaattttaaacaaaagcaaattatg

SEQ ID NO: 99846 - DNA, 538 bp, Heterodera glycines
  Promoter: Source sequence=SeqID_34382; Location=707..1244; Strand=-; Gene=SeqID_64193
gtttttgtccatgtttcgtccatattttgcgattttttcgtatatattataatccatattttggatttttttttgtccatgtaaatccaggccctactataatatcaatctattcctcaataatttacagaccccgagaattttggttttttcaagcagtttttggtttgaggctttgagtaaaattataaaaaataaaaatttaaatgccatttgattgccgaagtaattcattatacgaattattttgtaaaataatgaaaaaataattggaaatttgcatttttaagctcacaaaaattaccaacaaaatcaataaaagtaattaaaaagtgctaagttcctctttaaactaataaaatttttcgttcatttttagaaaaaaaaattaataataatgataaacgcataaattattaaggaatatgaactaattttttatttaaaattttggttaattgatttggtttatttttaaaattgattttcgtttaattttctattaaaaatttgcagaattatttccttttaagaaatg

SEQ ID NO: 99847 - DNA, 458 bp, Heterodera glycines
  Promoter: Source sequence=SeqID_29969; Location=388..845; Strand=-; Gene=SeqID_60436
ccttaaagacatattttttgaagattttgggtgaaaaaatttttacactcaaaaatcctgtccaccccctttggtcccgaattccaaaatcacttttatttttataacttttttcaaaaaagtgataaaaatgccaaataaaatttatataatagagcaaaaaattgcggattttatcaatatttttttataccttagcactttgtttggagtgagttattaatttttatgtgaaaaattgaaatcttcaagtttttcaggaataacttttattgtttgcaagatagaaatcccaaataaatctcataaaattctccctatttttctctattttttaaactttaaatggactgaattggacctttttgatgggagttatgaattttcaaaatgtagcttaaattttcaagggccaaaaaattctaaaatttcaaaaaattttaaaaaattccaaaatg

SEQ ID NO: 99848 - DNA, 857 bp, Heterodera glycines
  Promoter: Source sequence=SeqID_14857; Location=345..1201; Strand=+; Gene=SeqID_79010
ggtgccatggaaaaggcggcggcactttttataaatttaaaaaatttggcaaaaaaaaaaatttaatttggaaaatttggccaaaaaatttaatatttagtgtgcaatcaaaaattgccaatgaggaagagtgcctaattagtataaattaattaatatgaaaaaattaagcaaaagtagaaaagggagaaaaatggccgtacgaaatgccaaaattggaaaaaataaattaaatgccaaacaatgcgaaaaaaataaatttaaatgccaaaattggataaaaaatatatttaaatgccaaacaatggggaaaaataaattttaaatgcacaatttgattcactggacaaatggtgccattgcatccaacggagggggagaaaggccattattattcataggactaaagccttcttgacaagcccagaaaatcccccggggtgaggagcaaataaatattaaatgcaaaaacaaaatacgaaaaaaaaatattttaaaatgcatttttatgaaattaaaatttatttgatgtaaatttttgattattattgtttataaaatatatttaaagcataaaatttaaaaaaaaatgtaaatttaatgaaataaaattgaaaaaataaaaactatattaaatattaataaaataaatttttcaatatttttcgaaaatatttttcaacaaaaatttttttaataataaatttaattaaattccttcaacaaatagaatatttatttttgggacctcggatttgtagggatccagttttttttttacacatttatatcgatctaaaaatcaaaaatatattttttaataatttatttattttaagataaagaaaaaaaaaatg

SEQ ID NO: 99849 - DNA, 718 bp, Heterodera glycines
  Promoter: Source sequence=SeqID_13675; Location=2070..2787; Strand=+; Gene=SeqID_77591
tttttaaattgctaaagaaataagaatttaaacaaatgtatatattttctttaaataaaaatagaaaaaaattcattttataaaaaataatcttacaagaaatcgtctcgaaaaataatccaatagtcaaattacggatcaaaattgcggataaatcccaaaaatccgcaacccgcaatccgcaattacgggggtccaaaaaccccgcaatttccgtaatccgcaatccgcaatccgcaattgcgtgcagccctgatactgtagcaccttaggctcaagtgatggcgatgttttttaaaattttaaatgtggagggattattttaattccctttttctcaattttagatttaaaatatttttgtctcaacttttttcttcaatatagtagtatcatatagaacatttacaaaatttttatccatcattttgatctaactattttcacacttttacgaatttacatagatattttatgtgggcaaatttttttcggtattacttagggtgtaacataagtttccgcacaactttttttaaagaatttttttatgaatataaatttaaaaaaccacaatcatgatccgaaatatctgacattattattgagaatgagtttgctatttatcgggcaagggataaatcccattagaaaagtatttaaggagttagagttgataatgtaaaaatggtcattttcgaggtatgtatttttgatg

SEQ ID NO: 99850 - DNA, 952 bp, Heterodera glycines
  misc_feature (86)..(86): n is a, c, g, or t
  Promoter: Source sequence=SeqID_42228; Location=264..1215; Strand=-; Gene=SeqID_70175
agtcatttatccaggtcggcttcatcatatcacattatcatttttcatttggccctccatcccccgggcaaaaacaattttaaggncggcacaaacaattgttatcccccaccgccgcccgctttgttgcccccctccgccgacggggcgttttgtcgtccgccgtcgtcggttgaatggaggaatttttgaagaaaaaattcatcatcgtcatcaccttccttcagcattttggatatatagtataaaaaataaaagccagaaaatcaatcaaaaggattaattacctatggaataatatgtaataaaaaaaaactggtgctaattaattgatgcattaaaaagcggcattctttaaaaaaaagaaatgaattaattcgtggaaaagagaaaaaaatgttaaaaaaagataattatttgacattcaccacattcattaattaggactgattaataaatttccaaaaaaaaacaacaattcctgtgaaattggaaaattttattagcaaaatcttaaataaaatgggaatgaggcaagaaaaacaaataaaaatagaacaaatataaattaattatatgtgccaataaaaaataaaaatttattgtcaaaattctacgaaaaaattaacaaaattaaaagatacatctgtgatatttataaagattttaaaataacaaactcataacaaaaatttatttgattctcttcaaaattgataaaattaaagcattttcattaaaacttttaaaatattttattttaaatctacaaaatattttaatattcatttacagaaattgtccaaatttgataaattaaaattaattacattttcacaaaaattattatgcaattttaaattaaaaaatatatttaatattattttataaaaatggaccaaatttaaactatagaataatttttattaaattttaaaacttttgcagaatg

SEQ ID NO: 99851 - DNA, 65 bp, Heterodera glycines
  Promoter: Source sequence=SeqID_1503; Location=9128..9192; Strand=-; Gene=SeqID_74022
ttttatttattttttatggaatgctcattttatttatatcttttcattttcatagatttgaaatg

SEQ ID NO: 99852 - DNA, 721 bp, Heterodera glycines
  Promoter: Source sequence=SeqID_26756; Location=462..1182; Strand=-; Gene=SeqID_57521
ttaaatataaataatattaataaataaactaaataattcaattattaattaattttgattattattgttacaatatgtacaagattttgtgcgtacaaattattaatgtgtatgtttatttgttctctctccattcttgaagagtcgtcgattcttatcgttttgtcgtccattcaaatcgtcgccaattttatgagtttgattgaacttctgttattcacaccagcacacaaatccatttggaaaataatttaaaaacaattttttaacatttaatttaatttaaaataattttttttttaatttcaaaattatttacttttaatttttaaattttaatagaaatttgaatttttaactttgaatgaatgaactttcccttttcatatcataaaaaattcttttaaatttttttatttttgctctttatttaattattaattaattttaattccgtttttaatgtttgttctttttaagcattttcgtaaatatgtctattgaatcattttcatctgattttcaacaacagaagaaggtggtggacgaaaatgtgccaaaattggaacgaccattaaaggcattgttaatttttaaaactaattaaataaaattatattataattatagtttcagcatttgtttatttttgattaatccaaatgaattaaaattttaaaaaatattaataatcaaaaattttagcatattctatcgcatg

SEQ ID NO: 99853 - DNA, 469 bp, Heterodera glycines
  Promoter: Source sequence=SeqID_8292; Location=1475..1943; Strand=-; Gene=SeqID_67597
ataatttgagagatgtccgaccgttttatttgatgataattttgtttgctgttctgatgaccattttggcgatgaatattaaaaataggaatttgagttgggcggataaaaaaaaaaaataataataataaatggcatttcattgtttcgggaaaactgagaatgttttgcgggattgacattggcaccaaaaaactctcacaaaaaagaaaattaaataaatgtaagaatcaacaaaaagcatttcttagaaaaaagagagcatcaaatccattttcaattggtgcgataagttcatttccaattgggattatttttcaaacccctcctagactgggggataattggatattgggggattaatggagatttggggataattagagcaaatacggtagtgagatttggccatgcctcaaatataattagtagggagtccaaaaatatggatataaaattgcgaaatatg

SEQ ID NO: 99854 - DNA, 486 bp, Heterodera glycines
  Promoter: Source sequence=SeqID_108; Location=3313..3798; Strand=-; Gene=SeqID_70624
acttggcttaaataagtccagacttatctatgtcaaggacgtccttggaaatggacccacttttctgaaaataaaacttctggccaaaaattacggcttttattcttttacatcctgggaatgcattcaagaatgacatgttttgttacacttgccccaaggacttttttaggcgtggtcgacctctaagggcagtccttgaaatcggacaatttatcgctaattataccgcttttgttagacatactttttctgacaaaaatagcgtcctaacacagcaaattcatcaaaatatagtatcaataaagcattttcgacaggacatataccattgggttacggtattattcaaaattttatttcaattagggcgagggaatggcggggggggggggggtgtcaatttcttatagtctactaattgcattgctctaattaggctaattacccacttataactaaagggttgcgagtgttgtgagcatg

SEQ ID NO: 99855 - DNA, 793 bp, Heterodera glycines
  Promoter: Source sequence=SeqID_12890; Location=354..1146; Strand=-; Gene=SeqID_76625
tccgtcgcgcttccgcccgcggtgcaatgtcgcaaattttttgccgaccttcgcccagtccgtgtttgttggttttgtggtgttagagaaaatgacatataaattttttttgcattttcatttgtttatgtgtcggccctttttttctctgtctgtgttttctcttctcatgcaacgagaagagactacggtattgtcagtttgccctccattttgaattctttcttgtcattcattcctcaaccacacttgcagaggctgtaagtatcttagctagagttggcaaaattgaggcttggattttgtaaatgtttttccagttttaagtggtccgattttgggcctaattgtaaacatgagagtatcatgcattcttccactaagtaaattggcgattatgaccacaattcacctttcccatgacctaattgcacacaaagtgcccattaatggggttggggttgagaaatatcagtttttcttccataaattagtcttctccacaaaatggtacaaaaaaagaaaatcctacccctcgaattgctttttgaattgaccaacgcactccgtttcgatgtccggtgggcgtctgtccgagtttcggaaatttttgaccactttatgctcaaaaaacaattcgcctggattcgggttgaattggcttcctgggaaacccttcgccagatggtttatataatccaagctttaaaccatcaaaattttgatttgatatgattgaatttagagggctgactttggcagagctaagggccagtttaaacgtgctgtcatg

SEQ ID NO: 99856 - DNA, 471 bp, Heterodera glycines
  Promoter: Source sequence=SeqID_31871; Location=1..471; Strand=+; Gene=SeqID_62179
gtaccggtaaaaaccggtaattttagaacataaaaatttttggacaaaattttccaaatacaaaatttttattcagttttcgcgtgagtacctgttttttagcattagaattgttcagaagtatatgtatattcaggttgaccaagttttttttttcaaattcaggacatacagtcatggtcataagtgttgtcccatcatgctttgaaaaaaataatgcgtataaaattgtcattttccaatttcaacagataagtagcataccattggatagcattttttatggactttccaatgataccatatttgcatttgtgacataaacatttatttgatttattttaccatattcacaatttgatcaaaatataggtggtcaaaagtgttgtcccatttcatttttaaaatattgcttctctggatcaacattaaaaaaatctaaaaaaattcaggtaagcataactttggatg

SEQ ID NO: 99857 - DNA, 589 bp, Heterodera glycines
  Promoter: Source sequence=SeqID_19425; Location=1..589; Strand=+; Gene=SeqID_84146
ttaatgggtacatttttggatttagtcaatttttgtaacaaagtgcacttaaatggtataattagtttgaaaacaatttctcttggaaaattgcgtggttggtagcggtctcggtcgtgaatagaggtaccggtacctgccttttgtggtcgcggtaagtaccgctcgcaatcttgtcacagttttcggtcctgtccaactcaaatggacagcgagtaaacatataaaaaatcatattaatagacgcatagatagtcagattctagatcagcgctcaagctacacgagaaaaaatgcttttactttgccgaaaattatgatatttttgcaggcgcataaataatataacaactgctttaactgagaaaatactatgaatggacagttcccctcccccccccccccccacgttctttcatgaccctcaatagtgacacacttagtataaacaaattaaacttattttaacttatctttcaatctttcaataattattattaggttgtcattggatgatttaacacgtctgttttcaaaagtgcacatttgtttcctggacgcgcatgcacttgccgaaattagagaaatg

SEQ ID NO: 99858 - DNA, 213 bp, Heterodera glycines
  Promoter: Source sequence=SeqID_42400; Location=1..213; Strand=+; Gene=SeqID_70298
aaaaaatttgtattttttaatgcgattggtaaacagaaatttgtaaaaaaaaatgaccaattgattaagttctggggtttttaggatgcttaacatgaaagaaaaaaggttggaatattttctaaaattaaaattttaattaaaataatggtaaagaaaatgtgagggaatattctatccaagtggggaattgaacccaggcgaaaaattatg

SEQ ID NO: 99859 - DNA, 61 bp, Heterodera glycines
  Promoter: Source sequence=SeqID_25029; Location=961..1021; Strand=-; Gene=SeqID_55761
ggtcatcaaatgccttttttattttgttatttttttttgtttagctgaccaatacttcatg

SEQ ID NO: 99860 - DNA, 83 bp, Heterodera glycines
  Promoter: Source sequence=SeqID_10682; Location=1366..1448; Strand=-; Gene=SeqID_73929
cgtaagaaaaatgggaatggaaaggaaatgggaaaaagtgccatttattccggagaaattggggggagggcatcaaacgaatg

SEQ ID NO: 99861 - DNA, 98 bp, Heterodera glycines
  Promoter: Source sequence=SeqID_27964; Location=878..975; Strand=-; Gene=SeqID_58624
attattgttatttcatattttgaatcaatcaatcaatttaaaatttaatatttttctttttttgttttattgcattttttagcaaatttcaaattatg

SEQ ID NO: 99862 - DNA, 87 bp, Heterodera glycines
  Promoter: Source sequence=SeqID_12048; Location=367..453; Strand=-; Gene=SeqID_75577
tgccaatttccaagtattgcttaattttgcgttaaatgttagatttttttccaattcctcagcctgaaaatttattttttgacaatg

SEQ ID NO: 99863 - DNA, 217 bp, Heterodera glycines
  misc_feature (42)..(42): n is a, c, g, or t
  Promoter: Source sequence=SeqID_9568; Location=1..217; Strand=+; Gene= SeqID_71921
aattttcaatttcatttcttaggggtgcattttcccgatttnattccatttttaatgtaattttccttaaaaacgccaaaaaaggcaccaaaacggcaaaatgccaaaaagccatttaaggcacaaaatcccgaaaaaggcaaaaaaaggcataatgtgtctcgagactccccttttatatgtatgaaatgtacccccctacctttcggttgccatg

SEQ ID NO: 99864 - DNA, 80 bp, Heterodera glycines
  misc_feature (20)..(20): n is a, c, g, or t
  misc_feature (44)..(44): n is a, c, g, or t
  misc_feature (70)..(70): n is a, c, g, or t
  Promoter: Source sequence=SeqID_43367; Location=1..80; Strand=+; Gene= SeqID_71051
gctttttcactattttatgnaaaaatccggggaccatttttatnttaatgccctacaaaatgccaatttnagtgaaaatg

SEQ ID NO: 99865 - DNA, 453 bp, Heterodera glycines
  Promoter: Source sequence=SeqID_3677; Location=433..885; Strand=+; Gene=SeqID_51422
tttttgtattgaagacaataaggaattcgtagaataagaaaatgaatgcgtgaattgtaggaagaatgtgaaaaatggtgaaaaacaactccttttatacacatttttgtatcaatttaccgactttccaatttctataattttcaaaaattctataaaagactgaatcattttgaaaaaagcaacattttatttgtttaaaaatctatcaaaaaaattttcgacttatttctttagtcaaaaaagtgttttatgaattttttttaattaacaggctttaaaaaattttctcagataaaaacctttttttttgtgtattaagtttaattaatcaataaagaaaaagccatttaaagattcaattaaaaatggataaaaaacgaaatttaacaaaaaaccaaaattctaaaaggtaaaaaaggcgatttgcttcaagtcgactccaaccgaatg

SEQ ID NO: 99866 - DNA, 306 bp, Heterodera glycines
  Promoter: Source sequence=SeqID_2891; Location=1954..2259; Strand=-; Gene=SeqID_82215
gtaatcagttttttctaattggtttcttttaaaagcttagaatagacaaatgtgctagaaaaaatatttctaaaaccataatttatttgactaaaaaaatggtttttataaaagcaaattcaaatgtataaaacaggggaaaaatatatttaataatgcagttatttttcaaagtaattaagacaatttcaaatattaatttatgctggtttctttttcaaattattaaaatatttttactgtaataattcaatataataaaatatatttaataatcttttgtaaaatgctttaagccccgcaatg

SEQ ID NO: 99867 - DNA, 347 bp, Heterodera glycines
  Promoter: Source sequence=SeqID_14322; Location=1335..1681; Strand=-; Gene=SeqID_78350
aaaatgagtcaatgagatcattttggagttcattttgttatttgtccgtcaattagttgttggatttgtaatttagcaaaaataaataattattaaaccgcttaattggaatacattttgcatagacttatttaattgaaaatacgattattaaatcattggcatttattgccggcattttctgcttgcaaattcatttgtcgcccaattttccaacttcgttcgccaacgcattgaaacataatttgttggctaagcccaacaaattaaattggaaaggtaaatggctaatttcgaagaatggcattgtgatagtcagcatttagtagagtaagcaaaaggaaatg

SEQ ID NO: 99868 - DNA, 234 bp, Heterodera glycines
  Promoter: Source sequence=SeqID_16583; Location=1699..1932; Strand=-; Gene=SeqID_80995
aaatgatcaatagagtcaattaggactactgatcaatgatcacttttgatcagcagtcattaagaattgaacattttgatcagactactcaattaaggactgatcacttccccttgcatgtcttaattgttggaattattcttttttgtttccctcattgtctctgttcactgctgctggactccctgcgggacagaatgcaaatcacttccgtccttttcctcacagattatg

SEQ ID NO: 99869 - DNA, 78 bp, Heterodera glycines
  Promoter: Source sequence=SeqID_1479; Location=6634..6711; Strand=+; Gene=SeqID_73800
attgcctttccaataaaatcagatttaacaccaagcgaaataaaccaattacaactcaaatattatctaaattatatg

SEQ ID NO: 99870 - DNA, 381 bp, Heterodera glycines
  Promoter: Source sequence=SeqID_4820; Location=892..1272; Strand=+; Gene=SeqID_55843
atgaaaagttattaagttttttcaaaaaattatacaaaaatttcaaaaaattttcgtgaggaaaacgataggggggacgaagtgcaccctttatttttatcccggcggcactttgccaaacatgtttcccaaaaaaaagtgtgttttgcctttttgcgtcaatcttggcattctaaattaaaataaaaaatcctcccgtgatcacaggaaaaagatgttaagtccaattggcataactattgtcatgaccgtgccacggcatgccttggtagtaaaattccgagggcgaggaggggggggggggggtaatttgtatatattttattgtttttgcctattttggcacctctaaatttgattttcagcgtgccatagccaatg

SEQ ID NO: 99871 - DNA, 764 bp, Heterodera glycines
  Promoter: Source sequence=SeqID_77; Location=1..764; Strand=+; Gene =SeqID_63057
cctgtcccccccccccacattccccagttttttgggaaaagcacaccgcgaaaaaaaactattttgggattttcacctcaaaaaaacaagcagatattctgatcataaattaatcttaacaatttttagattggattttttaaatttaaaaattttttaaattaaaaaaaaattttgaaaattacggattacgccaaattacggccttttttgacccccgtcatgacggattacggatggccgtaactgaaaaaatcgccgtaatgacggattacggatggccgtaactgaaaatcagttacgtccagccctggtccaaatccaaccgggactctactgaccacaataaaatcgccacaaaagcctttataaaaaatattttttatttattatgactagggaccggatttgtatggatttccatatttttttaacactcatttcggcctaaaaaccacgtaaatagtatttttagcttaggcttctaggatgcctttttacttccacccccggtccccgacatttttgggcctattccccgccccgacccccgacatgtcgccccccgaggttcccgaccccgactttttgcccccccgagggctcggagcttaaccctaatttaaaaagaaaaatcaaaattcaataatatgccttaataaataatagggctaattgatttcattgtttatttggtaatatttaaaagaaagatagaaaagcaaatttaatattttcaatttcattcatttggacaaaaaatg

SEQ ID NO: 99872 - DNA, 295 bp, Heterodera glycines
  Promoter: Source sequence=SeqID_3467; Location=2772..3066; Strand=-; Gene=SeqID_84796
agttgggggtgaagccgaccgatgcatttcgggaaaaaactcgttgaattggggacaacccgatcgaatggaaattgatacgaaaacgaccggaatgaagccgatcgtacagaatgggacgaactttgaggatgaagctgatacctagaaagggttcaaaccgatcggatggatttttacaactgattcggtcgggttgaggaccaattggtccattggggattttataaaatatacgattggccatgatcggtcaattcaataacaaaatgcttttcagtccatcgttcgaatg

SEQ ID NO: 99873 - DNA, 274 bp, Heterodera glycines
  Promoter: Source sequence=SeqID_21455; Location=998..1271; Strand=-; Gene=SeqID_52062
agtaaacaaacaaagattatattcgtaaatttaattaaatacacggaaaaaataatttactaaaactttgaaagaaattttggaaaattcgctggagtcaatctaaaatatttagtttaccaaaaaagaatctatttgtaccagtgtatttttaatcccgcatttggtgagaaaattgacgggaatgtgtttaaaaagggcggcgtttacgaacgaaggctaaggtggggtcgatgtttgttaatttgcattttcgattgtttgggagtaaatg

SEQ ID NO: 99874 - DNA, 1003 bp, Heterodera glycines
  Promoter: Source sequence=SeqID_4635; Location=1808..2810; Strand=+; Gene=SeqID_45865
aggccgaaaattacaacacattcgtacgtataccaaacaaaaagtgtgaggaataaaaacaaatgactgctgctgctgttcactgtgttcagctgcaaaacatttggatgaaagggggggggggggactccaataattcattccgttccgctcaactcattgagtttaaaaatgtaatgaacgccgacgacagatacataaatcgcaactcgttctcgtctcacaaatcagcaaattatattttaaaaaacagagagaaagacagaaaaagatcaaatctcgcaacaaatggcgaaggaaaggtaaatgtcagcgctgtgcaaaatgattggcaaaagaaaacattccgagtcaaaagtgtactggggaaagaaggggagggaatgaacggatgacgtaaccaaaagcgaaatgggaaaaaaggggggggggagagagaggaaaagccaaatgaaacgacggacggaggaggaggcaaaggaatgcataaaggaggacaaaagcacaacaaaacaaaaggaatgaaaaatgacgagaaaacaaaacaaaaaaaaaattctgaaacttttggattttataaaataaaaaccaaaataaaaatttaattatttaatattttcacttgaaataaattaaaatttgaattttttttattttttgaatttttttgaatttttaaaaattcccggttggtcccggttcccggtcccgaacaaaaatcgaggtcccggtcccgacttctcaggtcccggcaagtcccggtcccgacttctcaggtcccggcaagtcccggtcccggttttgcccaaaattcccggtcccgctctactctacttaccaaagcttaagactggtggagcttttaaggaagttgaaatgcacaaaaaaaataaaaaatatttgagattgtgtaaatttttaaatttaaaaattattaaatttcgatattatttttgccaaatttaaaaaataaatttgttttggccttaatttcacgacaatg

SEQ ID NO: 99875 - DNA, 917 bp, Heterodera glycines
  Promoter: Source sequence=SeqID_9890; Location=1..917; Strand=+; Gene= SeqID_72918
tatgtcgagccccgaacccgaattcgagcaaaaagtcgaaaattattcaatttttatttttggtctaaaagtggcttacatatcgagaaacaaactaaaactggtcaattcattaaaaaaaaatagttcaactatttctagaccaaaaataaaaaattcgcaaatttgaattttcgactttttgctcgaattcggggttcgacataggtcgaaattaacgtcagattcggattctccgacccttaaaacccccaatataatcttctctcgaaaaagtttcaaaaatcttgttttcgaaaaaaggggggctaaccatcggtaatatatttacctaatttaatgaaaaatttgggggaaatgcatgtgaaaaatgaggcaaagaaccgtgatgaaatgaattttgtgaacaaaactaagtgtaaagtgacgaaggctgaaattcggacaaaagtctgacggacatcgaaaaaagagcgatgaatcatcggaagaaaaggcgaaaaattcaaacggaacaccaaaaaatatttggcgaaaagggagcgcaaagaacggggaaagaatggacgaaaggagaaaagcgatcggaaggatcaccggcggaaagatgggaaacgatcggagagtgatcggaacaccaaaccgcgccgaaacgaattgagtgatcggaggggaaggagtgaatggatggtggtgggttgttgtcgttgtcacacttaaaacatttttggagtttgattcgaatgaatgcgccacaccccaaaagatgggcgatcgattggactgtcgggggaaatgaggcaaaacgccaatgaaatgtcaaaatacgaatgaattcaagaggaatttacccacaaaataaaaataaagatctttgaatgagaaaaattacacagcagaacaaacaaacaaaaatg

SEQ ID NO: 99876 - DNA, 284 bp, Heterodera glycines; identical to SEQ ID NO: 98949
  Promoter: Source sequence=SeqID_36949; Location=279..562; Strand=+; Gene=SeqID_66143

SEQ ID NO: 99877 - DNA, 303 bp, Heterodera glycines
  misc_feature (30)..(30): n is a, c, g, or t
  Promoter: Source sequence=SeqID_10648; Location=1..303; Strand=+; Gene=SeqID_73888
tccatgacagatttggaagaattttttaanttgattgggactccgcccggccattttctacgataaagcgtggaaaaaataaaggacccccttaaaaaagttgaggaattaattccggaaatagaggcattaaatgatcactttgattcacaatttgttgatcattttaaagaattgggcataaaatcgaaaggaaaaaaattggaaaaggaaaaaggaaaacgaaaacttagtgaaattgacaaattggaagatgaaaatgagcaaaaaagaaaacaaattggaaaattaaagaaggaaatg

SEQ ID NO: 99878 - DNA, 98 bp, Heterodera glycines
  Promoter: Source sequence=SeqID_7341; Location=784..881; Strand=+; Gene=SeqID_64521
aaagaaataaagaaggcgtttatattaggaagaaacgcattatcgaacccaaattcttcctgaagtttataaacaagtcaaaaacaaaatcagagatg

SEQ ID NO: 99879 - DNA, 1003 bp, Heterodera glycines
  Promoter: Source sequence=SeqID_20285; Location=1114..2116; Strand=-; Gene=SeqID_85083
taataagagcttaataacaaataaaagagttacatttatatggcctattgttgtcaattttttttatctgagatttatttattcatagttgttattattttatagataaaaaaattcaaatttatccattacaatggtttaaaaaattttgcaatgagcactgtacacaaaaaaattaaattaattaataattaaaaaccaaattatgttctatcggaaagtctgcatttactaatttacataatgttataaacattttatgattgcgatgtatttagtaactaattaatagggttataaattgtatgattttatattttgggagttttcgagaataaatgcatattttgccatttttgggcttttagggcattttggtcatttttggcaaatttacataaaaaatacaattcaaaaaaaatacacccctaaggcttgacctttttgggaattaaaaaatataaatttgaaaatcgaaaaattttgaattttacaattctcaatattttgtgaaatattattcttcttattttagtttgatactaaatattggcagatacgtagataatttcatgcgaatttcagtgaatattttattttttgatttatttataattttttcatatatgtagatgtcaaggtatagaatcacatttttgtacatttaaaaaactaaattttggtgtgtctttttttaaaaaacccgttttttaggataccttttttaattttaacaagaaattcctaaatttatgaaaaatgctaaaaagtctaaaatatgtttatcaaatatgtaaaaatatgtaaataaaagtcttaacttttgttcatggaatttttatattttattacatatttcaggatttttagcacaaaaaacccttttctagtgttaaattaaattaataaatgtcaacattattgtcaaaaaatattgatttcctcttttaggattgaccctattgatttttttttctattgcctcaaaaacatacacacaatg

SEQ ID NO: 99880 - DNA, 595 bp, Heterodera glycines
  Promoter: Source sequence=SeqID_8292; Location=2713..3307; Strand=-; Gene=SeqID_67598
tctgttaatacaaatatttaattttaaatagatatacgcctaaattttgtataaaacggttgaaatcacccaagacaaaaagagaaaagataagcaaagaatttcatttcgaaataaattgagcaagttttgctagagagattcggcgctacttgcaaagagcactattttgaaaattttttcacttttttttggaaaaatttttttttgtttttttgacacataatgatgaatattaagtattaacagcataattatggcgaataaaaaatatattcacgattttttatctcaaaaaaattttgcaaaacaatagggtcccccctttggtttggtttttgataaaactcaaaatttgtcaatttttaactagcgctaaattttcttttaaaatgtttttttcagtttattaaatagtatgcaatacgttccatgttaaaaaaacaaattctgcataaaaaaaacaaaaaaaaatttttccaaaaaaaagtgaaaacattttcaaaatagtgctctttgcaagtagcgccaaaattttgtacttttgagttttttgttcgagtccgggttcgagattcggaaataggccggaatg

SEQ ID NO: 99881 - DNA, 713 bp, Heterodera glycines
  Promoter: Source sequence=SeqID_15573; Location=478..1190; Strand=-; Gene=SeqID_79857
ttttgagattattattagaaccttcacaatttattattattagcatatttttaaatttatttaaatttttcgccgtagacaatggccacaaaatgggcatggctaagccggagattttgacggatcgaatgaaattgttgctgagcacggccaaaggtgccgatgcacattttttggttgggcaaagtgacaataaagaggcaagtgaaattaataaacaattaattaattacggtataattagcgaattacatttttagacaattaattagggtaaaattaaattttaagcttgtgcatgcgcacaaaaccattctgattgcttcttccaatgtttttgaggcgatgttccaaacggagcaagaaaatgcaaatgacaccaatgcaggaaagagtaagcaaaagggattacctaattatgaaaacataagcaaattaatacataagggactagccccactccttttgttttttctatttttcaaatttttctcatttaaaaatttttcatttttgccttcccaccttccccccccccccatccctaaatacgcctgtgataaagtctgttaatttcaattagtctctactaccctatttaaaattttcacttcgtctctgctaattgccctaattattttcaattagtctctgctaattgctctgtggtggaggagctccccgactttgaaccagcagcgttcaaaataatg

SEQ ID NO: 99882 - DNA, 52 bp, Heterodera glycines
  Promoter: Source sequence=SeqID_44506; Location=1..52; Strand=+; Gene= SeqID_71986
ttttcagtcagtttattttgaataaccgcgatagatctttggaaatcaaatg

SEQ ID NO: 99883 - DNA, 458 bp, Heterodera glycines
  Promoter: Source sequence=SeqID_6798; Location=1511..1968; Strand=-; Gene=SeqID_62942
tatgctttagatgtcgggctctttttgaaaaaaactgttttcagggtcggagaatacgaatccggcatcaatttcatcctatactatacccggaatcgaacaaaaagatcgtaaattcaaatcctttgaattttaaaaatggtgtaatgcccaccatttaaagtattattaccttaagatttatactactaaaatatttagttagaagattttggtttgttctgtttatttatcattttatttttatcgtatcgtatttattccaatttcaaaatttttatatttgtttttgctgaaaagattgcttatttagtttactttctttttattacaaggaaagatttcctcggattttgaatttgcaattttccatgaaataaatgtgaacatatgtcttcttcaagaaaactttttataaaaaagtaatcatttttctaaatttcaacaattggaatatg

SEQ ID NO: 99884 - DNA, 376 bp, Heterodera glycines
  Promoter: Source sequence=SeqID_29832; Location=826..1201; Strand=-; Gene=SeqID_60304
agtctcacacaatcgaggtcgccggttcgaacccggctcgtgtcaattgttttttggcgtccagaattcaattgcacttttgacagggaccctggagaatagaggagaatctcttagtttttttattggtgagaattgaagaatcggccacgtaaatctcgagtcgagaaccgacccttcccgctgtcattactattcgtctctgtcgccccccccccttgtaaattgcgttcgctccgtcgatgccccaattccgattcgacactttccttaataggtcgaggtcactcgctctgccaccactttgatcactgattgttcctccccaatttctccattttatcgcttcatttgaaaggcgactgattcaagaatg

SEQ ID NO: 99885 - DNA, 502 bp, Heterodera glycines
  Promoter: Source sequence=SeqID_19909; Location=1356..1857; Strand=-; Gene=SeqID_84671
atttggtgaaaatgttaaacggcaagttctaaaggcggtttcaaaaactgaagacggaatggagtattggcgttgccctaaccgtccaccttattgcccagggcgtgcttgtgtacaatgccgctgggaagtcgatgacgatgggtcgcaatataaaattggacgaattaccgggcagcataatcatccacccgttttgggtggtcatatggtagaaatttaaaatgtaaagtgcgttaagtagctaattaggtgagagaagcatctgaacgtctccgacaagaggcgaaaagcgaatttccgacaacaagccgtaacatcatcagagaagttcggtcgaaccttagtgatgaggttcgggcaatcagtgcaccatctgcagccgacatgaggcgaacatataattatcagaaacggaagcatcaggaagaggcaaaatgataatttaaaaaataaattaaaacaaaataatatttaaaaataattggttaggtcggcgatg

SEQ ID NO: 99886 - DNA, 798 bp, Heterodera glycines
  Promoter: Source sequence=SeqID_18049; Location=297..1094; Strand=+; Gene=SeqID_82632
tcgccgactgatcgccccaaaaagataatgcaaatgggggcggcggtggcacggcagatggtgccagcagaagctcatcaacttcggcagtcgttgagcggggttcgctttttggttggggacaccttccacccagagagaaattcgaaaataaattttaaaaatttcataggaaaatctttcttttttttcttattcgtcttagtttttccaaccgtgctatttttcagatgtaacaatgtaacacaggcttgaaaataatttgcttaaatggcaaatttatggattttgagggcaaaatttgaaaaaaatctatgaaatttaatgcttgttggggaaattgtttggaaatattagtgaaatttaaagaaaatgccttaaatttttagtttccttttcttttaaatttaagtctgagggctctttctattcccaaatatttggctcaaatttcatttctttagggcaaaaggaggccaaatttctcagctttttggagcagttcacactgagcacaatgtcccgcatttttggccgtttcgtcggcacttatcccatcgcatttctgatctcctcactgatctttgcctcgctgtcaggttgagcaaagttacaaaaaatggaggccgaaattcagaaaaatattgatcatggccctgtcttcacttgctgatcactttttggcccagcgactgatcaattgctgactgatcgctggccgatcactttgatttaatcaataaaaacaaccacaccattaatcacaacgatgggagcagcagcaggtggtgcaaaatg

SEQ ID NO: 99887 - DNA, 139 bp, Heterodera glycines
  Promoter: Source sequence=SeqID_25271; Location=1..139; Strand=+; Gene=SeqID_56018
aaaaatttttgcttataatacatttagttggtcaaaccaccaatccaattaatttttttaatttttcctggttttggtataattttctggttttttttatttctggttttttattatttctggttttttttaaaagatg

SEQ ID NO: 99888 - DNA, 631 bp, Heterodera glycines
  Promoter: Source sequence=SeqID_31005; Location=1..631; Strand=+; Gene=SeqID_61362
tgatgtttaattgtatttttcatttcaaattttgtatcaccggaccaaaaattcacttattatttaaatttaacgcaaatccataaaattatgttttttttgatgctataagccaaaactgtgccatgtgatacatttttcaattcccttttcatttttgccattcgcctttttaaggccgcttttcgcttgaggcgcgtgcccaccaattgttggccattgctcggcttcactgttacgaattctcaaatttttatgccaattgcgtccccaatttgctcagcgaattcggacgagagaacggtttgggcgagcagagccgcacaaaacttgagaaagcattggcccattcgctgttcaaagtcagtgagagacaaagcaaaacaaagcaaaaaaaaaaacaatgcttaaattctttaatttttgaattatttaattttcaatcatttaaatttaatttgaattacgtaatttagccattgattaattcgggagcagttcgtttgctcttattgtgtatatatttgattctcaaatatacaaatttatgtacacaaaaaaaatatttattaaaattatacaaacaattgttatttttctaattaatattattaatttttaggactttatg

SEQ ID NO: 99889 - DNA, 191 bp, Heterodera glycines
  Promoter: Source sequence=SeqID_1993; Location=2321..2511; Strand=-; Gene=SeqID_77229
aaaatttaggaaaaatttgacaacatttccatttctgttgttttgcttggagaagacaaacaatttttggcgaatttatcattcaatcggcaggcaaataaattaacatattttattactataattaataaaataaattctttttttttttttttttgctttttgccaatgtttatttgtcgaaaccaatg

SEQ ID NO: 99890 - DNA, 214 bp, Heterodera glycines
  Promoter: Source sequence=SeqID_1002; Location=1..214; Strand=+; Gene= SeqID_65808
taaataataaagaaaacaaaattaggagagatcaagaaaaccaaaggaatggaagtgcagttgaaaagcttctgtttaaattttattttattcacatggcaaaaacaaaaatgctaatatttgttttttaatcgcttttggcatttttattaaaaatcgacattttttaaattttggatggaaaaacggtagttgactttaatttggactaatg

SEQ ID NO: 99891 - DNA, 540 bp, Heterodera glycines
  Promoter: Source sequence=SeqID_20539; Location=1..540; Strand=+; Gene=SeqID_51078
aatctctaatgacctctaatcatcgtaaaaaatagtcccaagatgcgggaaaatcaacggtttttgaacgggttaactcacgaacaaaaagtcttgggaaattgtcacggcgctcaattcaaaaaccagttttttcgcacgtcgggagtgtttttattagggttaagccctgagccttcggggggcaaaatgtcgggggccgtggaccatcgggtgggcacatgtcgggggtcgggtcggggggagctcaattgtcgcgggccggggaccccgatcgggtagtgatcaataaaaaattttaaagaaaaaaccaatttttatttttaaatgctcgtaaatcttcctttttttctttaatcatctgattcaaattcgtacgttggcgccagtaaaagtgcgtccaagttggcctttataacatacagtcatggtcatatgttatctacacccccatcttattttatttttgtcgtcatactataagtttcggttaaacccttccaataagacccgaattcgaacaaaaagtcgaataaaatg

SEQ ID NO: 99892 - DNA, 526 bp, Heterodera glycines
  Promoter: Source sequence=SeqID_2668; Location=2839..3364; Strand=-; Gene=SeqID_80972
ttttctaagaaaaaataggagttttgggggcgcggcgatgccgataggcgccgccggggaaaaaattggaaattttgatcatttataaacaggttttcactgaaaattagccaatttataggtaaaattttgaaaaattttattggaatttaatccaattcttaggggtgtaaaagtcgcgtttcgcgccaaaatgcgaaacgccaaaaaatgcgaattatgcgaaaggcgaaatgcgaaacctaggcacatccctggcgggcacccaccaaaattttacaataattccatcaatgagaagggaaataaatgaaaaatattgtggaatacagtatttaaatacatgtgtaagtaagtgtctgactggcattttacctacctatttttataccgacctattacctaacacacataggtacaaacgagttgaaaatgtgtttaaataggattattgattttcgtcatttttcacttacatttgtattaaactaaagtgtcttgggctgacaatcaaagcgcaacaatg

SEQ ID NO: 99893 - DNA, 1003 bp, Heterodera glycines
  Promoter: Source sequence=SeqID_2393; Location=659..1661; Strand=+; Gene=SeqID_79499
aaattttttgttgtttactgattcaaaaggagggcttccaactgaaaatggaaacaaaaaaattccaaataaaaaattttttatggcgcaactttttccaagaattttttgggaacagagggccggtaggcaccgccaggaaaattttcaaaatttgagtttattttgttaacagattttcacgtaaaatgaacaatttttcgattttgagcatttttaatttaaaaaaaaataagcggggtccggcaagaaatacacttttgttttgttttagtagttgatgaaaaatcacagaaaaatcaatgatatgtaaatccgagctcagattcgtggttcaacgcatttttttaccccagaaaaggtgcttcttaaattattatatttattttctcagaaaccacaaaactttaccattgccaaaattggaaaacactagtgatccaaatagggtgaaatggcgccattaattatgaattattaaaatcttaactaaattggaagaaagaacatcaaaaatattattcctcatgagaaagttgacaagtaaatattaatctgactatttaattttggcaaaatgttttgccaaaaattcaaaaaattccaattcttaccagtgcatttttactcccgttttttgggtaaaatttccaggagcgggatcgggagttcaaaattttccgggacgggagtcccgaacgggaatcccgtaaaaatcccgatcccgtaaaaaatcccgttcacctaaaaaagcgggagtcgggagcgggaatcccgtaaaatcccgcgggagtcccgatcccgccggactctaatttttattttttcaaaccaaatttgtaaaagttaaataacaaataaaaagagaccatttattcagagaaattgtaacaatggtaaatagtgaagataaaagacatgacgcacaaataaatggtgaaatggtggatgccaagaatagcataagaaacatagataacggatgaagcaagaaagaaaaatg

SEQ ID NO: 99894 - DNA, 314 bp, Heterodera glycines
  Promoter: Source sequence=SeqID_9659; Location=2069..2382; Strand=-; Gene=SeqID_72226
aaactgagcaaagtgaagaagatcatctgcagacgagcttacatcagcgtcagcaaggccatgttcatcacgctcaacaagaacaacaaagactacaatgtacagccatcaccaacccaattcaattttcggcacaaatttttgttgagattttgtccgtttttttgagtccattttgaaagcggaaaatttaaatgacaatttatgaaaaaagcgcggacccaaattcaattaaaatagcgaattttcattttttaattgatatatgcaattaattcccacccctttttttacaggaagaattttcacaaatg

SEQ ID NO: 99895 - DNA, 74 bp, Heterodera glycines
  Promoter: Source sequence=SeqID_7147; Location=1260..1333; Strand=-; Gene=SeqID_63963
tgtgtgcatttattggttaattacctcatatttttgccacatttgcaaacttttctgatttgttgtttcagatg

SEQ ID NO: 99896 - DNA, 1003 bp, Heterodera glycines
  Promoter: Source sequence=SeqID_5488; Location=403..1405; Strand=-; Gene=SeqID_58230
acacatttttggctttttaatgatacaaattgtgaaaaaagcttaatgaaaaaccaatgaaaacgaaagaattttttttctttttaacgcattaaattataaaaaagaattaaaattaattttcaaaagaagaaaagcgatatttgcataactgcggaaagctttgattaatttcatttttatttgtacaaatttatgcggatcaaagaaataaattatggtaagaaaatagggagggcgggggagctggtcaaatcgggtaaagagcattcataagagttgtaaaccggggaacgggggtccctgttttccagtttttatagaaaataaaaaattttcatataaatttcactcctttattgggatgagacattttaaaacttgttttcacatttttgttaaaaattttcacaatttattaacagattttgatttgccaaaaatataatttgagcgttttgggtcaaaatttttattaaactccgagatttactaaattttttataaaaaaataatagaaatttcaattttattttgcaattaggaaaaataaacaaaaagaaaagattatgggttaaaatcttaatctttgcataagctttgagctggcccattttttttacatgtggctaataatcccttcttctgcccttccgttttgttctcattgatccgaaagcgattaatggcgtgccaaaactgacaatgaggaggatttcattcgctttatcttttgcccccgggggcatttgactgaaacgccccatgccccggtgggggatcacttgcacaaagtttcgatgtcttcctttcccagcaaatgcggcggagttggaatggaattatggcggtgccactgccaaacgaccgacgcttcaatacgcttcgacgcttcaaaccggttgctcatccctcgcgggtccgtccgtatggcgttgggggggggggggggggggagggggcgtcaaaagaggacaccaaaaacgggaggacgaccaaaatg

SEQ ID NO: 99897 - DNA, 1003 bp, Heterodera glycines
  Promoter: Source sequence=SeqID_797; Location=835..1837; Strand=+; Gene=SeqID_61503
ggggttgacaaatcgttcggggtcggggtcggggtttttcaatttttgccttatgccatatagtcaaaaaattttatattattttagctttaatttttttattattaataataataattttatgtgctttttatcataaatatttttgtatagaattaattaaaaatgcataaggcattttaaaatggccaattttcagtgaaaatctgtaaaaataatcaaaattttaaatttttcatcctgcgcctgacccccaaataaaaatagtagattttattcaaaaaaaaatgccaaaaaatttctgcttattttttttttgtttttcaaatcatctattttttcgcggcgttctttttctatagacttttttttaggagaaaggggtccggcggttgccgatatgcgccgccggaaaaaatttgaaaatttggatggctttgttaacagattttgttcaaaaagtgataaattttttctattttgagtaaaatttttcaccaaaaaatttatgaatttctgataaatttttagttttttttattggttttttgtcaaaattattttgaaattcataatttttcatgatttagtcaaaaaattaaatttttaatttcaacgaaaggaaaattgggttcaatacgtcaataaattatgccaatgatgaccaatttttatgggtatttttgtttaaaaaccctataaattaaaaaagaagtcaaccaggatccgaactcatgacaaaagtagtgcatgtgctaacgcaattaccactacaccaatattacacatgaatggacaaaagcaaattactttatttaataaaaatttggcaaaatggttaaaaaaaattcaaatttgtataatttttttcttttctctcacgaaaataccattcttaggggtgtatatttaaccccgagccgagtcggggttaagggtcggggttcggggtcgtcggggttggaagcgtcggggttcgggtcggggttaaccccgaaaaatg

SEQ ID NO: 99898 - DNA, 181 bp, Heterodera glycines
  misc_feature (23)..(24): n is a, c, g, or t
  misc_feature (35)..(35): n is a, c, g, or t
  Promoter: Source sequence=SeqID_29418; Location=1..181; Strand=+; Gene=SeqID_59922
cgatagggatgaatagtttgatnntcgtctctttnttcttttgcctattttgccgtgccattcttttttcggctttccttaggcttcgctttcgtcccactgcctttgatgtgctgttgtacgctgttcagcttctgatcggctacattttgatgatcattgtcatgacgttgaacggatg

SEQ ID NO: 99899 - DNA, 142 bp, Heterodera glycines
  Promoter: Source sequence=SeqID_31148; Location=433..574; Strand=+; Gene=SeqID_61524
ggtagaaagaaaagggagagtgaaatcggaattttttaaatggaaaggataaaagcaaacccaaaaagtagggaaatgtgcggaattgggacattgggtacgcacattttgtcagttaaactgtttgttttagtacaacatg

SEQ ID NO: 99900 - DNA, 638 bp, Heterodera glycines
  Promoter: Source sequence=SeqID_16643; Location=950..1587; Strand=+; Gene=SeqID_81053
ttaacaaaaacgcttgcactttaattctttaatatttaaattcaaacaatggcgcttgttggttggcctcggttttgtatatgtgttgataaaagtaaaattcttaagaacatcattctgaattccgaaccctagacccgaactcgaagaaaaagtcgaaagtcaaaattttcgaaattagcatattactgaaacaaactgaaagtcatcaaccatgtaataaaagatcatttaggccgtttttggatcaaaaatgctaaattcgaatatccatgtttttcgtgcctacttagacagggattttttccgatatgcctatcgtctttctcattttccttctcgtcctccttaaaagattatgtctaaaaatgacttttttgtgattaagagccaatattttaaagaaaatttaaaattttttgttagcgtcgaatggttttttgagaaaaataatccgtttccagaaattttttgtttctaatatgaatatttaaataaaacaatcagttcataaattttctttataaaaatttagaaccaaaaagccgcgagtcgctgtcgcgcagtaaaaaaacccgtggtcgcgggtcgcgcatcacgaatcaagtatccgttgcggtcgcgctccacccctgatg

SEQ ID NO: 99901 - DNA, 281 bp, Heterodera glycines
  Promoter: Source sequence=SeqID_35116; Location=171..451; Strand=-; Gene=SeqID_64749
actgaaaattgtaaatattctatgcatttaccgcacatttagtttggtgtactgtaacagtgggatttattcggacgtaccgaataccgttccatcatatgccatccttttgttgtgcaccttaaattatgcagtaatttttggtcttattttatggcgccatcaaataaacaaaggaaccaatgaatcaaacgcaacaatcggctgcaaaatgtcgcaaataatttgttttaaatttaaattctaattgccatattttagcggctgctgatcggtcaatg

SEQ ID NO: 99902 - DNA, 303 bp, Heterodera glycines
  Promoter: Source sequence=SeqID_17310; Location=470..772; Strand=-; Gene=SeqID_81786
tattattacatatcgatcgaagaaagtgcagcaaaattttatgaatttccaagggcggtggttgacacaaaaatactcggtcgggttcaatatgaaaatactttataaaacctcaaacaggaaatttttttagattttctggaaaaaattactgatcaactactgagtctggttcgaaaaaattctaaaaaatttgaaaaaaatttactaaaaaaattcaaggaaaaaattaaattttttttttgcggcgactattcagcaatttaaccaaaatgccaaccattttccagccgtgtgggcatg

SEQ ID NO: 99903 - DNA, 255 bp, Heterodera glycines
  Promoter: Source sequence=SeqID_8084; Location=1960..2214; Strand=+; Gene=SeqID_66933
tattttttttgaaaatctgatcaaaatgaaactaaatttgtttgtccccatttatataccggaccgttcatcctttttttagctttatataatttgcataattttttgagatggcccctttttcttatcagcgtaataaatattgtgagtagatcgagacgcgaacggagaagagcaaacatatgccgtcaacgacgacgagaatgcccttctcattcatttctttttacattttttctgcaaattcttccaatg

SEQ ID NO: 99904 - DNA, 79 bp, Heterodera glycines
  misc_feature (16)..(16): n is a, c, g, or t
  Promoter: Source sequence=SeqID_4015; Location=6594..6672; Strand=-; Gene=SeqID_52823
ggcgaatttgccgggnagtaaattcttgaaagggatgaccaattaattaattaattgattggtggcgagcggcaaaatg

SEQ ID NO: 99905 - DNA, 136 bp, Heterodera glycines
  misc_feature (60)..(60): n is a, c, g, or t
  Promoter: Source sequence=SeqID_7571; Location=1..136; Strand=+; Gene= SeqID_65269
cttctctacaagttctacacattcaaacggttgctgctttcttacagaacttcgccaggncggtcatattctccatgaattgtttatcgacaactcttcccccgtggaattccacgccgttctctttgaggagatg

SEQ ID NO: 99906 - DNA, 263 bp, Heterodera glycines
  Promoter: Source sequence=SeqID_13070; Location=503..765; Strand=-; Gene=SeqID_76856
aataaactaaccattttaattttatttccaaaaaccaacaaaattgtccaaattatcaaatctcttttatccattttgtttttgtgcaatatttttttcctatttttcaatttgcatataaatttgatcccaaaaagttggacactttttcactgttcggaatttgcctaaataaaactattgtacctatggtgtttatttccttatgtctgtggtgtttatgtgtgtgtttttggtaattttcaactcaaattttgctgatg

SEQ ID NO: 99907 - DNA, 450 bp, Heterodera glycines
  misc_feature (227)..(227): n is a, c, g, or t
  Promoter: Source sequence=SeqID_4943; Location=1..450; Strand=+; Gene= SeqID_56303
ctgtgcagcagcattgtgtgtgggaaaagggaagaagtgagaaaaataaagaaggaaatagtgcactgtctgactgtctggttatgcttttgaaaaatttgtcccaaaagggggatacaaacccaattagtaccctgaagggctttcgaatgataccaacaatgtttgatttggatgacaaattaaaaagttataagctgaaaacccgcttggggctcgaaaaattnctggggcccgcgaaaactctggaggtccgtggaagtgatatgctgttcgaaggtgtttctgttgaaattttcaaataaaataaaatttggcattcttcctcccgccctttctaaattttaaattttttcggttcaatacagaagcctcgtttaactcatttttacatattttaaaattaagaatcagaaatttagaaaaccaacgcaagcattacgtaaaatg

SEQ ID NO: 99908 - DNA, 564 bp, Heterodera glycines
  Promoter: Source sequence=SeqID_4708; Location=2886..3449; Strand=-; Gene=SeqID_55465
atggtgctgaaccgcccgcgcttgcggtcacaacgcttgtgcaatttgcgcgcgtcccacttcagcactgtgcactgccggacaactgtgcgcgatgtgtggcactgcgtgatccggcacgattttacatatttttatttatttattattacatttatttatttttttatttagcattgcgcatgggatattgaaatacgacgatgtgtcagcaaaaggtgacgacacattatttattgacattaaaaaatgattttgacggagcaaaaacattaaattttgttttaataaatttaaaaaatgataatctatattattttaaaatattctatacgataaatctcacataataaattaatttttcaaaaaatattcaaattatcaaatttttttcgtttttgttaaaattaaactaagtaaaaaaatgtttaaataatatttccgacaaaaataaattaatctttgaaaatttttttatttttttaacacgcttttactatagatgtaaacgaaaaatattccgttctaaacccaatttaaaaacttgttttttgcctaatgatg

SEQ ID NO: 99909 - DNA, 83 bp, Heterodera glycines
  Promoter: Source sequence=SeqID_24470; Location=236..318; Strand=+; Gene=SeqID_55198
tttttggcgccactgtataaatatataatattttttatttttaaatattttacaaaaattatttttagctttttcttcgtatg

SEQ ID NO: 99910 - DNA, 165 bp, Heterodera glycines
  Promoter: Source sequence=SeqID_1136; Location=3316..3480; Strand=-; Gene=SeqID_68456
tttttaatgaactcaatttcaatttttccggcttttaaatcaattttgaatggtctgatcaattcggaataggttattaactatcgaattttatattaaatttaattagataaattttcggaaaatcccacttaaaattattatgtcagattcataaaggcaatg

SEQ ID NO: 99911 - DNA, 367 bp, Heterodera glycines
  Promoter: Source sequence=SeqID_15247; Location=955..1321; Strand=-; Gene=SeqID_79454
tgtttttttaatgacaggagtttgtaaaaaattaataatttttttctacatccttggatttgtttcgaattcgcattcagaaattcataatcatttgtgcctccttaatttcatcatcaaatttgaacattgaacaaaaaacatttatcatttaagtttatttccattaaaaaagtcacatgtcatggaggggactcgaacctccgactccactttgttgaccatctgaccccaaaagacaataaaaggaaaaattgagtttttttcaaccgggaggcctaaatcaattctctgttttattacaattttggatccgctttttaatttaatttttaaattttgatttttttaagaccccaaacaaatg

SEQ ID NO: 99912 - DNA, 82 bp, Heterodera glycines
  Promoter: Source sequence=SeqID_43929; Location=851..932; Strand=-; Gene=SeqID_71496
cgctacagtaccttttcattaatgatacggtaggaaataattaactaattatatcttatgtaattatgcctgcctaattatg

SEQ ID NO: 99913 - DNA, 392 bp, Heterodera glycines
  Promoter: Source sequence=SeqID_3015; Location=2503..2894; Strand=-; Gene=SeqID_82795
ttgagtccccggatcgattattttttgtgttgtcattgaccgtttctgtataagctgctcaaggcgacccagccgctcgacaattgtggcgttgatcgatgggttgagaaattttcaagacgaccaagccgaataccgatatcatcattgtcttaaaacatgtgagacatttgaccttttttttggaggatttacgaaaagatagctcaaacatttttctattattctgtgaaaattcagaatttatggagtttgaaataagttttggacaaatttagtgagtcaaaattttttcgaatttactagtaataatttgcaataagcggctccatcccgtgccgaccaaaaaagcgtgtccaattctccatccaaaacattttgctggggaaatg

SEQ ID NO: 99914 - DNA, 52 bp, Heterodera glycines
  Promoter: Source sequence=SeqID_35259; Location=751..802; Strand=-; Gene=SeqID_64849
ttatataataattccctttgaaaagattgccttgtgcagtaatattgcgatg

SEQ ID NO: 99915 - DNA, 66 bp, Heterodera glycines
  Promoter: Source sequence=SeqID_24143; Location=591..656; Strand=+; Gene=SeqID_54844
ggtcggccctttcacttgtttttaatttatttttgccatattttccgcatctatcccctcaaaatg

SEQ ID NO: 99916 - DNA, 272 bp, Heterodera glycines
  Promoter: Source sequence=SeqID_40957; Location=426..697; Strand=+; Gene=SeqID_69180
ttatagcttattcctaaaatagagcacccgtggctttattttcacccactctcaaaaggggggctttattttaggggggagggtttaatttagggagggagagctgtattgtaggaaattctgtaaaatcatatagcatcagatactttttgtttgtaccgaacgaatccgaaagaattttgcgaaaatccacctgctgattggcttataatttttttccactcagtttttatttgtccataaattctttcgcatttgaattatgaaaaatg

SEQ ID NO: 99917 - DNA, 209 bp, Heterodera glycines
  Promoter: Source sequence=SeqID_11102; Location=1433..1641; Strand=-; Gene=SeqID_74433
ttctggcaatggcatgaccaaactgttcaatttgttaaggtgttggccatcctcaatcaggtgagacgaaaatttgcgggaagtgatcagaaaaggacaaaatgattagaaatgagaaaagaaacagttatttggataatcaaaaagtgattataaaatgatttttgccccccccccaaattgaagacgagcaaaaagatgaccaaatg

SEQ ID NO: 99918 - DNA, 92 bp, Heterodera glycines
  Promoter: Source sequence=SeqID_16698; Location=2691..2782; Strand=+; Gene=SeqID_81097
ttaaataaagccgaaattcacgacgaaaattgagtcatttacaaagatctttttttagaacttccacagcgccacagaaattgcctaaaatg

SEQ ID NO: 99919 - DNA, 933 bp, Heterodera glycines
  Promoter: Source sequence=SeqID_3155; Location=1093..2025; Strand=-; Gene=SeqID_83452
ttttgttctctgcaattttttcctaattaatttacttaattaaatatacatttatgattttttccattacctaacatgatcctcttatttccttttcagtttttatttttaaacaaaaactttacgaataaaaggctgacccataaaattaaattaattttacgctttattctaatccaaaattataaattatctgtttcattaatattaatataatttattcaacctatgtacacaccattttctacaatgtttctttgtattgatttggatcaattttttaccccgaggggcaaagcgatgaataaatgaaaaaaatacgggaggatgggaacaacaaaacattacactcttctgacaattgcatattgttttgaatgagctttggatggaagatgatgggtaaaagtaaataattttccgatgatttgggagttcaatttccaatttccatgaatgaaagttcaaatcgggtaaggattttccaccctttactttttttaatttgtttttacatacaaattgaaaaataaattaattaaaatgtttgcgatttttaaatcttccccccaaaaataggggaagccttcaccattcactcattcgttgtttatgggcttggcatatgattagccagctgaatagtccagtaaaatcataaggatttagccgattttgttatttattttattgccaattttgaatatcttaattcacttaattcccattatttcatttcattacattaatagataaatacgattttcatattgcttatcatgtcccaatcagtgcttgatcggatgaagcatttgttgagcacgcgtgaggacgcggatgtttattttttggtgggcgacggagacgcaaaagaggcgagtcttcaaattaaaaatttaatttattaattataaattggaaatttagtgaatg

SEQ ID NO: 99920 - DNA, 82 bp, Heterodera glycines
  Promoter: Source sequence=SeqID_17668; Location=1..82; Strand=+; Gene= SeqID_82197
tgatgggttaacatttcttagagcaaaagaagcaaatggccaacccccccccccccctaaacccgggaagccattctttatg

SEQ ID NO: 99921 - DNA, 608 bp, Heterodera glycines
  Promoter: Source sequence=SeqID_23188; Location=1649..2256; Strand=-; Gene=SeqID_53897
tcgtctatttattttataaacgccagtctatgcatatgatattctgtccatttatgatcaattaaaaaacttttctgtgatgccttttcttgtcagtgcaattttttatcatttaaatgcgtttatttttcgttgtactttttccacttttaattggaaaaatgaaaataaaattcattttctttttcttatccataaacaattagatattgaaatttactatgaaattaactactgtaatcgaacacaatttttaaattttttttttaaatttatattgaatttctttatttggcgttctgttattaattacgtcaaaacacttagcgttagcgtttttttcacatcgtcgaaaagaaatgatgacaattgaatttacacaatgtcgtgcctttgcagatgattttgtgtttatataagctgaattatatctttttttgcttactatcattttaacagtttcttaagccataaatttttgtatttattaattcccgagacttggacgctcacttaaatttcatagagccgttttttcgttttgactttcttcccccaataagctaaatttttacctttttagcgatatttctgagactctcaaaatg

SEQ ID NO: 99922 - DNA, 294 bp, Heterodera glycines
  Promoter: Source sequence=SeqID_1325; Location=6605..6898; Strand=-; Gene=SeqID_72562
agtgaatatttgtcgtaacatttttaatatttaaaaaaaatagttgtgtgaccgattatccgattggacatccaactctccacgtgctctgcgaggaagttgattggcgccgacccgaggacaacccatacccgctcgccattctaaaagtgttcatcattccaccgcgacaaatcgacatccccgttttgccggtcaaagttgacgatcggctttgttttccactttgcatcaaatgttgcaaaaaatttccgtatggtgccgtcaaatcatcatacagttgtactcacgatg

SEQ ID NO: 99923 - DNA, 249 bp, Heterodera glycines
  Promoter: Source sequence=SeqID_27556; Location=1..249; Strand=+; Gene=SeqID_58257
ttcgattgactgtttgggtgggatttcaaggacgagttgagaataaaattcctttttaggttccatattgtgaatatttatatgctgcactttcgcgtttgccgtcaattaataatttagagccaaaaataggtgaaattttggccgcggaagtcaatgggagatgggaaagagttgaaatgatcagaccatcgttagccgaccccaatttttgggtattagattgaaatttaaaaagagtaaaaaatg

SEQ ID NO: 99924 - DNA, 188 bp, Heterodera glycines
  Promoter: Source sequence=SeqID_29418; Location=207..394; Strand=-; Gene=SeqID_59923
tctcaaaaatgaatttaataatttttcaattgcattttattattaaataattaaaacttttccatttttttgttcaaatgaatttaaatcactttggcttttccaattgcttctgcttcggtgccctttcaattgttcagcactgagtccgaagtgagtaaacccaaaagcaatttggccaaaatatg

SEQ ID NO: 99925 - DNA, 1003 bp, Heterodera glycines
  Promoter: Source sequence=SeqID_24536; Location=624..1626; Strand=-; Gene=SeqID_55262
aaatagcgcaaaatgtgccaatgattgacagaaacagacaaataatcggtcgatgaacaaaagtatcgaaaaaccggtaggcaactccgtctggccaactccttcttattgtataaggggccaactccgtctcagaaagataaaattcattttaagttaagaatttttctcgcttcattacaaactaatttaggaacaaaagtgagaattttcaaaatatttttgttcgaattcgcgtccgagattcgaaattgttctaaatgaaggtttttgcaaaaataattcccattaaaaagttattcaaaaaaaacaaaatttcgaacgctcatatcttttttctaactcatcaaattgattagcattgcgtagaaaaagcttatccttgtcgagagctttatgacatagccacaaaatgacataaaaattactttttttttggtatttttaggcaacattttcaaacttattttttctttataaattttcaaaatatgtaaaaaaacgaaaatatgtacaaaaatatttgccgaaattttggattttttttgaggatttccaaaaattccgtaaaaaatactcaaaatatgtaaaaaaaaatgaaaatatatatgaaaaaaatctaaaatatgtacaaatatgtaagaaaatcccgaaatatgtataaaaaccccgaaatatgtaaaaatatgtaaataaaagtcccggtttttgttcgcaaacacaaaaaagaaagtgtttttcctgctatttagagcaaggagaagccaggaaaaaaatatgtatttacataaaatttgcagccctaaatatatatatcaataaaatttttctctactaacgttttgtggaaaaaatttataataatcagcagaaacacggacataataaatttgcattcaaaccccggaataaattgaatcaataacatctcagagggatgggtcagtgcaattagttaattgggaaaattttgtctcaaggcaaataatagcactgacaaatg

SEQ ID NO: 99926 - DNA, 175 bp, Heterodera glycines
  Promoter: Source sequence=SeqID_17017; Location=228..402; Strand=+; Gene=SeqID_81437
ggtgatgacggacgtaacacatgcatttattggatttataatattggggaggaattgccgggaaatggacgcaaaaaagggcaatttggcgcaatgggcaggggaaaatgcaacaaattgagaactcaaaagttaaatggaaaaattaatctaaaaataatattttaaggaaatg

SEQ ID NO: 99927 - DNA, 265 bp, Heterodera glycines
  Promoter: Source sequence=SeqID_8626; Location=1446..1710; Strand=-; Gene=SeqID_68714
taaatggtcataaacttacaataatccattcatgttatgtttgtttttaatagattttggaaaatgtgttattttttgaacatttcaaaaattaaaatgattaaaaaaatattcactgcacagaactctaatgcattttccgtgatcctttgatggtagtaaatgtatgatttgtctttaaaaaataattattaaatccgcttctcgtcattgttctaatcggtgtaattttgaaaccatcaaagttctccatgccaatgtgatg

SEQ ID NO: 99928 - DNA, 1003 bp, Heterodera glycines
  Promoter: Source sequence=SeqID_15301; Location=3388..4390; Strand=-; Gene=SeqID_79535
atccatggccactcccgctgtcactcaccacaaatgggcggtgggaaaggcgcgtcactaattgccttgcccattaccattcatataaataataatttgtgttgacattgggctagtcggctcaccacccgatgaccaccacagccaccaccataataaataaacaaataaatacacaaaagagaataatttattgttccaatccttcgattattcccctaattaccccccccccccccccgccacgcgcctagtttatggggacggcggttctagaatttgggatttggaggggataggggcagggacagtccgaggatttgggatttggtaggggtagtgaggcggtcctagaatttgggatttaggggataggggcagggacagtccgaggatttgggatttggagggggtgggggcatggacagtccgaggatttgggatttggaggtggtgggggcatgaacagtccgaggatttgggatttggagggggtgggggcatggacagtccgaggatttgggatttggagggggtagtgcaactttctcttgggcggtcaaaatgttttccgcatttaaaaaaaatctttgaaaaattcataaatccactctaacttgtccatatgtttcaccttagacgggatacgaactcgaaaaatccaaatttttcaacaataaatctatttttctcttatttgtgggtgggcgggagtcttggggggaggggtgggtgctaaaatgtttttcttttaaaaatattttaaattaattttgtcccaacaaaaaatcgctctttaattattccgttttttttattttctccattcattttgtcaaaagccctcttccccttgtgatgccccaaaaatgtattaatattaaattgctgccaataaggccaacctcacaattttcaggcccatccaaattgattttcccgtacaaccaaaattctccgctattttttgaagaattaattcattttttgagtcaccaaaatg

SEQ ID NO: 99929 - DNA, 1003 bp, Heterodera glycines
  Promoter: Source sequence=SeqID_6944; Location=822..1824; Strand=+; Gene=SeqID_63362
ctcacattacaataaatgtttagttttgctgtaaaaaactatattttctaatgagtttttatgattttaaaacatttgatcagatgaaaatataatttgtttttcaatttgagtgtgttggcgttttgttttacgccaattattttttggcaatttctttcgttttttaccgtccatgacttgttttataggttttcggggtcgggaaaaccgattctggcatctgttttgacccaattcgaaccccgaacccggattcgaacaaaaaaattaaaatccatttttccacgaaaattcactttgtcccaactataatttcattgggtgaccatttgtacacgtgcgcttggcgtgaagaagcccgcgttcttggaaaaaaacgatggcgtttcatcatttaggccaattttgaactccggatcaaactcgatttcgaataaaatgtcaataagtcttttaaaattcgcattatttcgaattcgtataaaaagaccaaattttggttatgaaatgtttccgtattgattttacgcttgttaaaaaataatttatttcaatcaatctaaacacataggtatacataaatgattaaatggacaatatggaatatgcgcaacactatacacaataaatacatacatactggttcgacttcatttcctgatttttagattaagctcgtcaagagctttcaaatgataccaaatttgtggggattcgatggtttaaaaaaaggtagagtgcgaaatctctcaatttttcgagttttgaaccggttcaaaaaccggttttttggcatttccgcaactcgagacatatttttccatgcttagctccttgagacgaatcgatcggtatatcatttgaccctttttttcacggggcgttcactacagttcacccgtgaagcggctatatgtaaaaggttggaggattgaaaaaaaaggaagaaacactggcgaagtgcacctgcgattcgcgtgacttctgatgtcgtaacatg

SEQ ID NO: 99930 - DNA, 147 bp, Heterodera glycines
  Promoter: Source sequence=SeqID_31326; Location=930..1076; Strand=+; Gene=SeqID_61694
acgatagcggatttaaaaatttatgagattaagtttagaagaggcgaaaaattcccgaaaattcattttcgggacagttggcttttaatgcaaaataaattggctcacctaccaaaaacatttggtttggattgtgaatcaaaaatg

SEQ ID NO: 99931 - DNA, 634 bp, Heterodera glycines
  Promoter: Source sequence=SeqID_4337; Location=135..768; Strand=+; Gene=SeqID_54094
tagtgatcagtgatcagagtgacaccagcagcagttatccgagtaaccattagtgataacatggtgatttattgatagcagtgatctgtgatgacaaaaagattagcgattagagtgatgccagccgttatcagattgatccattactgatagacggagatcattggtatcattgatgagtgtgataaacatagtggtgatcagtgattagactgataactttatgtgtgaatagagtgagaccagcagagtgattaattataaagtgattttgataccatatcagtgatccgacacaatgccaagaaaatttttgaaaaatgccaatttaaacgagtgccaatttttcattcagtcccctctccaacaacagctgcacaacggttcaccaccagcagttggccaccaacagtcatcgttgtttttgctggaacagctgagcgggcccaggacgccgttgggcggtggcgccggaggcgcaggaggaggaggtgaaaacaatggcacaaaaatgccgaaaattggcgcttagtggtgcactaagccatcgcaaaatgccaatgccaattttgaatgccaaagtcttaaagtcacacaattaactatttatgtattaaaaaacccatcaggcatg

SEQ ID NO: 99932 - DNA, 856 bp, Heterodera glycines
  Promoter: Source sequence=SeqID_637; Location=2219..3074; Strand=-; Gene=SeqID_57908
ttttagggctgttcgggatggtttggttctcgatttttcactcctctttctcgggtttttgaaatcaccgagaggagaaattctacaatgtactaaaattgaaaattgctaaaaactaaaaagttaatatcggattttatgatttcacgtttcttggtctcggttttttactcattgtcattcttcggtctcggtactcggtaaaactatttcagccctaataaataaaatattaattttttcttttatttaaatattaaaaagggattaaaattagtgcttcgatttttagtcaaatgcctaaatttctgcgcacttgatacgcatagataagcacgaaaaacgcgttttcgctaggtttggggtgtttacgatgacttttataatgcctaactttgcctattttggaatttttgtgctaatgcctaaattccaatttttgtgactatttcgccacttttggcgcctttttcagaattttcggaaaaatccttaacaaaaatgcaagaaaaatgaaaaatacaccccctaagaattgaaaaaagttttcacaaaaactgattcccaaaaattaattatattttcttgacaaaaattttggtttaaaaattgtctttatttaaaaaacgttaaaatagttgaaatataagcaaaattaagttttttgattaatttttatatgttttgctacctaaaaagtgttaataaaaaatgttatttgcctttttttgtgcctaattaatgtaatgcctatttcgcgattttttttgactaaaaatggctctaattataatatttaaattcaccaaaatctccggaaacaaaaaacaccgaataattatttcgtggtaaaatg

SEQ ID NO: 99933 - DNA, 224 bp, Heterodera glycines
  misc_feature (9)..(9): n is a, c, g, or t
  Promoter: Source sequence=SeqID_26836; Location=1..224; Strand=+; Gene=SeqID_57589
aagcataantttttcaaatacataagttcaacaaagatatggctcgcggcgccaaaatgggcggaaaatgaaatttttggtgtttttttgaccgtaacttttatctaaatttttgaaatttggcaggctaataaagagactgtcaagcactttatcaagcttgtttaatggatgcaaatgaaaaatgttatatcatttggagctaaaatagcaggcgcaaaatg

SEQ ID NO: 99934 - DNA, 204 bp, Heterodera glycines
  Promoter: Source sequence=SeqID_9639; Location=1..204; Strand=+; Gene= SeqID_72156
tcataattatgggttaactgcatagcaagcgcaaaaattttccaatttttttttgcaattaaatatttttgggttatcttttggcaaaaaaagcgcaaaatttttcttaattattaaataattatatatttttaatctttttaaagaaccgaggcgcagctgaagtacagccaggcgatcagtcagtcaattgttggcccaatg

SEQ ID NO: 99935 - DNA, 1003 bp, Heterodera glycines
  Promoter: Source sequence=SeqID_40022; Location=116..1118; Strand=+; Gene=SeqID_68465
tgaaccgttttgagtagattagactagaaaaaattgaaaattttgaaatcatgtttcccactcccttctcccaggggtattattttgtagtctttttttccccaataaacttgtcaaaccccatttttcgcaccgtgaatgttatttttattgaattctgaaccgttttgagtagattagactagaaaaaattgaaaattttgaaatcatgtttcccactcccttctcccaggggtattattttgtaaagtctttttttccccaataaacttttcaaaccccatttttcgcaccgtgaatgttatttttattgaattctgaaccgttttgagtagattagactagaaaaaattgaaaattttgaaatcatgtttcccactcccttctcccaggggtattattttgtaaagtccttttttccccaataaacttgtcaaaccccatttttcgcaccgtgaatgttatttttattgaattctgaaccgttttgagtagattagactagaaaaaattgaaaattttgaaatcatgtttcccactcccttgtcgcgtcccgaaaattaaacgctaaatttcgtcccccgagtgagtcatccattccctccctttgtgaatcgccgcctattttttcctttgtattggccctaaggacaggtgcagacaaaatgaacccctttttctcacgacaactccccccccgccccctttttctctacatataatcacttctgccgcttctgcttttcacttcaatttttcccccttttttcacttcgctttccatcgcttttcctattcgccgaaaatcgccaataaattcgttttcttttcaacttcgcctttggaaaataaagttttggtcagacttaattcgtggtcaaaacccagctaatcctaagttcgggttccccttcccatcccaaccacgacacaacggccgggaaacggctcgaaccctcaaatctcgtttcccattttcctaatcttattcttaaccaaaatg

SEQ ID NO: 99936 - DNA, 209 bp, Heterodera glycines
  Promoter: Source sequence=SeqID_13809; Location=1968..2176; Strand=-; Gene=SeqID_77745
caggacgttttcgcgtggccgttttcgcgtggccattttcgcgtggttgcatataaaagagaattcataactcacacacacagacacacagacacacactatattttaccaaaatttgttcgacttttattttctttcgagttttaatttattttataattaagtgaatttgataaatttattaagactttttaaattattacaatatg

SEQ ID NO: 99937 - DNA, 218 bp, Heterodera glycines
  Promoter: Source sequence=SeqID_34393; Location=1..218; Strand=+; Gene=SeqID_64199
ttaactgaatttttggtgcagagattaacgttataatttaggtctgattaatatgtagaataataaaaaataggccaaatgttaggctcgtgtgggaattgaacccacgcgtccacccaacccgggggcagctctaccattgagatacctttagaaacagccggactgagtacaacctgagcttgaactatcagatcaatgagaacacacaagcaatg

SEQ ID NO: 99938 - DNA, 891 bp, Heterodera glycines
  Promoter: Source sequence=SeqID_12349; Location=1713..2603; Strand=+; Gene=SeqID_75945
aaagccaaaaactgctgaataaaagaagccatgaattttataatgagaggaagaagaactgagatgaatttagtatatatataaaattcttaactcctattgtagattttttcagtatttctttagtttcggtcgttatatataaatactttaaatatttcgtgccgcatttataatttattcgagaagaagatttgaattttgaaaacccggaccatgatttccgaggtggaccaggagaggtttcggcaaaaaatcatgttttaacaggacaattcccaaggctgcacgtaactagatcttcaattacggaaattcgtaatcccataattgcagtgatttttttttttgaattatggaaatcatcctaataatgaggggccccattatttatcttaagaaaatttaattcaaattttacaaattttttcataagctcatgtcggcaccgctgactcgttcttcctattttattattattataatataaaaataaatattacttataaatttaatattttttttgcaaattctacattgatttttttgaaaaattcatcaatggctttgtttgtcatcatgtgtataagtttattcaattctattcttatgatatattaaaaaaaaaatttgcagctaaatctattgcgaatatttaattacctattctgctaaaacaaaatcataggcaatgtaataattttaaagaaaattttttatatgtgggatggaaggagtttttgctaaatttaaatttaaaataataatgataatggtaaagaattaaataggagtggggtgaaaaaatttataatttaattaaaaatgtttctttcatttatcaaaatacttttttattaaaactgagagaatttttaacaaaacatcatg

SEQ ID NO: 99939 - DNA, 379 bp, Heterodera glycines
  Promoter: Source sequence=SeqID_22893; Location=1..379; Strand=+; Gene=SeqID_53600
atgtaccgcgcacttctaccccaactcgaaatgttgaacttcccgagcaaataggaccattcccgtttgttgttgaccgccctacagagcaccaaccccacctttaaacatacggcaacaaattttccaccccatcccactgaatgcacaccgcattaaccaagtgtcggttaacgcgcaacgcaacattgacgttcagtacgtaacaaataattgcgttaatgtcccgccaaacgtacagcgtcattgcgacattcagtacaccgctcctaaccctgtcgccgcgccatcaaacgcgcaacaaattcaagcaggaagtagacttattcaaaacattccaatgcaggctcagctttggcagggccctgatggaaaaatg

SEQ ID NO: 99940 - DNA, 391 bp, Heterodera glycines
  Promoter: Source sequence=SeqID_4754; Location=322..712; Strand=-; Gene=SeqID_55617
tgttagtggaataaagcttaaaaataaagaaacagaattacatgaccaaaaatttttttcatattatttagtagagtgccacgggaccgggacctggtagcggacaactgagtacaactgagtaccaaggtcccggttttgaccgggaccgggactagtcccgggtttttcccggttttcccagccaaaaattcccggtttttcaacccgaaaaggtcccggtcccgggtttgcccaaaattcccggtcccgtggcactctattatttagctatgaagattccaggaaaaaaaaatttatatttacaaaattgacatccctaaagataaaaaccaagccttgctgagatgggatggatttttttttgacgaacgaacggaccaacgaaatg

SEQ ID NO: 99941 - DNA, 1003 bp, Heterodera glycines
  Promoter: Source sequence=SeqID_5770; Location=863..1865; Strand=-; Gene=SeqID_59171
aaatatttatcataaatgcatagaatgaaccgttggtggcccgggtggcttacaacccggtacggagcacgcttgtgcgcaacttagaagtcattcttcaatcaaagatcagttttgccctttttaccaatgtccatctcattttatctgtagattgattcaaattgttaggttttctgtttcaaaaattgatggtgacttttcaattgggaaatctgaaagatgatttaatcggcgtaaatttggcaaaaaaagaactgagaatttaaaaaattatccaaaaataataataaaacgaaaaaaaatgtggtactcttagataatattattattcaatctcttctgatttataagcggcacgaggccaaggcggcaaatattttgagtaagtgcctgttttaatttggtttccgatgacaaattttcaataatcggaattcgcttctcgaaaatgcaaatccatttttaagaaataatatggccactttgcgctttcgcttcctttcaatgactgtaattcgaatggaggaatcgcgcgaatataacaacttcaatttgcttggtaatattttgcatgaactctgataatggtctaattgactgttttattttggcaaattaaaagtttttctggtcgttttggcattgataatttttaaattaaaaacattttatttgataaatgaaaaactctcttgggttatctcataattattgtgtcaaagttaaataaaggcatcacaattttcttgagtttgaccattccaatgaacaatcgagcaaatggaaaaattgttttattttttaagctcacaaaattggaaatctttataaattattttacgtattttataaaccaaaaattgggctttttctgattttgggcgtccatggccatgcttatttgcttagttgatgtcttttcgttcaataacattagcaatggcattggtaatgcattattttaatggtctttttttaagttgaccttggctctacaatg

SEQ ID NO: 99942 - DNA, 1003 bp, Heterodera glycines
  Promoter: Source sequence=SeqID_1191; Location=790..1792; Strand=-; Gene=SeqID_69615
tcattttgttgtttttccctgtttggtctcccctttttccttataaatatctccatattataaacgtatccattttctccattaattattcaactcaattgtatttttgattatttttaaccaatgcttcaaaaatattcatagaattcaggataaattacaattagaattgcaggtccaaaatccagtaaattattgtctttttgctttttgaacgatgccatcccaaaaacctctaaaaaaaagcatttcacaatataatgtattgagactggattaatggacaaaaccctaaaatatggattatggatcaaaaataaaacgcagaaagaataaaaattgcaaaatataaaaaaaaattgtcaaaaatggagttggaaaatttaaaaaaaaattaaaatattaaattttcatttgtcattcacgaaaaatagttgaaggcgcattttgtcatattaatttattttttcagttaggtatatgtttttttttatgtagcaaatatttttaaataactatattattttaaatttaaaaattattttactttttaatttttaaaatattgaaaaataattctgttgacaaaagaaaaagtacaaacagtgttagagacatggaaatagtgcatcaaaatgagagtaaaagaaaaactgtgcttttgtaaaaagttccttattgtttaattttcttcagattttcataggcctataatttgaacccattccttcatcgatttctatcaaagtattttgaaaatgcattttggtggcttttgtatttgtcaagggaaaagctcgttttttaaatttgcaaagttttgcgttctgattatgttaaaaataaatttatttgtagcgaatattttggtaatgtaacagatttctttttatttctcatacataatacatacaaattgttaaaaatattgctcggttattgggaattgaatttacaaatataaaaaaaaacaaacactgacattaagaaaaacaataaaatg

SEQ ID NO: 99943 - DNA, 366 bp, Heterodera glycines
  Promoter: Source sequence=SeqID_11746; Location=422..787; Strand=+; Gene=SeqID_75235
gcattcccaacagggctgggcaactgagtttttaaattacggaaaccgttaatccgtaataacggcaattttctcaattacggaattccgtaatgacgggtgaaaaatgccgtaatttcccgtaattcgtaattacaggatccaaaaaggccgtaattttcgtaattacgcccagccctgatccctaatcatcattgaccccttgaaaagcaacaaaatgatgataaatcagcagagttgggagccatggtcataattaatgaattaatgttgaaaacataggacggaaaagtgacggattatggcaaaacgcggacgctgaccggcgcagaacgtgccaaactgaagaagttcatcgacgaaatg

SEQ ID NO: 99944 - DNA, 949 bp, Heterodera glycines
  Promoter: Source sequence=SeqID_6442; Location=1759..2707; Strand=-; Gene=SeqID_61580
aaaggggggagggagcttttccatcacatcctcccccccccccccccggccctccttaggggggagaggtgatttggaaaggacgacgaataatggaaggggaatgaatagtcagtcagtcccaatagggccccagggtacgacgacgacgacaatttgtgcaaaaaatagtccgcgtttggctgatccactccacagatccacctctccaccctgcctctgtgccgacatcccatcagcttttctgggttatgcacagcgaaaggaaaatccgcttcaccctcggggccctgacccccgcgctctcaccacccccctcggggcagggggtcgttggtggcaggaggccagctttccgacccacatcatccacttaattcgtgtcccaattagatgacgcggattggtggggggggggggggacagggctgcggcgcggctgacgggtccatccttggccctttaccccccgcccaaaaattccatgggcccttcccattattcccaaaaacattggctccaattgtgtgtgtgttttgtaaccccaaaatgagttggaggagggattttgtccttttttacaggatttgttggcttaagcattcattttttgttgaaaaagaaaaaaaaatggaacataaactcaaaacaatttattatgaaaaatgcattggcattattaattttagtcaggctaagtagcctattaattgtttaattcatgaacaaaaaatgaccaaattgtttgtggtggtgacaattttttgaaatatttttgcttggctaaaaatcataataaatatgtaagctctcttcatctgatcaggccaaaaattttaaatttcttccctgatcaaggtccaaacaaatcccacaatttacctgttttctaaattcatacaaaataatgtgatcagttcagaagtgatctgactagcgcaacgccatg

SEQ ID NO: 99945 - DNA, 75 bp, Heterodera glycines
  Promoter: Source sequence=SeqID_29662; Location=1101..1175; Strand=-; Gene=SeqID_60134
agagagttttgtagacgaagagaacgagcagacagacagtcagacaaaattgttataagcttttgccgacgaatg

SEQ ID NO: 99946 - DNA, 580 bp, Heterodera glycines
  misc_feature (25)..(25): n is a, c, g, or t
  Promoter: Source sequence=SeqID_42411; Location=313..892; Strand=-; Gene=SeqID_70309
tactttgtgctcccctcccccgaantttttgtggcgcgttttacttacggaaccgatggggaatttttttcatatttctgaaccttataccctggggaatttttggggtttttttttggaaatcttatgacccatttcgttaaaaaaacttaacttgttcacatttttcctaatttttacgcttaattggtactttccctgcaatagaagcaataatcggcgaaatgaataaaactgatgcaaataaatttaaggaatttcttgaaactaatatttttgagaattttttttttttggcgaaatcccatgaaaatccttttcgggtgaatttgacgaaatttttacaaaaatttactggcataagccccccccccctagaaaaatggtgaacctttattttcttaaattccaataaaacaacttttttcgctgtcataataattaaatcaattgtaaaattttctattcttcatattcttcttatttaatgtattatttattccatgtaatttaagcaattttcaattttatttaattaaaattttcaatttaaattatttccagcaatttttgcgccatg

SEQ ID NO: 99947 - DNA, 123 bp, Heterodera glycines
  Promoter: Source sequence=SeqID_25040; Location=989..1111; Strand=+; Gene=SeqID_55772
ttgtttaacaaacaaactaaaacaaaaataatgtataattttggaattaaatttcggagcacaaacacatcgacttgaggatgggagaataaaaaggccaagtccatgtttgtctaatccatg

SEQ ID NO: 99948 - DNA, 61 bp, Heterodera glycines
  Promoter: Source sequence=SeqID_19921; Location=2155..2215; Strand=-; Gene=SeqID_84680
cacgaaaatgcgcgagttttctccgttgctcagtccgtcataaattctggcgaaaaacatg

SEQ ID NO: 99949 - DNA, 96 bp, Heterodera glycines
  Promoter: Source sequence=SeqID_27975; Location=1051..1146; Strand=-; Gene=SeqID_58633
tgtacgatggaaatgatgaggtcctgattgaggactctcccccattgtacgatggaaatgatgaaggggtgattgaggagtcaccgccccattatg

SEQ ID NO: 99950 - DNA, 61 bp, Heterodera glycines
  misc_feature (16)..(16): n is a, c, g, or t
  Promoter: Source sequence=SeqID_15101; Location=1..61; Strand=+; Gene= SeqID_79278
ctgagttgggcctganattcgggcctaaacattgggaggccttggagccgagtcggggatg

SEQ ID NO: 99951 - DNA, 131 bp, Heterodera glycines
  Promoter: Source sequence=SeqID_10972; Location=1415..1545; Strand=-; Gene=SeqID_74279
ggaggaggaggcgggagtggatttgctaatgcccatgaccacttttggtaaatttttgaaaagatttttcaaaaaataattaaatgattatttattgaccacttttgtccatttttttagggctcgaaatg

SEQ ID NO: 99952 - DNA, 80 bp, Heterodera glycines
  Promoter: Source sequence=SeqID_20553; Location=415..494; Strand=+; Gene=SeqID_51097
ttaatttaaaaaataaaatatgcgcaattgtattacaattttggatcatcaccagtccagttcataatttacattcaatg

SEQ ID NO: 99953 - DNA, 62 bp, Heterodera glycines
  Promoter: Source sequence=SeqID_341; Location=1..62; Strand=+; Gene =SeqID_83236
ttcatttgcgcatgctttggtggatacgaataaaataggtgttgagcgaacagttgaagatg

SEQ ID NO: 99954 - DNA, 742 bp, Heterodera glycines
  misc_feature (224)..(224): n is a, c, g, or t
  Promoter: Source sequence=SeqID_14346; Location=145..886; Strand=-; Gene=SeqID_78374
gaaaattcaaaatttttgaattcaaattgttgattacaactttatttaaattcacggaaacaaagttaaagtcaaaaaagtggcaaagtcatcactgcttcaaaaaagatcaatttaaactaattttgactaaaaatggaaaatcgaaaattttgaatttctattttttgttcgaattcggatccggggtttggaatagattgaaatggatgtcagattcgtgnatcagtaaacccgaaaaccattaaaaatatattttcacttttgaaaacaaaaatttttttcgaaaaatggggggggggggcaagactttttgggtctgaattttgaccatttctcacttggttgaccataccacattcatttcatattgtttcgggggtttttttttgttgctaatgtgaagctgacataatgaaccactaattgtaaatggagagacatttgcccgaaacgctttatttaattagcgtttgtgaacgcagagaaaaaacatgtatggttgttcagacttttttgggtcagtgtaccataaataaacaaatgacaaaatttattttaaaaagtttgggtattttgttgttcattcataaaaatttatattcggaggtgaacaattttcgttcgttgaggcggcgattgaaatgttttggaaatgtccgcaacaatttacatgtccgccttcgttgggtttttttgcatcagcaaaaagtgacgacaaatagcagggagggacgaaatg

SEQ ID NO: 99955 - DNA, 177 bp, Heterodera glycines
  Promoter: Source sequence=SeqID_7694; Location=232..408; Strand=+; Gene=SeqID_65646
gctaaatgaatgggaatgttaatggtaatgggatagtgcacaatcagtcagaaattaggaatgctttgaacaaaatttggcgaattttgaaatttcaagccgcaaaagttaaagtaatccaagacaatttggacatggatgatgggtttggaaaatccgctaaattgtgaaaaaatg

SEQ ID NO: 99956 - DNA, 643 bp, Heterodera glycines
  misc_feature (83)..(83): n is a, c, g, or t
  Promoter: Source sequence=SeqID_6073; Location=1..643; Strand=+; Gene= SeqID_60217
tcgttccaatagctcaaagtttatttattttttcaaaagtcaaataaaattccataaataaaaaaattagctttttaaatttnaaaactttcagaaaaggactatagaactaactaccaagttattttaagtcatgttggttctgcaaaacaaacaaatgtggttacgaatggaagtatttaagaaaggtcccagcaggaacaaagcttacttgcctaatttattctatatttatatttaaatttatttaatttaatttttttctattaaaaatcaatattcaatgaatgccctccaacaaaaacaacttttttttgttcaagaaaagacaactttggatatgaaattttaatatttattaccttaatcagtgttatttttcaaattatttcttaatttcggtttgattcaatcttcagttgagtccattcgaatggctttgtgttccaaaaaatgccacactcgcgctgatcaaaaaaaactacaaaaaacttgcgatggccacacacccggacaaaaacaatcaatgcagcggcaaattgtttacggtttgggttactgtacaatttaatttgtaatttagcaaaaagaaggtaaagtttaattgaaaaattctttcagctcattaccaatgccaaagatg

SEQ ID NO: 99957 - DNA, 776 bp, Heterodera glycines
  Promoter: Source sequence=SeqID_1878; Location=6100..6875; Strand=-; Gene=SeqID_76534
tttgtgcaaaaaaaaaaaaagcaaacggacactttcactactcattttatttacagcaaatgggtaattaaacaattcatatatacaaaaattaattagaaaaatgaattgccgattgatatggatggagtggtaatctctaattgatatgcaatttcaaaagtgatttaacttttggctgatgtgcatgatgaatcccgaaaaaaatgttcgatttaactgaactccgtgtgaatcgaactctaaaatatttttgttggtccggactgtgaaccgtgcgtagcccgggactcatcagggcccattgtcagtcttgaggacattctcggccttaagcctcagaaagttctcaatctcgagaagtcaatgcttcgaaatgatcgctcatttctgaacagcctaattagggaaaattagaaagcaatgatataacaaaaagcgattaaaagtagtgattcagaatttatgaaacaacaaaaaaaggatggaatgggaaatgaatgaatgaatgtctgatcagtgatcacattgtacaagaaaaagcaaataaaattctcataaaatcataggccaccaagaaaccgcgacacttcatcgtcggcgtggctaactaacggctgatgttggccaaggacgtggtcaattacaaatttcatcacaaaatctcaatcgatgattttgtacgggaaaatcaagtgttggaaagtgtttcggcgcaaggacaaaaagccggcattgggggcgattatggaaaaaaattcttccaggaccaaatg

SEQ ID NO: 99958 - DNA, 121 bp, Heterodera glycines
  misc_feature (34)..(34): n is a, c, g, or t
  Promoter: Source sequence=SeqID_20092; Location=1..121; Strand=+; Gene=SeqID_84878
aatttaaaacttcacaaatcaaaaataaattttntggatcttcctgataagtaaaaattaaaggtttgacacaatttaaacgtgaattatataaagcattggttaattagcattagaaatg

SEQ ID NO: 99959 - DNA, 106 bp, Heterodera glycines
  Promoter: Source sequence=SeqID_11298; Location=309..414; Strand=-; Gene=SeqID_74672
tttggtcagtttttaaactgataataataattgttttaattgtcataataaagaaatattaattatcttatttacataatttgttttaggtatagaaaaagaaatg

SEQ ID NO: 99960 - DNA, 202 bp, Heterodera glycines
  Promoter: Source sequence=SeqID_18586; Location=1020..1221; Strand=-; Gene=SeqID_83223
aacgaagtgcagtgcgccatggccatttttatttttcaaataattttttatatttaatagatatcccagaaaaatggctatctctttttttgagaaattttctatgcaacaaacgctctcgaacatgaaacgaagtgcggtgcgccatggccattttatttttcaaataatttttatatttaatagatattccagaaaaatg

SEQ ID NO: 99961 - DNA, 79 bp, Heterodera glycines
  Promoter: Source sequence=SeqID_38647; Location=938..1016; Strand=-; Gene=SeqID_67398
caaattccgccgaaaactcctagcaattgcgcaaaattcgcaataaattccaaacgaaaaaggcattttcgttaaaatg

SEQ ID NO: 99962 - DNA, 170 bp, Heterodera glycines
  Promoter: Source sequence=SeqID_3503; Location=1..170; Strand=+; Gene= SeqID_84943
cccgtcaaggcttcctgatcaatgaacttggcgtattccatttccatgaatcagttcaacaagccgatggaacatcgaatgtagtcaaagactacgttaaaaaactggagaaaaatatcaaccatatggccaaattccactgtgtcaaagttaagtcaaagttcaccatg

SEQ ID NO: 99963 - DNA, 475 bp, Heterodera glycines
  Promoter: Source sequence=SeqID_11186; Location=2527..3001; Strand=+; Gene=SeqID_74535
aaaagcatatgacactagttcgactgaaagatcaaatcgcgcattgatcagtgatcacttttctatacctatgtaatcccttttcattatgtaaactctttttctagtgatcatagtagtgttctttttgtagtaaacttgttgcagtattatatttggattagataacaggactaaaaatgatctgccgtcctttattgcaaatgaagcatcatcagttggcataaaaatgtatgccgatgatgttaaattatattatgcccatgaaaatgatgataaaacaaatcatttagaataattaattggactaaagaacaagtttaatttgtgtcaaatcattccatataaatgcattatttgtcgtcattattttattctgcacattttatttttttgaatgtcgctatttaaataatccatttcaatttaaactttaatagctaattaatttatttttaatgtttcagttaaaatg

SEQ ID NO: 99964 - DNA, 327 bp, Heterodera glycines
  misc_feature (75)..(75): n is a, c, g, or t
  misc_feature (156)..(156): n is a, c, g, or t
  Promoter: Source sequence=SeqID_6398; Location=772..1098; Strand=-; Gene=SeqID_61409
aatttttactaattttttaaaaatccataaagatagcagaggttcaatacgaagttcattaaatttgattaaatntaagctaaattataaaatcgatcaatgttcattttcatctgacttccaatttaaaaatttattattttttaattattcatntaatccgagcaattttctggaagtttccccacggtttcactcaccaaacaaaagtggcaaaacagtgaatcatccgcgcaccttctgaacccgttccattgaatttggcactttgccttcccaaaaaattttgccgctctccaagtgcgtaattcgggcacaacacaaatg

SEQ ID NO: 99965 - DNA, 560 bp, Heterodera glycines
  misc_feature (31)..(31): n is a, c, g, or t
  Promoter: Source sequence=SeqID_15904; Location=1..560; Strand=+; Gene=SeqID_80250
caggcaaaataaaccaatttgctcatgatgnaatccccttattattgtatttattgtctctcactttttcaatttttgaaacaaaaacaaaaaaagggacacagacaaaatgacaaaattgaaaataaaaaattgacaaaatgtcaattgctttaatcatttttgttcttctcattggcttggttgattgattggaatttttgctgatcagtggaaaaatggtgggaattgaaaaggtgatcaaaccggtttatgagcccacagctcaacaatattgcagcagaagaaaagcactaaatatttcaccaaaacgccaatttatctattggtcaaataaatgggaaatttcaatgtttgaactcgaagaaaaataattttaaacatccattttttttaattttttgccggtaattagctaattatcgtgattaaacgaataattaatcatttggcaataccgtgcgataacagaaattatagagcattcatgaaaactagaaattagaaaaatttaattaaaatttaattagatttttacaaaaattaaattcaataagatg

SEQ ID NO: 99966 - DNA, 1003 bp, Heterodera glycines
  Promoter: Source sequence=SeqID_17825; Location=1024..2026; Strand=-; Gene=SeqID_82355
tagaatttccttataaaaaaccttcaaaaattttttcttgaaaatttaatcggattaactaaaaaattgatacgcaaaattcaatccgatcaatcattaatcccatatgattgattgacgaattagccctaaccaggatctgatcacatatttattaatgaaccagattaacgaaaaatttgatacgcaaaattcaatccgatcaatcattaatcccatatgattgattgacgaattagccctaaccagggtctgatcacatatttattaatgaaccagattaacgcaaaaatttgatacgcaaaattcaatccgatcaatcattaatcccatatgattgattgacgaattagccctaaccaggatctgatcacatatttattaatgaaccagattaacgaaaaatttgatacgcaaaattcaatccgatcaatcattaatcccatatgattgattgacgaattagccctaaccagggtctgatcacatatttattaatgaaccagattaacgcaaaaatttgatacgcaaaattcaatccgatcaatcattaatcccatatgattgattgacgaattagccctaaccagggtctgatcacatatttattaatgaaccagattaacgcaaaaatttgatacgcaaaattcaatccgatcaatcattaatcccatatgattgattgacgaattagccctaaccaggatctgatcacatatttattaatgaaccagattaacgaaaaatttgatacgcaaaattcaatccgatcaatcattaatcccatatgattgattgacgaattagccctaaccagggtctgatcacatattaattaaacacagactgatcattgatcagatctatacacaccgattaatccactacagatctatacacaccgattaatccgatcaaccatgccaaataatttgatcgatgatcagtttgaacttcacctgatcagtcgttccattttcctatacacattgtgattgggatg

SEQ ID NO: 99967 - DNA, 1003 bp, Heterodera glycines
  Promoter: Source sequence=SeqID_9845; Location=4475..5477; Strand=-; Gene=SeqID_72868
agaaaattaccacaaactgatcacataaaaaaaaagttggaaaatctgtttatccaggcttatcagatgaaaccggcacttttccatacgggatttgaatttttgtaaaatcattgggattttttgtcataacaattgtgaaaatttgtttctaggaattttttgcggtcgctgaccacaaatctgacaaatatttcaaccaattctgaatctctaacctaaattcgaacaaaaaaaaaagaaatccaagaattttaaatttctacctttgtccgagtttaggttagagattggtcaaaattgatgtcagaatatagtaaaccttcttggtttctaaggaggttcccatctgaaaagtgcatgaaatttataaaaaacatcttcattataaattttcaaactgttaaaaatcaaaaggagtttatggcaggcgggaaatttaaatttcaatgcaatttataaataatttctataaaatcagatcaattcactcattccaaaaatttgaattgcgtcatcctttaagggataaataataaattatatatttaataaataagggtttggataaataatattcaaataattctactgttgatcaatctaagttttaattatattcttatttaatatatataaactattaaatatataaataaaaaaggcttaattgcattatttaatttttcatttaaaatagatttaaattattttattatatattttttttattaattagaaagtattcgttaatttcataataataaaaataatttttacttttttatgtaaataaattgaaaaacaattaatgttcttttaattttcatttgatatttaattcattaaagaaaatataattgttttattctttttctataatcctttttcaatttattattcatcatattttaattcacatttcaactgcaatttatatgtgattcttaataaaggcaattaatttttctaatttttttgcttagggagacgaccaaaaatg

SEQ ID NO: 99968 - DNA, 1003 bp, Heterodera glycines
  Promoter: Source sequence=SeqID_4045; Location=1593..2595; Strand=+; Gene=SeqID_52952
cctaatattactctaaaatctctcctattattgtctcctttctcacagaatttttttttatttaacaaattttgaaatatttttgtaattgacaaaaaataaccgttaaattcatattagataaatagggcccggatttttagtgacaaaaattcccaaaataattaactaaatagtggccaaaaaatgccaaaatagtggcgaaaaagttccaaatttagtggtgtaattttttaaatagctgttttttaatttgaaaataatttaaaattaaggcaaacaattttattcactgtttgcagtcacaaatgaggaacatttcctttccaatattttcttagcaaatattaagcaattaaaaaaatttggggaagaaattttgagaaaattttccaattcttagaggtgtatttttgaaaaattttaggtcgattcttaggggtgtatttttgattttttttaggtcgattcttggtgtatatttttcgtttttattgaatttttgggaaattttccaaaaaaatgccaaaatagtggcaaaaaactattttagtggccaacttccaaaataattttttttaatggcaaagctccaaaatagtgattcctaatgatgaatagtggcgttaaaacgaagaatttccgagttaaaaatgtgttttttgtgcatttctcatcgaaataaagccgcagaaaaaatagttaagaaactaagaatccgggccctatagataaattattgaaaatttttttagcatttggctaattttttttgatttttttgtattttcatgattttggtagttttttgacatttagtcgactttttgctgatgtgacttaaattcgcacctctactaatgatatgctaaaaatttaaagaataaaaatgctatttcatttttattaatgaaaaattaaaatataccagtaaagtgaatctcaattgaaattcaattttagttgttttgcaattccaggacttctttatagtcataaaatg

SEQ ID NO: 99969 - DNA, 1003 bp, Heterodera glycines
  Promoter: Source sequence=SeqID_8418; Location=521..1523; Strand=+; Gene=SeqID_67993
attttaactgacaaactttgaaactttctattataatttcattaaaaaatccttccttttttcgttttatttttaaaattagacatttaacttgccttcgaatttactaaaataattttattggacataaatttgtgaaaattcacagtgtaaacattttaaaattataaatttgctttcataaatttttttatttaaaaattgaactcaatttttgagaaactttttgtctgcagttaggcgttaattgtttattctatgatcagcctgtcacctgatttcgttaaacagttgggggctgaacgaacgtgcgcgagaaccttccacaattgaagctcgccaattttcgaggaaatccaaattttaactgataaactttaaaactttgttttataattgcaattttttttttcgtttgttttaaaattttattttgttgtagtatttgttatgcataaattgaggtgaatttaaaaatgtttcttattttatttttgtataaatttcttttcaatttatttttgtgcttattcatcttttcattctttcttccgacattttaattatttttttcattctttggctttttcatcttgacattaacacattgttaaaataatgaacataaaaaatgttttcttcttttttgcttattcatcgctgtaaatcaactgcaaattgttcaaatttttaaagatgaataatttctgaatatatattttttctatttaacaaaaatcatttcaattatttgcaattaaataattataattttattataataaggaattaataatagattattttgtatttgtgtaaaaattatgcattgataaattaagtttatataaagtttgttaagtgtattatgtatttattatttattaatttcttcacattttttaccgtactattcaactccgtcaatggccaatgcttcttcccctctgaagagtaattttacattattaatttttattttaagtaatgttcaggtcgaatg

SEQ ID NO: 99970 - DNA, 219 bp, Heterodera glycines
  Promoter: Source sequence=SeqID_13092; Location=1109..1327; Strand=-; Gene=SeqID_76879
attttcaatgctttaaattttaccatgatcagcggcaaaaccaggctccaatgacgtaggattggactaggtatattgtttcaaaattttcacatgttaaaagatatagtgaaactgtgcgggggagggtcatagcccaggaggagagagaattttttgtgcttaatagtcgatttgctattgccaattttcggtttttttggctccgcgccaaaaatg

SEQ ID NO: 99971 - DNA, 360 bp, Heterodera glycines
  Promoter: Source sequence=SeqID_38819; Location=274..633; Strand=-; Gene=SeqID_67526
ggtacgttattaaaaaataatagtaataaaaattaattttataaaaaaatgtttattattttatttaggtaatgatgtgccaagattatgaattttggaatgatcgcattaatgaactcatttttggaatgattttgctaataatttttttaagtttattaatagttttggcagttgcaataattgcccaatgttttaacaatttttttcgtgctgcaaacatgtaacatggaaagaaaatttgacgaataaaatattaaatatttgtgatttttttaaaactgtctcaaaaacagtttatcatattttttttgaaatcataatatttttatttgtgtttcagctaataaaaagaaaatg

SEQ ID NO: 99972 - DNA, 614 bp, Heterodera glycines
  Promoter: Source sequence=SeqID_14046; Location=1761..2374; Strand=-; Gene=SeqID_78021
gttaatttaatttctaaactttcataaattttgacccaaaagtgcacaaataaaaggtcattatttaaaacgatttaaagttaattactaatagattagaagtaaatggaagcatcaaagttaattaattaactaattaggtaattgatgagactttgcgccaattatttgaattttaaacattttagaggctggaagaccaaaaagaaaacgacaattttttggagcattcggatggtgaaaatgaagatgacgctgtcattgatgttattgggtgatcaaattttgttttgttttttaaatttacttaaaaaatttttagaataatatgacttaattatttttattcgttgagaaaaacgtgaaatattgcttaattaaatatataactcaggtgggattgaacctgggactccctttttggtggcaaactcacagaccactgagacaacaaatcaattagtttttgaactgggggctcaaaattgactcggtgtgtaaatgcttttgagagaaactctctgttgctatttatctatttttttatataaatttttacaatacaattcagggttttaattataaataaaaataaattatttttgtaataaatg

SEQ ID NO: 99973 - DNA, 223 bp, Heterodera glycines
  Promoter: Source sequence=SeqID_6827; Location=2171..2393; Strand=-; Gene=SeqID_63008
tgtatctcgataagcgaaacggagttgatcacttttgcacattcctgcgcacttttggcatttgcaacgagtggggcgcaattttaggggaaattgtgttgaggaaaatggcttctttgtgtcgtgtttatcctgcaataaggtatgagacccataatttttgaattttcttttcaagacattaaaaagccaaaattgttatgatcatcatgttcgcggcatg

SEQ ID NO: 99974 - DNA, 64 bp, Heterodera glycines
  Promoter: Source sequence=SeqID_4061; Location=1432..1495; Strand=-; Gene=SeqID_53023
ggtaaggcatgccgaggtgtgccccgtccctcttaaactcacttctttgtttaagcagccaatg

SEQ ID NO: 99975 - DNA, 659 bp, Heterodera glycines
  Promoter: Source sequence=SeqID_13780; Location=296..954; Strand=+; Gene=SeqID_77705
aaaatggatcgagaaattattttcggattttcaaagatttcatgacatttttcggaccaatttgttcatggacatacaattaattttgtatatttaataaattaatttattttcaatttaatttaattgataattgttaactttttttaaagaatttatttaatattaattaaaaacatttaggaagtttgaacaaaaatttttcataaatttattgctttctttaaaaatttaaattcatttaattaggtattttaagcaaaaaaaataaggaaaaaagttattaacaatatttgctgacaaccttcgcataaaataaaaagcaatgattaaattttagacaattttttcttattaccaatgttttattaaaattgtttttttttctaattatcaattttattttttcaattaaaatttctctttttgttttttaaattatttcttcaatcgattaatcccatcaacaaatttgcctccgtaaatccgtaaatatgctttacgacaaacagctgttaaagtgggcggatattggcgtttattttcgaaagaaaatgctttttgtttataggaatattcaataaaataatttaatgatttcatttttccattaaattaaaatatttattttaaattaaatttgattatttctaaaaatg

SEQ ID NO: 99976 - DNA, 216 bp, Heterodera glycines
  Promoter: Source sequence=SeqID_3320; Location=718..933; Strand=-; Gene=SeqID_84193
aaatccgccattttaacgatttttcgacaaaaaacatggtataacttaaaaagcaaccaaattttacatttttggtatcattcgatagccaagttttttctctattagcctaacaatttaaaaaaattaggtcaactttagaaaaagttgtatgaatataagcactatttctgccacaacttatgtctttatttgttattttaatattgaaatatg

SEQ ID NO: 99977 - DNA, 145 bp, Heterodera glycines
  Promoter: Source sequence=SeqID_3828; Location=2040..2184; Strand=+; Gene=SeqID_52039
aaaatcaaaaacaaatgcccgagcagaaaaaactactcgccttcttgtaagggacgatgaggaggggcgtttgatcaaattggcggcggaagagatcggcaaattgcacagattggtgaagttcggatgccgttcgagcagcatg

SEQ ID NO: 99978 - DNA, 62 bp, Heterodera glycines
  Promoter: Source sequence=SeqID_31016; Location=1..62; Strand=+; Gene= SeqID_61371
cagcagtttccctgcaaaatttgtgagcttctgatcagtctagaacgttgggtgataaaatg

SEQ ID NO: 99979 - DNA, 1003 bp, Heterodera glycines
  Promoter: Source sequence=SeqID_18277; Location=280..1282; Strand=+; Gene=SeqID_82870
atttcaatataatgaaataaataatacttctttttattatatcagcttcatttatttgcaaagtttgcgcaattttcattattgaaccccatttttattcattttcaatttaccatttaatttataattactttttttatataattttttagggatgatcgtagctttccgtgacctgaaacgcacgaaaaacatgtttttttttgtctattttggcattttgcccaaaataattttaaaaaatgcaaaaaatataggcctataaataaaagatttctcaaaaattgatttatttattttcttcacaagaatctgtcctttaaaatttatttaacttaaaactgatttggcctattttttttaacttttaataaattttatcattttacacacctaaaaataaggtttttagtgccaattttagggtctttacagtctagagcctatctattttggcagtttttagagccaaaaatttaatcactagtcgataaatgaattagggacggaggcggtgcttaaaagggagtgaagctgcttaataagcaacttggcgtagtcgggaatggagttgtctgtgtcgatttctttggggatttgtagttggtcaaggtcggacagaaatttttttggggcagtgttgtcagaaggaggagaaaaattcgccataaagaattgttaaaagcccagaaaaataagtgcgtaaatcatattctgtgggtgaaacgaatcgatgatgcatgtacgaacatttgagaaatttttagaaaagagcaataatgttaagcattttttttttggtttgccatcagaaaatttttttgcattattatctttgcttctttttttgttcattacatatatgttgtctaacttatttttgctgtttaaattttcattcattttgtagaatacgtgtttaaaaacgttccgttactgaatatttattatttttgcaatcagtttttattttatggtattctgctaaatggaacagacgatg

SEQ ID NO: 99980 - DNA, 407 bp, Heterodera glycines
  misc_feature (161)..(161): n is a, c, g, or t
  Promoter: Source sequence=SeqID_37927; Location=1..407; Strand=+; Gene=SeqID_66894
aagtcaagaggctcgcgcaacacgggaaacgtgacagtgatgaatttccaaataccagcgtaaccgtgaaagatatccctttgcaaagcattccagggaacccaatgaattggccaccttcagtgtcaagttttcagaccatattttcatcttctgacccnacagcagcatcaacgacaaccaatgttgtaaacaaatctccacgaaaaaggcttaggccctcttctgttttgcaaatcggaacgagcacaaccactttgattttgttgctgatgatcgcgttggtcgccatacctgtgaacgcagaacaagcatcggaatccgacttgaaagccggaacgggtatttttctcacattttcggatttgttggcactgcttggaatcgtggtctctcttggtgcaatg

SEQ ID NO: 99981 - DNA, 142 bp, Heterodera glycines
  Promoter: Source sequence=SeqID_5627; Location=1547..1688; Strand=-; Gene=SeqID_58693
cttaaaatacaaaatgaatattcatttttcgaaatcgcacatttcgattcacttttgctttatccgttgttaatttatcttccctttaagtcatcaattaaactttctctttatctcttaaaaccttttaccttcttagatg

SEQ ID NO: 99982 - DNA, 301 bp, Heterodera glycines
  Promoter: Source sequence=SeqID_6686; Location=2405..2705; Strand=+; Gene=SeqID_62492
ttatgttaacaataagaattactgaaagtgaaggctttaagaaaacatgtaactttcttgtgagcatttgtgagtaaagaaaaacataacttttaatttatttatttgacgtagaacaattaataatttaatttgcaattgcaattgtattttcttcattaataaaattatttaaaaacctacaacttcaatttttatgcattttcactcccttcgctttgtttaagctctaattcgattcaaagttttgcaaaatcctaatttacccaatttacattaatttctcattttcttacgaatg

SEQ ID NO: 99983 - DNA, 409 bp, Heterodera glycines
  Promoter: Source sequence=SeqID_32060; Location=414..822; Strand=+; Gene=SeqID_62372
aattatttttcaaattctaaaaaataaagtatttttttatcgaatatacatatcatttcatggttgcttaaggcagttattttttaaagaatctatcatttttaggttagaatgaaactacacggaaaaaccgataatttaaacaaaaatttgcataagaaaaacctcccggctgaactactgtttcaaatttttacttttgttccaataatcttattatttggagaaactagaagaaatgcaggttaaagtatttggtttttaaatgaattaatgcttaaggtaataatgtaacaaaggtcattgaaattatttgtcggcaaattgaaatatttcgaacatatcgcaaacagcaattaaaattcatggttaattttcattattacaaaatcattttccattttagatg

SEQ ID NO: 99984 - DNA, 217 bp, Heterodera glycines
  Promoter: Source sequence=SeqID_1035; Location=4707..4923; Strand=-; Gene=SeqID_66642
gaacaaaacttttgaaaattcaaatagaaattttggttcaacgaaaccaaattcttcgaattttcttcgacaaaattgcatcgtggagcaacaagaaagcgtgacaacggatgtttgccttggcaaaatcgaaattgcgccagaagtcgatgattttttggaaagacttgttgttggtcgtgaaaatgaggcagttcctcccatcggaaaagtgatg

SEQ ID NO: 99985 - DNA, 166 bp, Heterodera glycines
  Promoter: Source sequence=SeqID_10154; Location=1914..2079; Strand=+; Gene=SeqID_73257
acctttttcaaaactatttggtgagttagcttaaaaaaaaattgttttagtcttctaaaaaatatttgactttttgaggaaatcaaattaggtagataattaaatttaaaaatgtattacaataaattatcaacattttaaataattttaaattaatataagtatg

SEQ ID NO: 99986 - DNA, 159 bp, Heterodera glycines
  Promoter: Source sequence=SeqID_39786; Location=357..515; Strand=+; Gene=SeqID_68274
attttgaccagcgtgatccgcttgaataccttcgcgcatgtgcctaccacttacacttttaaaaaattaagaaaatcattcaaaaatatatcacaatttaaactatgtaattattttaacaaaggtattccaaatatttgtgcgataaataaactcatg

SEQ ID NO: 99987 - DNA, 1003 bp, Heterodera glycines
  Promoter: Source sequence=SeqID_17609; Location=1234..2236; Strand=+; Gene=SeqID_82119
cctgagcttttcaaaatccgggaccgggacctcggacgatcgggaattcccggcccggtcccgtggcactctggtttccaccaccgttcgttccttgcttaaaaactatttttgtaaattaaaagaaatcaaatttgtgtcccatatcaaacaaaaacaattttctaatttaaattaaaaacaaataaattttttaccagtttaaaaaaacaaatttaaattcttctcaagtaaaaactaatatatttaaaaacattttaaataaacataataatattcttatatttagattacctaaaaattctcatttttaatcacatttcgttagcacaattacaaatttaaaaatgtttcaatgctgtttagagtaaatatttttctcactctcaaagatttataattatttttcggaatttcttcgccaaaattcaaattttgccctaaaagtgaaaaaaagtcataaaaaggtcaaaaatgcaaaaaaaaaaaaagaggaaaaaacttggacattttgccaaggttttgatgccataaaggctaattttgtaataaaaaaaattcaaattttttcaaaaaatcgccaaaatatgtgtcaaaaacagtcaaacccccaaaatatgtttatatgaacaaaaaatccaaaatatgttttttagttcctaaaaactcgctctgattgcaaataaaactggtaaaaatgcctttcatgcgttagcatattctcaaataaatatgttaaaacataaaaatccaagcctgtatcctgtatatctatattaaaataacagtaagtgatatctatgaattttaaggcatgttcaaatatttaatgtcatcatttaattttttaccatttgtcaaatttatgaagctaaacaaacaccgccaaaaagcgcaatttaattatttaagaaataagggttgtaatttcataaaattaacagctgctgcattttcatttcttattcaaattaataattaaattttaaggtgaacgaacatg

SEQ ID NO: 99988 - DNA, 270 bp, Heterodera glycines
  Promoter: Source sequence=SeqID_13333; Location=804..1073; Strand=-; Gene=SeqID_77197
agataacaaataagtaccccggaatcttacagttcgaatggtttccttgtaatctacaattaggtaggtatacaattattactataagacatgcatatttaacatcaaaatttttttaaattttttaaggctagcagaaaaattagggaatgtcgaatgatatcaaaaatgctaagctttagtgtttgatggatttaccaaactcttgctcaaaaatcctcaaaaagcccctggttgtgtaaaccttatgtgcacaccgaggccccgatg

SEQ ID NO: 99989 - DNA, 563 bp, Heterodera glycines
  Promoter: Source sequence=SeqID_8541; Location=2420..2982; Strand=-; Gene=SeqID_68463
ggttcaaatccggccttccaccccaatttttcgcctaaataatatggtgacacttggcggacaccccaggtcgtttggtcttcacaccactcgacactccagaaacaacagctggcactggggcaaaagaaccggaggcgcgccgatccttgcatagcgggaacggcccaacgccatctctcgagcgagggcgctcgaatatgagaggaggggaatgtaatggctgatcgaaaatagctatgggagctgaaaatgctgtgggagcaaaacaacaggggccaaaatgaaggaaagatgcactggggcaaaagaaccggaggcgcgccgatccttgcatagcgggaacggcccaacgccatctctctagcgagggcctctaaaaacggccaaaagcggattccaatatattctagcgatcatcgattctttctcaaaattctgtgaccacaataccactacgagaacagtcgacaacaacaatcacctcggcttttgtggaaaaatttctatgttcctttggcttgccgaagatagtagttaccgactgtggtacccaatttatg

SEQ ID NO: 99990 - DNA, 837 bp, Heterodera glycines
  Promoter: Source sequence=SeqID_19384; Location=1..837; Strand=+; Gene=SeqID_84107
aaaccacttttcttttttgtgtttgcgtataaaaatcggggacttttatttgcatatttttgcatattttgaggtttttgtgcatatttatgcatatttcgccattttttggaaaattgttaacaaaaatgcaataaaaacggaaaatacaccccttaagaatcggccctaaaaaattcagaaaaatacacccctaagaatcgaccgaaaatttttaaaaacacaccactaagaattggaaattttctcaaaaattcttcccccaaattttttttcatgagaaaatttttgatttaaaaaatgtcaatatttgctaaaggaattttataaaagaaatgtagcagctcattggcaagtgcactggtaaaaaaatttttttttattgaatttgcagccctaattttcaattttttagtgcatatttggtgcatatttcacgactttatttgcatattatgtgcatattttggccacttttcgtgcatattttttgcatccctgattatcaaagtaatttacaattagaacaattcaatttaaaaatttaaattctcaatgtgtaactataagtattattaatgatatggtgcttggatttattattttttattattttgtgcatatttatcgcataaaactcgaataacagtattttacaggacaggacttcaactcaattagagcgaagtagtttttcagactaatgaaactgaataattagcgttttttaataaattaattatttttaaacaattttcgggaacttttccgttatgcctccccccccccccctcggtctacgtcagttgggccccggcacttatgggccccagcatg

SEQ ID NO: 99991 - DNA, 177 bp, Heterodera glycines
  Promoter: Source sequence=SeqID_12411; Location=2519..2695; Strand=-; Gene=SeqID_76019
ttttttggcattcgcatacgccgtttttgttatttctcattttggtacggagaaagcgaaaattcaagaaaacgcgctgctggctggacttgttgaggaaaattggaaggatacttcgaaactggaccattttctgagggatttgcgcaggaatgttggtgacaaaaagaggtgatg

SEQ ID NO: 99992 - DNA, 77 bp, Heterodera glycines
  Promoter: Source sequence=SeqID_35472; Location=810..886; Strand=+; Gene=SeqID_65018
ttcacccgtttgttgctgtacgttgggctgctagcctccagtatggggtttgctgtccttctgttcagtggcgaatg

SEQ ID NO: 99993 - DNA, 182 bp, Heterodera glycines
  misc_feature (161)..(161): n is a, c, g, or t
  misc_feature (167)..(167): n is a, c, g, or t
  Promoter: Source sequence=SeqID_31983; Location=1..182; Strand=+; Gene=SeqID_62298
aaaaaaaaattatttttttgattcatttttattaataaaaaaatatttttttttgaaaaacgcaacatttttactgggttttttttaaatcattaattttttctaaacaatcccaaaaattcgaaaataaaaatttcggtttttttaatgtccccatttcnccgtcncaggtggacacaatg

SEQ ID NO: 99994 - DNA, 304 bp, Heterodera glycines
  Promoter: Source sequence=SeqID_7172; Location=1189..1492; Strand=-; Gene=SeqID_64039
ccgcgccggtctctaattataagccagcaaatccagggcgaaagtgtccaacttgttgccgttggcccaggtatctgaccaatagaattgattatgcatttttcaaaacattaaacaaaacctgaaggtggtgagagagaaggaatagcgttccgtgctcattttggcaacaaaaaaaaaatgtattttgtgaataaattggcttaaaattgatacattaaacggtaatactgaagtttatcccccccccattttttggaaaaaattttttctgttctaaaaagtcgtgaaaacacgttttatg

SEQ ID NO: 99995 - DNA, 954 bp, Heterodera glycines
  Promoter: Source sequence=SeqID_1315; Location=3925..4878; Strand=-; Gene=SeqID_72415
aatggcaggaggacaaaaagcaaatcaaatgtcgaaatcggagacgaaaattgaaacggacgatcgatcaaacggacggacggacgctttctttcttttctttctttccacgacaaatgacccccccccccacagcgttttgtttggttttcactcactttcggatcagcagataaatgctctatccatccattggttttgactgctgtttgatcaattctctcttcgtcccatcctttgctttggccagcagttgctttttgctttttgccttttgccccccggcgctgtttcatcacttcccacaaatccctctcgccctcttaagtttccgtttggcgtttgcttcatttccctcattcttggccatgtttccttacgaagtccttttggacatttgcaaattcctcccccgtgcccatttggtctctctccaattcgccgaccgccgactttgcaaatttgtcaacgacaattccctgtattggcccctgcacaggtgctaccgattgacctttctcgaggtgatttcacatctgataattgccggtcaattgcctttttcagttcttcgcccttaaaactctctgccgcgcggataatctcagcgattttcccgtcgaattaccggtaataatttttataattattagagaacatttagtggattttcatctaattagacctaattacccccccccccctcccccaccaaattctcagccaaatttgtccgctcggctcgcgtcactccgttggccccccgcggcggatggccaaattccgctgtttctcaatgagactgagcccactttccttctgttcgagttcgtctctggccacaaattcttcgttcaaattggcccttttgtcaccgcccaaaatgccgcctcattaattttttggcttcatcaaatatcggaagtgtttttcgaagaagaaattcgaggaatg

SEQ ID NO: 99996 - DNA, 100 bp, Heterodera glycines
  Promoter: Source sequence=SeqID_34889; Location=444..543; Strand=+; Gene=SeqID_64580
ttgtgccggtcattgatggtacggtttgaaattgtaaaataaaaatttaataatataaataaaatcaaaagaatttgtcgtggatgacgctgtcaaaatg

SEQ ID NO: 99997 - DNA, 172 bp, Heterodera glycines
  Promoter: Source sequence=SeqID_43556; Location=778..949; Strand=+; Gene=SeqID_71205
ttttttattttatgaagaattttaaatttgattaaaaaatataaatttaaaagaatttaaaaatattttattggctcaaaattttatgttgctcaatgatcatgagcaaaagttaataattggattcatttagattaagaaaaaaattaattggttaatattacagaaaatg

SEQ ID NO: 99998 - DNA, 241 bp, Heterodera glycines
  Promoter: Source sequence=SeqID_31159; Location=822..1062; Strand=-; Gene=SeqID_61533
ttttttctgctcttcgtactgtgtacatttggggccgtacgagtgacatccttttacggtatatttaccattaccaagaagtacaaaggttttctttagggaatgataaatccaattctcccctcccaatttgcttttgctttttgccgtggcttcgctttttcacctgtaagtgaatttgcttggtattcgggcattgtcaacataacgttttgatgatgtcataaatgcctttaaaatg

SEQ ID NO: 99999 - DNA, 242 bp, Heterodera glycines
  Promoter: Source sequence=SeqID_35922; Location=819..1060; Strand=-; Gene=SeqID_65382
ttgtacatattttaggaatttttcttacatatttatgtacatatttggaccactttttgtacatattttttgcagccctagtaatagtataaataaataaattttattttaatgtattaatatttttttatgtttttttgtttgcgcgagtgaatgtttttttttttgagttctcttttcaccgcgcgacaactcttttcgtttcattgttctgatattttgggcaaaatgtgctgagaatg

SEQ ID NO: 100000 - DNA, 157 bp, Heterodera glycines
  Promoter: Source sequence=SeqID_6398; Location=614..770; Strand=+; Gene=SeqID_61410
cctaaaataaaagaatttaaattagggagggatccccattctttaggactattgcccaaattcgttatttttttcgaaatttagaatcgcaaagcgaaaattattgtcatgggttcctaccaattgggcgcactcaccaaacaatcagacatcgatg

SEQ ID NO: 100001 - DNA, 581 bp, Heterodera glycines
  Promoter: Source sequence=SeqID_29114; Location=429..1009; Strand=-; Gene=SeqID_59661
ataaaatttaattaagcatttaaggcaaaatattggtactttctttatgttattgaatttaaaatatagaaaattactatctcaaaattatgtacattttcagagggtatagcacataaaatcaatcctagcattaatagttattttaattagtctaattaacaaattaattaggtgactaatgaagcagatgaaacagtggaagatggagttttaaatccgttgaaagacattgccaatgccgaaatgaccatcaaaacgttgcataaattttgtattaaaaatggaaaaacgaaattttcagcggaaaattatgcaaatttattgtatttgaaggaaaatttgaaaataaaaaggaaacaaaatgccaaagaaaaattgcaaaatttgaatcagaatttgattgacatagcttaaaaaatgagttggccaatttgatggttgaggccaatttggacacaaccatagaatatgaacaattgatggaggaatgcgcaaagtttggcaacgaaacgcaaaaaaaagcgaaagcaaaaaatttggtggaaaaatttttgaaccgaataaatgtacaagaaatg

SEQ ID NO: 100002 - DNA, 483 bp, Heterodera glycines
  Promoter: Source sequence=SeqID_27252; Location=1..483; Strand=+; Gene=SeqID_57940
cattttgctcaattacacttcatgcatcgaagcaaaaatagcatattcgcttggttttatttatgaaatttatattaaattaaatattttttgctgtttcggccatttcgaattgtttagtgccaattttcttttatatttttagactgccgaaagccgttcctttggcattctgttttcccacaaaaaatattgccaaattcgactttggatggtcatcattttccttttcgttaccgttttccatccgtgccatgccccgtgggcaacaaaagtgccgaattaatttgtgtcgatggaggaaaatggcgagccatcggatgccaagaagaaggagatgagaatgaaaattatggtaaaaccgtaaaacattaataatcattaatttgttattacattagcaaaaattttaattttcgcacatttaaaaaataataatatttaaattaaaaaataattctaatcactttttttgacggaatg

SEQ ID NO: 100003 - DNA, 174 bp, Heterodera glycines
  Promoter: Source sequence=SeqID_19191; Location=1753..1926; Strand=+; Gene=SeqID_83940
aataggattggcaaaattaacgttttggaaaatttataaagttaaataataaaatttgtaatattataatattgccttttatggtaaattaaaaaatactactagaaaaagaaattttaattctcaagataattgaaacaaacataaatattttttaaaatatagaacagcatg

SEQ ID NO: 100004 - DNA, 453 bp, Heterodera glycines
  Promoter: Source sequence=SeqID_7426; Location=3009..3461; Strand=-; Gene=SeqID_46418
ataaaaatttgaaactccaacaacttttttctgagatgtcaaattgcttagccattcgctttgaaaaaaattctccttttcaaaaacttattttagatatcaaatttgttcggtttagttgggaatgaagcgagttatggctgatcatcaaaataaattgtgcaaaaaaaaaaacatttaccagtgtaaattttgaattagcgcgcaaaaattacgccaattacgctatttggcgttatgaacaattttgtctgacactggacttgactcatagtgagctaatccttaaattaatttgtccattcattctccgcactacaaatgaccatcgctatgtaccgcaatgtgttctcaaaaagtaaacaaatttgccccgcttggtacaaaattctgttgcgctcatcgcatgccgggggaagcagcagaggtcgtgtgtatgccgagaacaaaatg

SEQ ID NO: 100005 - DNA, 68 bp, Heterodera glycines
  Promoter: Source sequence=SeqID_10668; Location=972..1039; Strand=-; Gene=SeqID_73914
tggcaacatatcggtctgcttagcgaccatgatatgtagtgctcacgccggtctgctttgcgaccatg

SEQ ID NO: 100006 - DNA, 361 bp, Heterodera glycines
  Promoter: Source sequence=SeqID_66; Location=1..361; Strand=+; Gene =SeqID_60275
atttttgtgatttttttaaaattcttaggggtctattttctgaaattttttcaggtcaattcttaggggtgttttttcatttttattgcatttttgagaaggatttttccgaaaatcccgaaaaggcgccaaaaatggcgaaataggcaaataggcattaagcacaaaaagtgcaaaataggcaaaaataggcattataaaagtcatcgtagacaccccaaaccaagcggaaaatgcttttttcgtgcttatctaagcgtattaggtgcgcagaaaaaagaagccctaatgatcagtccctgtaatattatacctaatgaaataaatttgaaataaaaaaggttcaaagcgttcaattatg

SEQ ID NO: 100007 - DNA, 1003 bp, Heterodera glycines
  Promoter: Source sequence=SeqID_9443; Location=691..1693; Strand=+; Gene=SeqID_71441
catttatagggttttcagcagttcccctgcaaaattgggttagctttcgatcagtctagaacgttgggtgatcaaatgcaaaaaataattttaaaaaaataataatttaatcaaaaaggaacaaaatttaagagtatcacaaatagaaaaatttaaaaaaatgccttgcatacgtggagaatcgaactttagacctattcaatgcgaagtgacaactctaccgactccaccattgtgaatgtaagatgttccaactctcactttcttaatccgttatgcaaaaatgtttacaaaattaattttattttgtgacaagtgtataactttttattggtaagtgatttcggattttgaattacaaaagaacaaatcccacggcccggttaagctgcacaaaaaaagaattaaaatttgtcattcgaatgctcaaactttctcgaaactaggggaccggactggctagaaacggcactgatactggatagtctcggttacggtcttttttaggagaaaaatccggtccaaacctatttattattatccggactcggcgacggctgcataaatgggacatatagttgtttttaaaagttaggtctcaaatcccgggacggtccagtcgccgggatagacacctggcttagtccggcactgatatgaagccgatgccatgacaacttgtacaatggcatctcatacaaaaggcaaaaaaatcaacaaaagagcgcgcagctgatccattttacgaaattttttctgaaattgctgcatttatgcctttcattagtgttacgcgcgccttgtttattttgcgcgctcttttgttgattttttaaattttttgggtgctgataactccactcagagaagagctaaaaaaatctgaataggcttggactaccgtaccaactattatttttataatggatctgttaaatgcaaaaacgtcaacaaaatttgttataactccattcatagttgagatagaaaaaaaaacaatatg

SEQ ID NO: 100008 - DNA, 622 bp, Heterodera glycines
  misc_feature (7)..(8): n is a, c, g, or t
  Promoter: Source sequence=SeqID_16536; Location=2226..2847; Strand=-; Gene=SeqID_80944
tgaaatnntgaccacagcgatccaaacaataggcgccaccgcgagtttcgccccacccgccgttgaactacctgttggacacccctttcggttcaaaaaggctgaaaggcggggacgcctttttttttgattgttgagggatgttgtattttgataattaaattgactataattatttaaatatttcttggcttaatgtattttcttttgttatggcgttatttttttcatttaagaatggttctttttattcttctcagtctttgctttttgattgacttcaaccaaatttgtttgttctttttctcttttaaattttgtgttgtgattaaagtgatttgaattgactccggtatccttattcggttttatccctgcctctcaacccaaaagacccggaaaaattacaattgtgaaattttgaattttattttaagcatcaagaaaaatttccttaaataaagcctcaaaaaatgcagaaaaagaagtccaagtaggaaaatatgtacatttttgtgcatatttgcacacattttttttttaaatttgaaattttggattcattaattactttttattttgaaaataatttaataatgaatttaattcaaaaattataatg

SEQ ID NO: 100009 - DNA, 1003 bp, Heterodera glycines
  Promoter: Source sequence=SeqID_26424; Location=637..1639; Strand=-; Gene=SeqID_57155
tgaaaattaaagaaaaaatcactgcagcagagaagccaatcatacattaagaaatgaaactaaacagaggttaatacttgaacaaattttctcggtaagaaaaaagtgaaacgatcccagaaaaaccgaggaatgcaaaaataacaaatagaaaatgaatgtcagtcagtctatgtttcaaaatttaaaagcgttaaaatttttccctacaaatgccactgtgccgtacttcaaagtcaaatgcggtgatgtcgtttcgtaaaaattcgaggttttttaattaccacaaaattcaagaaatattttttctagataaagtaaataataaaaattttaataactttttttgaaaaaatactgaaaaatttcaaaaattttctttgtgaaattttcgaatttttttaagtttctgaaattgaacggggggggggggggtacgacacgagaggaaatgacaaattggtacttgtgcagtacgccccataaatttttttttatttttaaaaccaattttttataagttttcggggtcgctgatcactagggcagcaacttttagtgaaaaaacttttttttgctcaattgttttgaagaaaggagctcaaaaaacgcatttctgcgttaaaattttcatttggacgtcatttttcgtcactagaaatcaatattttggcgtttcgtcacttaaaatagtgaaaattcacttttttggcgttttgtcactatttttcactatttcaacattttttggaaaattccttaacaaaaatgcaataaaatcaaaaaatatacccctaagaatcgatctaaaaaaatttcaaaaaaatacaccactaagaattggaaaattttttcaaaaattcttcccccaaatttttttcttgacaaaatttttgatttaaaaaatgtcaatatttgctaagagaattttatataggaaatgtagctcatttgcaactgcaatcacttagcacacatgctactcctatggcaagttaatatg

SEQ ID NO: 100010 - DNA, 483 bp, Heterodera glycines
  Promoter: Source sequence=SeqID_32126; Location=1..483; Strand=+; Gene=SeqID_62455
tgctcggatcggcttcaaacaaaatagaacagctgttttttaaggattctgcatcgaatggtgaaaagtatttttttaaagctctaaaagaaaaaaagtttcttcagaaaatttttgaacatgtttcagaaaaatggctgtagcgggtcggtgtgcggatagcgtcttgggcttggagaaagggcacatcagaagactctgacggttcaaatgagctatagagcatgattatcagggctgcaaaaaatatgcacgaaaaatggccaaaatatgcgcataaatatgcaaataaaatcgtgaaatatgcatcaaatatgcacaaaaaaacttgaaaattaggggtgtaatataatttaaaaaaaaagtttcttcagcataaattttatcggttatttttgcaattgtagatcaaaaatttttcaagattttcggcagtaaagctcatcctattgtctgccaaaatattcttataaattgaaaatg

SEQ ID NO: 100011 - DNA, 691 bp, Heterodera glycines
  misc_feature (76)..(77): n is a, c, g, or t
  misc_feature (83)..(83): n is a, c, g, or t
  misc_feature (89)..(89): n is a, c, g, or t
  misc_feature (170)..(170): n is a, c, g, or t
  Promoter: Source sequence=SeqID_42655; Location=1..691; Strand=+; Gene=SeqID_70495
tttttggttctttaactaatagtgtttaatggatttaggagccccaacttttctggtttcaaaaatggatgaaatnnatattnttccanaattcattattcttttgatttttttattagagtgtcgggttttttagggtctcgccgggacaaatctcgccgcaaaaattnaaaaaaaattcaaaaattgaatttttcaaggaaaaaatcttagaaaaatttattataagaaaatataagaaagaaaaattattgttaagtttttcttgaaaattgcgcggccaaatttggaagttccatggcataaaaaagcaattttttctaaattttgaaagtttttacttttaatagaaaacttttggttttgtgtagcagtctctaagagattttggtcaaaaactttttgtcaaaaacttattgtaaagatttctcattcgttttttggtgcaaaagtgccctttttagggtttttgcttttttgttgaaatttattagaattttcacaacagcttagcaaaggaatagttttttttaaatattgtgtgcccaaaaaacgcgctccagttttaaataggctatgaaaataaaaaaaaactttctgaattcggcgttttttctaagggacagaggctttttgctgcaaattttttaagatttataattttcatgactttttcagcacgtgcgcaatg

SEQ ID NO: 100012 - DNA, 629 bp, Heterodera glycines
  Promoter: Source sequence=SeqID_23361; Location=248..876; Strand=-; Gene=SeqID_54072
aacgaacacctgatgaggcgacgatgactgtgacagaagtattaaaatggttcattaacggacaaacaaacaaaaaaacaaaaaaacaattattccgattccatttcattttggaaatgcatattcattttagaaaagtaaactctttttagtgttttaatttgcaaaattgctaatttgtaaattataatcaaataattttatcaaataattataattctaaatttattttcctttaataatgttattaaaattaaaatgcgaacggacaaccaaatcaactaaaggtattttcaattaagactgaatgaaaatgctcattattaattaaaacaggttttaattgtttgtttgggtttggctgtcaaaacattatttgggcacaaatttagaaaaattaattttctcatgggaaagaataaattaaaagaaataaaaagttatcgagaatattaaaatgtcagccgattcgccagtaattagagtggatgttaattaattaatgattgcctttgtctgtcaaaacaccgacccaaggcaaaataatttgactataaaagtccacccgaattgggcccacttttcattaattactccattttttaccaaattattaaattaacaaaatg

SEQ ID NO: 100013 - DNA, 170 bp, Heterodera glycines
  Promoter: Source sequence=SeqID_5907; Location=2829..2998; Strand=-; Gene=SeqID_59634
ttcagagtaccaaaatagtgaaagaactgttttccaatcatcacttaagaaatcaaaattcctaaattgagtaaatcaaaaaaccaatccacttttttagcttatctgactcaattgctctctcttcctcttcttaccaataaacctattcaaattttggtcgcaaaatg

SEQ ID NO: 100014 - DNA, 263 bp, Heterodera glycines
  Promoter: Source sequence=SeqID_13399; Location=1510..1772; Strand=+; Gene=SeqID_77285
gcgacaaaaagtgcaaatttaaataaaattccatcgttgggcaaattttagattttcgaaatttttcatttttttaatcaacaagcatcaaataattgattgggggaggtgtgaaaatactcggcttgagaaattccaagggttttccggtctcaatttgggagtgaataatttttaaataacttctttaatgactatttttgtttcgtcctatattaattttggccaattcccccgtcatccatttcagtacattcccaatg

SEQ ID NO: 100015 - DNA, 213 bp, Heterodera glycines
  Promoter: Source sequence=SeqID_9828; Location=268..480; Strand=+; Gene=SeqID_72841
aatttgaaaactttgatttgcccactatggcgctaatcacaaaactcattaccactgccagcagtcttctaaatccctgattatttgtctaccattttcatgcaaaaaccgtttactaatggactaaagaggctaatttttctcttctaattttgaaaagggaataaagagcaaaaatgctcgcttttgtctcttttaatttatcaaattatg

SEQ ID NO: 100016 - DNA, 182 bp, Heterodera glycines
  misc_feature (30)..(30): n is a, c, g, or t
  Promoter: Source sequence=SeqID_7477; Location=1..182; Strand=+; Gene= SeqID_64938
agaggaaagggattgttgatgaaacttttnaatgtgttgccttttggatattattgaataaacttttgcttttattcctccgccttgtaaaaaagtaaatcatcctttatataaggcatgaattgtatcaatcatcatctatttaagggtagaatttatcaattaaaaatactttaagaatg

SEQ ID NO: 100017 - DNA, 1003 bp, Heterodera glycines
  Promoter: Source sequence=SeqID_26598; Location=63..1065; Strand=+; Gene=SeqID_57334
aaagttggccgaatttttccattctttatgcgcaaattattatcaactgataaagtttcgtctaatggattgattattaaaaatattagaaaatttaaattataaattttcatttcaaaaacaaaataataaattgcttttgctttttttattaatgaaatggtgacatttaaaaaatataatttaaaataatatgaaaatatgacttcgtcatattacgtggaaaatatattaaatggctgtaattatttaaaattggtaaaagattgatttacaattgtttaacatggataaagtttaaaaatgagcatcactgtagaaaatggaggaatcaacaattttcaattttatgtgcaaatttatagttttttcgctgccctaatgccaaaaaaatccggcatgtttcgaaccagcaaccgcaccaacccgtaccatggtgtgcaaaaaccaaaaaaaaaaatgcttttcaaaaggaacgaaatatttatttttcacgaaaattaaaaaccgaacgaaaagaaagaaaaacacacgaaaattttcaaacaaattttacgcataataaaatcctcaaattctgatgcaaaaattaaatttttcaaaatgttcgggtggagacttttccgcatataattaagatgaaaaatagcagttgagaagcatcgtttaacaactattggggtgatggagtcctttggataaaattttaaaataattaacaacaaatatttttaattactgagaattgttggagaataagaaaaatgtacaaaagtcttacattttttaaattttattcatattttgaataatttaaaagagcaaacgttgtgaagcgtcatttcccccaacctaattttatttttctgactgatttgtgtggattcggccctccttttatattgcctagggcacaaagtatccgatattatttgatccattagcattttatgtttgtgatgccaaaaggaatcggtgtctgtgagagaaagtgggataaatg

SEQ ID NO: 100018 - DNA, 1003 bp, Heterodera glycines
  Promoter: Source sequence=SeqID_4589; Location=2193..3195; Strand=-; Gene=SeqID_55002
cgacactgagtattttcgacactaagtaatttcgacactacgttttcgacatagagaaatttcgacactgaactatttcaaaaactttcactgttttcctgcattttcgacactgaaccatatcgacattgagtaaattcgacactatagagaattttttagaaagtaatatggaaaatttgaaaatgttagtacatatttatgataaatagggcgaggatttctagttttttaacaattttttctgcggctttattttgatgagaaatgcacaaaaaacacattctttttcaaaaaattttcgtttttagtgccactattcatcactagattctcagatttagttggagatgctgcgagttatggatgatcaaaacaaccaatgcaaaaagggcagtgatcactgatcagtatttttttttgaattagggcctaaattatgctatttggcattatgaatcattttttctaacactggatttgatttgtctaacattgatttaaccaatagttataccatctacctttttaagattacgaattagaaaataacaggaaaatttatcataaatatgtactaacattttcaaattttccatattactttctaaaaaattctctatagtgtcgaatttactcaatgtcgaaatggtccagtgccgaaaatgcaggaaaacagtgaaagtttttgaaatagttcagtgtcgaaatttctctatgtcgaaaatgtagtgtcgaaattacttagtgtcgaaaatactcagtgtcgaatttacccagtgtcgaaattacatagcgccattttaattacatgtgaaaatttaaaaaaatataaattttgatttacacccatttttaatacatttcgccataaaaagacgaaaaaaatttatccaggaaatccaggtttttcatgcctggacctggatttccaaactgacctggacctggatttcctggacaaaaatccaggtccaggaaaaatccaggttgccgaaaaatg

SEQ ID NO: 100019 - DNA, 316 bp, Heterodera glycines
  Promoter: Source sequence=SeqID_23285; Location=1362..1677; Strand=+; Gene=SeqID_45772
aaaagatgtcatctcaacagcacataattaattcgaatcgtatactatcattgttttttgtcattgatttatttttttgttttcgtttgtcggccgttgttttttatatctgtcgtatgcgccgccgccgttttttgtttttgacaaaaattttttgattttttaaaagattatttcatcaatcatttgatatagtatacttatttatttgtccggattaaaacatttttttatttgcctaccgatttttatttgtttgtttgtgcttttttctccatttgattattccaaacaaattttgtaagccccgaaaatg

SEQ ID NO: 100020 - DNA, 57 bp, Heterodera glycines
  misc_feature (7)..(7): n is a, c, g, or t
  Promoter: Source sequence=SeqID_19980; Location=1878..1934; Strand=-; Gene=SeqID_84748
aattttntggtgcagacaaatggcacaattaaaaatgggggattggcatcgaaaatg

SEQ ID NO: 100021 - DNA, 1003 bp, Heterodera glycines
  Promoter: Source sequence=SeqID_16716; Location=2440..3442; Strand=+; Gene=SeqID_81118
gatgaataagcaaaaaagaagaaaacattttttatgttcattattttaacaatgtgttaatgtcaagatgaaaaagccaaagaatgaaaaaaataattaaaatgtcggaagaaagaatgaaaagatgaataagcacaaaaataaattgaaaagaaatttatacaaaaataaaataagaaacatttttaaattcacctcaatttatgcataacaaatactacaacaaaataaaattttaaaacaaacgaaaaaaaaaattgcaattataaaacaaagttttaaagtttatcagttaaaatttggatttcctcgaaaattggcgagcttcaattgtggaaggttctcgcgcacgttcgttcagcccccaactgtttaacgaaatcaggtgacaggctgatcatagaataaacaattaacgcctaactgcagacaaaaagtttctcaaaaattgagttaaatttttaaataaaaaaatttatgaaagcaaatttataattttaaaatgtttacactgtgaattttcacaaatttatgtccaataaaattattatagtaaattcgaaggcaaattaaatgtctaattttaaaaataaaacgaaaaaaggaaggattttttaatgaaattataatagaaagtttcaaagtttatcagttaaaatttgaattttcctcgaaaattggcgagtttcatttgggaaaggttctcgcgcagaccggatttgaatggacaaaaataaaatccaaaaatgcattaaaaaatggacgaaaaatttcagaatatggatgaaataagcttaaaaacttcaaaatagccaaagtaaagacaaaaaattcgcaaaaaaattttgttctatttttatagttggcatatgtatttagaaaatttgcaaaagtgcaaaaatctgtcctaaaaatgcaggaaacatttttttgagaattatttttctcaattgaaaaattttaaataatttttattaaaaatagaaatgttgaagattaaatg

SEQ ID NO: 100022 - DNA, 126 bp, Heterodera glycines
  Promoter: Source sequence=SeqID_6334; Location=555..680; Strand=+; Gene=SeqID_61178
ttcttttgaagtattgggaccgtttcaaaaaaccaccaaaacaacgaggccatcgtaaaattgaaaaagtgccggaaactgtcttgtcaatttgctccgacgaaatgtcatcagacaaccaaaatg

SEQ ID NO: 100023 - DNA, 762 bp, Heterodera glycines
  Promoter: Source sequence=SeqID_41935; Location=784..1545; Strand=-; Gene=SeqID_69969
tagatttaaaaaaaattttccatgtcaacgaccgatctcctcccaagacatttggtgccaaggaatgtttagtaagcaaaccttttgtgtcagcttatttggccaaaatgcgaaagaataataaattggtctttgggaaattggccaataaaaaaatagaaaataaaaaattgcgtcattaaaactgtaaattaattgtaaagaaacaatgccccgaaaaaaagcgacgtcaatttctacctgaacaaatagagcgattggatcaagaatatcaggctaacaattatttggctgcttctcaacgagaaaaattggccaaggaaattaacctcaaagaggcgcaaataagagtgagaaatatacaaataattatttaatttaaactattaaaatatggaaaacatggaaaactttgattatgcaattaagaacgcggtcattaattaataattaattgcaatgggttagtcttttcagcgaaaaaaactttgaattatggcgtgtttcgtcctaaaaagccataaaaagttcattttttcgccctaatttatttttctgtgcaatttttttcccttttcgagatataaagcttgataagcattctctggatgaatgcaagattatttacatgatttgtttacatgaaaaatgaaaacatttgtcgccgaaacggccatttgtccccaatttttatagatttggttccaaaatcggcgttacaaatgtggactaaaagaaaaagaagcaatctcttggtaaatg

SEQ ID NO: 100024 - DNA, 169 bp, Heterodera glycines
  Promoter: Source sequence=SeqID_9708; Location=261..429; Strand=-; Gene=SeqID_72436
gctctaacaaattcaaatacttttgattgataaaaaacaaagaaagaatttatttaaacatttaaatttattatttttgttaatttttttaattggaaaagaaaaaaaatttgttgtcagtttttctgtttatccgacatttacatttaattttttttttcagaaaatg

SEQ ID NO: 100025 - DNA, 93 bp, Heterodera glycines
  Promoter: Source sequence=SeqID_202; Location=4146..4238; Strand=-; Gene=SeqID_77386
ttcttcggtgccgatgacaaataatggtatcaaactttgccttgttttaaatgtttaattttgcatattgtccttttaggcattgtgccaatg

SEQ ID NO: 100026 - DNA, 87 bp, Heterodera glycines
  Promoter: Source sequence=SeqID_39381; Location=692..778; Strand=-; Gene=SeqID_67957
taattagttgttgattacttacgaaagcaattaaattatcccttttcccgtccgacaaattgtgaaattaaaaaacaaaaataaatg

SEQ ID NO: 100027 - DNA, 418 bp, Heterodera glycines
  Promoter: Source sequence=SeqID_10136; Location=961..1378; Strand=-; Gene=SeqID_73231
tatatggttgggatagagaccgtacggcatcgggataccgacctcgagatccgtaccgatggctttttcataaattctcgagactgatcgggattcctccgaccacagagcgagcggatccggtgaggggaaccgaagcagccaccactctcacaatatttccaaggcttggaagcgaatttgtctcggcagctgacgcacggtgagcggaaatggagccgtattgttggcataaagttgcgctttcccgcgggggcgtgtcacgcgtgacacgagagcagtcagcacactgttagtgtgcagctggcactcagcatgagacggctcctgcacgtggccgttgcgcctgtcggcacagccgccgcaaattggtggcgtcactacgacgagtgccgcagcggcggccgccgcgacaatg

SEQ ID NO: 100028 - DNA, 141 bp, Heterodera glycines
  Promoter: Source sequence=SeqID_24547; Location=1..141; Strand=+; Gene=SeqID_55270
aggggaaattcatcatcatatgatggagaaagctcttataattcatgcgcatggtgtgtgcttgtggggagggattttgtccatttattttgccatttccccctaatttcgcattcatttgatttttttatttttttcatg

SEQ ID NO: 100029 - DNA, 255 bp, Heterodera glycines
  Promoter: Source sequence=SeqID_17034; Location=1957..2211; Strand=-; Gene=SeqID_81457
cattcacaatgaaaggtcgattttgagcttgacagcggtgccgatgtcacagtgattgacgagattgattggaaatgcatcggaagcccaaaattggaaccatcccaaggattggtagcctatggcggaaaagccatcggtggcattttgggaaaggcaaaggtgaaagtgacgcacgaaggcagaacgattgagtccaatattcatgtcataagtggtaagcacaaaaatttgtgtggccgcaatttgatcatg

SEQ ID NO: 100030 - DNA, 719 bp, Heterodera glycines
  Promoter: Source sequence=SeqID_15316; Location=841..1559; Strand=+; Gene=SeqID_79554
tattttatttttttataaaatagttagatatgtaaaaaatatattttattttaaaaaattaattaattaaaaaacataaaaatagattaaacaaattaaaaatagaataggtaaacaaaaaaatgtaatatataaaaaacacagaattaatgggagtcgaaccctcagccatcgcagcacaaaagtcaggcacactaaccacttgaccaccgagtcacttgccccattgccatttaattcccttttccttttccttcttttttggaagaaatcccgaccaaaagtgcttgagctccttttttagggcacttcccggacccggaccaaaacaaccctggtatcattcgaaagccaagagtttgtagatgtgcacaaacatatttgttttttgatttgaccacttttaaggcatgcaaaaagcgttcaaaaatgggacattcaataaagtgtgattttttgacttgtttttcgaatgcagttcgaacagttctaaaccgatcgaaaccgcactatttttcccttatagcccttaaaaaactacgtcgatagaccccacgatcgacctgtaaaactcgctagaaagtcttaaattagtttttatgcttggatcatgggtataaatttcttatatagggaatatgtaaaaacaattttagctgtcttctccagtcaattatcactggtaaaattaccatcgaaaagaagttgaggaattcatg

SEQ ID NO: 100031 - DNA, 1003 bp, Heterodera glycines
  Promoter: Source sequence=SeqID_13788; Location=2153..3155; Strand=-; Gene=SeqID_47155
gaagtctttccgtgccatacctggtgcctatcgacatctgcgagaaattttatgaaatttaatacgatttgttaacagattttgtctaaaattgaccaaatgacgcagtttttgactcaatttctacaggattattaagtaaaagcctatccggcggtgccgataggcgccgccgggaaaatttcacaaattttgaatgaaatttgcgatgaaaaatgagttaactttaattaaatttattatttaatttatttaaaaatatttggcattctgtcttagaaaaattttcaaaaaaatcaataaaatcccgcataatcccgcacaaaaaatcaaatttgcggatcccgctgcgggattggaactcaaaattctttgcgggacgggatcccgcgagattaatcccgcaaatcccgcattttccaaaaaatgcgggattgcggactgggatcccgcaaaatcccgcgcgggatcccgtcccgcgccggtctctaaatgaaccgccacactgatggatgatgacacgaaaaggcgcgttgcaatcgccggtgtgctgcttccgcaaagttgttcgtccgatcctgctcgtgaacagttctttcgtgcaaaatgtccttattgtttttgttctcacacctccaaaatttgataaaaccatccgcactaagttagcgaaaacataaagatgcccttcatgctcaattttttttgtggttattctgcgataatatattatttgccatgaaatgatagttaaatttaaaaaatagctgaagaaaaggtattgtagttaggcactgaacgaaaaaaatataaacacaaattagattattgtaaacgaaacacacatacctatgtgtatgtaatgaaaaatatataaataatattatacaataatggtggaaaaattattgtcccttggggcccagttggcggggcccagtcggcggggcccagtcgtgcccgtccgttcttttgtaccgttttcccgctaccgtatcagatg

SEQ ID NO: 100032 - DNA, 410 bp, Heterodera glycines
  Promoter: Source sequence=SeqID_683; Location=1801..2210; Strand=-; Gene=SeqID_58945
ggtgagtttatggagtatttggtgtgtattgtaattattgttgagttttttttctcgaagtgagcagctcgcttcccacacccgaaatttaaaaaaaaatttagaaaaaaacgaaaatttttataaaaaatacaaagaaaattttcatagcattaggattatgcgttgaatatcctaaaaaaattgccccgtttttgtgaaaattcaaaatttaattttttttttttttttttctttaggttacatgcaaaaaatccgcgacctggtcaacaaatttcaaagtgcaaaatctgagcgaccggggcgagtacgtgttccgcgttgcggcaaagaatgcggcgggttggagcaaaccgtcgccccaatccgaccgaatcaaattgcgacaacgctatggtccgccgggaatg

SEQ ID NO: 100033 - DNA, 71 bp, Heterodera glycines
  Promoter: Source sequence=SeqID_15265; Location=3191..3261; Strand=-; Gene=SeqID_79476
tagcaaactaaaaatgcaattgcatttgcatattgtttttagaaaattcacttcaccatgccatccaaatg

SEQ ID NO: 100034 - DNA, 232 bp, Heterodera glycines
  misc_feature (24)..(25): n is a, c, g, or t
  Promoter: Source sequence=SeqID_15015; Location=2441..2672; Strand=-; Gene=SeqID_79172
ccccttttcacacagttatgatgnntatcagggatggccgagggtttcgcttttcgcatttcgcctttcgcattattcgcatttttggcgtttcgcatttcgcttttcgcatttcgctttttggcgcgaaatgcgacttttacacccctaagaattgattaaattcccataaaatttttcaaaattttacctataaattggctaattttcagtgaaaaactgtttataaatg

SEQ ID NO: 100035 - DNA, 261 bp, Heterodera glycines
  Promoter: Source sequence=SeqID_18413; Location=159..419; Strand=+; Gene=SeqID_83008
ttggtttctgccacaactgttcaagttgaccgaccaccggacttggcaattgggcagtttggactcttcattttgccggccaagcacgacaaagcttcagatcagaaaatcatttctcataggccaattatgggaaaagggataattgaaacccttcccaagttccaattccccttcagtgccgcaactgacattcattttgctgaaaaaggcatcgcagcagcattgtcgtcttgttttcttaaaaatcggataaaaatg

SEQ ID NO: 100036 - DNA, 742 bp, Heterodera glycines
  Promoter: Source sequence=SeqID_5470; Location=714..1455; Strand=+; Gene=SeqID_58172
agaaacactgaggatccgacaatctgagctttaaattcacacacacacacatatatcattttgcattttcatataatcatttttaattgcattttcatataaccatttttaaattgcattttcatttatcattttcaaattgaaatttccatatacgcattgaaataaaaatttgaactcaatataatgccaaataattatataagattatggtatgattaatgaattttgtccaatggtagaccagaaagggtccatatttaatcattaaaagtgaaattttgaattttgggctttgtgtaaatgattcataaataagcagtttgcacacgatgggatgttttgcatattaaaatgggtcagttttcgggatctcacccaaaaatttgaattttgagcttcacatttgggcttagtgaataactaatcgcgcaaatattggtgggcatcaaagaaacggggtgaaaatctgggtcatcaatcggcacgcgagaacatattgtcaacatataaaggcgcaaatccccgcagtcatcctcatttttaaatgtaattcgtccaacattgttcataatttatttttatttaatttaatttaataattcaaattttatttccatttctttaataattaaattccaattaaaataattaaccactttttataattttaattccattttccctaaatctcaatttatcccatcattttcaaaaatgtccaactcttctttaaaaaatg

SEQ ID NO: 100037 - DNA, 271 bp, Heterodera glycines
  Promoter: Source sequence=SeqID_16824; Location=2044..2314; Strand=+; Gene=SeqID_81241
gttgcacactttttttttataatgcaaagtagtcagataggacacagtagtgtgtctgcacgggtaccaccacacacataaatgtgtcccagtcaataagtgctccaagtagtcagataggacacagtagtgtgctgagcacttttgtgtctgatttaaagaacttaaaaagtttcttaaaaattcacttagggaaaaatgtctcaatttaaaagtctcaaaagtgtatatttaactagatggaatcggttttgaagtgccattgactatg

SEQ ID NO: 100038 - DNA, 417 bp, Heterodera glycines
  Promoter: Source sequence=SeqID_37376; Location=927..1343; Strand=-; Gene=SeqID_66468
aaaaggaggcgagttggcccacaaaagaatttttataaactccaaaataaaataattaataattattaggaaaatgattttaggcacagaaaatttcaaaatagatataatgtaaaatagcacaaaaaacagcaaaatagaggtatataaaaaaaattttattatgatttttaagtagcaaatttcaattgaagacaaaaaatcaaaacaaaaaaaaaagaaaccgaaaatgagctaaattttaaaaaccaaactttttcgagaaaaacaaacaaattttaggtgacgaatttttgaaaaatttattttgaaattttagattttttttttattgtattttttgttaaggaattttcatttattccccaattttattttgcattttcttagcttttaaaagcgcacaaatgcattatg

SEQ ID NO: 100039 - DNA, 826 bp, Heterodera glycines
  misc_feature (13)..(14): n is a, c, g, or t
  misc_feature (33)..(33): n is a, c, g, or t
  misc_feature (35)..(35): n is a, c, g, or t
  misc_feature (47)..(47): n is a, c, g, or t
  misc_feature (65)..(65): n is a, c, g, or t
  misc_feature (72)..(72): n is a, c, g, or t
  misc_feature (81)..(81): n is a, c, g, or t
  misc_feature (93)..(93): n is a, c, g, or t
  misc_feature (95)..(96): n is a, c, g, or t
  misc_feature (98)..(98): n is a, c, g, or t
  misc_feature (118)..(118): n is a, c, g, or t
  misc_feature (123)..(123): n is a, c, g, or t
  misc_feature (133)..(133): n is a, c, g, or t
  misc_feature (135)..(135): n is a, c, g, or t
  misc_feature (137)..(137): n is a, c, g, or t
  misc_feature (139)..(139): n is a, c, g, or t
  misc_feature (153)..(153): n is a, c, g, or t
  misc_feature (181)..(182): n is a, c, g, or t
  misc_feature (192)..(192): n is a, c, g, or t
  misc_feature (198)..(198): n is a, c, g, or t
  misc_feature (207)..(208): n is a, c, g, or t
  misc_feature (215)..(215): n is a, c, g, or t
  misc_feature (249)..(249): n is a, c, g, or t
  Promoter: Source sequence=SeqID_5330; Location=1..826; Strand=+; Gene= SeqID_57700
catcaattcttgnnttttattatttctttattntnaataaaaaactnaaatatcacaattaaaanccatatnaaaaatttnaaacccaaaatntnncnattccctccaaaactaattnttcancaaaatactnantnantttatacaaccatncataacatatacatctacttatataatnnaatacaacantttatnaacatatanntaatctnatatatcatatatcatccatcaatcacattattntttctgttcgggtggtcaaccccgagagatgaaagttcacaattgcatttattttcccttggcatttgtctctttcttttcctcttattttccccactctctaattgttgtgtcttcctttattaatgtaagacactattgatttatttggtccaatgcatgtccattcccctcattcattcggttgctttttatgcacttatttctcttcgcctaaatttttgttctcctccaatttatttattccgcctccgacttcgcccatttttatttaaaattgtttaatttatttgttcatcaaataaacattttattgtgtcggcttgaagaccgaacaattggcgacgcccgtcttaaataaagactcaacgacggatattttggcaatttcggacagattccgaattgctattcaactttcttcaaaaaagcaatagacccaataagggtgagcttccgccaggtgcggtttattcatcgaaaaaaaaccaagatacccaggtggttgcggtttccgccaggtgcggtttactcaacaaagacaaggaaattccccaaaagttgatcaacaaaaatg

SEQ ID NO: 100040 - DNA, 64 bp, Heterodera glycines
  Promoter: Source sequence=SeqID_13828; Location=442..505; Strand=+; Gene=SeqID_77766
tgtgggttatatttaaaatttatagaattcgtgcacaaaaaaagcaaattcttagggccaaatg

SEQ ID NO: 100041 - DNA, 51 bp, Heterodera glycines
  Promoter: Source sequence=SeqID_43074; Location=354..404; Strand=-; Gene=SeqID_70838
taattgacttaattaccttttaataccctcgcactaattactctcaagatg

SEQ ID NO: 100042 - DNA, 60 bp, Heterodera glycines
  Promoter: Source sequence=SeqID_24694; Location=488..547; Strand=+; Gene=SeqID_55440
ggtaagaacagtgccaaagatgctactgtacaatggtaatacatttcaggaaaaagcatg

SEQ ID NO: 100043 - DNA, 1003 bp, Heterodera glycines
  Promoter: Source sequence=SeqID_1915; Location=1510..2512; Strand=-; Gene=SeqID_76780
ctctcgccaaactctcgctctcgtctttttggggactctcgcctctcgccaaactctcgctctcgtctttttggggactctcgcctctcgccaaactctcgctctcgtcttttctgagacaagtcacacccctggtgtataatatgatttaaatggtgctatagttttatataatcaaatataaatttttaaaactatttgcgtgctcccgggacagaacccgcgttgcatcgctcccctgtggctgcgctactaccaagtgcgctatttgcacgactaatccgttcccttctaaagaaaatttatgatgaaattttcctttctttttttgattattatttgttaatcataaacagaaattttgatttttttttttgcaaaattaaaatgggaaatattataaaagggcgcaccccatccgtgtctcttttaggtggggcttagaaattcaaaaaaaacatatcaattcatttttaaaagtttaggtttaggccttagaattttttttttggtagcccaggttaactactgaattatactaaaaacgtatgttttgtaagcattggattaaaatttgaagaaatgtccctattattcaccacaacatttttcgcctcaaacatcataaaattgaatgaaaaatcaagatgaaatctgagtgagaacccaatcatttgaatttatcacgataattgaaaaatgatgaaataatgaaagaaattataatggacaaaaagaaggacaatgagaaagcgaattaatggtgatattttcatttagaaacagcaaaattcggttcgttttggtcagttgccaattacgatttgtaatgtttttaccgataaaaaatcgtaatcgttgaaattgtgattattttttgttgaaaaacgtgaggaattgatatttgttcatcagcaacaccggactttttgaagccattcagctgcagaacctttgaacttatgacgacggtccaattcaaaaaatccttttattcccgatg

SEQ ID NO: 100044 - DNA, 268 bp, Heterodera glycines
  Promoter: Source sequence=SeqID_34404; Location=569..836; Strand=-; Gene=SeqID_64205
ttaaatataagcctaaactttttggcctgtttaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatg

SEQ ID NO: 100045 - DNA, 351 bp, Heterodera glycines
  Promoter: Source sequence=SeqID_6949; Location=1969..2319; Strand=+; Gene=SeqID_63379
ccaataaagctgttaaaaacgattttggagttatgccaaaaaatgttttctgttttttagtaaaaaggttaaagcgtataatcgaattccaaaaaaaaaaataaaataaaatttcttcttagaatgcgtatatggtttaataatttatagatttttaaatttatttaccgttataattgttttataagaatataaatttaattatttgaaaaattgagccccctgcggctctattagaggaaatgcttatgtaaatcgatttgcaaatatttgttacctaaaaaaactattttggagttatgccatcattttcattttctatcaccattattcttttcgtcacattgaatg

SEQ ID NO: 100046 - DNA, 453 bp, Heterodera glycines
  Promoter: Source sequence=SeqID_29991; Location=961..1413; Strand=-; Gene=SeqID_60452
aagtttggtagcttttctaataaagttatcaagcaaaatttgtttgatttttgagggctttgtattttaacggccgcgcacataatgatgattttttaaataacgacctcaattttccgatcccgtccgggagccgttgtaaaagaaggtggttatggttaaataacctctgatgagggggctaaagcccccccgaaacccaaaaagtaaaaaattctcagaaatttttttgaaattttaagcaattttcttaacaaaattgcattaaaatactcaaaaattttcccggcggcgcctgtcggcactgccggacccctccctattttaccatagaaaaatggaggacaaaatggcaaaaaaatattaatttttggcgaaaaacggcgaaaaattttgtaaaatacaccccataaatagggatttcaaaaaaccaaaaatacacccctaaaaatg

SEQ ID NO: 100047 - DNA, 91 bp, Heterodera glycines; identical to SEQ ID NO: 98538
  Promoter: Source sequence=SeqID_43622; Location=846..936; Strand=-; Gene=SeqID_71250

SEQ ID NO: 100048 - DNA, 367 bp, Heterodera glycines
  Promoter: Source sequence=SeqID_3969; Location=185..551; Strand=+; Gene=SeqID_52624
aaagatgcacatactcatgaccttgattgttaattaaatgatttttctgttctttctcgtcaatttcatagtcagatttaatggaaggggcaattaaaaataacattaaaacttttatttatttattatgcataagtaatttaatgcagaaatttatgtaaatttattatttgctaaaaatgagaattgcttaactatcattcgatcagtaattattattcaaaaagtggatgtatagtcaacaagaataattatttttattaaatataataatacaattttaatttatattaatttataatgaaaattatttaaaaagtaaaacatatttccttgattttttataaatttgtagaattaaaaaatg

SEQ ID NO: 100049 - DNA, 165 bp, Heterodera glycines
  misc_feature (111)..(111): n is a, c, g, or t
  misc_feature (117)..(117): n is a, c, g, or t
  Promoter: Source sequence=SeqID_20396; Location=1..165; Strand=+; Gene=SeqID_50922
ctgccaatttggcgatgtgtgcacgggtggtgtccacgcgtggtgcgcaaaccaccggatgccagaacgatacatcgaattggacgaaaacggcaacaaatttcggccacncaacancaacagcaccagcaacaacaacaccgtgtgccaccactgtccaccatg

SEQ ID NO: 100050 - DNA, 1003 bp, Heterodera glycines
  Promoter: Source sequence=SeqID_1238; Location=279..1281; Strand=-; Gene=SeqID_70470
ggaaattccttaacaaaaatgcaataaaatcaaaaaatacacccctaagaaacgacctaaacattttggtaatactttggtttgtcccccccctattcaaaaaaaataaaaaaattttaaatctcttaaaacatctctcctggggtttttggggccactgatcacgaatccggcatccgtttcgacccatttcgaaccccggacccaaattcgaacaaaaatcgaaaatttatttttcaccaaaattcacactgcagcgactcgtggtcacaaaagacgttcaaaatgaaagagcgatggacaacggccaatagattttgaatggagaatcgcacgactgccaacgaacgacctgcacccctaagaattggaaaattttctttaaaattcttcccacaatttttttttttagttaactatttcgagattttccgtcactaaaagtagcgaccctactctgatgatgatgcagggctggatggagtcggagatgggaacgaattgttcatttattagccccttttactgttgaattgagtttaattttttttttggaaaatgtgccaaaaaaattatttaaaaaattctatttatcccccctggcacataaatggagactggtatattatttttcaacctcctcagaagggggtatataattggaggccggcagattaatggagactggcatataaaaagagtatatacggtaacccaaaatcggtcatttcgcctactgacatttcgcctactttcatttcgcctactaattagtaggcgaaatgaatgtttttggcttagtaggcgaaatgaatgtttttggcttagtaggcgaaatgtcggtaggcgagatgtcgagtaggcgaaatgtcagtacattttgcatatcgatagacaaagaaattaggaacaaaatgtaagggtttttaagagcaaaaaaagggttaactaaaaagttataacggtttctcttctaaaattcttattttttaaattttagatg

SEQ ID NO: 100051 - DNA, 88 bp, Heterodera glycines
  Promoter: Source sequence=SeqID_13477; Location=1234..1321; Strand=-; Gene=SeqID_47131
ggttagaaattggatgaatttatcaatttttagctccaattgggtcgtgtaaaattaatttatgcaattgcttcttcttcttcagatg

SEQ ID NO: 100052 - DNA, 585 bp, Heterodera glycines
  Promoter: Source sequence=SeqID_2528; Location=658..1242; Strand=-; Gene=SeqID_80219
ttttgaaaaaaagcctagacctggacatggatttttttccatatttcgtctgaactggatttcctagataaaaatctatgtttgcaggaaaaacggcttgtcaaaacttgtttaattaaaataagcaaatcatttgtaaacgaagaatttggggacaaaaataagcacattttaagttaattttaaggcttaaaacggccattttttcaacaaaatgttttcagcgcattttttaaagtccggcagtgccgctaatcagtgccggaagtttttgaaaaattcaaataaattttaagaaaatatgtatagatttcttatatatttttttagtttttattgggacctttttaaagagttttttgctttttatggtacattttgccattgacctgagaaccaacgccttttttacacacaataagtgctattttgtattaatatccaattgatttttgccgtttttgtgttccatttccctcctccaaatgaccaccaccaactcactcactaattattcatattccatgccaaattttttaattatttcactaatatccataaattatttaaaatttttaagccatg

SEQ ID NO: 100053 - DNA, 310 bp, Heterodera glycines
  Promoter: Source sequence=SeqID_3634; Location=631..940; Strand=-; Gene=SeqID_51205
ttttgagaggcgacggcattgaaatgggtgaaaaaaatgaaaaatgaaatggacaccctcaacggagcgccgtgccgtgggcaattggcggcaaatcgcgcaaaagagcaaaaagttgtcgcccgaaggcattgcgaaacaaaaaattccgtccattgaaatcaaaacaaaaaattttgcctaaaactgaactgcaaatttttgttttgaagcgattgcttcggtataatttttagtgaatttttggggtttttttttttaattttgaggtgaaaaatggaattttctatattcagagaaacgaaaaatg

SEQ ID NO: 100054 - DNA, 283 bp, Heterodera glycines
  Promoter: Source sequence=SeqID_29673; Location=1..283; Strand=+; Gene=SeqID_60141
agatgtgtaccaataaatagagaatgccagagaaaaacattatctttttttctctaattttttgtctccttttggcgtactatctaatatttttgttattaggaaaaacaacatttatttcgtgacgtttaacttttttcctgcacgttaaatacacaccaaattttgcatgtcgatagagaaaaaaattctgcatcgattcatctgttattttttgattctatctgttagtttatgaattatttagtcattaataacaaattatccaattatagctttcatg

SEQ ID NO: 100055 - DNA, 418 bp, Heterodera glycines
  Promoter: Source sequence=SeqID_5866; Location=1610..2027; Strand=-; Gene=SeqID_59480
tcgcaacaaaaaaaaatgggaaaacgaaattccaagactccattttctgttggcttaaaaaaatatggaaatcataatcccgataaatcacgatgaaaaaaatatcacaagaatggggaaaatctggcaataaaatttaaaaatgagcacgaacgggaaataggtataatttttattctaggctaaagggtagggtggggagcgtgccgtaaaacttttacggcggcaggaaatgagaaatgtatgtaaaaaccaatgattacatagggagtgcggggggcggcacgcccgcaaggcacagcgccttagggcgggttggccatcgacgaggaaggaacggtgccgtcgacagatggccaagacgcggcggcggccgtggcaccgccgcttctctaagagaggcgcttgcgcttaaatg

SEQ ID NO: 100056 - DNA, 510 bp, Heterodera glycines
  Promoter: Source sequence=SeqID_5639; Location=7092..7601; Strand=+; Gene=SeqID_58741
atcattttaattgattaggaacaataatttttgcgctgtaatctgctgatcgtcttttgcaaatgcaaaaccagcagacgaagctttgtgccaaaattgatgcggtggaaacgaactcttctgcaaaatggagtagtatgattcttgagttgttgaatagaggggaggcggaaataatgttacatttagttgatttatcagtttttgtgttttcgctcgcaaatagttacaaaggatatttttaaaggatgaattatcttcagtgtcgagaatggttagttctgcttgttgaataaataaagaaaagtttcaataaattttttccagtcatcaattaaaatggatatgcaataatataaaaaaattcaaaggagtgaaaagttttccaaaaaaactgcatatattttctagcttgaaaaattataatcaattaagagtgttttcccttcatgttttttcaaaatttaacctaaaatcaataaattattgatgaatcatgatttcagaatg

SEQ ID NO: 100057 - DNA, 488 bp, Heterodera glycines
  Promoter: Source sequence=SeqID_9242; Location=1..488; Strand=+; Gene= SeqID_70726
tgaaaaaaaaatggcaaaaattggccgaatgctatgaatatttataaaatttatacttcgaccttgacctggacccaggcttgggtttttgtcctcagatccaggtcattttctgcaaattagttttttcttgactttgtttttgtccaagtcttgaaatccaggcaaggcatgaaaaaacccgaaaaaaccatgaaaattctgctaataaattacacttaaattttgtaaattttatccggcgacacctttctatacagccgaactcaactctacatattaaatatttttatgaaatgtataaaataaaactgatgagaaaacatgttgttaaatttaattttttaattttattttcaaggtcaaatttttattttataagttcaaaacgagtaaattgattaaaaaacatatttttatatgtctttaaaataaatttaattctaattgtataatttattttaacaactttaaaactccaggcaatg

SEQ ID NO: 100058 - DNA, 444 bp, Heterodera glycines
  Promoter: Source sequence=SeqID_14065; Location=3618..4061; Strand=-; Gene=SeqID_78040
tatccccccggactttacagaacatttttccgggctcccggaagtgataactatttttttattttttaactttttaaaaaaattaaatttttttaaattaattatttaagttttttgttcttaaaaatctttaattttataattttaatttttacgataaatgttttaacagaagttgcaactcttcaaaaaaattttaaaagttttaattttattaaaaagaatttaacacaaattttacatttatattaatttttaaatcatttttaacctttataatttctggattttcccggtcccgtggcactctagtcgagaccgaggcgaagtgggacggaaatggcgacgactcgttgcacaatttcggtgagcggctgcaaaattgagtctcggaaaatgaggcattttgaaacacccttccataattttttaacagccaaaatg

SEQ ID NO: 100059 - DNA, 466 bp, Heterodera glycines
  Promoter: Source sequence=SeqID_12259; Location=33..498; Strand=+; Gene=SeqID_75847
agacaaggcgattgtaatttggcacaattaacaaagctactggcgcagaccttgccactaattatctcctcctttaattttgctttttcgcagggaaatattgccgacaaatgccaaagattggtttctttaggatagggcctaatgtaatgaaaggaacctccgactcattcagttacttaaatgggcatttttcatttggccataaacccaaaaagtatgacgtgccgtcgccatccatggcttaataagtgttattactcattttgtttgcgtataaattggtagtgccctgctgaaatttgacacagcttttaatctcttctcgcgtggacatttaacaattttaattaatttcttcccccccccccccccacaaaaaaaaacggaagaaaaccatttcttttaatgccaggacgaaacgctggtacactgcagtctcagcgagttgccagatgcgacaatg

SEQ ID NO: 100060 - DNA, 830 bp, Heterodera glycines
  Promoter: Source sequence=SeqID_27986; Location=1..830; Strand=+; Gene=SeqID_58644
caaaatttgaatttttagcgaagaaaatgccgaaaaatactatttagatcggtgaaaaggcacggaaagatgaaattgttcgtacttaggaagaattacttttttatgcctattttaggtattgatgattatgtgatctaaatgttggactttgccatttacgtgtaacatatatttgatttttacacatgaattcataaaaaaagattggcatttagctgaactatgtacatatagtcaatcccccccccccccaaaaaaaaaagaaaaaatatcacaaattatacaccattgatttgtctcaaggagttaagcactaaaaaaagggtctccagtagcgggaatgggtttaaacagttttaagttggttaaaacttcgaaaatggaaagaatttggcacataactttttaattttaatttatcagaccaaatgcgaaaaatctgaagtttcgactttttgttcgagatcggttttccaagccattcccccatctgtttgtgcatcgctcaattaccacgaattaaatggcaatgcgacgaattgcgccgagaattaggccaattagagggatcatttgccctgcgggtacagtgtgatgggcacgggtatggtaaagtgatgtcaattgggctcaaagaggcgaatttcttcaattaattggatggaccgaatgaccaaaacggcaaattgagggccaaacgaaatggcttttcagctgtgaagcggacaaattcctccaaaagaagaaaaaaagtctcaaaaaaattttttggataatattcaatttttataaaataaaatatattatttctttttattcagcagatg

SEQ ID NO: 100061 - DNA, 292 bp, Heterodera glycines
  Promoter: Source sequence=SeqID_3022; Location=2957..3248; Strand=-; Gene=SeqID_82812
ggttaatatttattcaaatggcttgtatttttcaccggaatggattttttccaatatttttttatttccgctgatcattttcctcatttacgacgacttttttctgctttaaaaacgctttttttgtggcgcgctttttccaaaaattttgtgggacagagggggggggtccacggacactaattgaccattggtgtaacggtgaatcggttccattctcacggaataattccccatttgcttgcaaattattaatgcagaatggcactcccactttccatgtgccaatatg

SEQ ID NO: 100062 - DNA, 230 bp, Heterodera glycines
  Promoter: Source sequence=SeqID_8167; Location=864..1093; Strand=-; Gene=SeqID_67189
agtaagtgccatgggacggggaaaatgcaaaataaaataggggaagacagggcggggccaagcaaatttgtcgaattttttccatgacaagatggataaaatttctttacctgttaataacttttggattactttgacttggctttgctcagccttggaattcgagcagtacacccaatgttttagcaccaatcaaattcttattgttcttttttaggtttaactacatg

SEQ ID NO: 100063 - DNA, 117 bp, Heterodera glycines
  Promoter: Source sequence=SeqID_5655; Location=102..218; Strand=+; Gene=SeqID_58791
tttgtttgagcagcgacgacgaggaggaggaccgtcagcagatggcacgtgccattgctgccagctcacgtcaacagcagcagcagcaaatgtttggcgccgggagcaccgaaaatg

SEQ ID NO: 100064 - DNA, 1003 bp, Heterodera glycines
  Promoter: Source sequence=SeqID_20565; Location=1363..2365; Strand=-; Gene=SeqID_51117
tgcgatttttaggcacaaaaaatcgcgaaataggcattaaataggcacaaaaaagcccgaataggcacaaaaataggcaaataaaattttttattaacgctttttaggtaacaaaacacgtttaaactttaaatatttcaattgtaaatgaaattattaatgttttaaagttttttttcgaatatgaacaaatttttaaaccaaaaaatttttattaagaaaaaaatattaaatttagggataatttttttgaaaaattttacaattcttagggtgtattttctgaaaaattttttgggtcatttcttaggggtgtatttttttgtttttattgcatttttgttaaggattttttcaaaaaccctaaaataggcactttaggcacaaaaaccccgaaataggcaaagttaggcattataaaattcatcgtagacaccccaaaccatgcggaaagggcttttttcgtgcttatctgtgcgtattaagtgcataaattttaggcatttgcctaaaaatcgcatccctagtgctaacataatttatttgcttttggtcttttttgttatgtttaaaaaattatttgttattcaaacctatcagaatttaaaaagctcacttttataaaaaagcacattttgaacaaaattttgagaaatttcattttaattttcttctaaaacccaattttttaaatgtaatattttattgttttttaaaaatttcttttatcaatttaataattttttgccatttttaatatacagattttcactttttcactaaattccctgattcaccaattctgtatcgcaaaaatcaaattcttaatcgacaaaattttagcaccccaataaattatggataataattaagataattttagaaaatgatagagaaacgcccgcttttgatgatgatcgtccgaatgctagtccagtaaatagaaaaagtagcgaaaaactatttaatttcgtaattattaaaatttttttaaggaacaatg

SEQ ID NO: 100065 - DNA, 819 bp, Heterodera glycines
  Promoter: Source sequence=SeqID_24130; Location=709..1527; Strand=-; Gene=SeqID_54829
tccggaagtataagggtcaccaagcccatacaaaatcaagggttgacaaacccaattaaaaaaaaaacacacacacacacacacacacggatcaccaaacccaatcaaaaaaccgaaaaaggacaccataaaaagccaaacataattaaaagtcataataaaccctacagcaaacccatcactaatttaaataattaagtggacagagcgactcctaattcatttactccgactaccaaagccaacacgaaaaagaaacaagtggcgaaaagcactacactgactgaacttataaaattaaaaacacaaacggaatacaaattaacgaaacttcgcccaaaacatacggagaatatattgaaagaattttatgaaaaaaaggagcaaataattaacaaaaacaaataaaattctgtgatcaaatttttaaatttgtgataacaattattaattctgtgatcattaaattttaataaaaattatttaaccagtgataaaccaattaaaattcgactcgatactgattatccactaaataaccataaaagggtacttagttaattattttgaatttttaaaatacaaactatgtccggtacgcttcgtagcaaaatacccctccttaatcgcgtattaaaaagggaaatagaaacgatcaaaacaaaaattgaggaaaacaaattcgaatatgatcaaaataatcccggagaatgcatgcggatattcaataaaacaaaggaaattatccaaaaaatagagccaaattttgaaaaattaaaagccttaaataaaagatggcaaaatttaatgagaaaaatg

SEQ ID NO: 100066 - DNA, 273 bp, Heterodera glycines
  Promoter: Source sequence=SeqID_39482; Location=539..811; Strand=+; Gene=SeqID_68049
ggtacaacagtgataagtaaattcattaaattaaaatgaaaatattttttaacaaatttaattaaaaaaatacatgaaattctatcaattaaaaaaataattaattaaacttataaaatttatttataaaaaaaaattaaattaaatataattttttatttattaactcaacaaaatattttaaattaattaaaatcattgaaaataacgtaaaaatgcacaaaaaaataatgttacaccgtccggattcgaacctgcccccccctcaaaatg

SEQ ID NO: 100067 - DNA, 321 bp, Heterodera glycines
  Promoter: Source sequence=SeqID_20108; Location=670..990; Strand=-; Gene=SeqID_84896
aaaaatcacctttttgtttttcatttgcccaagccctggtattagacgattaaaaacagtcaaaaaatggtgcgacaattcataaaaatctttttccctaccattttgacagtaacccgcaaattaaagaggtttcgtctgaaattgttcatttatgtcaccaaaaataattttgcgcgtcattttatagactttttaggggtgtacaacacaggaaagcaccgtaatttttcaattttatattatttattttttttaagatttgagtaactgtggccgaaaaactgtaacaacaacagcaaccaattgtttgcagcaatg

SEQ ID NO: 100068 - DNA, 669 bp, Heterodera glycines
  Promoter: Source sequence=SeqID_28129; Location=1..669; Strand=+; Gene=SeqID_58782
accattttaaacagttgcattatttaataataatattataaattatataagtaaaaaattgatttgggataatcttacttatgttcattcaacattttaaataaatgcatcataatttataataatatataaattatataaagtaaaaaatagattggtataattctactgatgatcaatcaccattttaatattagctttattatttaatattatttatttaattatatgaagtaataaataatcctacttaggataaattactattttaaatatatcattattatttaataataataatattatacaaattcaattaagtaaaaatagatttagataagcctatttatgataatttactattttaattagaattattattaaagatttgttatcttactctgatgatcactatttcaagtcatcaaatttttcttcctttataagtctatgtgattttatgattactttacttcatttgacaatttcttttttctttaaaaagaattcgttattttaaatatatatttatcttctattctaattatattaatattagttaatttcttaataaaaaaaatttgtttaaacttttatgtaattaaatgaaaccaaaaattaatggattttaatttccatttgaataattttatttaagaaaacgtaatg

SEQ ID NO: 100069 - DNA, 1003 bp, Heterodera glycines
  Promoter: Source sequence=SeqID_8613; Location=1552..2554; Strand=-; Gene=SeqID_46624
aaaaatttttttaagataaaaaaccatgataattttttatccggggttttaaaggtcgctaatcacgaatctgacatgtattttgactaatttctaatccctaacccgaacccgaataaaaatcgaaattttgaatttttaaaattatgattttttgttcaaatttagattaggaaatcggaattgatcaaaataattgaaggattcgtgatcggggtcccccaaaaaccccagagaataaatttttatgactatcacaaaaaaaattttgcaaaacaaaagggtccccccttttgaaaaaattttcaaaaacggtaacttttacagtagcgccaaaaaagttatgtccataagaattcaaaaagctagttcgaacattttttggaataactttttttgaaccttaatgatatttttgaaattttgcagaatatgtagaggacacttaggactattgaattataccaatactgttggatttggttggcaaagaaaaaagttatagccaaaaacttgtgctcgtatgaaaacggtctggtataaaaagcatgtgaccaaccaaatcaaatattgtattgtaattgtttaggtatcccttcccaaactgattcaattcataaaaaataatgaataaacattattgtttttggttctattggactttatgaatccaatggctttttatttgttaagagcaaaccgcaaggcaactaggtagttgcacttaaatgataccaaaaaactaattggacacataaaatgcaatagaaccagaaattattcttggtgtcatttgatagctccaagagtcctctattaatctacgaaggatgaaaaaaaatttctcaatgattcaaaaatttatggttcaaaatatcagaaaaatacttttttggagtttgtaagagttgccaaattttttcctgctcgtgtaaactgcaatagagccgtgattttaatgattcttaaataaatacctttagcaaaaaagagtccggtaatg

SEQ ID NO: 100070 - DNA, 228 bp, Heterodera glycines
  Promoter: Source sequence=SeqID_150; Location=187..414; Strand=+; Gene=SeqID_75164
ttgtccaaatggttgcactctccgagaaaagatggccaacccaagcgattccgtttcaatgatattaatgaacaagtgggcgtccatttgatcaacaatttcaagcaggtggcccacattttcggcaaatcactgatttttggaattatttaggaatttatgcgtgccacttcttcagtcagttacgaaattcatttttctgttcgcgtgccgtcaatgccaatgatg

SEQ ID NO: 100071 - DNA, 788 bp, Heterodera glycines
  Promoter: Source sequence=SeqID_3540; Location=5329..6116; Strand=-; Gene=SeqID_85088
agttagttgattggacaacagaaatcagctgtattcctccgaaagacatataaaatcccgctagaagacgaaccgtccactagtgcgaacaatttggagaaaaaagattgattttttttgacattatttgaaggcgatcagataccaagatttttgatcactattgttgatactgtgatcgtattgttaataaaaaaaaaaatttccaaataaacgtcaaactgtgtcggccaaagaaactaatttctgaactggaaaaggaagaagaaaattttgaaaattttgatcaattggaagaaattattgaagaagttgaagaatttgtacctattgtagaaattccggttttaacacccgaagaaattgttaccgagcttgaaagaagggcaaactttccctttccaatagtgcatatttacccaggaatttccaaattaacgaaccaaattttaaaaactgaacccttcacataccaaaacaaaaccgtatataaattcactttgacaataactatttttccatactgcattttagataacctagataaagccgattctttggaaagaatatcacaggaagtaattttagaagcttacttaaaagtaagagaaacactcaactctaaccctgaaaaacgactgaaatttgtcaaattcattctaaaagttttatcaagagaaagaaaaagtttattaaaaaagtggagaagatctgaaagaagtatagtattacaccctattaattcattagtccacaaagagtatataatttaaaaacttacgaaaatg

SEQ ID NO: 100072 - DNA, 532 bp, Heterodera glycines
  Promoter: Source sequence=SeqID_44356; Location=1..532; Strand=+; Gene=SeqID_71857
caaataaaaacaacgattacaacaacaacaatcgctctataagcagcttcactaataatagctcaacttttggcaatttttgaaacaatcgcacgaactttgacactgggaataaccaaaacaacgcatacaacaatgctaatgaaagtgggcaaatggtaaataacaatgtcggatggatggattgatcacaaactttaatcaattttgcaaaatagttcatgtatttgaatcatcatttcataataaatttaaatattaatcattataaatttctttaatcccctttggtgtttgaatacacccgtaaatgtgacaagcgcatcgccggttagcggcatgatgcattagtttctcttttgtgccggttcagaaatgccgcacatccctttgttatttgaatttgaccccgttcgcatcggtcaccgaagcgtcggaccttggctacacagatggccacgatcccgcctcatataaaagggcacatgggaaagtcgccctcttttttttcctccattcacccccaaaaatg

SEQ ID NO: 100073 - DNA, 133 bp, Heterodera glycines
  Promoter: Source sequence=SeqID_12060; Location=1999..2131; Strand=-; Gene=SeqID_75590
tgactcgtcgaagtacaatccccgttcgggcaagaatcaaagcgcttacaaaataagcaagcccattgtggccaaaaattaaataatattaaaataataatgaaaatgatataaaatagattattcaacaatg

SEQ ID NO: 100074 - DNA, 86 bp, Heterodera glycines
  Promoter: Source sequence=SeqID_6425; Location=1664..1749; Strand=-; Gene=SeqID_61525
gggggggaggggcactaaaagaggacaaatggccaagtgacgcacggatcagctgctggggcgcctaaacaaatgccaatgaaatg

SEQ ID NO: 100075 - DNA, 347 bp, Heterodera glycines
  misc_feature (28)..(29): n is a, c, g, or t
  misc_feature (35)..(35): n is a, c, g, or t
  Promoter: Source sequence=SeqID_35686; Location=1..347; Strand=+; Gene=SeqID_65179
aaataaatataagcaatatttattgtannataganaatttcggtgtttctaagataatattctcggtccctgaaagctgaaaacccgattggctttcaaactcgcaaatttgaagccaaatgttagtccaatctccatgcaaaaatataaggggtcaacaatgaatgtgtggagggtggagggggaaataacaaaaacataatgcacacatattcaaatggtgtctcccgaacacaaacatttaggcctttttgtgtgaacggacaaagtgtagacaggcatgacaaaatgtccatatctcttgaaaatacaacttttatataaatctttttttacaggcaacaatg

SEQ ID NO: 100076 - DNA, 92 bp, Heterodera glycines
  Promoter: Source sequence=SeqID_16190; Location=2215..2306; Strand=-; Gene=SeqID_80553
ggtcaatttcttactaattaccatattgactgtttaatttttggtaatttagtggtctactacaattgttatatattggttggaacaaaatg

SEQ ID NO: 100077 - DNA, 133 bp, Heterodera glycines
  Promoter: Source sequence=SeqID_4076; Location=3350..3482; Strand=+; Gene=SeqID_53070
ttgggaaaaaataagattttctttaaataattgtagaaaagatttgatttgatgacctattactgaaaatagtcgcaaaacatggaaaattaaaaataaaactttatcaggtaaaagctgaaaatttcagatg

SEQ ID NO: 100078 - DNA, 788 bp, Heterodera glycines
  Promoter: Source sequence=SeqID_16888; Location=1..788; Strand=+; Gene=SeqID_81318
gtgtgcatttaagcgactcgctgtgcttgcccactgcatatcaaatagctggtaatttttatttctccggcctaatccagaaaaaatcactatctctttttttggaatattttacgtctcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttgtccggcctaatccagaaaaaatcactatctctttttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctctttttttggaatattttacgtgtcaaagggtgtgcatttaagcgactcgctgtgcttgcccactgcatttcaaatagctggtaatttttatttctccggcctaatccagaaaaaatcactatctcttttttttttggaatattttacgtgtcaaagggagtgcatttatccccccccccccccccaaatg

SEQ ID NO: 100079 - DNA, 316 bp, Heterodera glycines
  Promoter: Source sequence=SeqID_10690; Location=1..316; Strand=+; Gene=SeqID_73940
aaaaaaattagacagaaaaaaatttatttattaacaattttaatgaccctaatgatgaatgataaaatgcacgaaatgttttttaaaacaatttaaataaaaaccaatttcaaaatatttaaaataaaataataattaatttcaaaatattttaaattttgtgaaaaagatgaattggacatataaaaatattcattttatacatttgtagagtaacaacaaacggttgatgattgttcgtcaacattcggcatccttaaagcttggcaaggcgacaatccatgcgacggatgccaaaaacaatggcataataatg

SEQ ID NO: 100080 - DNA, 223 bp, Heterodera glycines
  misc_feature (29)..(29): n is a, c, g, or t
  misc_feature (100)..(100): n is a, c, g, or t
  misc_feature (133)..(133): n is a, c, g, or t
  misc_feature (174)..(174): n is a, c, g, or t
  Promoter: Source sequence=SeqID_30169; Location=1364..1586; Strand=-; Gene=SeqID_60602
aatttgatgtcaaaaattttttcagactncattccgtttgagttgtttgtgacaaagcactcgaaaattgtttgggtcaagactgaagttttgcgggcgnagaaatttacgcagcttgtggcgggccgttttnatagtaatgcattaaataaaaatcttttaaattttcttttnagaaattaagtgtgttttaacgactccgttttcattaattggagaaatg

SEQ ID NO: 100081 - DNA, 333 bp, Heterodera glycines
  Promoter: Source sequence=SeqID_7395; Location=1607..1939; Strand=-; Gene=SeqID_64695
ggtttaaccagtttgggtcgtattaaaaatttagcaaaagatttaaaaaagcatgaaaaaaatggattgccattaaagcataagaaagaaaagctttttttaaatttccatttctatcttatgtataacgcctaattttaaatgtaataaaattaatttatctattttgattattttggacaaaatcgattaacaagggaatgccaaaccagattaaagacggaattcataaactctcaggaagttgtgtcaccggtgccaaccgaaatgtaccggaaacgctttgttggcacattgttgggctgcttgttcagccccgaggcgccaacaatg

SEQ ID NO: 100082 - DNA, 98 bp, Heterodera glycines
  misc_feature (6)..(6): n is a, c, g, or t
  misc_feature (49)..(49): n is a, c, g, or t
  misc_feature (56)..(56): n is a, c, g, or t
  Promoter: Source sequence=SeqID_4168; Location=1..98; Strand=+; Gene =SeqID_53440
aatttntggtggattcgaaatgagataattcgccctcaccaggtaaggngaaaagntgtaaaaaaaattttgtaaaccttcaattatttaagcaaatg

SEQ ID NO: 100083 - DNA, 1003 bp, Heterodera glycines
  Promoter: Source sequence=SeqID_13110; Location=1295..2297; Strand=-; Gene=SeqID_76905
agtgttcattgttaattagttataaaaattagttgtgtgtataatatttgccatttagtgcaccaaattttttatatcaaaaataaatgatttccataaatctgaattttttaatataagtctcaaacttctaaatctaaaaattttaaatgataatcttttaagattactgtcattttctaatgtaatacataaacatgaactaattggcgggatcttctcactttataaatttttaaatttaaaaataaacgagtttttgggtatcgaaaattcaatttcaaaaatcaaaagaattcagtgagaaaattcttttttttctttgcctttttatcatcgtaaaatgttgggaatttaccggaaattcacatggacttcaaacaaaaagaaatgatttttattctaaaattaatgaaagagttggtttattggtttatttcccatgacaaattacataattttttcggcttaaaatttaattaaaaattgattaaaggcacaaaaaagtttcgatttaaatttgttgctaattttttgttgttcaaatacttctcattttcccagaaattgaatggtcaaaacaaacaaacaattagagattgaaaactgaagggttttcacaatttattgccactaactcaaacagatgtttttgacagtttctgttttttggcaaaaaatattaaccgaaattaaaaaatgacgggggaaacagctgctcaattggacacaaaacaaaaaaaccaaaaataaattaaattaataaatttattttgaaaactcataaaagatgagttgttgccaatggaattaatgggtttttgtttaattgtgagtgaacttatggcttcctttaacagattaatgatttgttaaaggaaaacttttaactaaaatttagccctttcgccattcgtctgaatttcaatcgcccacaaagcacatccgataacgtaaaatgagaaatgtccttccgctgtcaccaaagataagcgtaaaaatg

SEQ ID NO: 100084 - DNA, 52 bp, Heterodera glycines
  Promoter: Source sequence=SeqID_408; Location=1..52; Strand=+; Gene =SeqID_51749
taaaaactggtgcctggcaattgacgagcccgtcaatgtcccgccgcagatg

SEQ ID NO: 100085 - DNA, 90 bp, Heterodera glycines
  misc_feature (11)..(12): n is a, c, g, or t
  misc_feature (65)..(66): n is a, c, g, or t
  misc_feature (86)..(86): n is a, c, g, or t
  Promoter: Source sequence=SeqID_32714; Location=896..985; Strand=-; Gene=SeqID_62985
tcagctgacanncaaaaataaaaaggaagaggcgcaagaagcgttattacctggacgtgctctanntggaattctagccttagttntatg

SEQ ID NO: 100086 - DNA, 203 bp, Heterodera glycines
  Promoter: Source sequence=SeqID_24800; Location=1360..1562; Strand=-; Gene=SeqID_55551
actggaacagctgggaggttccgtcaacaaatttgaaacgttgaaactattgcttgagctttttcggttggccactgtgtcgccaaaagttcaattggacagttgcgaaacaatgaaaattcgttcatcgccaattcaagggattaggtaaagaaaaaaccatttcaaaatcatttttcaaattcattattagcctcattatg

SEQ ID NO: 100087 - DNA, 109 bp, Heterodera glycines
  Promoter: Source sequence=SeqID_17370; Location=665..773; Strand=-; Gene=SeqID_81855
tccgggaaatgatcaaatcttgttagcaaaagcgcaacaaacgcatcgctaattaggggggggggctaattaggcgtgccaattaaaccagattaaattaacaaaaatg

SEQ ID NO: 100088 - DNA, 376 bp, Heterodera glycines
  Promoter: Source sequence=SeqID_20959; Location=452..827; Strand=+; Gene=SeqID_51538
atcggtgtgccaaaatgtgcggcaaacatgcttttcaatgccaaatcgtccatattttctttccacattcattttcagtcccgtaaccggacaaaaaaaaattttttttttcgtagccccctttggtttttttttgataactgccttcccctcaaatttgttttggataaattgttcagcgcttttttaatatttttgaaaacttttcgacggtaaaactttatcaccctcttggagaggtctaatttttaaattgttataagagaaaaacaaaacatggcccgttccgcgctgtttcattaaaaaaaatttttttttcaaaaaacccaaacaatttgtttgccaggtttttgacactctgacgaatctgagcatg

SEQ ID NO: 100089 - DNA, 226 bp, Heterodera glycines
  Promoter: Source sequence=SeqID_8742; Location=543..768; Strand=+; Gene=SeqID_69073
ggtaaagcacaacaaaacagcaccatggacattgtgaattaccctcaaaaatattttggcatttgaatttgccaatccatggcttaaaagaacgccacttttggattcttccccaaagctcgactttgatttggtttcaattaattggctgttaatttcttaattcaaagattgtaaaaataaaactccgcgtgtgcattgaaccaccttctcacagtgcgaaatg

SEQ ID NO: 100090 - DNA, 51 bp, Heterodera glycines
  Promoter: Source sequence=SeqID_19933; Location=919..969; Strand=-; Gene=SeqID_84695
tgccgccgccatcgcgcacagaattcaataaaatagtccaaatgctctatg

SEQ ID NO: 100091 - DNA, 402 bp, Heterodera glycines
  misc_feature (352)..(352): n is a, c, g, or t
  Promoter: Source sequence=SeqID_26112; Location=1..402; Strand=+; Gene=SeqID_56861
gtccaaaaatttctaaggaaaaataatattatggcggaaaaattttaggttttccatgcggggctggtaccccccccccagacctagccacacccaaattttccaagaaatgtcgctaaatttttcaaaaaatccacaaatttttaatgaaaatctgctaaaaatggctcaaaatcacaaaatttggtcattttttggacaaaatctgttaacaaaccgcatttaaaaccgcaaaaattttcccccctgtcccccaacaattttttttggaaaaaccgcgccacataaaaaacgggtgtgaaaagcaaaaaaaaaaaaaaggtgtcgcccggggggaggtgccccccccccnccaagccaaaatcctgggaccgtccctgctattttctccacccaaaaatg

SEQ ID NO: 100092 - DNA, 53 bp, Heterodera glycines
  Promoter: Source sequence=SeqID_27745; Location=483..535; Strand=+; Gene=SeqID_58414
ggttcgtgccaatatgacctttcgaaatggggagttttgcctgttcagaaatg

SEQ ID NO: 100093 - DNA, 109 bp, Heterodera glycines
  Promoter: Source sequence=SeqID_30092; Location=1092..1200; Strand=-; Gene=SeqID_60535
gctaaaaatgtgtttttcgtgcatttctcgtcgaaataaagccgcagaaaaatagttaaaaaactaaaagcccttttataatattcttcagaattttcccttcaaaatg

SEQ ID NO: 100094 - DNA, 722 bp, Heterodera glycines
  Promoter: Source sequence=SeqID_31822; Location=1..722; Strand=+; Gene=SeqID_62128
tttcattttttcttcaatttattcccacgaaaaattcaatctaaaaaattatctaaaattcctctttgcgtatgaacagaagttttccaagacgttcttcgatccaccaacaggtgctgtgggtggtgttttgtctgctgatcaccagcgtgtttctatgctcgcccatcaattactacgcggaactgaagcccctgcaagtagcgccttggccggggaaccgggatcgtgaaaacaaattttgtgggatcccgaaccatattttgggggttttcgggaataaatccatatttcgacatttttgcattttaagtccatatttcggcatattttcacaagaaaaatgcaaaaaaaaagcaaaaatacaaccccgaaagatcgactttttgtaaatttttaaaaattacaccccaaaaatacgaaaaatttgcgttttcttcgtcattttggcaattttaataaatatttcaccactttttgcgaatttttctttttttaaatgagaattttttttttaaattggcaaacttggaggtgttttttatacaacggatgacaataaatcggtgtgccaccgccaggccaaaattggcggaattattaatagattagcacacccccccccccccataaaaaaaataaattgctaaatttatgatttttgaaggtaatttggactcaaaaattaaatttttccaaattgcagttgagttacgatgatg

SEQ ID NO: 100095 - DNA, 374 bp, Heterodera glycines
  Promoter: Source sequence=SeqID_18291; Location=739..1112; Strand=-; Gene=SeqID_82880
ttgtttattttggacaattatcaaccatcgatttggcataaatttgacaatgccattgtgggaggcccataaaaaactaaggatttttgtgaaattcgcaaaaccgtcattttttgtagaactttgtcgttagatataccaagaatattgctttttttaattggtatcagcatcgagaaaaactatggatgactgattttttggcatcccttggatttttttaattagactcaaattaaaaaaaaatcatttgtgctagggttgaattggaccgcctctacccattggttacgcccttgtatcatgtttttcttggacaataacattgtattaattgctgtactgttttcaggcactgtgtcaaaaagggaatg

SEQ ID NO: 100096 - DNA, 214 bp, Heterodera glycines
  Promoter: Source sequence=SeqID_7798; Location=4900..5113; Strand=-; Gene=SeqID_66004
atttgggaaacagaattaaaaaatttaatttatgacatcattcaaaatttataaaataaaactgctaaaaatttaacaaaacatttttctggcaatgatataaattgatttaaataaaaaatattaaaggtaattaattccatataatgatttttcagtcgagcattttctccgacacagcgccaagttccccggtgaaaacgcccaaaaaatg

SEQ ID NO: 100097 - DNA, 245 bp, Heterodera glycines
  Promoter: Source sequence=SeqID_14378; Location=2728..2972; Strand=-; Gene=SeqID_47196
agtgggaatgacaaaagggcggaaaaggcattccattcattcggatccgtaaccagaaaaaaattcggacacggcaattggcaattttttatgggatttgtcaacagatttttctaaaatggcctcgaagtgttttaacattaatcaaaattgattggatttgttttttgaatcttttaagctattgttccctttttgcagaagaaagtcgcctttttcgcgagtcggctgacgtgttcaacatg

SEQ ID NO: 100098 - DNA, 231 bp, Heterodera glycines
  Promoter: Source sequence=SeqID_29268; Location=632..862; Strand=-; Gene=SeqID_59796
attctccaatgtggcccaaattttaggcccccagccacagccccttgcttctcccagttttaagtcttggatttgtcaaataaattcaagacttcaaaataataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 100099 - DNA, 97 bp, Heterodera glycines
  Promoter: Source sequence=SeqID_22102; Location=499..595; Strand=-; Gene=SeqID_45692
tgttgagaacaatgttttcatttttattttcaataataatttattttttaattgttttagttgttggtacaaaactaattttatataaaaataaatg

SEQ ID NO: 100100 - DNA, 155 bp, Heterodera glycines
  Promoter: Source sequence=SeqID_6726; Location=2507..2661; Strand=-; Gene=SeqID_62647
agtgagtgggtggtgttgatgatgaaatcgttgttaccatgcatcgaattcgggtccctggattcggcgcggaattggtcgaaacggataccggaaaataattatatttttgctttccctgaaaataatggtgtttccccatttgtgcagatatg

SEQ ID NO: 100101 - DNA, 342 bp, Heterodera glycines
  Promoter: Source sequence=SeqID_10350; Location=3600..3941; Strand=-; Gene=SeqID_46860
ggttgtgcggggcagggccctgttatcgaatataaaaaaaaataaaatttaaaaatgggtagtaatacaattttttgtaaatttctatcaaatttgacccaaaaacgacaaattggcgatttcttggtatttcgacttgctttgatttaatttttaatcactaaaattttgtagcaatttaaattgaaatttaattaaatgtttcgaatgatggcgaaggatccgctgccaataatattatgtaaataaataaattttgcctaattttcccactttttttccgccaggttcaatgagtgcgcctgcacgccgtacaacgcggactttgacggggacgagatg

SEQ ID NO: 100102 - DNA, 182 bp, Heterodera glycines
  Promoter: Source sequence=SeqID_7200; Location=1379..1560; Strand=-; Gene=SeqID_64122
aataaattaaaatacaaaaaaaataataaaatgttttttatttaatgataaattgcaaattttgatcagtttttggagaaagtgaaggcgaaagtgagggaaattcagcagcaacgagcccaaacaaagaaaggtcggaaaaagcgattgactcaaaggaaaagcggcgacaaaaagccatg

SEQ ID NO: 100103 - DNA, 266 bp, Heterodera glycines
  Promoter: Source sequence=SeqID_14036; Location=1174..1439; Strand=+; Gene=SeqID_78011
ggtaataaaaaccaacaaatccatataaatttaacagtgtaaaattttaaatatttaaaattgtattaacaaattcaaattataaaataactaagatcgaaatttgaaaaactttgtattatacaattatttaagaaatgaaaaaagaatatttaattgttatacaaatgcttgtcccaaaaagatatttctttctcttttattccgtgatgagaatccaaaattagtaaattaaattattacgccaaaactaatttttaaaaatg

SEQ ID NO: 100104 - DNA, 481 bp, Heterodera glycines
  Promoter: Source sequence=SeqID_2196; Location=1034..1514; Strand=-; Gene=SeqID_78425
agagcggaaacaacaacggtaacagcagcagcgacagaccagaaacaatacaacaagaaaagagacaacaacaacaacaacaacaaaagcaagcgaagaaaaggccgaaaccaagtcaatacattcaacggaacactagctttttcaagcaactgagcaactgtcgctcggcacgcgcacgtgcctaccgtcagctggtgaggggggcgagcagtgagcagctgttgtgtctggtggaaagtgcgttgaacattctccgtgcacgcgtcccgctccggagcactcatcttcagcacttgcgcgctcaggcccaacacgtgcgtgcgttgggccgtgcgagaagcggccacggggcacgtcgactgttgctgagacagcagaccgggcgcggcgtcccggccttggctggcttggtggccagcgttgtgcttccactgctggcagataggtttatgaaccgccaagacagcacacaaacatg

SEQ ID NO: 100105 - DNA, 368 bp, Heterodera glycines
  Promoter: Source sequence=SeqID_18476; Location=1469..1836; Strand=-; Gene=SeqID_83086
caattgataatgaccttttatatatatttttttttttgcctcatagaacataattccaaggatgaataaatattgacgcatgtaatttaatttttaaatattaaaaaaataaaaatgacagtcaattaaataattaattgtccctaattgcccctgcctgtctcacctgcaacgggcgatagtcccggtcggcgcgttcaaactgttcgccgctggcgccgccggacggctgcagcggcgccgcttctgctgcacacgacagcaagcagtagcagcaacacaacaccatcaacagcagcgagcaggacgatgacgaagcatagcactgagcaggaaaagagaacaacggtggcgacgaggacggcatg

SEQ ID NO: 100106 - DNA, 705 bp, Heterodera glycines
  misc_feature (564)..(564): n is a, c, g, or t
  Promoter: Source sequence=SeqID_27025; Location=394..1098; Strand=+; Gene=SeqID_57756
tttcttttgcgggtttgaccgtgtgaaagacgaacgaataacaagacaaattttcttagcttaaaaaacaaaaaataattgcaagtgcatgtacattcatttacgaaaattctttacacaaatttttcggcagaactcggcagaactcaacatcctaaagtaacaataacaattttggtttttcgaaaaaaaggatggactaatgaaaagataaaatctccctcctatccaattcgtttcactagtccaacgccgaaaacgaacacgccctctccgcagtgaatatccccaacttgccacattttcatttttttaacagaaatacagttttaaatcaataatcgagaaaatgtattaaagcgaatgaaaatcattttataattcaatttttaaaaattctaataatagatcctttgagaatttgaaccgaaccggaacgtgatcggaattacgcagagattttcccggaatcccggcaaaagcgggattttaaccccagtaatcctacccgactttttcaaatttccgggctctacataggatagagtaggaccgggaattttntaaaaacccgggaccggggccaggatcttcaacatggattgtgactcctttttgtcccggtcactttttttttgtttacttatgagttaactgacaaaatatattttcaataaatttaagcatatttatttatttaaaatg

SEQ ID NO: 100107 - DNA, 1003 bp, Heterodera glycines
  misc_feature (820)..(820): n is a, c, g, or t
  Promoter: Source sequence=SeqID_3586; Location=426..1428; Strand=+; Gene=SeqID_50972
tttaaatgggggagggggtaaaacgtttaaagtttggccaatggaaatttttgtgaaatgggggacgaaagtttttgctaatggggggggggttaaacttttaggcggtgatgaaaaactttttggcaaaaaaaaacttttggtcagcgatgcggtgattaatgatcatttggtggcggcggcgcggggcgcaggcagtggtgtggggcagagaaaagaaaagagtgagagatggaggagagggggaagagggtgggaagggcgcaagggatgaagagagatagaggaaggagagattgtgacgtaagagagaaagagacagattgtggggcaagggaggaagagagatattgcggggggcaagggagaaagagcgggtagagagagagcaaattgtgaagtggcagacagacagagaaaattgggggtgccgataagggggaaagtgatgatgcggggcaagggaggaataggagaaagaaagaagagagattgtgggcaaggggaggaagagcggatagagaggcagtacagcaaattttcaagtcaaacagacagagaaaatttgggtgccgataagcgaatgtgggggggggccttaagaaaagaaaaagggaggaatgttgcatatattaatcaaaacatttttgagcgttgggaaaggggggggggcaagcaaattatacgaaaaatggggggggggatcccaaaaaattgtcaaaaataatgttgttgatccaacaacattatgatcttgttgttgatgggtaatacagcaaattatgcataaaaaagttaaaaatagagtaaaattggtagngggggggattgggatcactttcatttattttgccatgcagtggttcccctttatttgcactgagtgcgaacccgggcttacgtgttatcatccagataactatcgtaagcccattctatgtatacacagcagtattgaaaacctcaccgactttttgaggcagggcaaaactgaaacaacatg

SEQ ID NO: 100108 - DNA, 657 bp, Heterodera glycines
  Promoter: Source sequence=SeqID_14; Location=144..800; Strand=+; Gene= SeqID_74197
cctgaatgtagcggcctattggtcatttatatattgaagttgagcaaggcatttaatacgagaaagaaaacttattgcagtctacaacgcaactcaggctgacgtgtaaagaaaaccgaaagtcaaagaaagagctgaaaataattttcataatattttggggttaataaattttaataatgcaaaataaataattaactattgttatgttcttttttaaagctgaaatggttttcaaataaacaataattttaaaacaaaaaacaagcaacttttcccatttgataaaaataaatacacaaaaaataaattaaattttaaatttttgttcatttctaactacttttaatacatatcacatttaataaattcctttaaaattttctaattaaaaaatatttaatccagtatttttcatttttccatcaattaagaggcgcttctcttttccatttctgctccgcagctatttttttattagcggtgacttgtatcaccgtggctggcagaaatggagagaacaaaaaaaactgtttgtaatttgtttattggacaagtcttttttcaaatttaatttaattattaaaaaaatacatttgtattttgtacttgtaattttagtaccggaaaccatgtattttcgctttttccagcatg

SEQ ID NO: 100109 - DNA, 275 bp, Heterodera glycines
  Promoter: Source sequence=SeqID_26435; Location=740..1014; Strand=-; Gene=SeqID_57163
tttgaaactaattaatgggaacgcatttttggatttattctgtttcccattaactttgaattactctctaaataacctaaatgttgttttgagttattttcgaattttagatcctaaaaatcccgtccctaatcatcataagtcctttgaatctttgttccgtgtggggcataatttaaaaaatattttttaaatttaatttttaatattttttttttgttttgattttagtcccgtgaaatttttgttttttatgggaaatatttgtcaaaatg

SEQ ID NO: 100110 - DNA, 157 bp, Heterodera glycines
  misc_feature (17)..(17): n is a, c, g, or t
  Promoter: Source sequence=SeqID_45323; Location=1..157; Strand=+; Gene=SeqID_72644
atattctcagaataaantttagaaaaaaaacacaaataaaatttttgagagatttaaaagtaataaaaatttaaattaatcatttttataaattaaattttaattgcataacttaaattgcttattgaataagtaattgtttgttttcaacagcatg

SEQ ID NO: 100111 - DNA, 52 bp, Heterodera glycines
  Promoter: Source sequence=SeqID_9415; Location=1500..1551; Strand=-; Gene=SeqID_71330
ttgtcagcacacatttttgccctcgctgaaggtgtgcattcgaacgcgaatg

SEQ ID NO: 100112 - DNA, 320 bp, Heterodera glycines
  Promoter: Source sequence=SeqID_22144; Location=546..865; Strand=+; Gene=SeqID_52798
aaaagctgagcaattaatggattaataaaagtaatttgtcatcagaagctctttgtcgccctactaaaattttctaatttttttttcaattttgtgatttttaaatgtaattcatacaaaaaataaggagggtgagggccgactacaagggggcaaaaatgggagactccttaccatcgttcaaccatttctttatacatatttatttattgtcgcgaatatgcgtatattggaatataaatatatttttataatttttaaataattttattttaattttataccttttttttttgttttcagtcggtgccacggtaatg

SEQ ID NO: 100113 - DNA, 56 bp, Heterodera glycines
  Promoter: Source sequence=SeqID_2681; Location=35..90; Strand=+; Gene= SeqID_81056
tctcaaattggaggacaacacttcctttaattggccaacatgtgttgatggaaatg

SEQ ID NO: 100114 - DNA, 1003 bp, Heterodera glycines
  Promoter: Source sequence=SeqID_11399; Location=4516..5518; Strand=-; Gene=SeqID_74792
aaagcacgaaaaaatgcaaaaaatttctgaaaaattaggcgaatgttaaaaaaaatcccatttttaacaatttatagaataacatcttataaatagagatcggatttttaggcacttaattttacaaatatgtacctaaaacataaataaaaaagttattcttccaacaattacgaaaaatttcatccagatttcattgccttttcaccgatggaaattttattttttggagttttctttgtatttttcggcattttcattggttaatttaaaacttggcctcaaaaagtcaaaaaagtcacgaaaaaagtcataaaagtgtaaaaaagtcataaaaatcccaaaaagtgtaaaaaagtaaaaaaaaagttacaaaaaaagtatgttagaagcttcaaacaaagtttagaacactttttaagccattttaatgccatttagaatcagcaaaaaaagtcatttgacttaaattcccaaccctagttatgtataactttgtaatttttttatggtcgtgtaaactgcaattgagcccgaatttcggcaatctttcagaattgcggtcccgaaatttgactatttgttttgttttagtcatcaaatattgcgacaccttttcatttgaccaagtgcggatcggtgttcatcttttgaactatcgtaacaatcgtgatcaacgtatttttttacaccagaaaatcgattaaaaaaatttcataaatcaaatattcgataaaaaatcatagacaataatcaaagattttcaaaatccgtgttcatatcgtgattagcatatttttaagcctagaaaaagtgccttacgaattaaaaaaaaatttttttttcgggaccgtaattccgaaagattgcccaaatttgttccataatttttgaaaattccttgctggaggcacctacgccggcccacaaaataattaacttcttttaaaatttaatcaaaacagctaaatttttatcatttcacatcgtttagcttaaaatg

SEQ ID NO: 100115 - DNA, 398 bp, Heterodera glycines
  Promoter: Source sequence=SeqID_26609; Location=601..998; Strand=+; Gene=SeqID_57352
cctgcattttttggaaaatgcaggatttgcaggattgcaggatttggtaatactgacttttactggtcccataaaaaaaggaaataaaaagacggccttttacgattattcgttctattcgagggttatcgaggccgctgatcacgaatatgatatcataattgtcatatgacatcatctaatctttgattttcttcaagtatttttttcattttttagaattatagtcataaaatattttacggggttatcggggtcgctaatcacgaatatatcatccatttcgactaatttctaaaccaggacccgaattcgaacaaaaaacgaaagttcacatgttaaacgaatttcgaaatttccgtattaaaaatgcttttatgatttttattgcaggaatg

SEQ ID NO: 100116 - DNA, 103 bp, Heterodera glycines
  Promoter: Source sequence=SeqID_41527; Location=989..1091; Strand=-; Gene=SeqID_69622
tggaaaatcaaattgcccatcgcaaaattgcataacaaagtgataatgaggagagggagcaaaagggcggacaattggacggtcatttcgggggatcaatatg

SEQ ID NO: 100117 - DNA, 273 bp, Heterodera glycines
  Promoter: Source sequence=SeqID_43633; Location=1..273; Strand=+; Gene=SeqID_71264
ttattttatgaattacaataaatataataatatttcaaagatttttttactttttgagtccggtattttttcctttatttcatgacattttatttctgcttgtgatgctccatttttattaatcaacagatcataattaatatcacgctgattattatgcagctttgggttagggcattttactgccatataaaatttattcttaaaattaacagtaaattatttgataatgtattaatattgaatttttaagcgatttagcagtgattaatg

SEQ ID NO: 100118 - DNA, 491 bp, Heterodera glycines
  Promoter: Source sequence=SeqID_36248; Location=1..491; Strand=+; Gene=SeqID_65618
gcccatttgaggcgctaattgaatgggcgagggaccaaacggaaacggagggttttatcccctccagcagcaatttaaaattaaatgttttgtttctattgtatatttcagtgtgccattaaagtcagaaacctaaattttataagtccgctgattttgttttatttggtacactttaaaaaagggaaacgtgccaaatttttgtttgctataatttaattttcaacatttttaaataaaaattctcattgatttattggtcctatgaaaccaaatacaaaaaatcccattgggcaagaacggatttaaggaggaaaaagaaaataatctaattaaggaacaaatgacaacgaaatgagagaaagaggctcaaaagggggaattgacgatgagtatcaaagaaaacgcactttaattgggggggggggggggggacattcgtacaatgaatggaatggagtccaaacaaatcctccgctaacaaagcaatg

SEQ ID NO: 100119 - DNA, 78 bp, Heterodera glycines
  Promoter: Source sequence=SeqID_29415; Location=927..1004; Strand=-; Gene=SeqID_59919
gggggggggggcggtgcgcccatggccattttatttttcaaaatattttttatatttaatagatattccagaaaaatg

SEQ ID NO: 100120 - DNA, 89 bp, Heterodera glycines
  Promoter: Source sequence=SeqID_15768; Location=1..89; Strand=+; Gene= SeqID_80095
tgcatccccttaacaataactcctttaagggtccacgcatttggctaagaagaaaactttggcccaagtgttggcgccgcctaagaatg

SEQ ID NO: 100121 - DNA, 736 bp, Heterodera glycines
  misc_feature (34)..(34): n is a, c, g, or t
  Promoter: Source sequence=SeqID_11783; Location=1154..1889; Strand=-; Gene=SeqID_75282
cagttcaattcgcgatttatttaggtgagttatnagagaattcttagggctatcgagtgctataaagaatgtctaattttattgatttggacaaaagttatgggcagttttttgttgaaaattttcatttgatcgttttttatatagcgccctttttgatggttttatataacgatatatcaccaattatttagttttctgacatagtttttctaatcaaaatgttttgacgaataatttgaacatttaaaaataatattttaatagggaatacctctaagaatagagaactaaaaattttagtttgtagagggcctagcaaggagttcacgccacttataattctctcataaaaattattaactacgcaaatttctcttattcgctgatatctatagtcagtcgaaatggagactttattacctggaatctaatacacaaaggaaagactaagttctcgtatgaagacgatgtgcataaactttgggtaaaaaacttgccttgtaacaaatttcttaaaaaaacctttaattcagattttgagtcctattcccggttttgctacaaaagttagttggaatcacaagaaaatataattaaataatttaattttcgcaacctcattttatttataaagcctccctcatatgtttttcatcattggctcaaaaaaaaaacagtatacaccttaattcatagaaattttttaaatattttgttattaaaggaagacatg

SEQ ID NO: 100122 - DNA, 1003 bp, Heterodera glycines
  Promoter: Source sequence=SeqID_21093; Location=109..1111; Strand=+; Gene=SeqID_51687
tcggcacggagaccggcaaaatatgtctccaaggcttaggttaataatagataatatatattttttaaattttttgtggaacttctccaaaattaaaaatgaaaactattctttttatatttattttttaaaataaaaaataattttttattaaatttaattgaataaatgttcagcaaaaaaacttactccgattcaatggctaaaaacggaggaaaagcaaatctttggcattttcaggaatttgtgaaatttcttcgaaaaaattagagcaaatggaaaaaatttttttaatatagtttttaaaacaatttttcatcgtagcaaaatttgctttccaaaacttctccgattcaatgccaaaaagggaggaaaaagcaaaaacttggcattttcaaaaaaaacaaaaaattattttcctttgaaatttattttttaaagtttggaaactacgaaattgttgccaacaccaatttattatttagagtcagtgttcaacgtgaatgagccgatcacatgtttggccatttacccgcgaatgcaaacggacgccgaccattacgacgtggcactgatcgggactacggtataaaaaaaattgaacaaaaagagttatacggtaatatgtaaaataaaattttcaaattatatatgaaaagctgattttggtgccaaattttcatatatttttaactaaaataattttttttaaatttaatttgtgcaatttttgcaattttcgaaaaatcaaatagcataaattttaattatttagttaagtatattcaaataattgttatttaatttatgcaatttataacaacagtttttggacttatttattataattaatctcgaattaattgtgtaattaatttcatttcctgttttagggaagtttgttggcattggacgtgtacaataatcgcacgtactttaaattaaaaagtaatttaattagctaatttgacgcatttaaaaaaggcttttccaccgccacatg

SEQ ID NO: 100123 - DNA, 115 bp, Heterodera glycines
  Promoter: Source sequence=SeqID_4274; Location=3316..3430; Strand=+; Gene=SeqID_45764
ggtgaacagaggggggggggggaagacgttcagttaaaatttgaaagagagggacggaacgaattgcgaaatttgtccctctcccaagcggatttgacagtgaaaaccgaaaatg

SEQ ID NO: 100124 - DNA, 1003 bp, Heterodera glycines
  Promoter: Source sequence=SeqID_535; Location=2904..3906; Strand=-; Gene=SeqID_55710
tattaatggcacagtatccaaaatagtaaccactacccaaataatacggtgaaatttacgtataaactattaaactattttgtgcacagcaaaaaaatgtgttggaatccaacaatcgcgaagcgatagctagacagatttaattcgttttttaaaatttttgtcttttaggctttttcctctgcttcttctcctgtcaatttctacatttctgtttacaaaacaagcactcgcgtgaaaattgagtaaaaatttcgtatttgaaaaattttgtccaaaaatcttttacgtcggaaaattaccggtttttaccggtaccggtacaggtggaaaaagttggtaccggtaccgtacagatttttgcattaccggtcagtaccggtaccggtttttttacaattaccgattaccgctcaactctagtcagaatatcactcactatcttacgaagaaaatataagattgaggcaaaatttggtcatttttggacaaaatctgttaacaaatcgcattaaaaatgaaaaatatttcccggccgtgcctatcggcaccgccgggcctctccccctcccccatgttctcaaaactttttggaaacatgcgccgtaaaaaattgttaaaaatctgattttctgatcccaaatgcgctgaaagttacgaattgcttatttcttccccccccccccaaaaaaaaaaatttaaatggtttaaaaattggaaaaatttttaataaattcgcgatccgcggcaatttgaatgcgcggtgcgcggccgcggtttttttttgcgcgatccgcggccgcggcaatttgaatgcgcgatgcgcggccgcggtttttttctgtgggcgccccaccccttggtgtacccgagtatataaagccgaccaaatccccttccagtcatattcttcagcccattcattccatccgcatttttttttttgataattttttttttcagttcacttcctaaattctgtttgattaccagccaaaaaatg

SEQ ID NO: 100125 - DNA, 239 bp, Heterodera glycines
  Promoter: Source sequence=SeqID_217; Location=6238..6476; Strand=-; Gene=SeqID_77993
aggcagaatcagcagcagcagccgtagttcatatcgatcataagcaaattttggttctcaataataataaagtgttgttttctattggtgatcaaaagcacaggagtcgcccaatgtttttttttaaaacacgcaacccgtgtacatccatccatccataatatgtgacaatgccttgaatataataataataagcataaagaaagcagcccaaaccgaatagatttttgcccaaaatg

SEQ ID NO: 100126 - DNA, 210 bp, Heterodera glycines
  Promoter: Source sequence=SeqID_43805; Location=1004..1213; Strand=-; Gene=SeqID_71390
ttaaattaaaattaaaaagaaaaaataccgaaagaaattctcccttttcgaattttttaaatttaacaattaatatgatttacttagtcttatcgaatgtttcaaaaaaatatattttttaaatttaatgctcaaataaaacctcatttccttaataaaaatccctcgttaattaccctcattagattactttaaataggcttctaaatg

SEQ ID NO: 100127 - DNA, 675 bp, Heterodera glycines
  Promoter: Source sequence=SeqID_12946; Location=1192..1866; Strand=-; Gene=SeqID_76700
ttttgacatgggaaaaaatattccttatttgccgaaaatcgagaatcgagaagttttattatcattacagacaaaaaatcaaagaaaaacctatttaagcaaattgcaaaaaatgactcaattagacttaactaagaataacattttagctatttgaaaaattaacttcaaaattcttttttttgtgaggaagttcaaaaataaatttcgtaaaaatttcaaaaagttcaaaaattggtaaaaaaaaattatatgaaaaagttctgaaaatttgcattttattttgggcatttcatgcctattttattcattcaaggaagatgcctatattaattctttgtattttaatattggtcttgtgtagatatttcgttaacttttttttcttgatgagcttcctatgttttagtatttacaatccgttaattcaacttagtaagaaatctattaacattcataaatttaaattcttgttaacttaaataaaatttttatagatttcaaagtttaaattattaaatgaataataatttatgtctaaatataagttggaataaaaaaattattaacaaaattaaatgttaatttattacatttaatgaattaattttctataattttatatgtgttaatttatacaaatttcgtgttaataattctttcagatattttatg

SEQ ID NO: 100128 - DNA, 54 bp, Heterodera glycines
  Promoter: Source sequence=SeqID_18946; Location=1..54; Strand=+; Gene= SeqID_83676
acaaaaagggaaatccaagcgaatcactgacaaaatcacccataaagaaaaatg

SEQ ID NO: 100129 - DNA, 188 bp, Heterodera glycines
  Promoter: Source sequence=SeqID_24558; Location=776..963; Strand=-; Gene=SeqID_55282
tcaagttcgaaaacgaagggaaagaaaggccctgagaagaaaggacaaagtcaacagggaaagcgaaacgccggacccaaaccaaccggaaaagcattgcggggccaggccttgaagctctgctcagagcaattggagggaagaatgtggttcgacgagaactccaagaacagaggaacccggaaatg

SEQ ID NO: 100130 - DNA, 83 bp, Heterodera glycines
  Promoter: Source sequence=SeqID_16899; Location=2411..2493; Strand=-; Gene=SeqID_81334
atttttctctctccaatgaatggtcctttagtttgccttcttccactgccgtttcgacgtcgttgtttgggccaccgccaatg

SEQ ID NO: 100131 - DNA, 293 bp, Heterodera glycines
  Promoter: Source sequence=SeqID_25866; Location=1073..1365; Strand=+; Gene=SeqID_56636
gggcggaaatgcctttgtatttttaatttaaaaataatttatcggttgtttcctttaagttgtcattagtaaaatatcacttccttaaatttgggggaatgtaaagattgtcataaatttgtttttcattttgcttggtaattttgtcacgttcaattttgtgccttcgctgccgctggtcgataaatgccacacttcgcctgcctttcgtgccacccttccctttcctctcccattttatttataatgattctttttacaattttacatcccaaataataattaatcaaatg

SEQ ID NO: 100132 - DNA, 90 bp, Heterodera glycines
  Promoter: Source sequence=SeqID_13536; Location=1..90; Strand=+; Gene= SeqID_77437
tgtgctcgattatgcattcgaaaattcgggaaagtatggcgcaattcaaaaataactaatgttaattaattaattaattaattttaaatg

SEQ ID NO: 100133 - DNA, 339 bp, Heterodera glycines
  misc_feature (5)..(5): n is a, c, g, or t
  misc_feature (12)..(13): n is a, c, g, or t
  Promoter: Source sequence=SeqID_17603; Location=1635..1973; Strand=-; Gene=SeqID_82108
tatanttgtgtnntagtggttagtgcttcacccccaccagtatttctttttggagtcgccaccggttgacgttttcatttgaatttatttttatctgattaatccagggtttctttatgtgcttatttctaagaaatgtccctgattttagggcgtattttcatccaaaagaatgaaatttatgaaaaatttgactaatttctaacaaaattcattaaaaaatttcccccggcggcgcctatcggcaccaccggcccccaaaaaacctattttttcttaaaaaattagcataaatcaataaatttggtaattctttagacaaaatctgtgtaatttatg

SEQ ID NO: 100134 - DNA, 796 bp, Heterodera glycines
  Promoter: Source sequence=SeqID_6866; Location=367..1162; Strand=+; Gene=SeqID_63156
attgttaaaaaaatacaatgagtccggccaaaaccgagcaaagaatcacagtggcaatgcaaaacaaagtggaacgggcacgagcgaagcgaacgccaacggacgaactgacaaaagaggagccaaaagatatgatgccacatttgggatgaggttgtaaaatgagtttgaccaatcaaaaatgattaaataattttaaaaacatgctattttaaatcagattttaggtaattgatttttcaaaacatttttttgctttttaaaaaaacccaggcccaggcttggatccaggcctcgagttttttcctgggtttttgtccaggaaatccaggtccaatatggaatccagttccttttttcaaaatgtcgaaatctagtgtttgtccattttttggtgattggtcgctttttttttatggctgaccattaaatttatgccttcccccctccctgaacttacacgcctttgcagtgcggacaatgggccaccgtgttggacagcgtgttgaagattatcacctcagcgcagtgcgcgcactgcacgcggcacgtgccggccggcgcccgcaccgccgtgccgacgggagaagaggcggccaaagtgatcacccgacgacagttctgccgagggcacgcaatgcgcgcggaggacgccttgcacacgagcagacagttgcaggggcagcgcacgtacttttttccgggcggtgcggcacggatgggcgtcacctatgacaaaatgaggggaaaagcggtgtaataggaaacggccgacaaaacaaaatggtttcaaatg

SEQ ID NO: 100135 - DNA, 154 bp, Heterodera glycines
  Promoter: Source sequence=SeqID_5872; Location=896..1049; Strand=-; Gene=SeqID_59508
ttatattaatagatatcccagaaaaatggctatctctttttttgagaaattttctatgcaacaaacgctctcgaacatgaaacgaagtgcggtgcgccatggccattttatttttcaaataatttttatatttaatagatattccagaaaaatg

SEQ ID NO: 100136 - DNA, 120 bp, Heterodera glycines
  Promoter: Source sequence=SeqID_727; Location=2200..2319; Strand=-; Gene=SeqID_59926
tcactcaccccatataaaagctctccaaattcacccccaatcagttcaaccaaaagttggattttgctaaaataagattgtgcgtaaatatttagaaattattaaatattattaaaaatg

SEQ ID NO: 100137 - DNA, 94 bp, Heterodera glycines
  Promoter: Source sequence=SeqID_15281; Location=769..862; Strand=-; Gene=SeqID_79495
tcgccatcaaaatgttcaaaaatggtagagtttcaaagaaagtggcgacggaggcaaacgcaaagcaaatttaaagggaaagtcgaaaagcatg

SEQ ID NO: 100138 - DNA, 604 bp, Heterodera glycines
  Promoter: Source sequence=SeqID_23372; Location=142..745; Strand=-; Gene=SeqID_54080
aatgaatgatcaatcggtgattgtgaatcgaaaacaaatgttgtatatttttgggaacgtcgaatggttttgacattatttgatctctccaattaattttcacttttgcgctgcataaaattctatttaatttgtccgttttgcattttcaatattaaaatcgttttgtacacgatttttatttcaatattcgcaccaattttctgttttttttaatttccttttgaggcctttcatttttctctttccgttattgcctatgtttgcttccgtcgttggtgtttttctgttcattttgcctttgttcgccggacagtcggccgacagtgacgagtcgttgggttggcttcgagaatctcggcgagacggcaaaaacagtgcgtttttttgtcgaatttttacaacatttgggcttttcgcctgatttgacgagttttctctttctttcagggccaaagttcacttgctaccagggcaaattcaacaacagcgtaagggcgcctgtgctgacgaaatgtgtgggcaaagtgtgccaacggtacactcacattcaatgtacggtagcgcggcgtaccgtacttttggatgttcttattcagttatg

SEQ ID NO: 100139 - DNA, 58 bp, Heterodera glycines
  Promoter: Source sequence=SeqID_25544; Location=1..58; Strand=+; Gene= SeqID_56287
aaataaaataaattttaaaaattaattcaattttataattaaagaaatttcaaatatg

SEQ ID NO: 100140 - DNA, 199 bp, Heterodera glycines
  Promoter: Source sequence=SeqID_10796; Location=538..736; Strand=-; Gene=SeqID_74058
tctgaaaaaaattaaattcctagtgaattattgaatgatgcatccatttcttttactcgccttttatatgagaatttccaatgcgttaaaattgcgacagttaagcaaatatcatttttctaaaatttcagcatcaatttcgaataaattcgttaaaattgcagtaattcttactgatgatcattaaaatttgcagatg

SEQ ID NO: 100141 - DNA, 442 bp, Heterodera glycines
  Promoter: Source sequence=SeqID_8039; Location=2353..2794; Strand=+; Gene=SeqID_66788
agtaccgttttgccctctatgacgcgcagagaggtaggccatcaaaagcaattttaaaaactaattaattaatattattattgggagaaacgatttatataccgtatgatcaccgtgcccgttaaccgttaaaggagtgcctccccattcgggccttttaccgcccaccaaggcggtggtggtgtacaaaagcaatgagcgagtgaggggcgttcagggtccgccaaaaagtgtggctacttcctactgcagtccgcaggtgaaaaattgttgcaattggacaatcatttttagactttttcattttttcgaactccaatggacccgaaagtacgaaaaagttgttcttagcattaattttacaattctagtgcatatttaggcttttttttctataaaatgttctttcactgccaaggcggtggaagcgaatcgcgcgatg

SEQ ID NO: 100142 - DNA, 111 bp, Heterodera glycines
  Promoter: Source sequence=SeqID_2441; Location=510..620; Strand=-; Gene=SeqID_79732
ttttgcaatggacaaaaattaacacaacactttcatttgcctacccattcttttccctcccgtttttgtttgcttgatttacatattttgcaggagatacttttaaaaatg

SEQ ID NO: 100143 - DNA, 161 bp, Heterodera glycines
  Promoter: Source sequence=SeqID_5508; Location=1310..1470; Strand=+; Gene=SeqID_58278
actaattaatcattaattagcaaaatgatggctcattaaggtgccaaactttgttgtgccgcatcactcactgatctgaacgcaaatgaatacaaaaattggattgaggcggaaaacccggacatggacattgtcatttccgcgcacctttcaacaaaatg

SEQ ID NO: 100144 - DNA, 447 bp, Heterodera glycines
  Promoter: Source sequence=SeqID_2150; Location=1649..2095; Strand=+; Gene=SeqID_78095
atgattagagctcgacaaaacgacttttggggggttttaaatgcatttctttgaaagatttgttcagcttttattaaaaactgtttattaaaagcgcaaattgtgataattatttaaatatatgcaaattttgtaattttttttataaaataggtcttttgcgagtaaaaaataattggcatcatgtcaaaattggctcgcgctgttccaatgcctcccttctgctgtttaaatcatatgatgccaattttacaaatcaatttgccagcactgtttaaaggcatcatgccaaaatttaaaagaaaatgccccaaatcggaacaggacggttcggtgcccgccgtttcggtgccagcccaagttttggacgacaacttttgatgtagactttgattcctccttttattgtcagtgggccgaaataatcgacgccagtcttctcaaatg

SEQ ID NO: 100145 - DNA, 205 bp, Heterodera glycines
  Promoter: Source sequence=SeqID_37387; Location=861..1065; Strand=-; Gene=SeqID_46512
tggtagccgtactcatattttgtgtatcatcgtgctgaattaagatttaatttgaaaaatattcaaaataggaaactcgcacattttggcgcactgcaactgcacacaatgcaaaaaaaaaacgtccaaaattgtgtataaaagtcgctgttgtgatgcatttttctcatattttactaacggggcgtaacacaacgagaagatg

SEQ ID NO: 100146 - DNA, 1003 bp, Heterodera glycines
  Promoter: Source sequence=SeqID_13189; Location=817..1819; Strand=-; Gene=SeqID_77011
caaaccactaatgtttttcaaaagcatgacacacattagtgtctcacactaaagtcacagaacaaaccactaatgcttttcaaaagcatgacacacattagtgtctcacactaaagtcacagaacaaaccaaagatatgcatttatatttcattaaagttcaaataacattaagcataagcataattatttcacgtaaagaacacaaaaacaaaataaacaaataaacaaacaacaaccactaaatcaaactcaaacaatatactgataaattttttcgtttacaaaaaacaaatttatttttcaaatgcttttctaacgcaaaacaaaacaaaaatattttcattttcaaatcattttttaacgcaaaataataacaaaacgccacgccaattcaaagcatggcagatacaaacactcatctttattatataggattatgggaaaaaattggcgttctgtcacatttactttttatctttatttctctcacttttacgtactatctcttcattcttaataatgtaaagaacaacatttacttcgtgacgtttaacttttttcctgcacgttaaatccataccaaattttgcatatcgatagagaaaaaaattacgaacataattggagggtttttatgaataaaaagtgggttaactaaaaagttatggagtgattaaaatttttgcatttcttttcctctcgtgttggcgtactattttcacatctctaacacacaaaaaacaccaaattcgaaaattctaataattttggttataagggtacaaaatcactttgaacatttagaatcaatagaaaaaagaataaatttagcattttggttagaaagagctgcctaggacttgagttataacgtgatgaacatttgaaactctcacaacttttttctgagatgtcaaattgcttagcattcacttagaaaaagattctccttttcaaaatctttttttagataccaaatttgttcatttttgttgggaatg

SEQ ID NO: 100147 - DNA, 244 bp, Heterodera glycines
  Promoter: Source sequence=SeqID_5361; Location=1..244; Strand=+; Gene= SeqID_57790
tttttttagatttaacttagaaaatttttcgaaaaaacttttgacaaaaattttttataagaaaatttcaaaatgaaaaaaaatctcagctttttttgggaaaattttgaaaaaagataacctatcgtaaaaagttttcaaaaattgctaaaaaatgaattctcaaaaaaaaattctaaattttcatcaatcattgaaattgctggatatagggacggacatacattggtagaattgaagaatg

SEQ ID NO: 100148 - DNA, 600 bp, Heterodera glycines
  Promoter: Source sequence=SeqID_43085; Location=747..1346; Strand=-; Gene=SeqID_70848
ttgtagcgaaagattagtttttgaactttgttcttaattaaaaacaaataaacaaacggaggaacaacaaacggtttttaaggaaaagtgaacaaattaacacacagccaaaagaacggattctcgaaaaattgttagttttaattattgatgagagcgtttggcttttaataactgtcgaaggttgggttgttttccggtgtaacagcctcagcctgtgtagatggaagttaggaattttagtcaaattgtcagttcatttttaggtaagcatcattcatcaaaaaacaatatcgttttaataaaagaagaaacaaaaaaaaaaaaatagttaatttcggaaacatttacaaaagcattttaaatcaacgcagaatcgcataaaacccgcgtttatatatttttttattttttggggtaccattaaaagtaacgattacctttaaaaagttcaaaaaagagaaataaagtgtataaaagtaagaaattttcgctctttgccctcacaattttaatatttatttcccacaattacttattgaattgtccttcgactacaacatttaatctcacgaacggacgtgccctggtgcaacaatg

SEQ ID NO: 100149 - DNA, 386 bp, Heterodera glycines
  Promoter: Source sequence=SeqID_12009; Location=967..1352; Strand=-; Gene=SeqID_75534
aacaaaaaaatcaataaaaacaaaatttctttaaaattcgaatctaagtttggcatttcaaaaatgggttcaaacaatttcaaattataagtaaaagtttttaattttttaaaaggtcttttattctccattttgtgccaaatggaacataatcccaaaaactttttgtttccctacaacaagaattttagacaattttctaaaaccttagatgtgccaaactttccggcacttctatcacaaaaagttatcattccctcagcaaaatttgcttccattttttggatttttaataaattaataacattcagctgtttcaacagcagcattcttcgtccgtttaccaaaacaataattttggcgattttggcacttcaaaaacaatg

SEQ ID NO: 100150 - DNA, 499 bp, Heterodera glycines
  Promoter: Source sequence=SeqID_1955; Location=480..978; Strand=-; Gene=SeqID_77017
cattaaaatgcatatgatattggtcgtgttctgttgctatttccgcgggtgctgaaattggcatttgtgccgacaaagttggcattgttccgtcctctcaattggaccccgcgcaatgccgtcattggcattatgttgagtgtttgcgcttgctgttgatgagaacgatgtgtacatttgttgtaaacaataattttggcatagcgcacaaagtctgtacgaatggttttgttcagtgccaaataaatcagcggcggaattttaaataaataaataaataatttatctaatttttttaactttattcaatgtataaatttaaaaaatttccaatccttaaatttttcgaaaattttcacattttcagtgtatttagggatttctaggcttccgaaaaaatgtccctattttaaacactcgttttcgggaaaaaatgtcaaaatttttctagcttacattttgctttccgactttctgggtctgcatatttttagaaatg

SEQ ID NO: 100151 - DNA, 438 bp, Heterodera glycines
  Promoter: Source sequence=SeqID_42261; Location=888..1325; Strand=-; Gene=SeqID_70196
ttataccaaaccccgaattttttaatcggttttcagaaaaaaatacttggggtgaaaacaatttttccacatttcactccataacttcgtgagttcggctcggatcgagaccgggataagtccattggaaagagcagctcgagctctacaagaaggtatgaaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 100152 - DNA, 615 bp, Heterodera glycines
  Promoter: Source sequence=SeqID_3999; Location=3757..4371; Strand=-; Gene=SeqID_52759
atctatatattgtgaaatggtgtttatgcattgatttgttctttacttttcctcgctttgtgacaaaataaacaaatttctaaagatccatttccacttttcttactttgccccctctcttcctattgtctttctcctccattctccgctaaagaccgtttcaccaaatctcccacctccccggcatttctcatattggtacttttactttgggcaattatcataataaaattagctcgttgagcagccgtttgagtgcgcttgtggagacgaggcgacgaaagtttgacaaaaggtcaacaatcggaaattatctgtcaaatgctttcgaaaagagggacttgaaataacgcagatgaagttttgggtagagaacattcattgcgtcgctgatcagtgatcacaaactaactgtttttagcctcatccacttgaaaagtgttgggttttgcccggcggacggcgaactgaacagaatttgcgtgcttgaaactgatggaggtcagtcagtttggaagtatacatccgtaccgttttaatgtgccacttcccccgtttaatccataaaattttgtgtttaatgccttttttatggcataaaatgaataaaaaatg

SEQ ID NO: 100153 - DNA, 799 bp, Heterodera glycines
  Promoter: Source sequence=SeqID_12388; Location=1..799; Strand=+; Gene=SeqID_75992
gccgttttcgcgtgggcccgagtttttgaactataactttttttattgtcaaccaaatccaacaatcttgctatcattcgaaagccctcttcacatgctctatctattagccacaaaaagcaaaacgattttgtgaacagtaaaaaagaaatttaaaatttttttcgagtttttcgcaattttcatgttataaactttgtcttggtattttaactgtctaatcgccaagcaatagtttactaacaatttctaaacatattaagctttccaatgatacccagatcgttggaagtttttttgatttaatattaaaaaatcttttttgtaattaaaaaacccgcaatccattcggttatcccacatttgcgcctcggacatttgcgtgtccaaaatacggttcaaacttaagtttttttaaaccacagatagattaatcagctttaaataagcgattgaaagtgattgcatgcaatatttgatggtcagcaaatttttgaaaaaataataaatttttcaaaataacagaattattgttcctaataaattgggcttccaaaatatggatataaaatcgcgaaatatggccataaaatattgaccaaaaatcgcgaagtatgaatataaaatggcaaaaatttggacataaatttcccaaaatttcggtaaaactttcaaaactcgcaaaatttttgttaaaaaatgattttcggggattttttcaatctttagggggtcaaaaaggccaattaagttgatggggccgttttaatagagatttttggaaaaatgcaaaaatatg

SEQ ID NO: 100154 - DNA, 954 bp, Heterodera glycines
  misc_feature (705)..(705): n is a, c, g, or t
  Promoter: Source sequence=SeqID_21492; Location=927..1880; Strand=+; Gene=SeqID_52103
agtaattaagcagatgcagcggcggtggaaagcgaatttcgcaacggagagaaatgacgggaaacaatttttttttttggaattggattttgcattaattttggagacggactttggcgatggttgtccaatcgaatgaaataaatttaaacaaaaaaaattgacgaaaaattatgaaatggaaataatttaatttattaaaatgatttaacaaaataaacatgacaggaacaaatcttagtaattaggacaattggcagtcgacaggacccaaattgcaaaaagctatgctaagaatttgtctaatcacccactgatcggaccgcctttcccggtcgctttcatgtgcaaactgcaaaaattatcaaaaaattatgcttacaaaagatctgatctctacaggtctacgttaaatggtttagtttaaggatttagatacaaaaaataagaacaactcatagaaataaggacattttgtagccctgtcgttattgcaaaaaattatgcaaaagaatttctctgatcaccactgatcggacacaatttccgattgctttcatgccatttttcaattcattaaagcattgaacccaagccaagttggcaccatgccatcattaccgatcacagcgatcaaaacttcgcaggtgccattgcaaatgttgaggagcagcatcgacaaaatggaaaaacttaatttattanatggatataaaaatttaatttaaatttaaaattattttagtttttcaatttccattcatatgatcaattttgtaatggccaaaagcaatgctaattgagtcaaactcaaactttttcttcaatctgatcaattgaaagagttttcttttctgtcatattaaaagttgatttttgcaaaactttttttttaggaaaataatatttattactacaataaaaaacatttaaaaagtacaagagcattaaatg

SEQ ID NO: 100155 - DNA, 393 bp, Heterodera glycines
  Promoter: Source sequence=SeqID_15066; Location=112..504; Strand=+; Gene=SeqID_79239
tttgcaaatgtttcaaatcttttcatcttttattaccgcgaattgtgtccataattaaacattcattttttaaaatattctccccgtttcctcaggttctgttcaatttctgctcgaatctctgcaggacatcagttccaccaattgtggtggtgaattctctctccaatctgtcctccaatgcgctcttcactctttccaggcttttcctttgccttttccctttttaaattcgttcgctttttagggtttgcccgcccattccagcaaagagtgcattcttttgattgccagcttaaggtgataattttgcttttgattgtgttaatttgcgtcttttttcgttccgtcgatgcgtcccctctccgccacactttcgagcagctcaaaatg

SEQ ID NO: 100156 - DNA, 118 bp, Heterodera glycines
  misc_feature (76)..(76): n is a, c, g, or t
  Promoter: Source sequence=SeqID_38354; Location=1..118; Strand=+; Gene=SeqID_67193
ttcattttatatgacaacaaacaaagtggactttttatgactgccagagtcggcatataaaagcactcattttgcncatattttacattccttgtcaattgtttattcgtcagcaatg

SEQ ID NO: 100157 - DNA, 277 bp, Heterodera glycines
  Promoter: Source sequence=SeqID_1277; Location=1..277; Strand=+; Gene= SeqID_71321
ttttcttgctttaaaaccgggaaaaactaatttggtgttggacacaacactttttggtgccacgacccgggaccccaaattacatttgttgaaaatttgggggtgaaggctaaaagccacaaataaaagcaggaatttttgagctggtcaaagctgtgtgcttccagccgggctgttgtgccaaaaataacaaagaaaggagaagctggtctaagtgtgttctttccagctaagctgagtgctgtaatctgaataaaggcattaaaaaaaaaaaatg

SEQ ID NO: 100158 - DNA, 190 bp, Heterodera glycines
  Promoter: Source sequence=SeqID_5830; Location=1..190; Strand=+; Gene= SeqID_59369
atttggattttttagaatttctcccccgtttatttattcagccatggtttttctagcaaattttaaaaattttcccaatgttgggcctatgtaatgccactttttgacatgggcaaaatattgggaaatatttaaattcccacgaattttttttgcatttaaaaaaattcaaataaaattattttaaatg

SEQ ID NO: 100159 - DNA, 1003 bp, Heterodera glycines
  Promoter: Source sequence=SeqID_2556; Location=1790..2792; Strand=-; Gene=SeqID_80405
atcttttaccttctttttctgtgctatttcttttgtcttcttcttcttcttaactatttattttcgtctcttttctttatattctcttctttttcaaaacaatttcttttcatctcttttcaaattcatttttaacgcaaaactcaaacaaaacgccacacaaattcaaacaccggacacacacaacaaacactcaactttattatataggataacttttttattacttggtaatccaaaattctttttgtttacgtttgcattttagtcggatcaatttttttttaccgatggcaaagcgatgaaaaaatgcataaaaacagggggggaaggagcacaacgaaacatttgcatgtttttttttgctacaaatttcctcaaaataatcacaaagcccaactgaacataaagttttgctgattttgtgccgtggtttttatttcttgccaattttgaaattgccaataattttaccgcatttaaatagataattaaacgaatgatggaattgcttatcatgtcccaatcagtgcttgatcggatgaagcatttgttgagcacgggagaggacgcggatgtttattttttggtgggcgacggagacgcaaaagaggcgagtttaatttaaaataaaaatttaatttattaattaaaaattggaaatttagtgaatggtaatttttgttgtgttttttaaaatttaatcctcttaagcttgtgccagcccataagctcattttgaaacacgcttccgacgtttttgaggcgatgttccgttttgatgccaaaaaggaaaaagcggaattcggtaaaaacattactgaatgacatttacaatttagtctctgcaaattaccctaattaattttcaatagtcctccgctaattgctctaattaaattttcaattagccgccgctaattacactaataattttcaattagcctctgctgattgtcccgtggaggtccccgacgttgaagcagcagcattcaaagtgatg

SEQ ID NO: 100160 - DNA, 1003 bp, Heterodera glycines
  Promoter: Source sequence=SeqID_18610; Location=1473..2475; Strand=-; Gene=SeqID_83261
gacacttgcggcgccgacacttccggcgcccagtcaaaaggacacttgcggcgccgacacttgcggcgcccagtcaaaaggacatttgcggcggcgcaaaattcaacgaccccaaaaatatttcaacaatttatttccattaaaaacattgataatgactctctcagtcccattcttcaaagcctttcatccctaggcgatgatgactaatcgtcggatcgcttcatcatttctcaaatatttttttaagcgtggcctttcagcaattccacgagttgggtcaatttcgtaaggtctcagacggttttgttggtgttcttcctcatttttgatggcgataatgaaccttattgaaattattttattacagtacccatttatactttgaaaatgatgtgtgtggcgaagtgaaacgttttctgttattgttatagttaaattagtcattgttaaaaaataaactattaaaataacaattctgttaacttaaataaattgttgaaattttttgggaccatttaattctgtgcgcaaatgttgttttgactgggcgccgcaagtgtcggcgccgcaaaagtccttttgactgggcgccgcatttgccggcgccgcaagtgtcgtcgccgcaagtgtcacgccgtaaatgtcagcgcgcgaatgtcgctttgactgggcgccgcaaatgtctgcgccgcaaatgtcagcgcagcaaatgtcagcgcagcaaatgtcagcgccgcaaatgtaggccaatcattcaaatgtgcgtcactcttcctttgcattggatgccagtactgaatccgctggactcagttttctgagtcgatgactaccataatgccgtggtcaatttcatccggcatacgattttcaggagaccaaaattccggttgcacaacagagagttgcagatggccagcagggcacatcagaattattaatcaaatttgcaaataaattggcaaattattatattttcagtataattatgtgagcaatg

SEQ ID NO: 100161 - DNA, 68 bp, Heterodera glycines
  Promoter: Source sequence=SeqID_29684; Location=1..68; Strand=+; Gene= SeqID_60153
agggatcacacatcagctcgtaaagaagccttcactttcattgcgccttggggtttgaacacccaatg

SEQ ID NO: 100162 - DNA, 859 bp, Heterodera glycines
  Promoter: Source sequence=SeqID_2354; Location=5124..5982; Strand=+; Gene=SeqID_79289
attttttaaaattatatttaaaaaccaataaaactaatcaatttgtaaaaattggaaatttcgctgtgtgtaaatgtggcatttattgccgtgttttccccggttgtccatttcacatggcaaattgcattattctcatgtgtttattaaatggaaaaaaagaaatttaaaatttaaacaaaaattgactaaattttaaaagaaaattgacaaaatgtttacaaaattaacaaaattttatatattataacatatttttaatataaaagcaataagagaataatttaaaataaattggcaaaatttttacaaaaattgacaattttttataagaaaattggcaaaatttttacatactctagcatatttttaatataaaagcaataatgaaatagcttataatgtaatttattacatatttggttttataatcattagcgttgtgcgtttgtatgctaaaaaaatgccaaaattataaaaaatatgccccaaaaatttaaaaaatggatttaaacaaaaaaactgcagctgtataaattcaaaattgacctggataaaaaaatcacaaaaatttttttattttataaattaacgtatgaaaagtttgaatgtttttaaatttgtatttaattatctggcaaatgcaattatattgccaaattgagaaagactttcttccgttaaataattttacgagttttttggagcagatttttgaaaattccataacccgaacgaatggaggggcaccgtatccaaaccgaatcgagaaatttcaagttttccattttaaagtttcggtttaccgaccccttgaccggtctatattattaatgacactaattaattataggaaatg

SEQ ID NO: 100163 - DNA, 597 bp, Heterodera glycines
  misc_feature (14)..(14): n is a, c, g, or t
  misc_feature (25)..(26): n is a, c, g, or t
  misc_feature (43)..(44): n is a, c, g, or t
  misc_feature (48)..(49): n is a, c, g, or t
  misc_feature (58)..(58): n is a, c, g, or t
  misc_feature (67)..(67): n is a, c, g, or t
  misc_feature (75)..(75): n is a, c, g, or t
  misc_feature (82)..(82): n is a, c, g, or t
  misc_feature (85)..(86): n is a, c, g, or t
  misc_feature (94)..(94): n is a, c, g, or t
  misc_feature (224)..(224): n is a, c, g, or t
  Promoter: Source sequence=SeqID_27997; Location=1..597; Strand=+; Gene=SeqID_58661
atattccaaatatnctatcatattnnctccatcaatattccannctcnnattttattnctttttatnatcccttnccaaatnaannctcaattnaaaaattttatttttttaccttttttgaaaattttcacaaattttttttcaaaaacaatacttttttgttttaaaattttttagaaaaactgggatttttcatcatctacgtcttaaacattttttttgnatttttacagcctaatcaaagcatggttcactgaatcgtacaagcacatgaaaggggttccgataacagtggaagagatggaatcgaaatgtgaaatttttttaaattttaatattttccataaaaaatatttggcgctaaaatttttatttgggtggtttggaatttttgctatttagatatttcctatttaattataattagttttttgaatttctaatttagggcaaaaaacttttattaaatttaaaaaagaaaaaacttagtttttcgatcaaaaacgggaattttttaagcattgcactaatagacgtaaatgcattaataattatccagggcattttctgtcggcatttttgccattgacggaatg

SEQ ID NO: 100164 - DNA, 931 bp, Heterodera glycines
  Promoter: Source sequence=SeqID_20577; Location=952..1882; Strand=-; Gene=SeqID_51132
tctttcacccttcccgtccctctttctatgtccctcccccttccgtacgcttccctccctttcgtgtctctcccccatcgttcgccttctctcttctctctcccttcgttctacatattttattctcaattccctcttttccactttcatcatcgctctttcttaataatatttcatgtctttgtgcagaattgacgtaaggaaagaatgttcgttggatttcgtaaaatgtctgtgtacatatcaaacagagaaggatgatgttttgtgggttgttaaagaacgtcaaacactcttaaggcacgcatggacggtaaaaaacgaaaaaaattgccaaaaaataattggcgtaaaaaacaaaacgccaaccagggttgttccgggttacccgaaacccgatacccgaaacccggcctttttctcgacccgaaacccgacccgatgattttgggtcgggtttcgggtcgaaataagcactggtaagaaaggggtctgggtgaaaattaggtggataaggaaattgagaattttttttgaaacgattgtgttcaatggaatcgaaaattttgtatttgtatttgttcattattatcctttttctaaagatattttgtatgaatttcttgaatttaagcaaagcagatggctgaaaagcctgattccatttggttttatttccatcgtcctataaatggcgcaattcgctgcaaatattgcagtgccatttgatttttaaacaaattaaaaatttgtcaattgacccgaaacccgatacccggcctttttctcgacccggaacaaccctgatacaaaccgaaagagtaccaacttttattccattgttttcaacgaattaaatgtatctttcatattatcccccataagatggtttctcaacatatttagtttcagatgaataggaataaaaatg

SEQ ID NO: 100165 - DNA, 304 bp, Heterodera glycines
  Promoter: Source sequence=SeqID_9650; Location=1..304; Strand=+; Gene= SeqID_72196
tttatattgagacattttcaaaaaatacaaataaaaaatcatggtccagggtccacttagtttttggttttcttacccccatttttaccaaatttttgaggcatatggtagtccctatgttgttgtttcgaaatcactgcaactgttagggaatagaggtgatgggtgtaaacaaaatggtgatgactcacttgcatctaatgataggggagcgtgataaacaagcattgattacgctttccgccccttttttgtttcattgttgccaccacccactcactcaccaccacctttccaggttatg

SEQ ID NO: 100166 - DNA, 811 bp, Heterodera glycines
  misc_feature (50)..(50): n is a, c, g, or t
  Promoter: Source sequence=SeqID_3010; Location=1..811; Strand=+; Gene= SeqID_82749
taaaaattactttttttggtatttttaggcaacatcccctaacttatttntttctttataaattttcaaaatatgtaactaaatgaaaatatgtacaaaaatatttgccgaaattttggatttttttttgaggatttccaaaaatttccgtaaaaaatactcaaaatatgtaaaaaaaatgaaaatatatatgaaaaaaatcccgaaatatgtaaatatgtataaaaaccccgaaatatgtaaaaatatgtaaataaaagtcccggtttttgttcgcaaacacaaaaaagatgtatttttcttgctatttagagcatggaaaagccagggaaaaaatatgtatttacataaaattgacagccctagtaatgacaaaatttatccaaaaaagtaaaaaaataggccaaatcagtattgagctaaataatttttaaaatcacaaattcttgtcaaggaaaaaataaattttggggattgatttttgagaaaatttttcatttcttaggcgtgcattttacagaaatttttgggtcgattcttaggggtttattttttgaaaaaattttaggtcggattcctaggggataacaacaaatttttattcacaagcaaaaatgttgaaaatagttttttttttaattttatagttttttttgttgctaaaaataaaaaaacttttaggccacggagagctcaggaaaaaaatagtgaaaaaacgttaattattagcactagtaattattagtaactatttgctaatataatggttagcatttgcaaatttcgtattttttaatatgttagagacatg

SEQ ID NO: 100167 - DNA, 378 bp, Heterodera glycines
  Promoter: Source sequence=SeqID_7058; Location=3458..3835; Strand=-; Gene=SeqID_63699
atgagtgattaattggcaataatcatatgttaaggagcaataatcattaaggctaattagaccaatgttagttgccgcgggtcacaaaaagccaatttcgtttcagctaacgcgaggcgactctgacgaacaaatatgaatttgtttgggaagatttaattaagcctttttgttgagtattttagatcaaaaatttctcttttcccttcgaatttcaatgctccgctttttcgtcttccgtcgcttttttccttctccccgccattcgtccgttcatttgcttacaattcccaaaatcattttgtcccccgcccctcgtgcctttctccgttgtccaaatgcattgatttctgcgttgagccatttaatcagacaatg

SEQ ID NO: 100168 - DNA, 61 bp, Heterodera glycines
  Promoter: Source sequence=SeqID_5139; Location=1333..1393; Strand=-; Gene=SeqID_57050
cgttgtggagcagttcagcgacggcgagggaatgctcatgaaccgatcaaagccgaccatg

SEQ ID NO: 100169 - DNA, 557 bp, Heterodera glycines
  Promoter: Source sequence=SeqID_6914; Location=3966..4522; Strand=-; Gene=SeqID_63284
caacttaaattcatattttttagtaatatcaaatcttaactaaaaaaacacaaaaaataattaaagtaaaaaataaatacttgaattacattgtacaggggcaaaggcaatcttcgactacaattttaaactaaaaataaatataataatccaaacgctaatccttaaggggatggaagctgatttcatatttaaacttaatataaattttaatcaatgaataaaatccttctttatcatgaaaaaaatcagcaaaaaatcttatgggcatataaactgaaaaaccgtgccaactgtaatgtaataaaattaattaaacataattgcatcattagagcgcttagatttttgaaattctatattctgataaataattcttataattatttaatgtatcacaaatattaaatttttggctgattttgtgatgtaactgaaattgcttaaattatatttgaaaaaataatcactactcaaaaaattttggcaaaaatgaaggaagaaattgaaatacaaagagcacaagtaccatacaacaataatctgtttggaaaatg

SEQ ID NO: 100170 - DNA, 129 bp, Heterodera glycines
  Promoter: Source sequence=SeqID_1402; Location=4810..4938; Strand=+; Gene=SeqID_73294
cgtaattctaaataaataaacccattttccaaattaaaattaatttggttcatttagcggactggcaatggcgcttgcactgtgccgagacccaaccgaggaatgtggttgagctgggccacaacaatg

SEQ ID NO: 100171 - DNA, 1003 bp, Heterodera glycines
  Promoter: Source sequence=SeqID_12824; Location=767..1769; Strand=+; Gene=SeqID_76547
gtgagggcggcgttactccggtctcgatctaaacatttttgagaccaatgcttaatttttgcgtctattcgaatagagaaacataaaagatagctagattaattaagcaatttattcgttttggcattaaacaattatattttttaaattaaactaatgtcgagacccttttaaaacgatttttaaattatgaaacttagacagcaaagtaaaaaaaatttagaattgaattcacatcctgacttaatgaaatgagaaatgctcaaaattaattaaattaatgttaatagatttatggagaaaaccttacttctctgatggcgacataaatcaccaacatcgcattatgcgacacttgacaaaacttgtaaaagttgtcattcggaattttcagacgcaccagatcccactcctttaaataaattttaaattaagaaagaattcgatttattttgatttcctaattacccaattgaaggggagagagagtcaagaattttgcaagtggccaggggtcagaggcgaggaattacatagatcctaattgttttcgttttcctctttctattcttcgttgggacccaggggagaaaacctttagacccgccttctttccctttttatgtatattgtataatgaccaaattgtccatcaggaaatgatgaatttcactggttccaaattggttgccgaaactcatgataacgttctcttgttgaaagtaactctaatccgctgtcgctgtgtttaaaatttataaaaatgaattttaggcaaattttggtcatgaaagaacagaaaccatcacattttcaatgattgtttaaaattagtttgttggattaatttcttgcttctgcttatatcctattttccaaaatttttgggaaggcaaattatttatgtgctatttccaaatttcctttcatttctctcgtcccaaaaagctcaaagtatcaaaatactggtgtttaacctcgtccggtccgctcattcgcaatg

SEQ ID NO: 100172 - DNA, 463 bp, Heterodera glycines
  Promoter: Source sequence=SeqID_12343; Location=3276..3738; Strand=+; Gene=SeqID_75941
tttgaaagtaaaattttatcttaattagctgacaaatttaaatgctccatttgccattaatttgtgctcccattttatgccacaaatattctttaaaaaattatttttggtatttgaagaattaatttgtgacatatttaataagcttttaactcattttacatcttttgcaggtgccttttactgatcaaaaattgttttattgtcattggtatttatttttggaaattgctttttaattatgcgtagctcattttattctattccgtgctcattttgccttattgtgaataataaatttggatatttgtaagattaatttttgaatatttgataagtgttgcgtttgttagggacaatgaaaggtgctaaaaataaaaaacattgttaagaaaatcctcttcctataaaggatgcgcttcctaaaaaggtaaataatttgttggaatcctattaaaacatg

SEQ ID NO: 100173 - DNA, 85 bp, Heterodera glycines
  Promoter: Source sequence=SeqID_21766; Location=1588..1672; Strand=-; Gene=SeqID_52371
taagttttctgaaaattttttttaattttgtagacaaatagaaaatattaggcttttgaatgataccaaaaattaaaatataatg

SEQ ID NO: 100174 - DNA, 629 bp, Heterodera glycines
  Promoter: Source sequence=SeqID_3250; Location=805..1433; Strand=+; Gene=SeqID_83910
ttgtagtgaaaaaaagaaatgaatgaataaatgcatgcataggttggctttaggatgcatgataccagaaggcgataccgttccctcgggaatcagtgaaaatttgaattggctttgaaaattatcgattgtttgcaaacatctgttaccatgtggcatttcccagagggaaatgcgcattgattcgccgaaaagttatcgattaatgggcggagacagcaactttaaaagcgagactgtacagagaatttttcatttgttccttgcccttaattatattcttaataaaaattttccatttccaattttgctgttaaccagggcggtagctcgacctacagagtaccgtttatcctggcagcaattttgttaatttgttttttagatcttgaggtaatgcttttttgacttgtctaattcccagagttgtttaggtgccctgtcgtcttgtgcttcatgggtggcagtgcgcggctcatcaggccaagatgggtttatttaagtgttaaatttcactcaatttcatcacttttccttccccattttgtatttgttacgagctcggctcatataaatatgcccttcctattgtcgatttatcattttaataaagcattagattaaaaatg

SEQ ID NO: 100175 - DNA, 427 bp, Heterodera glycines
  Promoter: Source sequence=SeqID_6452; Location=2145..2571; Strand=-; Gene=SeqID_46252
attaatgatattgaatttaatgttgttgatgttggccgggtccttaaatctttaccaaataaaaataatacttcaccggatggtataaatttcaggttaataaaaaattgtttcctttcttttgcaccttatgttaccgaacttttcagaatctcatttgataccggaaaattaccgaccttttggaaaaaatctataataattcctctctttaaaaaaggggataaaagttgtcccaccaactatagaccaattgccctcacatgttcactgtgtaaaatttttaaaaaatttgttgtcagggcaattactagtttccttttaaaacatgactagaggtaaaatccttaattggatttttgattttttggccaatcgctcctttttagttcgtgttgaaaattcgttttcttctgaatacaaaatg

SEQ ID NO: 100176 - DNA, 1003 bp, Heterodera glycines
  Promoter: Source sequence=SeqID_2481; Location=4134..5136; Strand=+; Gene=SeqID_79955
agtttttttcaatttttggcacatattttgggaatcggtcgttttggcgccgccgttttggcgacgccgttttggcgccgccgttttggcgacagggtcgttttggcgccgccgttttggcgacagggtcgttttggcgccaaaaaatcagagacgcagaaataagcggcagacaagcgcctcttcaatttggtgtagaattacattccgtgaacccgaacaatgataacgatcacaattaccacattaacccaaatcaaaatcatcatatcattttggaatttcttcgtggcgtttcgcgcaattatcatatgaacccatgaattttcttatttgtcttctttttgtttgttattgttagggccccgacttttagtgacgaaaaagtgccaaaaaagtgaattttcactattttaagtgacaaaacgccaaaatagtgatttttagtgacgaaaaatgacgtccaaatgaaaaattttttacgcggaaatgcgttttttgagctcctttcttcaaaacaattgagcaaaaaaaaagttttttcactaaaagtcggggccctagttattgttatttacatttttatgaaaagttgtaatttttaaaaattgaaatcgatcttggattcacaattttttaattttggcttggcgccaaaacggcagcgccaaaacgaccctgtcgccaaaacggcgtcgccaaaacagcggcgccaaaacggcggcgccaaaacggcggcgccaaaacgatacagactcatagaaaacatctagaactatcgaatgatataaggaattaaaaatttgattgattttaagtaaagatatgaaaaaattgctacaattgatggtaccatttgccgggcgttttaccttatccccccacccacaaatcaatcaatcaaataatcaattggatggataatttttacccaactttcatttgtaaaaggttagaaattttctttgtcaaccaaatccaacatttgttggtagcaaaaatg

SEQ ID NO: 100177 - DNA, 362 bp, Heterodera glycines
  Promoter: Source sequence=SeqID_9962; Location=1436..1797; Strand=-; Gene=SeqID_73003
atcaggatagaagaagtgctacattaagaacttttttaaaaccaaatccaaattattaaaacattattatttaattataaaaatgaatgaattggcaatatctctattgaattacattaatcaatgaagagaaaattttataaagcaaataataatcatgcaaattatggtgagttgccacttctcatcctcatacatttgcattaaattgtaaatttcttatagtttttcatcattattttcttattacacgtgaaagctctgctgcttatatttctttacatattttgtaaaaaaaatcatttaaaattaaaataatattaaaagatttagcaatttcgaattttgtgccctccgggatg

SEQ ID NO: 100178 - DNA, 119 bp, Heterodera glycines
  Promoter: Source sequence=SeqID_30866; Location=1835..1953; Strand=-; Gene=SeqID_61255
cttatttcttttgttttgactctttatggtatgtattatcattcttccctgcggatttttatttttaaaaatttattacattttgcgtctaggtttgtcgttcatcataatttttaatg

SEQ ID NO: 100179 - DNA, 493 bp, Heterodera glycines
  Promoter: Source sequence=SeqID_4767; Location=1912..2404; Strand=+; Gene=SeqID_55647
attttttgttttttaaaattttattttcttcctcagattgtgccggtcacgccgataccgctgaaggaggtgtatgccaaactgttgcagaacagtccatgccgtttggccagttggtactacaaacatcacaggtggttgagaatcagcgcatttttgggcaattaaatatttttaaattattaaattaatttgtgaaacttgttggcaaatttgctcctgtgctcagggtccaacgttttgagttgattcgcagagagttccgcacagacacaaaatggacaaagctggaggacaacgaaaccacgcggctttggcttcataagcgaatcatccaaattcaacggtggcggaacaattaattataattaaattaaattataatttaattctaattttttgtgcctcgtggatttaacaatacattttctttcattaaaattgcaattatgccccgttttctttaagtcctttgcccgacttgctcagcatg

SEQ ID NO: 100180 - DNA, 117 bp, Heterodera glycines
  Promoter: Source sequence=SeqID_18610; Location=3638..3754; Strand=-; Gene=SeqID_83262
tcgaatcgtgcaaaatcggcgcgagaaagccaaatgcggatttctacgaggcaattagcatataattagcaattcttttgttttgataaacttttagtgagtccctttcttcagatg

SEQ ID NO: 100181 - DNA, 569 bp, Heterodera glycines
  Promoter: Source sequence=SeqID_2628; Location=4451..5019; Strand=-; Gene=SeqID_80791
agtgaatttgtaaaagtagtagttttaaaaaatttaaagttgaactaacaaatagaaaatgttgatgaaaatagacttttcattttgacgtactatttctttgtctctgttcatagaaaaagaaaggtttcacttcagctttataggcttagcatctgtttatgagtcgcacatgtaaatctttttaactgggaggccaaaattgcaaagctgcgcagtagggataataatttaatgttcgacttgacttttcctccgatgtaatttaaataagtatttaaaagaaaggcaagcacaaatttgaaaaaggacaaattcacaaagaaaagatacgtttatcaattaggtcggaggatgtaaattggaaatacaaaaataattaatgatccactttatgcgcgaaggaaggagcgagttgacacaaaataagaaataaaaaacgaatatctggcataagtcaaatttaatccctattcaacacctccctccttaattcgagaagcccagaaaaatattcatttttaatatttcgattatggcatcgaaaaaatatttttttcttcggtatg

SEQ ID NO: 100182 - DNA, 244 bp, Heterodera glycines
  Promoter: Source sequence=SeqID_11078; Location=2738..2981; Strand=-; Gene=SeqID_74412
attatcataattgaattgaatttcaatttctatttttcagttccctccgcggctccgtcaattttctgatggcactgatttgtctttgtgaattggtccaccaaattgggcacacttttttcctggttgttgtcattcgggcataaattttgtcagtttgctcactgctgacttaattatgacggtaaatttaattttaaatattttttttattttgatttaattttttaatttttagccaatg

SEQ ID NO: 100183 - DNA, 163 bp, Heterodera glycines
  Promoter: Source sequence=SeqID_3394; Location=793..955; Strand=+; Gene=SeqID_84512
tattttatttaattatttattggtataatttttaccaaaaatttttggactatttgtatttagcgcgctaattaggtaattaatgatgaaagagaaaaatgatttaagagtaggcagtcggtcggtcgctgtttttatttgtttgtacgttcattttaaaatg

SEQ ID NO: 100184 - DNA, 137 bp, Heterodera glycines
  Promoter: Source sequence=SeqID_17385; Location=1686..1822; Strand=-; Gene=SeqID_81870
ccccccccccaagatgactacattgcgatctcctcagaaagagggagggagatcataccagaaccaaaaattttggattttctggctgcattagtcttcaaactacctagaaaatccaaagttttgctttcggtatg

SEQ ID NO: 100185 - DNA, 251 bp, Heterodera glycines
  Promoter: Source sequence=SeqID_8192; Location=3006..3256; Strand=-; Gene=SeqID_67264
atctcacttactcattgtcagttgtaaggaaaagtcactttgatatcggatacatatgtttatgtctcttacaattagcgttgttttcatcacattatgaattaaaaattcctataataaatattcgatttttgcttatttttcggagtgattcgaagatttgtttttctcttcaatatttttgattccgcgcaaatctttttatcatttcttacaatttatcagtttttgttggttgaattttagaaatg

SEQ ID NO: 100186 - DNA, 1003 bp, Heterodera glycines
  Promoter: Source sequence=SeqID_12561; Location=390..1392; Strand=-; Gene=SeqID_76219
gggctggcagatctgaggctttagcctcattttgtggttttttgataggtcaatgaggcttttcaatttttcgcgcttattgtagaaacaatgagaaaaataatatttatgcaaaagtggcaatcttatgatgcaaatgtaaagaaagaatcttccttttttggctgcaaattacgagtgattaagtagcttttcctaccgaatttttgcatttaaaagccaagcgctttcactcttttgccatatcattttaaatttctgccttttttcattcattttttgattcccgaattgcctaaattttgaaaactgaaatatttttagacgatttgtgttaacctgagatcggcgcggtcatttttttcggtctttccgacttttctattcaaattttacccgaaaaaacaatcaaagaattgttggataaaaaatgttgatttttgagaatttttgatttttaatgtgatttttttcatcattaaattagttttttctggtagattttgcaaaaaaataaacttgattttcaaaattgatctaaaattgcgtaaaagccgccccaaaattatgaaaatttagtgtaatttttaactaatttgtccaaattctgcgaatttggccaattttcgaaggaaattttaacgagttaaggtccggctgtgtctataggctccgtctgggaaaaaattggagttttggccacatatgttaacagaatttcttaaaaatttacccctttttacttaatttttttaaacaactcaaatttaatggattgaaaagaatttttaaaaaaaccgaaaacaattttcggcgttttcgaactttttaatgaaaaaccgaccgccaaaaaattttaataatcttttcaaaagcgattttgtagacaattttggctagggcccatttttccaaatttattgccagaccataggattattttttcattaatacataatatttagagtgatcaaattattctatttttatcttccataaaatg

SEQ ID NO: 100187 - DNA, 791 bp, Heterodera glycines
  Promoter: Source sequence=SeqID_42362; Location=1..791; Strand=+; Gene=SeqID_70274
tatttttcgatagccctaaatgttttctattatcctgcaaaatatctaaaaaattctttaagtttaaaaaaagttatcgacctgagaagctcaaaaaaccaagtttttttgaacattattagtcataactttcttgaaacttaaagaaactttttgaaattttgtagtctaatagaaaacacttaggcctatataatgatatcaagaattaaaaatttagttgcttttgagcaaagttatatcaaaaaatattttcatttgatggtttttgacaaacgcccattatgattgttttttgacaaacgtcttagcaccgaatattattgtttttaatacaatgtccccaattaaaattaattatttacaatgagaaaaaaataatttggaataattaatttctgcaggccattaaaactaaaatttttaaaatttattccacccaataaaggggaccatgaaattggtgagcctgtgatttttttttttttgttaattacagttggaaaattaagcaaaaaattgggttggaacaggatttgggaaaaactctctttaatatcaaaattccatacaattaataggcgaccataaaaaaacaaacataatgccatataaattcaaaacataaacaaatgtcaccattgttttccaaccttacatactgtatgtccgtccccatttcaggtggcaaaaaacatcggagtacgtaatgcttttttgtatacaaaattaaaaaaacaaaatttttttgtaaaaatttgaaaatttttcagacacaattccccattatg

SEQ ID NO: 100188 - DNA, 180 bp, Heterodera glycines
  Promoter: Source sequence=SeqID_6737; Location=5830..6009; Strand=-; Gene=SeqID_62696
ggtgcattcatttccatggggaacaaaaaaaagcggggcaataattatggctttagcaaatccattaatttactttaaaaattttgaaaatgccattggctttcacaccaattttcatgaaacatgggacgacttttatgcaagaagactttgccaattgtttttcagtgccttcgcatg

SEQ ID NO: 100189 - DNA, 602 bp, Heterodera glycines
  Promoter: Source sequence=SeqID_443; Location=1907..2508; Strand=+; Gene=SeqID_52872
aatttttgagctaaacggtagcctaaataaaatatctcattcgaaatttaggcattaaatgtgacatttatccaaaaatatccgaaaaatgatttattcttgtgggatcggttcttaagggttattttttgtttttattgcattttggttaataaatttgggaaaacgccaaaattggacaaaaaaataatttttggctgtttaggctcgaaaaattttaaacctagaaaataggctttaataactcgaaaagtagcttaagaaccaccaaaaaaacttgcttttcgtgcgtttaggccacaggaagctgaagtaaaaatagggcaaaaacctaaaaagggtcgttggaattacaaattaatttctttaaaattttaaattaaaaaagaaattagttaattaaatttttaaaagatgccgacaaaatcaaacaatttgaccaaatcaccgagctttataatcaaagcagaacagtggcattaaagcaaagagctttggtaaaggagaggaaagaaacaattttcgttttggcaggtaaaattaaaatatattaattatataattttatttagtttttaattttattttcagattttacaatg

SEQ ID NO: 100190 - DNA, 841 bp, Heterodera glycines
  Promoter: Source sequence=SeqID_14396; Location=1756..2596; Strand=+; Gene=SeqID_78432
aatttaataaggaaaggtattgaaaattataatgcttaaatatttttaaaaaatttcgaaaattcatttttctcgttcaaaattatacaaattttccgaattttaataaattacatattttttttaatttttttttttgggcaaggacataaagtgcccgtacatttttattggttttaataaaatgaattttaaaacaaaattttatttttgaatccgagtaaataaattttcaaatatcatttttttcgaacccaaccaaataaatcgtaaaataaaattttattttcgaacccgaaaacaaattttaagataaacttttttcgagtaaattttaaaataacatttttattttcgaatcctaccaattggaccattcatttgacgaacattcgacagctgagcaattgttggtcatcgcattggtcaatagatttgctcaaattagtgaacgatccattgagccatacaaagagattgttgtgatacaaacgcttgaggcaaattcaattaataatttaaatttaaattaatacataattggtttcttacggtacaaatactgtattttgaaaaagaacaaaaatggatttaaattttcgaattataaattttcatcaattaatgtagaaaatctttctctcactcaaactctctctctctctctcgctatctctcagtctctttctctctctcttcctctctctctctctttctctctctgttgaatatgaaaatatttaattgtattaattaatcaattttaattacgtattaattgcctaattaaaatataagaattttctaactaaatttttgttttaagcctgtccataaaatg

SEQ ID NO: 100191 - DNA, 1003 bp, Heterodera glycines
  Promoter: Source sequence=SeqID_17294; Location=791..1793; Strand=+; Gene=SeqID_81771
tggaatgatcggaatcaatcaatatttggctgatcagaaaactcactaaacggcaatccgcttgaaaccgatcaaattgggaggaagcggctttaatggaattggcaaccgtttaactgtcttgtcactgttacatttgacaatttccgctccgtcattcgtgctggaacgttcaattctcaaacttccaagcttccattttcttcgtttaagatgagtgtccaccactacatcaaatctataggagacaaccgcaaattccaaaccgatttttgcgtgcccacaaaagggcaatgaatccaacaaaatgtcattgcagataaaactgaattttgtttaacgaattatggcattaaaattagaattttatacaaatttatctcacattttctcaaaaattcgtttctcttcacgtggatgatctgacatagaaggatatatgtacagccagtcgatgatcaaattgaaaattgttgcattattaattaataaaatattaattaggtaattagtgtttatttacacacaaaaaattccctaaatgaaagaggatttattttttttaatttaaaataagaagttgattgaagtttcaaatttcaacgtcacatgaaatttctcacaacggtgtcattctttgaggctttgttttttcgttgacgttttattgacgaacaaatacaattcaaccaaaccaaaccaactcaagaaaaaacaaaattttcgtttttttggcgtaacgtcactcgctgataagggccaggagcaattttttttttgtttgatcacattttcattcttttgattttgatcgactgtttggaatacacaatcaaaacctaattgtttgttacgcaattagagtagataagaaatgaatatttaaacttgccaactgatcattactgattaattcaattcaatttcaacaaacaggaaataattaattaattcaatttgtattttctcgcttcttatcaagtgctattagtagaaagaaatg

SEQ ID NO: 100192 - DNA, 376 bp, Heterodera glycines
  Promoter: Source sequence=SeqID_1625; Location=301..676; Strand=-; Gene=SeqID_74919
aatgttctgactaatttacattacagtctttgagggcaatagaaaggatcttctaaactcatttcatttgtatttattccgtggaattttacattgcttaaattttgacggtgtttgttattgtaatgctttcactgttaatgcatcaccactttcatacgttgttattaccttattgcagtttttacacaaataataggtttgagttttctgaaaaagaaaatttgttcttttttgttcaagtttaatgctttgttcttatattgttcgaatttatatatttttcctttccattcactttttttcttaaatatcaattttatattcttttttaatttgttttacagaattccgttgtctttctattgtaaaaatg

SEQ ID NO: 100193 - DNA, 79 bp, Heterodera glycines
  Promoter: Source sequence=SeqID_9174; Location=54..132; Strand=+; Gene=SeqID_70493
ggtaaaatgttttgctattttttaatgaaaattttaaaattttttaggcctccgaggccatcgaactgcccaaaaaatg

SEQ ID NO: 100194 - DNA, 68 bp, Heterodera glycines
  Promoter: Source sequence=SeqID_26298; Location=1450..1517; Strand=-; Gene=SeqID_57044
cagacatttgccaatacctaacattttgcaagcatttgaaattggtgttaaaaactgctgacaaaatg

SEQ ID NO: 100195 - DNA, 127 bp, Heterodera glycines
  Promoter: Source sequence=SeqID_28964; Location=1318..1444; Strand=-; Gene=SeqID_59538
tttcccccctccattgtccctcaattttttgctaattacccagggaatttctggccctgggggacagtgcgttttgcccgggggaaagcccttggaaatggccgtgaggagggaatatcggacaatg

SEQ ID NO: 100196 - DNA, 1003 bp, Heterodera glycines
  misc_feature (439)..(439): n is a, c, g, or t
  Promoter: Source sequence=SeqID_10371; Location=341..1343; Strand=+; Gene=SeqID_73558
tgcgatcagcggttttgatctactggtgtaaatttgatcactttagaaacaatcaaaaaagatatccaaatttgttgcaaattgcaacacctttttaaattttctttgtttaaaaatttaaattcataaatagggatgcaatttttaggcaaaagcctatttttttcctgagctccccgtggcttgaaacgcacgaaaaacatgtttttttcggctgttgttaagctacttttcgagttattagtgcctattttctaggcttttatttttagcgcctaaaaagcctaaaaatttttgaaagagcctatttttgcctattttggcgttttgcccaaaatttgttaacaaaaatgcaataaaaacgaaaaatacacccctaagaatcaacgtaaaatttttttcaaaaaatatcccctaacaaccgacccgaaaattttcnaaaatacatccctaagaaatgaaatttttttcaaaattcatctccaaaatttatttatttattttattgacaagaatttgtgatttaaaaattatttatctcaatactgatttggcctaatttttttatttttttgaatacattttgtcattttacacccctaaatttgaggatttttagtgcctatttttcattttttagtgcctattttaggggttttttagagcctaaagcctacctatttttgcagtttttagagcctaaaaattgcatccctattcataaaaatttaaattttaaattaattagccaaaacaaaatgacaaaattatcaaatttaaaatgcaaaaactgaaaattataaaaaaaacacaatgatgggattgcatgtgattttgctaattttgcaaactaaaaagcaagaagttaatcaattctccattcttttctgctaaaatttcttaattttatattgaaaacataaataaatacaaaaccatttgctgtgcttttagaacaaattaaatttgataaatttgtgcattatttttgtgatcaaaaatg

SEQ ID NO: 100197 - DNA, 1003 bp, Heterodera glycines
  Promoter: Source sequence=SeqID_10040; Location=2642..3644; Strand=+; Gene=SeqID_73100
tataattgaataattagttaataataaaagtgtatttggctctgtttcagtttacacgaccataaaaaattactcgaccatgtaataatttgacaaatttaaggcaccgtaacttttttaagaagcatcctaattaaacattcttggtattatttaatagccctagtgtcctttattttcctttaaaatttcagaaaatttggttgagtttcaaaaaaattctggtcaaaaaggttaccaaagcaattttttaaatttacaagccacaacttttttgaagcacaacaaaattttttgaaaccttaaaagcaaatagaggacacttagggctatcaaaagataccaagattgtttaatttagatgcttttacaaaaagttatggcactgatcaaaaattgataatttttatggtgatcaattattcaaccaagtataactttctatgtacaaatcacagaatcaccattccaaaagcaattcggtagcaaattttgtgctttttccagtggcttgcccattttctctagaaaaatttcccagccccctagggattttgaaaatttccttgagtcaagattttttgggggacactgtatttctctcacaaaaatgtttgtttgagaaatatttaaataataaattgaaattataattatggacagcaaatataattaatagattaaaatagttaaataacacaccatcccgaaaaacgagaagtgtaccaataaatagatagtgccagagaaaaacaatatatttttttctctaattttttgactccttttggcgtactatctatattttcattattaggaaaaacaacattcacttcgctatgtttagcttcttttctatatgttagatccacaccaaattttgcaaatcgatagagaaaaaaattctgcatcgatttctatgtttattatcatcgcttaaatgttgtcttaaaaagttataagataaaaaagttaaattattattctttttaaagatttaatg

SEQ ID NO: 100198 - DNA, 82 bp, Heterodera glycines
  Promoter: Source sequence=SeqID_40775; Location=74..155; Strand=+; Gene=SeqID_69019
ggttgaattcatgacaaaaaaaaaaaaatcgaattttcgaaaattttagcgctatcaaaatgacccgacattcgcagaaatg

SEQ ID NO: 100199 - DNA, 194 bp, Heterodera glycines
  Promoter: Source sequence=SeqID_24327; Location=2083..2276; Strand=-; Gene=SeqID_55052
ttcttagtataagactcaatcttccacttcaactcttttactttgtttattttcttcacctcaatgcggaactttatgtcaccatattccacattaattttcatgccatcagtggatgatggcattatcagcagcataaacattgtcactagcccagctgaaatgccagcggagaacagggcattgccaaaatg

SEQ ID NO: 100200 - DNA, 222 bp, Heterodera glycines
  Promoter: Source sequence=SeqID_18961; Location=145..366; Strand=+; Gene=SeqID_83693
ggtgggaggggggggggatttaaaagtcaaacagaaaatttttgaaaatgtttcccaccttttgaaatttcaaaatttttatatttttgatatctttttgaaatttaattaaaattttattttcccttaatttttggtggataaatccgtggagatattcagctgctgcttctcttccggataaaattgtttatttttgcttctttttattaccacaaaatg

SEQ ID NO: 100201 - DNA, 748 bp, Heterodera glycines
  Promoter: Source sequence=SeqID_11205; Location=1..748; Strand=+; Gene=SeqID_74563
cgccagcatgtttttggctataacttttttctttgtaaaccaaatccaacattgttggtgtcgttcgaaagctaatcaatttagaagctttttctaagctattgctttgcgattagacaattatcaaaaaagttatgcatgaaaattgcgaaaagtcaaaatttttgaagttttttcttaataaaattttttccaggcttgaaaaacttttcgtttttgataaggctaataaagcatgttaagagctttcgaatgataccaacaatcttggatttggatgccaaagaaaaaagctatcgtggaaaaacgatttttcaattgtgtcacaaaaggcaaggcaaaactctgttgttatgttaaaagagagagttgggaaaaatgagagagcaaaaagaacgcaaaaacaattttgaaatagaaataaattcatcacattttttggcaaaaaacagacggagatttgtattattgtttagaaaaggattttgcagggcaattattaattcatttgtgacatcaatcaattggaaaacggcaaagttgcagcaaaaatgaacagagggcgaggaatttaaaaaattacaaatttttcatttgcctatttatcttttcgcatgcatttcagtttgatttgtggcgacgtttgatgtattttttgaatttttttccatgtttcagttggatttgtgcggatgtttggatggacattctgccatcttttgaccatgctcaactcggcctcaaaatg

SEQ ID NO: 100202 - DNA, 315 bp, Heterodera glycines
  Promoter: Source sequence=SeqID_24246; Location=1043..1357; Strand=-; Gene=SeqID_54967
cctttgcaaattatttaggccgagtttttttagaataaactggagaattttttccaatccgaaattttatgtttaaactaataacaagttttgacaaaattactgatcccatctttgtaaatataggttaaatcaataaatctattttggcactatggcccaagtatttttgcaccgaaatcgtccggctccaagccattcgatcacgcacctgagcaccggacttggcttttttttcataataattctattttggaagtgacagatgtcatttcttacaatccaagaataacccattttaatggatacagaatg

SEQ ID NO: 100203 - DNA, 310 bp, Heterodera glycines
  Promoter: Source sequence=SeqID_12701; Location=1314..1623; Strand=+; Gene=SeqID_76384
tttttggcacgtttaataacgaagatttatttaaattatttgctggtttattcctccattttcttttccctccctattcttgccacttttcacttaattatggtggaaaagtgtatgcttaatggaggaaaattgtttgttcgagaaaccttcggtgtccggccattttcccctggctgtgcttccatcctctgtctcgaagacagtttaatttcatttttaaatgttttttccttgtaatattcatttttgaccgtaaaatcgttgctttctctcccagtctgtttgacctgtgccgccggtcggaatg

SEQ ID NO: 100204 - DNA, 107 bp, Heterodera glycines
  Promoter: Source sequence=SeqID_32148; Location=1262..1368; Strand=-; Gene=SeqID_62479
aattttgaaaacggctaaatgtgaaaaaaatgaaacgacggtaaagaattttttaatagcacgcaaatttctcatttattaattttttccacattttcagttggatg

SEQ ID NO: 100205 - DNA, 216 bp, Heterodera glycines
  Promoter: Source sequence=SeqID_23385; Location=1..216; Strand=+; Gene=SeqID_54092
gatttaattattaataaaaaaatatttggtgaagtaattggttattgttgggttattgaatatcaaaaaagaggtctcccacatttgcattttttaataactttacatccaaaagacaaatggcataatagtgaagatattgataaatttatatcagctgaaattcctgatgaaaaaatagatcccgaactttatgaaattataacaaatagtatg

SEQ ID NO: 100206 - DNA, 239 bp, Heterodera glycines
  Promoter: Source sequence=SeqID_28490; Location=1336..1574; Strand=-; Gene=SeqID_59101
aataagactttattttttactttcaaaaatttttctattaaaaaataataaaaatgaaaaaattatttgcgcctttaatgttcctattttcctttatgtaaaaatttttgaaattgtttttggtcccattttcaatgcttcaccgaatattgtaaaatttatttgaatttattccatccttttccgatattctccaactttgtgccgcgtgtggcattgtgccgggacctccaacaatg

SEQ ID NO: 100207 - DNA, 385 bp, Heterodera glycines
  Promoter: Source sequence=SeqID_17995; Location=1..385; Strand=+; Gene=SeqID_82565
ttcactattttattacattttctaattaattatttctttatcaattcatcatttttcaaaaaaaaaaaaattggccaaaaatcaaactttgtttaaaaatttttcaaaattatttttaattgattttggagtgaacaaaaaacaaattttgcttaaaatcacgcgagcaaatttatggaaataaatagaaaaaataaaatggcgggagagcgcacgcacattagtgcgatgattggcacatggacggacaaatggggagggggcaattaattaattacactaattacccccgctaattattgagcacactaattgccccggctatcacatttgttgaacgacgattaaaaaaaaaataaatgtgcagcattgcatttttgtgatg

SEQ ID NO: 100208 - DNA, 1003 bp, Heterodera glycines
  Promoter: Source sequence=SeqID_16803; Location=941..1943; Strand=+; Gene=SeqID_81219
gcaaaaatcgcggcactgtaggcgcgcacgaagaacctctgtaaaaacggcgactaaccaaacatagagaaatgttttttgttttgtttgtgttttagcaaaggcatataggcagactcttgccttcgtgggggggagcagagcgatgacctgttttagtcgttttttcaaaaaaaaatttaaaggataggggcggtgttggtctgttccggtatacgactcgggatcaattgctttatttattacgtgtgccgacatttcgcccaaaattattgagctaatcgccctgaaccaggtctgtagccaaaaaaaatgttttttttatgaatggttgctcttcgaaccaaaatttttttaaaaatttaagttagccatttttttgccaaaaaatagcagaatttttccagttttcattagaagttagctctattttaagttaaataaaatattattggagagatttgtattcggatatttccgttgttctttccgtcctcgattggtgcgcctatttttcaggttaaaaaatctcgcaaaattttttatttctttcattatttacattactttctatagggcatttcttacagaacactgtcctaaagcaatggcaaactttttttgttagtctctaatgtatactttgtcatccttacaaatttttttagtaaggaaagtcaggttcgcgagtttatgggttgttttgagcacacaccatcccaaaaaacgagaagtgtaccaataaatagagagtgccagagaaaaacaatatctttttttctctaattttttgtctccttttggcgtactatctaatatttctattattaggaataacaacattcacttcgctctatagaactttttttccgccttacagaatttcttcatattttgcatatcgatagagaaaaaaatataggatttttcaatcgcttttttaaagaaaacaatcgcttttatttaactttaatttttattttaaggcaaatttaattatatg

SEQ ID NO: 100209 - DNA, 1003 bp, Heterodera glycines
  Promoter: Source sequence=SeqID_8306; Location=743..1745; Strand=+; Gene=SeqID_67640
agtgattgttcgtgctaatcccttcgaattcatttgtccgctctggtccgatcagatttgctcccggattttgcagggtcggttctcccccccccccccattatccctccccctcttccgttactaatttgatcaacccaaattttccacccgtaaatgccgaaaagcctttaaattatgccttaagggcatttcaattaagagttcaagcgaccacctgcagcaaaatgttagacgaatttttactttcctatgaaaattagtcaaaattccttctcccctcgcatttgatgagtttcgccgattccgtcgcctctccgccgggagattagcgcggagattaggccaaaagagacgaaacaaaagtcacgccaaatcaaaggcccaaagggaacggaggggagaagggaagggaccagtctctgctgctgcacggaggtcgcgcagaaggcaaaagcaaaccatttttaggttcaaaaaaattacgatggaattccaaaagtggcgattgaccgtccattgagttaaatcactttgaatgcatagccgctcaaaaaaaaataattttaatgaaaattgaaaaagatactaatggcattagtcaattgccaatcggagttggcttggcacttcccaatgccatgctcttttcctcccctcatgaatccccccaattcctttcattttttctgttctttcccttctgatcgatcagctgttttgtccctcagtcgccgatcacttcgcttacgccaatagcaaattttaacgaatctttgagctttttcttcacaaaataacgacattctctcttttattcgcttttctcggataaaatttcagccgaatgaatgaaaattggaaattgatccgattcgatccgtcttccattcattttccttttctcatttctttgaaatatatttttgacattccttttttcaaatttttttaatcattttttaggttttatttttaaggaaaggcattcgacgaacgaatg

SEQ ID NO: 100210 - DNA, 524 bp, Heterodera glycines
  Promoter: Source sequence=SeqID_17903; Location=1067..1590; Strand=+; Gene=SeqID_82454
ttttttgggattttttggaggagagaaaagggtttatcgattggtcaatttgatgaaaaagatgagggaatgatgaaaaagatgagggaatgaaaaagatgagggaatgaaaaagatgagggaatgaaaaagatgagggaatgaaaaagatgagggaatgaaaaagatgagggaatgaaaaagatgagggaatgaaaaagatgagggaattatttttaatgaaacatttgcaattttcgtcgaaaaaaatgcttacgcaggagcagaactcaaacttcagaataaccaatccaggtccaggtccaggcttttttcaaaatgtcgagctctaggaatgaccatcattaatagtaaaatcgatgagaatagctattgtcttggatgaggctgggttattccatccattcattctttccacttactggttataaagccatttatcatgtcttgtttatacagttattagctggtattgccaatgataaatgagcttaaacaaaaaatttaattttttatataaaatg

SEQ ID NO: 100211 - DNA, 355 bp, Heterodera glycines
  Promoter: Source sequence=SeqID_17714; Location=232..586; Strand=-; Gene=SeqID_82245
tttcaacagagaattctgaaaaaatttaaattaattactttcaacattttgttttataaaatttgtttgtagttcttagggaataaacgagctttggctcagaaattaaatgtttgttttttgattcaataaacaattaatttgtgctaattttaattataatttcattcaagcactttatcgaacactaacttgagtgatgagccggtgagtaaagatggagttcgaattcgtttaaataataattaataatagttacagaattatttctggaatatttcatatttaaaacagattgctaaatatttttttaaagcaaggaaatatgtgttagcatatggaacaaaacgaaatg

SEQ ID NO: 100212 - DNA, 252 bp, Heterodera glycines
  Promoter: Source sequence=SeqID_13690; Location=2501..2752; Strand=-; Gene=SeqID_77604
atgagatggcaaattcaaaaaaacactctattaaatgtttaaggtacaagatatagacctgaagatgttagagaaatcttttgctccttcctccgaattatctaatcattcctggtgcggtttatataagcaaatttatacaaataacgcgtatttcattaaggaaagtttgcgctaatcgttatcaagactccattagcaaaatgctgcgtttgtattcaagttatctttttcttaggcaattggaagatg

SEQ ID NO: 100213 - DNA, 217 bp, Heterodera glycines
  Promoter: Source sequence=SeqID_1550; Location=6617..6833; Strand=+; Gene=SeqID_74404
agcaaagagtgcaaatactgtggcgtagtatgggacatgcgtaaaaattgcgataatgggagagaggtttcttttaaaaatttaataaattttaatattggaatagggtcacaatgaccgccaccctcttgttgcattcgttaaatggcttctctacaaacttccaaagcaatacgaaacaattgcctattcccatttcggcggacgtttcgacatg

SEQ ID NO: 100214 - DNA, 133 bp, Heterodera glycines
  Promoter: Source sequence=SeqID_19663; Location=2608..2740; Strand=-; Gene=SeqID_84396
atatttatggatcattaggagattttggttcccgatctctttttaccgtctgctgatccatttgaaaatcttagtcgacccatcagcccctttaaatgcacccccagccctaaaaaatttctttttcaaaatg

SEQ ID NO: 100215 - DNA, 1003 bp, Heterodera glycines
  Promoter: Source sequence=SeqID_12966; Location=151..1153; Strand=+; Gene=SeqID_76722
tattttaaatggcttttatgactgaatgataataaaattattgggattaatgagattggctttgttttaaagggatggaaaataatttgtctttttaattttttaaaaataaataaataaaatttcttttaatagtcctattggcaggttaaaatttacataaaacccacacagccaagccacaattcagatagatgttaattggcttgaaaaagggggagaagaggacctaatcaaaaattcattgaatttttgtggccattgaaaaatgcgcgtaagcgaatggaaagggtttctaatccccgcaaattcaaaagaacaaaaaaaaaaaatttgtccgaataataaaaaaataataataaattgcttttgctaacaacaacaattgtataattagtgaagaattgctttgtcgataaaaattctcttggaataattaagaaattaaaaaagaggcgcttttgtttattatgcaaattttgagaaagacgtcaaaaatagaaaaataaataattttttatgaaaacaaaggatttaaaattgcactttttgaaataataaaattttaaaaaatggtaaatgagtaaaaatgcaattgaacggactaataataattatgtaaaaagccaatctcacataaacattagcatggattagaatgttgttttgattcagaattttggcggggcgcgggcgggcggaagattatgagcaaaatgtcaaaaaggcatttcaaatgggagacgtcagagggggtggggtggggggaggaagcggaagggtgccgactttgcccggtcgggggagggggagggtgccgactttgcccggtcgggggagggggagggtgccgactttgcccggtcggagatgagtcggcgatgtccccgaagacaaaaatatgggtggaccaggggggaggtggcttttttcattgccgtcgtcggcggaggaagcggcggcttcttcgatgcttttcctattcaaaaaagcacaaaaaatg

SEQ ID NO: 100216 - DNA, 986 bp, Heterodera glycines
  Promoter: Source sequence=SeqID_1496; Location=3715..4700; Strand=-; Gene=SeqID_73977
gctgtaatttgtttctattttttacctcttatctatttgtataatacctcatctttacctatgcatttgtgtccatatttttgtacattttataatgatgagcttgaacatcccctattatttgatagccctaactgttctctatcagtctgcaaaaattcaaaaaatttcatgaagtttcaaaaacgttatgacttgaggaactcaaaaaccttttgaacattttggccatttttgaatgttaacaatgtttctgaaattttgcaggcaaatagagaacatttagggctatcaaatgatagaagaattaaaaatttggttgctataaagtagcaattttttattttgatggtttcttaaataaagcgtattatgatgtttttaaatagcgacgacatagcacccaactaattaagttggtcagtgagtcccatcgggaacatcaaaggaggaaagttacactcaaattgcataaactagctaaacgatgatggccaatcaaaagaaagaatcaatttgtgccactttcctcaaaaattgcattttatcatttcgcccttttactgcttattatttattaattgttttcatcactttagtttccataaagtaattttaaaaattaaattatttttaacaacactatgttttggattattttaaaatttgaacaatgccaagaattaaataagctatcgatcggtataaagcatctaacatatgctattagtaaaaaaattacggctaaatttataaaaaaaattttggggtgtgttaaacatatgaccatgactgtattataattttattctagtaaatttttaaaaaataattagattttttgcttcttttctctgtatgtatgaaatttttattaatttttcagttggcgatctgtagcttttttttggttaaataacattttagcataaatctcaccttctcaattttacattgttctgtatcaatttattgcaaaataaatg

SEQ ID NO: 100217 - DNA, 467 bp, Heterodera glycines
  Promoter: Source sequence=SeqID_32972; Location=485..951; Strand=-; Gene=SeqID_63182
catattttgccaatttgtggattttttgaccccttttatattaaatttcttgtggaaaaatttaaaaattttttttagaaaagggtaccgaaaaaatcgggttttcttttccaaaagtgagatatcaaaaataatttttaaaatactaaaagtgatctctaagcctatttagattattttaatggcaatttgtgcttatttcaccctttaagaggaattttattaaccatttagaaaaatttatttacatattgtagtacatattttgggatttttgtacattttttcttacatattttagcattttttttaacattgtttattttcatatttcgagatttttgtgacataaaattggcatcaataatttttcatgaatttaactacaattgtcagtaattgatatcatccctttgtccgaattcctacacgaagacatccgaccggccgttgacggcgaacggatg

SEQ ID NO: 100218 - DNA, 274 bp, Heterodera glycines
  Promoter: Source sequence=SeqID_9492; Location=788..1061; Strand=-; Gene=SeqID_71620
atcagtgattgcaaaacaatgattgatctgatctggacccttttgataatgagaaaaaccatgatattcgttcttatgttttcttttcctttggtggactttcatgtcttcctcatttttatgtagttttatatgttctctgcttttaatatctaattggttttgatggcttttttattccttccatttaattaaatttggtaatttaaacatacttggacaaatgcttatgtgagaaattaaagcgattttccattttttttttgtcataatg

SEQ ID NO: 100219 - DNA, 193 bp, Heterodera glycines
  Promoter: Source sequence=SeqID_1282; Location=6640..6832; Strand=+; Gene=SeqID_71484
tttgttcttgcaatattctgtcataattttccaattgcttggtttttaattagttgtttaacaacatttcttagtcttcccatggcataacccaaaatttgttggtaaattcgggttctctcttttataaggccaccgaacagggtatctggttatttttaaatggtaacatttttatcaaactggtatcatg

SEQ ID NO: 100220 - DNA, 1003 bp, Heterodera glycines
  Promoter: Source sequence=SeqID_13553; Location=1440..2442; Strand=-; Gene=SeqID_77456
cttcccaccggtgaacgagtcgggtcaatcccgacggtcgcagtttggagtccactcactcctcctttgagtggtggtgccgtttctttccttccctctttgtcccgccctccctcttctcctttctcggccccccttgggcctcaattcgaaaggggtcgaccaagccgagaacgagggcatagaacccggtgatcacccctccctttgatcaccaggggttttcggacagaaagtgaaatttaattgaaattgagtaaaattcaaaaactaaataacattctccaataagtggaatttatacttttatagcaattaattatttaatttatttatattatgaagccaatgatttcataaatcgaccaataaataaaactaatagcgaaaatttttcatcttggtttcatctagggttgaaggggaggggcccatgtagttgggcaaaaaccgagtccagcaggtattttggctcgatactttagggattctcgaccgcaattagtgctcacatttatcttttccccaaaaattgactggctgtcccgtgtccgtttcaccaccaatcgcagcagcctgcacaaaagtgccgcgaaatttggcacgtcaaattggcattgatttcagcttccggatcagcaatgatcagacggcactgatgacgaaatatttttattcgattaaattttgtaaaaaaattaacatattaaaaagataactaatttttcttaaatgtgtgttgtgttatttatgtttgtcctaaggaaatgaaaatctttgtaatatttaatcataaactgtcctattttacatatttttgtcctgcagatttggtaataaatccaaggcttttaattttttaatacgtaattattagcgttggaaaacatttcctattaatcgaaaaaatattaattctataaaatttatttcgttaaattattaaattagtaatttttttttgtgaatttataattttgtcaagcattatcattgaaatatg

SEQ ID NO: 100221 - DNA, 157 bp, Heterodera glycines
  Promoter: Source sequence=SeqID_4435; Location=620..776; Strand=-; Gene=SeqID_54436
tagagaaattcttaaaaaataaataattgtaaattacattttgaaggctaatattaattaatgacccactaattatagtgattaattatatataaataattaattgttttttgctcacgaaattcgttgagcgttgagatcagctttgacaaatatg

SEQ ID NO: 100222 - DNA, 132 bp, Heterodera glycines
  Promoter: Source sequence=SeqID_7839; Location=1448..1579; Strand=+; Gene=SeqID_66132
acattggataatgaattgtctacaaattaggtcggaccgggtcagcttagtctggccgttctgtttttttgggtttattttatgccactaattttgggcatggggttttgagggtcgctgatcaccaatatg

SEQ ID NO: 100223 - DNA, 1003 bp, Heterodera glycines
  Promoter: Source sequence=SeqID_2480; Location=140..1142; Strand=+; Gene=SeqID_79933
tctctttctcccttcctcttctttcattcttttccgccctcttccctctctccctccgcccctcttcctcctctagggctacggcttgtacataaaaagttatacttgggttgaaaattggacaactcaaaattgatcaaatttttgatcattttcccttgaaatacggtagaaaatactgatttttatcgtcatcaaattcaatccaagtataactttctatctacaagtcgtagacccaccattcaaaaggcaattcggtagagaattttgtgttctttctggtagcccaatcaaaaaatttcagaaaaattttcccagccccctaggaatttttttctaaaattttcccaatttcaagccatttttgactttcctgatcaccatgaaggagtgatctgatcaagttggtgtaaaaggctttttaaatcagtatcaaaagataagctagcatgaattatttcaggtttttaaatgaactctaaggtggtttttcaagtttgagtcaagacttttttccgccctttttttgagtcaagtctgatcaagtgaatcaatctcgggaatgaataagccaaataaattttcttgttgtgtgtggacgagtcatatattgaggtaataattatccaaaaagaaaaataataagtcgactttaaaaagtccatgagaaatttgtaaaactcattattcggcgagtaatgtaaaaaattttgagcctattaaatattttgcccgatttcttctgatacagtggggaaaaaagtcttgacgcaagatgattaaaaattttaacttttttactgaaaattagctgattattttttcttacagtatatttatttatcccaatacatgggattttcatacacccacaaattatttcaatccaaaaatgataattcatgcttgcttttcttttggtcctgatcaaaaaaacaaaaacaaacttacaccaacttaaaaaaaaagcagaaaccggaccgatacaccacaaaatatg

SEQ ID NO: 100224 - DNA, 230 bp, Heterodera glycines
  Promoter: Source sequence=SeqID_32326; Location=712..941; Strand=-; Gene=SeqID_62639
gatacccgggaagaaataatagttagtcctttggttaatttttaaaattttaatcgtcaaatcggcttttggaatttaaatgagtaaatcagtacccgtaaatgaaattctctgcttctcttgtggattcacgggaagaaataatagttatccctttgttgaatttttagaaattctatccgtccaatcggcttttggaattttaatgagtaaatcagtaaccgtaaatg

SEQ ID NO: 100225 - DNA, 1003 bp, Heterodera glycines
  Promoter: Source sequence=SeqID_22416; Location=128..1130; Strand=-; Gene=SeqID_53080
caaacctattgcgcgacttttttcttgcaaacccaaacctattgcagggggggtgcgcgacttttttgactgcgcgactttatgcaaattattttaattaaatttatttaattttaaattattttaaatgtcttaaaggtcaaagacgttgaatttaaattcatttaaaattctccaaaaattccccgcaccaagcggatccgaaccccaggggggcggccagactgacgcactaaccactcggccacattggcaatggataataaacattaatttgctctcataaagggaaaatttgacgtcatcagcgggggcagggggggggcgagagcgggcggcgagaaggcgggaggggtcaagtaaaaaaatcaattattgaattcacaattttctcttttaaaagcaaaaagaaatgggggaccgtataataaaatataatttagaaattaaaataattaaaaggttaattaattaattattttcctaaaataaattttttattacttctaaaataatataaatatttttcagtgaattaacaaatacatttaagtttaattattgatttgtctgttaattttttatctccttaaaaataattacagcaccctttcaggtgttgggcgtttgtttatttgaccaataatttttaatttcacatctttactttgccccccctcacacctgctcatttgtgtaatttgacaccgtttcttttatcttttcgttaaaaattaaaaagattgtctggaatttgtcttgcgccacaccgctgtgccattcatttatgtaatttgacaccagtctgataataatttcgccaaaatttatttattatttgtccatttattaagaattattttgcatctatcactccaaattttgttaaaattttttttttattgtcccaatttttaccattttgtgttttttcaacaaaataaatatttgttcaaatttaaagaattaatttttaaaattttagacacaaaaacaaatcatg

SEQ ID NO: 100226 - DNA, 306 bp, Heterodera glycines
  Promoter: Source sequence=SeqID_24717; Location=1..306; Strand=+; Gene=SeqID_55462
aggaaatttttaaccaataaataatttaatattatcaacattaattaataattagggcgttttttattgttaatatatattttaatccaaaaacgttctattttctttcttcgggcccttaattctccaaaaatctccaaattattaaagtcacttaaattttggaaaaatttgaaaacaaaataggtcatttgttgggcaaaatcataattggggcaaaatcattaaaaaaagaatcaaaataaataatatttgtcgtccccttgctttagcaacattggcattggcattgtgccacgatcaatg

SEQ ID NO: 100227 - DNA, 173 bp, Heterodera glycines
  Promoter: Source sequence=SeqID_29523; Location=1..173; Strand=+; Gene=SeqID_60016
atttctttaattcatttttggcttgcttttgttattaattaaatattaaatttaatttagttactaaaaaaatttgcggtttttgaaaaataaaattctgagtgttttttttttgcagatttgccagccctcatttggaagcgtcgtccccaagttccattgtcccatcaatg

SEQ ID NO: 100228 - DNA, 82 bp, Heterodera glycines
  Promoter: Source sequence=SeqID_23828; Location=1..82; Strand=+; Gene= SeqID_54526
agctccaccaaagagaccatcacagagtaccaccaccaggacggcatcgaaaatcaaaaaagagtttcgcccgaaaaaaatg

SEQ ID NO: 100229 - DNA, 83 bp, Heterodera glycines
  Promoter: Source sequence=SeqID_6998; Location=2108..2190; Strand=-; Gene=SeqID_63534
atttaattgaatcggcaaataaagcaaaaaatctgcaaaatcttaaaaaagatggtggaagagacgcaaaattattaaaaatg

SEQ ID NO: 100230 - DNA, 648 bp, Heterodera glycines
  Promoter: Source sequence=SeqID_25487; Location=339..986; Strand=+; Gene=SeqID_56219
tcagaacagttgagttttgccatcattcgcaggagcagatcgaaatatctgtccagattcaacaaatctctaaaaattcaaaaaaaaatatatatttttttcgactacggatgggccacttttgggacttgtgattttcccccaaaaatcactttagatagcatgaagaggcattcactgtgttcctcgcggacgaggacaaagttggactaattagtgcctttgaacttattgttgtagcatagagaactgctgaccgacaatgagtttatttagtctgtccgttttgtttggttttgttttgtttattgtcattgctcaaatgatgcgccattgtttttctttcattaaataaatttaaataaaaattgttttgcttttttcctatttcaatgtgatttgctttcgctgtaagttcgcgattcaatttgcctttttttacattattttccactaatgtttctttgctttttctgtttgtttcttcctccacaacggccgacggtgagcagcgaaatttattgcctccttttcccattattttaatgcgttttcctatcaatttaaacaatttgttgtgtatttatcatttccatttaattgattttccgtcccttttcagaaatttgtcccccacccattgcgatg

SEQ ID NO: 100231 - DNA, 113 bp, Heterodera glycines
  Promoter: Source sequence=SeqID_10427; Location=894..1006; Strand=-; Gene=SeqID_73625
attcttcgagaattctcgttaaataaatttccccccccccaaaaaaaaacatttttaacgagtcgtaaaaattaaatattttcaaggtcgatatcattgtatccgagcccatg

SEQ ID NO: 100232 - DNA, 108 bp, Heterodera glycines
  Promoter: Source sequence=SeqID_14888; Location=1496..1603; Strand=-; Gene=SeqID_79049
tgtgattccgaggcccaaaaattccctggaaatctgttcttccagggcaggactgtctgtcatccaatgctgatttcttttttccttttccaggaactcaaggacatg

SEQ ID NO: 100233 - DNA, 196 bp, Heterodera glycines
  Promoter: Source sequence=SeqID_7820; Location=1..196; Strand=+; Gene= SeqID_66071
cccttcccgtaacacttcgccgagggttgaaagccatatcattcgctccattcattcatcatcattgcctcggactgtgcaatcaataaataaacatccaaaaaggcccaccgctgacttgcacacattcattcaattcacacaaagttctatctttttctctttgaaatctctgtcaattcacatcatcaccatg

SEQ ID NO: 100234 - DNA, 89 bp, Heterodera glycines
  Promoter: Source sequence=SeqID_1992; Location=963..1051; Strand=+; Gene=SeqID_77228
attaataatttaatattatttcatttattttaattagttttataaattatacttaaaatttattcagaacccggaagaaaagaagaatg

SEQ ID NO: 100235 - DNA, 123 bp, Heterodera glycines
  Promoter: Source sequence=SeqID_15449; Location=151..273; Strand=+; Gene=SeqID_79712
ggtgggcgatttgaccttggggttttggctgctttgctttggttttgattcattggttcaaagtccactacgaattgtacttttagcctttctgaagcaaattgcgtggaattagtgaccatg

SEQ ID NO: 100236 - DNA, 493 bp, Heterodera glycines
  Promoter: Source sequence=SeqID_18623; Location=1..493; Strand=+; Gene=SeqID_83276
cggctcccggacttttcgacagcaaagggcatttcgacagtaaaacaaaaaataatggacttttcgacagtaaacataaaaacaaataatttttattaaaataaattatattgcttgtcaattttattgaatttcttttaaattaacatactataatatgtattgctaaatcagaattacaatactagagatacgttttttacctaggaaaatttttagaaaaatacacccttaagcaccggtccttaaaattttcaaaaatacactcctaagaagaatgcaaaaattttctcaaaaattcatctccaaattttttatttattttcttggtaaaggaatttagattttaaaaattatttattcccatactggtttggcttcgttttgttattttggagaaaattttacgcttttacaccattatatttgaaatttaattaccttttctgtcgaaaagtcccctcctcaaatttataatatttctgtcgaaatg

SEQ ID NO: 100237 - DNA, 94 bp, Heterodera glycines
  Promoter: Source sequence=SeqID_31425; Location=1897..1990; Strand=-; Gene=SeqID_61776
cgcgcatcaggacgtgcaaagtttgatcgcattgatcaactcgtcctgcgaaaatgccgatctgtcgctgagcaaagaggagctcaaatgcatg

SEQ ID NO: 100238 - DNA, 237 bp, Heterodera glycines
  Promoter: Source sequence=SeqID_17073; Location=979..1215; Strand=+; Gene=SeqID_81500
aatgccatgtgaaaaggagagtggagtgaagattgaatgcccgaagtgtcgacgttacttttacaattgggagtgttataattatcatcagggacatcagacttgcaaatatggaggcgttgcgttatctgtgacaagacttatcgatttaacccgaagaaggaacatgaatgtggtgagacttattgccagctttgtagtgtgagccatgaccccaagcgggggtgttatattatg

SEQ ID NO: 100239 - DNA, 348 bp, Heterodera glycines
  Promoter: Source sequence=SeqID_9296; Location=1711..2058; Strand=-; Gene=SeqID_70895
tggtgacatccaaatttttggccctgaatgtttgactgttcagcataaagggaatgaaagaggcaaattctatgaattttattaaatttaattgtatcaaattttgcatttaattcatttaaaagttaattatttagaagttatttatgtatttataaattaggtcaacgaattcgatcggtgctcgcacaatttcccattccgaacagtgacagtggcattttttattacgaaatcaagttcattaatctggaaaggtgcaattctcaattaattcattaattggctaattaattaatccgttatgcttttcgttttgcttcgtttggcctcgccaccaaagcaatg

SEQ ID NO: 100240 - DNA, 162 bp, Heterodera glycines
  Promoter: Source sequence=SeqID_5693; Location=3082..3243; Strand=+; Gene=SeqID_46096
ggttttgattttaagcgatacaaaaaagactcggctccaaaaattggaaaaataaggggaaaaaatataaataaacttcaatcgtcaatcggtccaccaatggttgatgagaccaaaaataaacgtctgcgtgttgactcattaggaacctattaaaaaatg

SEQ ID NO: 100241 - DNA, 420 bp, Heterodera glycines
  misc_feature (9)..(9): n is a, c, g, or t
  Promoter: Source sequence=SeqID_43239; Location=568..987; Strand=-; Gene=SeqID_70962
aaaagtganccaatgattgttttgatattattatttcattatttctttatttttcggcgtcacgcttttgcgtataaatgattgattgattgattgaaattttgattcttaggggtgtattttcccgattttattgcatttttaattgaattttcggaaaaaaacgccaaaaaaggcaccaaaacggcaaaatgccaaaaaaggcatttaaggcacgaatcaacgtagaagtctcaaaccaagtggaaaaagtgttatttatgcttaatatatcggaactagtgcgcagaaaaaaggcatgcctcaaaagtcggtctctctctatttattggcgattagattaattttttatctacatatttattggtttttattatttaaattgcaatccctcctaattattttcaaaatttagacatg

SEQ ID NO: 100242 - DNA, 180 bp, Heterodera glycines
  Promoter: Source sequence=SeqID_1496; Location=5276..5455; Strand=-; Gene=SeqID_73978
tgtccgcaacggcatcacaaacattagaagctcacaatagaaaaaagaaaaaagaaaaccacaaattaaatttaacggaatttaaacagccgcaaatttatgttgtcacttcttcatcttcatcatccaaaaataggacttccaaaaacggcaaatccaaaagtggcagctccaagaatg

SEQ ID NO: 100243 - DNA, 216 bp, Heterodera glycines
  Promoter: Source sequence=SeqID_21620; Location=1..216; Strand=+; Gene=SeqID_52216
gaaacaaagcaacaaaaacatagttttttgaaaaacaacaacctattgacactttattttaatttcaacaccttatggtttttttcggtttatagcgcatattttcggttttttaatcattttaatagtttttttaagtttttagaacagttcatattttgatttttgcacataaatcgaagttttataaacttaaaattaaattacttaataatg

SEQ ID NO: 100244 - DNA, 626 bp, Heterodera glycines
  Promoter: Source sequence=SeqID_8221; Location=1134..1759; Strand=-; Gene=SeqID_67346
ttttcaaaattgttgcggcaacgaacgactccaattacatgagatacaattttgaaagtgacgatgtgcaaaagatggtcaacaaaatgacgcaacacaaatcattcaagaagttattgtgaagatttagagggacgagaaagaaatcgttaacatttcacaagacttttatttattttttgctttgtttttcgattttaaatgttcgctatcatttggcataattatgtgttttgaggaagccgaagtgatatttttcgaaaattcagggattttgtaatattgagtgatctttggaatcagtcgtttattagtcaaatcggaaaatttggacttgaattggcggacgcgaaaacgaataatttacctagcaaacactctttagatttgttaagtatgaactagggcccgaacttttaggcacgaaaatgtttcaaataagcacctaaaataggcacgaaaaatatgaaaaaagacataaaaaattacaaaaacgacaaaaaagcacgaaaattgggcagcaaaaatttccaatttctaggagttaattaaaaaaatgcaggataatttaggggcaggcccgtaactagaaaaaaaagaattttaattagtttgacgacaaaatg

SEQ ID NO: 100245 - DNA, 371 bp, Heterodera glycines
  Promoter: Source sequence=SeqID_20591; Location=1146..1516; Strand=+; Gene=SeqID_51143
ggtgggaatgttcttcatccccacccatccacggggggcatggtccacgggaatcaatgcccgctgagcatgaccccgcccccatctcagaagcaaaaccaccaaaagcagttgttgatcagcagctctctcattttcgcatactatttaactttcctcatcctctgatctgaggattgatcagtgtgaggggatggataactttgcaaaaacaatgaattttcccgatgcaacaggcgttgtgctgtgcgattatgggggtaataccctcctccgacataatgttccccacaaaggcaccgttcaataaacaaaacaaaaaaaaaacgcggggccaatgggccaaggatcgataatgaacaggcgcaatg

SEQ ID NO: 100246 - DNA, 90 bp, Heterodera glycines
  Promoter: Source sequence=SeqID_22500; Location=1619..1708; Strand=-; Gene=SeqID_53168
tggacggcgtatgtgaatctttaagacaaactaaaaatataagttgttttttggatatctaaaggaatttctttaagagaacagaatatg

SEQ ID NO: 100247 - DNA, 107 bp, Heterodera glycines
  Promoter: Source sequence=SeqID_10534; Location=2056..2162; Strand=-; Gene=SeqID_73767
aacgtagaaaatataaaatttgggaaacgatactgaaataaatttggacacggtatgatatcatttaataatttaaaaacattcaaattcttttcttttcagaaatg

SEQ ID NO: 100248 - DNA, 504 bp, Heterodera glycines
  Promoter: Source sequence=SeqID_43411; Location=844..1347; Strand=-; Gene=SeqID_71076
aatttttatattgtgcggcgacgatttgttctggcgatattttagaaattttttcaccagttctattttaatattttcagcgcctggaaaaacgttgaaatttctttccgttttttgctaaaaaccatctttgattttagggtgggtcaaattaaaaaaaaaaaattgcggtgaatggtggcacggcggtgccgttaggcgccatcgagaaaattttttgtttttagcaacttgatcgggaccagtagaggatcccgggtccggaacgctgggtcctaatttttgactggttcctgccggtagcgggacgttttgaaaaatttaaaaattttaaattttctatgattaatcactttttgaaaatgatttatttaattttgttttgatcctcctgaaaaatgttacatttattttattttacatttcttaaaatatggtcattaggtatatattttttcttcttaaattgataatttttttttatttttagcctcttggaaaatg

SEQ ID NO: 100249 - DNA, 204 bp, Heterodera glycines
  Promoter: Source sequence=SeqID_3822; Location=684..887; Strand=-; Gene=SeqID_52015
tctgaatattattttttgtttttatgaatttcgtttaattaattttaaaatttttaatctatttatataattaaagaaaattaattgtttaattaataggcagaaatttttattgctgttataattaaaattatttcaacttttaataatatagattattattttattgtcattatattttgattattttaaagttttaaaatg

SEQ ID NO: 100250 - DNA, 52 bp, Heterodera glycines
  Promoter: Source sequence=SeqID_3041; Location=1..52; Strand=+; Gene =SeqID_82923
atcactgggacccttctctcctgcgtttcatcacctggactcagtttttatg

SEQ ID NO: 100251 - DNA, 258 bp, Heterodera glycines
  Promoter: Source sequence=SeqID_13875; Location=1968..2225; Strand=+; Gene=SeqID_77821
tatttatgttatatttaatattttatcaatacaaattgcataatttggtaattagttaacttccaaaaaaaaagatttattaaataattaaaaattttgtgattccatttaaattcccttaattcggcattcttccccttttcgtctttactatattggataaaaattgcttcgttttaactaattgccacaattaataaattaacttttaaatcattgccccaaatggccacttcgttgtttgtcaagcgaatgatg

SEQ ID NO: 100252 - DNA, 1003 bp, Heterodera glycines
  Promoter: Source sequence=SeqID_8953; Location=1384..2386; Strand=+; Gene=SeqID_46674
cgttggaggaattttttaaattttttttttagaaaattagattcgttggtaaaataaataaaaaagtatttaatggaaattatttgagaatttgttcgatatgcccaccaggggtggcgcgcaaccgcgactagcgatttaaatgggttactgctagagcccggacggggccgggatcccgccgggattttgccgggactcccggtcccggtcccgggttttttgggcaaaccgccgggaccgggagtcccggaaaaacgggagtgccggtgccgggatcccgcccgggtccattttccaagtcccggtcccgatcccggtcccggcaatttcaaaattccgggctctagttactgcagattttttcgcgatccgcggcaattgggattaaattttattcattgagacgattgtctttgaaatattcaaatttatataaaaaaatttctaaaacttggtattctcgaaaaatttcgttcaaaattccgggtttccccgtctacgctgaccaaaaaatttaaaatatggctcaaatcacaaaatagatcattttttggtcaagtcttttagcaaattgcactcaaattataaaatttttctctggcgacgcttattggcacccggattcccacctgctccgcaaagtttatgggtttcatatattcctaaccctagctatgaggaaatcagaacaaaaacaaaaaaatttgcaattttcattttaatcatttgtgttattttttagggtttaaaatatttctgaatttgttgtggtattttgtccaatgtctgtgctaatcaccgagagaaatcagggtaatttttttttttaatttcccaattaaactgacgacataatgctttgttttgggcttccattcatgagacggttgggatttgtttcaatttggactcttttttgagccaaaaaaaaaattgtaaaaatcagggctcggaatttttgattgaaaaatgcggcgccttcattttttcttttcagatg

SEQ ID NO: 100253 - DNA, 323 bp, Heterodera glycines
  Promoter: Source sequence=SeqID_10395; Location=1..323; Strand=+; Gene=SeqID_73589
cccccccgtagtaggggtcagttgcgtctgagccaagcttaatacatcatactttttttcaggctggccaaattttataaattttgtatcattggaaagctctacatgtttagaagctttttaagttatttctaagcgattgaacaacttattaaaaagttgaaacatgaacactgccaaaaagtcagaatttttgcacattttaactggcccgtttcggttccccccccccccccgccgcatttctcacattttattgcccggaatttatttgcttaaaggatgaatcacttccatcacccactttttgattacgggaaatg

SEQ ID NO: 100254 - DNA, 157 bp, Heterodera glycines
  Promoter: Source sequence=SeqID_12842; Location=1..157; Strand=+; Gene=SeqID_76569
aattaatacccgcaggccatttaaattagagagagcgaagagagagaaagcaagaaaaagaaagagagagaaagatgggttagagagagaaaaaatggttgaaacggaaagtaagacaggaaaatagcgagtgagatagagccaaatagagagcatg

SEQ ID NO: 100255 - DNA, 896 bp, Heterodera glycines
  Promoter: Source sequence=SeqID_251; Location=495..1390; Strand=-; Gene=SeqID_79766
tatgtggcgaaatggttttttgtaagatagtaaagggcaaagggtggaggttcgagtccgttgtgcaacatgaatattttaatttatttttgtcaaaaatattaaaaaatgacgatttttgggaattatttttgaagcttttttgcaaccaaattagacaaacttggtatcattcgaaagctcttgataaggagaagatttttctatgcaaatgctaagcaattttacgttatgtaaaaaagttcgaagacttttaaattttcataacggtctcatgcaaaaatgggatagaaaaatcgtaaaatcttatagaacattcgatgcagaatttttttctctatcgacatgcaaaatttggtgtaaattgtatgagtagaaaaaaagttatatgtgccgaagtaaattcagtttttctctattagcagagataaagaaatagtacgccaaaaaaagagatgtttttttctctgcactctctatttattggtacacatctcgttttttgggatggtgtgtcctctttccttttttcgtcctagcacctatttggacagtgagaagtaaaaaggacacaaatggcacaaccgaaaatgccgaggaggacgaacatggaagaaagtgaaacggaagaacgaagcattggagaggaggcgaaggcaggggggggggaagcggggatttggcaccacgttcatttgaaaataaaaagctttttttctataattaattcaaattcaatattttactaaaatatatttaaaagtcatttctaaattagcgccttagttcagctgttacatatttttgtttgtcaaattaagattatgccaatccgtatgaatttagagcggataatttttaaatcatttaatgttagtacacataacgatattatg

SEQ ID NO: 100256 - DNA, 413 bp, Heterodera glycines
  Promoter: Source sequence=SeqID_38680; Location=559..971; Strand=-; Gene=SeqID_67422
catgcacgcgttttgcgctcgagctatttatcatcgggctttcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcaaaaagtgtcaacagacttttggaaaaatatatttgcaatttatcaacaattttgagaagtgagttagaaatgataaacttcacgattcaaaccagttttcggtgctctaattaaccgcgataaaaacatccgaatcaattaaatagcttctgagataataaggtttatcataaaatttcatttaaaaataaacactcaattattggtatgaacgatactttccaaacatg

SEQ ID NO: 100257 - DNA, 206 bp, Heterodera glycines
  Promoter: Source sequence=SeqID_33849; Location=1..206; Strand=+; Gene=SeqID_63794
aatttattttactaaccacactaggaatattgatttttaattaccctaattaagcaacctgttcaaccacaacaacaacatgcactcattggaatgttttcaagtcactttcgctggtaatttttgggcacattggcggctttcttctgatgtatgtcttcggcatttttgtgatgccaattttaatgcaaaattcactaattatg

SEQ ID NO: 100258 - DNA, 162 bp, Heterodera glycines
  Promoter: Source sequence=SeqID_542; Location=1..162; Strand=+; Gene =SeqID_55813
tttcattttgtccattcgctttatttttgttcattaataaatttatttttcacaattcgtacatttttgttccgttcaattttaataataaaataataaaaaaaaatttttttagcaaaaaacacaaaaaccccccaaaaaaatacccaaaaaaaaacaatg

SEQ ID NO: 100259 - DNA, 503 bp, Heterodera glycines
  Promoter: Source sequence=SeqID_29942; Location=1137..1639; Strand=-; Gene=SeqID_60417
ttttatgtttttacatattttttttgcggcttagttatggcgagagaagcccaaaaatagcattatctccgaacaatttttgatttagagcgacttataaaaacataaaaacacatattttggcgttttgtcacataaaatatgttagcactagggatgatatttttaggcaaaagcctatttttttcctgagctccctatggtctgaaatgcacgaaaaacatgtttttttcggcggttgttaagctacttttcaagttattagtgcctattttctaggcttttatttttagcgcctaaaaagcctaaaaaattttgaaagagcctatttttgcctattttggcgttttgcccaaaatttgttaacaaaaatgcaataaaaacgaaaatctttgcatagaataaagaaatctcggaaaataaaatccggaattgtttaattaattttaaaaatttgtttagaattctttagtgattaatattcaattttagtgttaaacatg

SEQ ID NO: 100260 - DNA, 284 bp, Heterodera glycines
  Promoter: Source sequence=SeqID_1441; Location=4174..4457; Strand=+; Gene=SeqID_73555
tgttctcgcggctctgtctcaattccttggctaaaaatcggacgacgataaatcgacggtggagagaccacggaagaaagtcggaagattggtccaatccaacgcatttcagcggcaaaaataaaatgaatgtgtaatgacttcaggacgaatcaatttttagagcaaagaataaaaaagtctataaatgtttcaacccattttcattttagtttaagagccagggaagtcaagcatcgtattgttttttaaacaatattatttctaattataagctcaaaatg

SEQ ID NO: 100261 - DNA, 92 bp, Heterodera glycines
  Promoter: Source sequence=SeqID_21968; Location=1226..1317; Strand=-; Gene=SeqID_52600
ttgttaggccgcttcgcggccttggaccgtcgcttagcgcccgttatttaaattttgaggtacaaaagtcgattaaaagaggtacaacaatg

SEQ ID NO: 100262 - DNA, 52 bp, Heterodera glycines
  Promoter: Source sequence=SeqID_13143; Location=281..332; Strand=+; Gene=SeqID_76948
ggtcgttatgccaatcggttttctaatttaatttctattcagcgtttgcatg

SEQ ID NO: 100263 - DNA, 414 bp, Heterodera glycines
  misc_feature (77)..(77): n is a, c, g, or t
  Promoter: Source sequence=SeqID_45345; Location=1..414; Strand=+; Gene=SeqID_72655
ttgataaatatgaccaaaccaatctttggaacttccactcttctagggggacgaggggtaccaatccagccgaaagntttcattcgtcgatgaagaggcaattattatgaataaaaattacaatataaattaaaaatagatttaaaaatcaattttaaaataaaatttagagaccttcggcgataaaaaagggatctgtaaacaattttgtcaattttttacaacaaatagttgcggaaagcgatgcaagaattattaagctttctacaaacaaaattttaccccgtaaaagatcaaaagtctatgttgatttagacgcacagctcttaagaacattggatgaatataatgtacaaaactaaagcactaattcataagtgactaaataaaaaaatttaggctacaattgaaatg

SEQ ID NO: 100264 - DNA, 198 bp, Heterodera glycines
  Promoter: Source sequence=SeqID_3432; Location=926..1123; Strand=-; Gene=SeqID_84667
cgagtgtctttactacgtccatttgtactgtaaccatgcctatgacattacggtagcgctctactctctgctgttcattgtgccgctgattttcacgcacagcgaattcagaaaacagtttatgtgcgtcgtcgtttgaataaaatgcgattgtaataaatgatctagctgttctgggcggttaaaacgcggaaaatg

SEQ ID NO: 100265 - DNA, 1003 bp, Heterodera glycines
  Promoter: Source sequence=SeqID_17399; Location=197..1199; Strand=-; Gene=SeqID_81876
tgtattggtttcaaatgatgctttttattctaattgttgttttttaaaattttttcgctcttttatatgtttgtttcttaattgacccgccaccatataaatttcgatttgacaaaacatcgaccaaaaaaacatgattgagtaataattaaatgcaaccaaataaattatcattaattattgtcttttgcttgtcttccgtgtccgccgcaccgcctaattaccccccgcggcgaatgttttgtgattgagaaataaaacaataaaaaatagaaaaataaaataagtagttccactcaaaaatgtggtttttctgattttattttaattttatgtgctgttctctgtacatttcattgtgtgttcattttcttaattttccgcccattttgtcacttcattagttaattaggtgcactaattgttcattgttccatcattaagaagtgcctcaattagtgctgctgctatttacctcttgacaaagcattctgtccaaaaattaatttgatgccttttctcagcgccagcaattaatcatttcggtaattgaccccgtgttgctctgcccacttatgttcttatgtgtaaccccgtataaatacacatgtccaaaaaagaagtttcacttatctatgctatgaaccattgaatttttctttttttctttttcaaataataacaaaaaaaattttttttacaaattttacaagaaaaatttttatttccaacatataaagttgaaaagctcattttgtttaagatttgccaatctaaaattagtcttaagttttgtatttattttttcattgccattgctagtgtttgtttccttaattaaaatgaaagaatttgacactatatgtaaataaatttgcaataaaaatattattttttattttaaaaattcattgtttttcaaattgccatagtttgtctatttttataactttaaaatataaattatatttatattataatttcagttaaaaagctaaaaatg

SEQ ID NO: 100266 - DNA, 74 bp, Heterodera glycines
  Promoter: Source sequence=SeqID_6348; Location=475..548; Strand=+; Gene=SeqID_61228
gcttaaacacacgaccaaaaaacagttaaagattttaattaatcatatccggacttggtgcaggcattattatg

SEQ ID NO: 100267 - DNA, 481 bp, Heterodera glycines
  Promoter: Source sequence=SeqID_6306; Location=4002..4482; Strand=-; Gene=SeqID_61087
tttttgaattccaatcctgcaacaggatccgcaaatttgaatttttgtgcaggattatgcgggattttattgattttaaaaaaaatttctaagacacaatgccaaatatacagaaactttgtttttataatatacatatggattaggtatgaggacgcgcttgttcattctattcctgatgtcaatttttcatattaattttcaccagtttttgtctaaaaatatatcggaacacttatttatcgttttggaaattttttaaatttaattgaaattttttcaaaatttccaaaaatccgcaatcctgcgcaggatccggcaaattttaaatgcaggatttgcaggattgcaggatttgcaggattaatccggccggatccggtcctgcaaaaaattttgaattccaatcctgcaacaggatccgcaaatttgaaatttccgggctctaggtacaaccactgttagaagaggtacaagcatg

SEQ ID NO: 100268 - DNA, 239 bp, Heterodera glycines
  Promoter: Source sequence=SeqID_11898; Location=2871..3109; Strand=-; Gene=SeqID_75410
ggtcacaataataattaattaatcattgacctaattgttctaatgaattaattatcaatttcacaatcattaagtgatcataaccttttagtgctaacgattattaataatcaaccagtttatgctaatgattaattaatatctattttcctaattaatatgaaagattaattaatcagcaatcaatttgtgttaatgattaataaatccgtcaattaattgaagcactcgcctcgatg

SEQ ID NO: 100269 - DNA, 181 bp, Heterodera glycines
  Promoter: Source sequence=SeqID_31844; Location=1..181; Strand=+; Gene=SeqID_62155
tttcaattaaaatagattaattctatagtaataataatccttttttttgaaaattaatagaagaaagtgctaaataaaattctcctgggaatgcgcagaaaattttcgcaacattaatcaatttggaacacatattcacacattcattcatttattcattattagtttcacgctgaaaatg

SEQ ID NO: 100270 - DNA, 63 bp, Heterodera glycines
  Promoter: Source sequence=SeqID_12580; Location=873..935; Strand=+; Gene=SeqID_76243
tgcctaataaatcgattttgttgccacaaaaaaataacatttttagccaccttcctcggaatg

SEQ ID NO: 100271 - DNA, 100 bp, Heterodera glycines
  Promoter: Source sequence=SeqID_23047; Location=1..100; Strand=+; Gene=SeqID_53751
tacagcccagacatcagcccgtgtgactactatctgcttcgatccatggagcacttcttgagagggaaagaatttgctgatcaaaacgaggtcgaaaatg

SEQ ID NO: 100272 - DNA, 158 bp, Heterodera glycines
  misc_feature (20)..(20): n is a, c, g, or t
  Promoter: Source sequence=SeqID_18749; Location=2224..2381; Strand=-; Gene=SeqID_83423
ctgcaaaatttgaaaaaatntcgttaaggttcagaaaagttatgaccagaaaaattcaaaaaaccaaattttccaacctttggccataaatttgttcaaaattgacgcaatttgggaacattttttgaaaaatttttcaggacgaaagcggctcaatg

SEQ ID NO: 100273 - DNA, 1003 bp, Heterodera glycines
  Promoter: Source sequence=SeqID_9202; Location=902..1904; Strand=-; Gene=SeqID_70578
ataacattagaggcattgaccgataaatattggcacaaacaaaaaataaaataaaacaattttaaaacactattaaattctaagcgtctgttcatttaacttttttttcatatatgaacatttagtagcaaagtaccgttcacaaacaaattataattagggatgcaatttttacgtttttgcctatttttttcctgagctcccggtggcctgaaattttctcaaaaactcatccacaaaatttatttatttattttcttgacaggaatttgtgattttaaaaattatttgtctcaatactgatttggcttgaataaattttgtcattttacaccccccccctaaatttgaggtttttggtgcctgttttcccgtttttagagcctattttttggggaattttaggggacctaaagcctacctattttggcggttttagaacctgaaaattgcatcctcattagagaccggaaatttcaaatttgcggatcccgctgcgggactggaactcaaaatgacatataagatacaatgccaaacttaaataattcacacttttacgcaataaatcaaaacaggtgttttttatgtaaatttccaaccagatttcctgttttcatatatattttttaaattcgttagatttggttatgtccaattttctatgttatataaaaaataaatatttgatatttttttactggagagattttaattttagccaaaaatggtttgctaatattttcgatgaaaattttactaagcattcattatctgaataatattgtacaaattttcggagtagaagaaagtgatgataaagatttatttgaagaaatttggcaaaaaactttttttaccaacctaaaaaatttagaagaaataaattatgaaaaaaatgatggccaaaagatcaggaaaagtattgtaaaatgtgagcaaaatgaaaatgatgaaaaaattaaagaattttcaactaaaagtttaaagaaaacaaaagatg

SEQ ID NO: 100274 - DNA, 232 bp, Heterodera glycines
  Promoter: Source sequence=SeqID_6776; Location=1..232; Strand=+; Gene= SeqID_62860
cctatttaaatgattctttttttattttgttcttcacgttgtcctcttttatatcttactatcgtttcactttttatttgattgatagatttttctgccttttttcccgaccatgccaaaattgaaaattggcccactaatttttctcgaattttttatggtcaaaaaccaaagctgatataacaaaatcttagtttttctatacaatttagaccagtagaatccgaatatg

SEQ ID NO: 100275 - DNA, 1003 bp, Heterodera glycines
  Promoter: Source sequence=SeqID_2985; Location=4044..5046; Strand=-; Gene=SeqID_82642
gcttttaattgatccgatgaatgaatgcctcacattttcattccccccccccccccccgtcggttttccgttttgtctttgtcccttccctttccatcgtttggtccgtcgaatcgcagcaaaatgcaaatgcttcgactgctgtaaattcaatgaatggcaggccacactgacagcaaaaaatgaatgaataaatgaatgaattgaaaaaataatgagtggggggggggcttttgggttttatccattgctttgatttggtggtggacgctcaatcactgagagccaaagggaagaagcaacggatttgcaaaaaacaaatgctagcggaattatcacagagaaagataggcaattcgttcgctttgtccgctggcatttgcttttcggtgcctgcagattaataatctgaacaaatcctttaaatttgtgtccaattgtctgtttttgtgaccgcattttctattccgttcagtttattacaaataaatgccgggattatttttctgaaaaatatttttagccaaaaaaaacgaaattttaattttaaattgggatccctccccggcactccttcggtggcaaagatggtgcgaatcggtattttgggtattgaagtccagggtctgatcagggacagtaataggccgagaattggggacccctcccgccggggtaatgagggatttaaattatttccaaaccggcaaattataaatccggcactctacttatcattcattttttccattatattttatttttaaattaatttcgacattaaagttaatctcaattttatttctttaatatgggaattgatcagctaaattttcacctttttccttcaatgttcgtcttcttcgcagttctgaccaccgcatttatgtgattaattaacaaaaatattttatttatttgcaatgaaaaaaaaaataaaaaaataaatgttttaattgctcaaattaattttagttttggcgtcggcggatatgaaccgatg

SEQ ID NO: 100276 - DNA, 378 bp, Heterodera glycines
  Promoter: Source sequence=SeqID_38927; Location=751..1128; Strand=-; Gene=SeqID_67621
agggaattgaggaagaagaacttagttgagttaaaaggcataagcatataaatgagtgtgaatttcgtattatctacacaggagatacaatacgatcaaaggcaaatgtgtgtcagagtcagtctgtcgatttgagtgcaaaataacttataatcggtatcaagaaacgtctaggcaggaccatgcagactcggtttcaattcagcactttcctttcatctgacatatttattttatattattaaataaactcttttatttattcggaatttatccccccctttttccaccccgccctctctccgcctttcgccttcccattttttgcccccctttgccgtccgagccaacaagtggtgccgttagcaaacaaagatg

SEQ ID NO: 100277 - DNA, 252 bp, Heterodera glycines
  Promoter: Source sequence=SeqID_1448; Location=2893..3144; Strand=-; Gene=SeqID_73606
tttgacgcttacatcgcaagtcgggtgggcgcaactgattgggcagacgcatctgatgctctgatcgcggccgtcttactcgggcagacaattgttgtcgtgtcacctgtagatcctgacaatgcccaacgtgcttggagcttttatgacgacaccgttcgacatacaattggagtgtttttcccagacggaaatcatatggtgacaaataatttcaaggcctacctcatattggtttaaaaacagagaatg

SEQ ID NO: 100278 - DNA, 215 bp, Heterodera glycines
  Promoter: Source sequence=SeqID_14940; Location=635..849; Strand=+; Gene=SeqID_79105
aaaaagggaaaaattagaatgccaatcaaagtctaaattatttaaacggcctccctcatatgttatccaccggaaaattaaaaaagtatttttcaaacagaaatctaaatctaggacaatttgaaatgttgtcaagaagaaaaaatttgaaaaaatttctaccaattttttccgaatttccgatgagaattatttgctctccccctcccaagatg

SEQ ID NO: 100279 - DNA, 490 bp, Heterodera glycines
  Promoter: Source sequence=SeqID_30257; Location=599..1088; Strand=-; Gene=SeqID_60680
ttttctaccgtttcccgcttccttatcactgtaaatttgccttttttcatttattttttctctctcattgtcagtgtccaaagttgcctggtttttgttccaaaaggatggcaattttacgatgggccattataattttgcggtatgaaatattttattattttaaatattttttgattgagccgttattacaagagataatgataggctccgccgggaaaaattgaaaattcaggcaatttattaacagaatttgttcaaaaattcaagattttttgaaaaaaactcaaaaaatttccgaaaatatccgaaactttttatcaaaaatttcggaaatcggaattctgacatccaatttttttcgggaatcggaattccgtgccaccatttaatttcccaatgcataaaatacagttttactgttggcgagatttgttttaatttgatttctttcaaggaaaaattccaattcggatcacagcccaacatg

SEQ ID NO: 100280 - DNA, 238 bp, Heterodera glycines
  misc_feature (119)..(120): n is a, c, g, or t
  misc_feature (148)..(148): n is a, c, g, or t
  Promoter: Source sequence=SeqID_35955; Location=1031..1268; Strand=-; Gene=SeqID_65408
gatattgtattgattgtgaacgtcgcgtgacacgctggtcccaccgcagggaatgcaaagtcgtctgccgtctgtgtttacgttttggcgcagggtatccatgtaaacaacacacaacnnaacagcaatcccgagcagatgggtcacntggcaatcgtctttgccgtgattgtcaatcgtttttccaaatgacgactgcttcgcctatcatctgagcaatcgggcacctataagcatg

SEQ ID NO: 100281 - DNA, 219 bp, Heterodera glycines
  Promoter: Source sequence=SeqID_8182; Location=1099..1317; Strand=+; Gene=SeqID_67227
tgatattctgaaaaaataaacaattaaatataaatgcaaaaaaaaaaaacaataaaaatctaagagtttgtaaaataacataaaaaattattggaaataaatgaaaaataaatttaaaaataattatagtagaattttgtatcaatttatcattttattcattattattgaaattaatatttgttttgtttattacaatgttaagaaggatgcaaaatg

SEQ ID NO: 100282 - DNA, 287 bp, Heterodera glycines
  Promoter: Source sequence=SeqID_3646; Location=381..667; Strand=-; Gene=SeqID_51264
ttatccaagcatttgttacttgcctccaggcaagtttcagtatggcatttcataattagtcaatcatcctattaattagctcagttcagacatttaactaattggtcatttaaactttcaaaaataagaaatttatttaaaataagccaaaaatggaaaattttgacttttacttggttttcttcaaagttaatactttatttaacgatttttaagaaaattttgcactcaatttggaattttaattatgtacatatgcaaaaatccaatcaacagaatccggcatg

SEQ ID NO: 100283 - DNA, 202 bp, Heterodera glycines
  Promoter: Source sequence=SeqID_5880; Location=4704..4905; Strand=-; Gene=SeqID_59534
ttattcaatcctgacaatttttttatccaagatttaaattagtgtctaatttagatcgggtaggattatccaaaattagggctcatcaatcacaaacaactgtactatctaaattcctaatcaatggataattttacaaatgattaattaattccgctaaaattgccaggatctacacatcattgaacgtatgatggccatg

SEQ ID NO: 100284 - DNA, 431 bp, Heterodera glycines
  Promoter: Source sequence=SeqID_5444; Location=5268..5698; Strand=-; Gene=SeqID_58066
attaggtgtgtatcgtgccagacccaaacggggattatgaaggttaaacggacacggaaacgcgccctgtaagcacaaggaagcaagtcatggccgaaattgcctgtatgttcggcggaagaatagccgaacgaatgttttgcgaccgtagtgtagggcttggccacgatatgagcgaggccagaaaattggcaagaataggttcgcctcattgactttttttggttaggactcaacatggacgtatggcactttttctctctctctctcttcctggggacaaatcgtgggacatgtcggtggacaaatcttggaggatatcggggagatagtccaatgcgcggtacctctgacacttgggacactcgtggctgacggaactgtcgcagttggttgtaaggccttcaaggcttgggaggggcgcgcctatg

SEQ ID NO: 100285 - DNA, 178 bp, Heterodera glycines
  Promoter: Source sequence=SeqID_2609; Location=4649..4826; Strand=-; Gene=SeqID_80693
cctgtttttggcaaattttgtatgtgtcaatttctttaacgaacatgccagggaacgtaaccaaattgcgttttccgagaaattttagacctgggagttcacagatttccgagtttttttttgtacctcggaattcagacttattgctttcggtgggttacatcccggaacacaaatg

SEQ ID NO: 100286 - DNA, 177 bp, Heterodera glycines
  Promoter: Source sequence=SeqID_13153; Location=4760..4936; Strand=-; Gene=SeqID_76966
attccttggtcttactgatgacgcgttgagagttttcttttttgaaaatatgacgaaaaaattcaaattttttgtgtttttcaaaaacaacctattgttattatttggaaacgaatcttaattaccccacccccgtcggtacaattaagtccaattaaggtgcactttctcaaaatg

SEQ ID NO: 100287 - DNA, 1003 bp, Heterodera glycines
  Promoter: Source sequence=SeqID_13953; Location=279..1281; Strand=+; Gene=SeqID_77914
tgctaggccatattcataccagagatagtaattctttaaaataaaattttgaacataagtgttttaatttaaatttaaaaatttgttttaattttttaactaaatatttatgtaaataaaaaaacagctttatgggcaaaaggtactttaatattatttaatttaatgatacaacaccaaacaatgaaaagcggtaaacgaaaaataacacaaatgacggaataaaacgtagaaatttcaaaggtgtacacataagcccctgtgtttatttaagtaatacgcaaatttggatgagatgggagaaaaagcaaaacaaaaaaacaaactgattgttgaaatgaaataagttaaattagcaggcactaaaaggaacaaacgaaagaattcgggaccacccaaaggagggacgaaaggggacgcaatttggtcgaacgaactaacaaagcattggaataccggaagaatgggatcttcaaacattcacaacattaaaagcaactgaattttatgaattacggcaaaactattcgaatttcgaatggaagggacggcggaggcattttgggatggaaagaaagtgagacaaacaatggtcggacattatcaagttacgcaacacaaagtgaagaattgggaagaacacaacgcaaaagggagggaatgaaatgaattggtcagaggcagacggaaattctcttttttggggtcagtcactcctttccgctgctcaccattttatcacggagttcctttagctcgtcttgaagtgccgccaatttgcgctcctgctcctctttgtactggtcgaactcagcccgactaatgaagttcggctgctcatccggtggcaaatgcggcgattgtttgttgccgaagtgcgtgggggagcaggaggaaagtgaacgctgttggggctgctgctgctgctgctgacggtcgtcggagacggcgcaaagaatgggcgtgggctgaagaagtggcgaggacggacctgtccacaatg

SEQ ID NO: 100288 - DNA, 400 bp, Heterodera glycines
  Promoter: Source sequence=SeqID_9516; Location=1..400; Strand=+; Gene= SeqID_71717
aaaacccatttttctgtatgagatttctacatttattagttattacttttcacatatgcatatgtaatttattatttatgtataatatgaaataaaagtaatccaagcgcataaaatttattccttgcaaattgttaaaaaaagacaatgatttttcctttgacgttaatattcattcgtaaattaatttttatccattttcctttatgcaatattatcatttttatattattttttctttatgtttaaaattttcattcataaatttattttacgcattttattttataattattattgccattattttaatttgaaaaatactttgaatgtaatgaatagtagttatataacctatattaaaaaacacttttttgttaccaatttaaacagaaaaatg

SEQ ID NO: 100289 - DNA, 230 bp, Heterodera glycines
  Promoter: Source sequence=SeqID_3373; Location=1..230; Strand=+; Gene= SeqID_84440
aaatgttgaaatcgcaggaaggaaaacgaaaacaaaaaatgcaaagacagaccaatggaaaaaaggttggcattggcatcatttcctggcaaaaaatttttgaaaaacatttccaatttcaatgaaaataaacgattttggaggaatataaaagccaaaagaaagccatgcgaaaaacataatcgaattattttaatttaattaatttgcttttattatccttcaaaatg

SEQ ID NO: 100290 - DNA, 538 bp, Heterodera glycines
  Promoter: Source sequence=SeqID_7120; Location=2107..2644; Strand=-; Gene=SeqID_63894
cttacaacagtgaagaatggagtgatggaattcagaggaggaagttacccaaaatatttcttaaatgggaaatttaattcccgaggcccaaaattctcgaaaatcggttaatttccgaggcccaaaattctcgaaaatcggaattccaccacctcaagcaattaattgaagttgtcataatattgtttcatttaccaatgtattcttttcaatgctcttaattatgtcataaaaagccataaaaataattcattgttttatttatttttaatatataaatattctttgtcatgttaaaataaatgcttgaataaaatgaaatatttgcaattattgtttttatatggcttactcatacgtgaacaaggagtatgccgactctcgtgggcgccataacgaagggagaaaaattttaaaaaattttcacggcggcgcctatcggcaccgccggaccccgctaccccctctggttccccataatctttgaaaaaatcatgccgcaaaaaaggtggtttgaatagcaaaaaaaaaaaaaatg

SEQ ID NO: 100291 - DNA, 1003 bp, Heterodera glycines
  Promoter: Source sequence=SeqID_4178; Location=520..1522; Strand=+; Gene=SeqID_53483
cgcatcaaaagacgccgacgatttatatccggcaatttccttgaacaaccccggagacgaagtggaggccaattttggaccgaacttcaaatacacacttaattaaatgacatatccctttttccgatttatttatttgtacttgaaaaattatttgttaaacagtggcgaagatttaatggtatttaaaatgttctcattttgaagaaactgaattttaagtattttaattaaaccaaaaggcacgataatggcaaaaaacgtgcaaaaaatgagtaccaattttataaatatggtcatcgtttttagtgcaaattctgctgtaatgactttcaaaagtgtcaattcctagaaacacatacgagatgacagctcccaaaagacacagtaattcttatgaaaggtccaacctacagtagtaggtaattactatcgaataattgatccatatttttgggggtgtatcgcagattgggttcagtcactgtgaaggaatgagtgatctctgctcaattatttactttgctgatcaacaccaaagttccccttgatctttgcagttatgtggtcgcttcccactatttatttggtcatgtctatgcaaaaaacatagccgccggcgctgcgattgattatgtgagttattaacgtctcaaagaaaaaggagatcaacaacggcggatgaccaattcattcattctctagcgaaaacaattctgcgaaaaggccctccctcataagtctaagaattcagtaacaattttataaacaaattagaattttttgttaaaatggtttttttataaaaatgcagtaatttatttattagcatattagtattttcgaattcaaagttaaaatttttgaaatgcccttttgttaattttggtgattatttcgtccgatctgcttattaatcccgaagtatcatactcgtaattttccgcattttataattttgaagcaaatttaccaacttttcttttctctgaattcaataatg

SEQ ID NO: 100292 - DNA, 949 bp, Heterodera glycines
  Promoter: Source sequence=SeqID_5981; Location=1259..2207; Strand=-; Gene=SeqID_59903
ttttaatccctttagaatgttgtatatgagtggtttaatgactttaatccacatccctcatttcattggaatgggggacaaagcgggggaggggatgaaaagcaatgaaaaagccggaagaggcggaaatgaaaattaaaattggacagaaaccgtagtgcgacatttgcggactgacatttgcggactgacatttgcggaccgtcttttgcgggtcataatttctggatttaattttcaaaaaaatttttttttcttaaattggatgatcatctgaatattattgaattttatatgtgatttttcggagttaagcaagttaatgcgaatgaaaatatgaaaaatttataaagtttttccaaaaagttcttttttcaattcctcttggtgctaaaaatttttatcacttcatatcatccttaagtagtgatctgatcaacttgtgcaatgcattagtttataaattcctgatttacaagaattatgttgtcattgataatgtgagtaattcattttaaaaatatatttttatatcttttatttgttcttgatattaattgttaggtatgcttgatcaaaatctaagctctttagactaaggctagtaggtgaaacacgaaaaattttgcgtgctatatattttgtgatatgatttttgtataaagcattttattaatcaatttagcaagaagcactatttaattatcaccttcagtcattatttcaatttggtaattacgaaaatttatttgaaaattcattttaatttttttttctctttttttttgataatttagtcacaaatgtcggtccgcaaatgttggctaaccacagaaacaacagcagaagaagcaaaagcgagagcagatgaattcacggccaaaaagactgactgataattacgataattattattattgtcatcattatcagggctgtcaaaaatatg

SEQ ID NO: 100293 - DNA, 176 bp, Heterodera glycines
  Promoter: Source sequence=SeqID_10627; Location=1..176; Strand=+; Gene=SeqID_73861
gtgtaattttccctttcccatgctttgggcgcaacagaagcgtcaccttattatccgcaaacaaaatcaataagtaatttcacactttgcagttttgtccttttttagctgatattttctaaattggttgtttgttatttgttagttccatttttgctaaaacaaaacaaagaatg

SEQ ID NO: 100294 - DNA, 1003 bp, Heterodera glycines
  Promoter: Source sequence=SeqID_11505; Location=1631..2633; Strand=+; Gene=SeqID_74931
acactttttttgctgataaatttactgcaaaactcttcccgaagaaatttttgcaattcattgatatcaattaatgtttaatcgttggccagaaatttgttgcgtgatttttctttgtttaattaacgttaaatacgaaagaattttttttttataatttggtgagaaatacttacttaaactgattttgaaaaaaattaattatttattattaaatttataaaattttatttttattttttttaatttttaaattgatagttcggtttttttgaaggggtcagtcaccccatcccaaaaatcagggaatccccaccattcacttatggaagtaattcattaaaacagtccatgtaaaaatattgataacgaaaatgtgaacttttgcctttaccttctccagcaaagaaatgtttatttaaatttagaaaatttattctcttacaacatttaaatccgcagaaaatgctctcattgatagtcatcgtttgcttctttgggattgtgccgaatttgtcaaaaccgatcaaactcagaaaccattctccaatggatgttttggtaaacaaaatgtaaaataaaaattatttaattaccaggataatattgttttcattcatcccctgagtctcatcatttaggcttctcataatccgggcgcacttaataatccgcaattccacatttttgggaattgcaaaattttgttggattaatctcttgaatcccgtcctagcaaaaattttgaatcccaattacgcagcgcacaattaaaatttttttaatttatcaatccgtctgccaggatttcttgatattcatatatatttgccattctgttgtagtttatggcctggcccgaggcgcgttatccactggaattgccttttcaccgcgtggattgctttagtgagatggagaggcgacacatcgtgccacaagtcatcacttaccggctggaaaatatcaaaaaactccgtaacggggttggttgaacattatg

SEQ ID NO: 100295 - DNA, 505 bp, Heterodera glycines
  Promoter: Source sequence=SeqID_18011; Location=454..958; Strand=+; Gene=SeqID_47493
ttgtagtgcaaaattgctgaaaagccaaaaatctatgtacgacgattgcaattttagaatgttttttaacaaaaaatttaaaatcaaaatacccaaaataccgcgtattttggctttgcgtttaaatcaaatgccgaaattcaaatttgataaagccgatcgcgatctgcaccaaattggggatttatggcacggttcgcgcgaacgaatattaactccaatttggcgccaaaaactaatgccgagaattcaaaattcaaagcctatggcataaaattggacttttaaagccaaagtattatcattttcacgacaattatcggccgccctattggggcacttggcggcgtcggagtgcccaaatcaccggccgtcgaccgtttggccgagaaaaggtggcccacaatttgtgaaatgtttctgcattttattttgacagactttgggaggagccggaagatgcggacgaattcaaatcggacgaagagattgaggtgccgaaatg

SEQ ID NO: 100296 - DNA, 172 bp, Heterodera glycines
  Promoter: Source sequence=SeqID_19439; Location=1139..1310; Strand=+; Gene=SeqID_84163
atttcgcaacattgtatcaaaattcggataataaatcagaaaatattcaacattcgactttttgaaatgaagataggttaacaaaccattggcagctataaaacaaaaaaatttttacagttttaattcattcataaatttacaaagcaacaaccaattcacattcataatg

SEQ ID NO: 100297 - DNA, 255 bp, Heterodera glycines
  Promoter: Source sequence=SeqID_33126; Location=734..988; Strand=-; Gene=SeqID_63287
aaaaatatgaacgttttataggcataaagcgaacgatccggcactgagccaagtgatcgaaaagtttacattcaatgtcaggtaaagttttcatctcacatggcgataaaattcggcaattttttcggttaagtgctgaacaattcaggaaaaattttgcaaggatcgctgaaaaaatatttaaaatttattgtaaaattttgggcaaaacgccagcaaattcccgaagaaaaattgttaacaaatgacaaaatg

SEQ ID NO: 100298 - DNA, 974 bp, Heterodera glycines
  Promoter: Source sequence=SeqID_8690; Location=1215..2188; Strand=-; Gene=SeqID_46630
tcctccatcttttcactttcggatttccctcccccttttttcgcttccctctcattaaagtggacaaaataagcgggcgcctgttgcttctcccgcccatcggtctctccgctgcttttcttcgattctcttctcatccatccgtctttaaatcgacggattcgcttgcctttcccttttcccttaagttctttcgaataaaataaacggaggcattggcaaataattgctgcacggaatgaatgccgtggctttttctccccaccaaactcatcccttcttagttagcctttgcctatcatttaaaatataatttggcccattaaaattccctttcgctctctttcttttccgttctctcctctacattcaatcactctctcttttccccttttctttgtgagaatgtctctcttttcacgttttaaagagtcttaaatttcttctcctccgcttaagtttaacgtcccttccttttttcatatacataaatcttttgggatatcttttgtcccaaacacagaggaaatgtaaaatatctttttgaaaagcatcggattgtttaagttttacccatttgcatgctaataattagttttttatgtacctagatccttctactaaattcgtcaaaattaaattttttataaaaaaattttttgtttttattttattaatttttgcgtgaatcccgatcacttcccgcaaaactttgactcctctacaacattttttttaccgtgctctaataattactttttaaaaaccctcagaagcatgctttcaaggctttttaaaagaaaaaaaattttctatcaaaaaaggggggggggtaccatcggtagtattacacttttttttctccggtaattaattataaactttttcttttatttttcatttacactttcctaacactatttttcaaaatgataaatgtgttgttaagcaataattgccctcccctcccgatg

SEQ ID NO: 100299 - DNA, 82 bp, Heterodera glycines
  Promoter: Source sequence=SeqID_4526; Location=3208..3289; Strand=-; Gene=SeqID_54774
tcttaaaaatgatatctgcacaaaattccaacgatgcaatgactgtggtgtaatatataacattaaatatcattcaactatg

SEQ ID NO: 100300 - DNA, 226 bp, Heterodera glycines
  Promoter: Source sequence=SeqID_44940; Location=259..484; Strand=+; Gene=SeqID_72346
agtgcgggaatggcttctgtggccgcgcgcggatggccgtccgaaagtgttgtactgcaccttttggtacgatataagtgacgaatacaagcaggcaagcggcgggaaagcaaaccaataaaaatgataattaatcgaaaagtaagagaggttgaaagataacagagagagagagagagaatgggagagcaaaagagggaggaacggggagggatataaaaagatg

SEQ ID NO: 100301 - DNA, 262 bp, Heterodera glycines
  Promoter: Source sequence=SeqID_26309; Location=36..297; Strand=+; Gene=SeqID_57055
tttttccaaaaatcgctttaaaaaattcaaaaaaaactttttctcgagatttataaaaagttttcaaagatttttttttgaaaaaatttctcggggggggggggcatagtgcatactaatttgtaagctgcgctgggattttattgagttgaaatctttctgacaatgactttttttctttataatttgttgaaatttgtgtaaataagttaaatacatatatttttttttcttcctttgtcaggttttcttgcacgcaatg

SEQ ID NO: 100302 - DNA, 933 bp, Heterodera glycines
  Promoter: Source sequence=SeqID_8336; Location=294..1226; Strand=-; Gene=SeqID_67726
ccaaatatttggtcatttttgaacaacttctgataacaaatctcgctcaaaatttcaacatttgtccggcggcacctatagacaccgccggacccccggccccctcccactgttccaaaaaagttttttgaaaaaacattgccacaaaaacagcgatttaaaagcaaaaaatttaaaagattgtaaatttatttaaaaaaaatacagtgggactcagaaaattccaagaacccccccccctgaaaacaaaatttttaataattttcctcgaactcgtcccccaaaacgtaaatacaaaattttattggtacatttttgaatattggcaattttcgtaacaaagtgcacttaaattttcaatttttttcaaaaaaaaatttcacttgggaaaagtcccggttggtcccggtcccgggttttttcgctgtcccggtcccggtcgaaaaacttggtcccggtcccggtcccgacttttctggtcccggtaagtcccggtcccggtttttgtcaaatttcccggtcccgctcaactctacctgatacctattttattaatcaccatattattagaacggttccagtcttttgtgcgcctaaattgcaacatttgtggacttttgaacaaaaaacccatctcagatttatttaatctaatgttggaagatcatcgttagaatctccgaatcaaaccatcttttaactctttccatcttctaaaaacattaaatacattgatcagtgatcgctgatcacacaataaaaatgcatgaataaaagaaatggaaaatattttgaaagagcgccattataataatgccaataacccatattcctcgagggaattgaaccaagacaaaagctgagtgttaaactgtatacaaattcttaatttattattttagtgaagcaaattgttttttttttcgacaaatg

SEQ ID NO: 100303 - DNA, 398 bp, Heterodera glycines
  Promoter: Source sequence=SeqID_8262; Location=2254..2651; Strand=+; Gene=SeqID_67486
aattgtttgtttattttttaatgaaaaattatcccaattatggtctcttttaaagatatttctgaattttttcccaaccttcaaagaaatagttttaaacttgattagttattaacggagtttttcattttttttacaagatttttgggtttattttagaagaattattttgtcccattgtataaacattaaaaataaaattaaatttattatttttttaaatcttgaattttttaattcaaattatgtttaatttatacttttcaattagtaataataataatgatcaattttgtattaatatttatatttacacaattagttaaaattacaattattaaatcaattaaaattttgctcagatttccggtggtgcccaaattgacataaagcaaatg

SEQ ID NO: 100304 - DNA, 211 bp, Heterodera glycines
  Promoter: Source sequence=SeqID_23242; Location=1341..1551; Strand=-; Gene=SeqID_53959
atttttttaaagttcgggcgggcgacaaacttttattatttcaaatttgttcgttatctcgtcaaaactagaaaattttaagaaagtttcaagaaaaaattcaatttttttttggaattcggcaaaatatgtgtttcaataaaatttatataggttttcaaaaaatttttttttaatttatggcgacgtttttcgacgttttgtcctgatg

SEQ ID NO: 100305 - DNA, 922 bp, Heterodera glycines
  Promoter: Source sequence=SeqID_4401; Location=527..1448; Strand=+; Gene=SeqID_54323
aattcgaattgaaatacgaagaaatggagggagtgaaagtgattcgcaatttcattatttatttattgccgttgatttcctttttcatcacaaatttttgctccattttcaatttctgttatgaacaaataccagaataaaacttgggaatccttaaactttgcataagttttgtcctgcacattcactggcttcttcagtaaacagctgttcttcattcgtttcccatcgctttgtccgtctgcggacactccgccgccccccaaatgttttccggccgatttccaatcgatcagaatttccaattctcaatttccatccgccgatcgtttgcaattcgattgcacattttcctagtcaagatttctccaaagttttggttttaataaattcttcctcccccattattattaccgcaataattttttgtttatgccgtggaaagtggcacaaatggccaatcaatggcacttttgctggtccgtctgccgtctctctcattgccccactctttctcccctcattagtgtcccttctatttaataatgcccacctttttgcccatttcctttgggcttccgctcgcttctttcatttccgttttggcttttattagcaattaattcttaatttttacaatcgattagtgttaaagtaattagtgagtaagaacaaaagctttaagcctgaaataagaagaatttccataagaattttccccacatgaccatattttaaggcctttaagttaattttaaaaaatatatgaaaaaagcggcgattggcgccgccggggattaatttcctcttctgtttccttttggattttgactatcaaaatcacaaattttcttacttaagattgtcaataatgtttaataatttggctaattaattaatttaaaaacgaacggaattaatg

SEQ ID NO: 100306 - DNA, 315 bp, Heterodera glycines
  Promoter: Source sequence=SeqID_964; Location=2206..2520; Strand=-; Gene=SeqID_65064
ttggtttcaaccacatcgaattgcggtgagtgaaaattcctttttaaccatattagtgttcatataatttttttgcatagctaaactaaagtctgtgtatcatattgcttaagaaacggggtcggacgttcattggacagaaaaatgatccattaaaagcataaatctgaaaagaggggatttttacggtcaatgcttaagtattgttggtaccaaacgttaaaggctatagaatttttttaaaccaaaattaattttcttgaatatactcgaaaaagctgcgtttcgtttttctcgttgtagtttttcttaatg

SEQ ID NO: 100307 - DNA, 89 bp, Heterodera glycines
  Promoter: Source sequence=SeqID_340; Location=970..1058; Strand=+; Gene=SeqID_83234
tacacacataataaatatattctttatttattttttaaaatatttatctatttattctttatttataattaataattatatgtaatatg

SEQ ID NO: 100308 - DNA, 1003 bp, Heterodera glycines
  Promoter: Source sequence=SeqID_4336; Location=762..1764; Strand=+; Gene=SeqID_45781
tcatatcatgccaaaaactgaaaaattttattccaaaatgccatttaatcccttccagagtcaaaatcccagttgagagcggagacttcggcactctgagagtgttagtcacgtgccccgttttaatgagtggcctcaatgttcgggacggccctcaattagtcattttttgactaattaaattttttatttaatttgtgccattggcggcaatttgttgttgttgtcacgtggcggcacggatttttagttgattaattttttcttcagcagaggataaaacatttaaatttttatttgtccattcgtttttttggagagactcattttatctgactttttttaaatggatttttcggcacaaaatgccattcagatttcgatctaagtctaagtaattttccggataaaaaaattcttgagaatacttcttttaaaaaaaaactccgtttattgttttttcattatttcattttaacagtacagagggacatttttgaatatccctccgctgggagccgaacccaaaccctcttttttctcaaaatggtcgaacccactgagccacagataaaccctcttttagatctttcgaatccgatcaagagaattttgatcatcttattccaagaaaaaagccacctgaattttaatgaaaatggcacacattttcacgcatcaaaaattttttcatgccaaagtgtcggattattaattagaaaattcgacgaaaatgatttttccttataaatgacgtcacgtcatcttactcacatttttattaatggcacattgcttttatcacacaatgccaaatttgtttctctgttttttctttaaattttcatgttttccccgtgccaaattttgtttctctgttttttctttaaattttcatgcattatccaaatgccaaatttgtgtctctaattttatttaaattttccatttttaaatttaaatcaatacactttttttccgccattcagacggttcagacatg

SEQ ID NO: 100309 - DNA, 629 bp, Heterodera glycines
  Promoter: Source sequence=SeqID_9597; Location=1784..2412; Strand=+; Gene=SeqID_72025
aatgttcattcgaaggactaattaaaagcattagcagaaaaacaacaagcattttcattttagctttagatgtaaaagcatagggatttcaacggaaggacaaaaaatccaaaagaaaccttaatatgacccgaaaattgaaaagtctaaatggagaaaacccaaactgtcgtaaaagtgacaggaaaagaaatttgatcaattttttgaaaatttggaaaagaaagaataaatgaatgagtgggtgagtgacaaacgccactttttttggtccttttaatatctatgacaaatttaataattcattattttttcgctcaaaaacgtgaccggggtagggagtcacggctaaatcccggcggggctccggtccagtccgggctctattgcttatcaatgtttatcggcggcggcgacacgcggggtagcggggaaaggctgacaaattatttggatttcctactttatcactgatttgtgagttgcaaaacgactcggcaaaacgtttcgagggacagaaattaagttgccaggctcaggttccataattctatgaaattgcgtttgatcgaagaaatgatcagtttcttggctctttcttcacaagaactctcgacggatgccaaatg

SEQ ID NO: 100310 - DNA, 410 bp, Heterodera glycines
  Promoter: Source sequence=SeqID_3105; Location=5075..5484; Strand=-; Gene=SeqID_83206
ctactttagcgcaattatgtttatattccttgtggtctttttgcgctttgtaaccgatgcgctgaagtggtagaaatcgaaggtacctgtcctttttgtcgtgaacaacttgatggagtgtttaaaatttttagctcgtaattatactacgatcgttaaatacccaaacttatgttgctaaattacatgtttataaagtgattatgatttccaatgcatattggattgttaaagcttcaccagaattaacaaactaatcataaaatctcttatgttacggtggcctaatggtttgtcttccagattgtggacaaatgttcggttctccaagaagctggcacatttaaaaattatttaatttaaggagggacaaatggttaagatgaggggaaaaattatcgataaaaatg

SEQ ID NO: 100311 - DNA, 704 bp, Heterodera glycines
  misc_feature (42)..(42): n is a, c, g, or t
  Promoter: Source sequence=SeqID_44622; Location=298..1001; Strand=-; Gene=SeqID_72093
tattagtcccgaaaaagccgtggatcgccagtcatataggtncgcgcaaaaaatttcgcagtcgcggattcaaattgccgcggttcgaagcgccaaatatggaaaaacgcttgaatcgcgcgtcgttgtcgagtggactaaagcccaaaattgtatatataacgaggccagttttcttcaatcaccctcagtctaatttcgttgcattcacaccgtactacacaatttatttttatttttacatttattcatgaaaaatcgttgcgtaaaattctaatgctttttttttatttctgatcacgaatttgacaacctttcggcaattctgaaccccaatcaattcgaatcaaaagttgaaacttcagatgaaacttaaaattcttgaatttcgcatttttagttcaaaaccggctaaaactcgaacacaaactgaattcaccattatgtattactctaccatcgactcttttttgtaccaaaattagcatttattgataaaatcttattgatactgttagtctaaattgtcttcattctcctcgaatttaaaaatggccccaaaagggaaacgaatttcacgacttattccttttggaaagcaaatatttgtattttttcaattctttatatttaatgaaatctgttctttaatcgggacggaatagttaagttgctaatatttggcttcttcgaattgcgcaatg

SEQ ID NO: 100312 - DNA, 398 bp, Heterodera glycines
  Promoter: Source sequence=SeqID_15042; Location=1638..2035; Strand=-; Gene=SeqID_79215
ggcaatcccaaaaaagtgctatttttgagtcatttttcgaacacagttcgaacagttcttaaccgatcgaaaccgcactatttttcccttataacccttgaaaaactgcgtcgattgaccccacgctcgacctgtaaaactcgctagaaagtcttaaattagtttttaagcttgaaactggggtatattattcttatatagggaaccagcagtgcaaaaagaaataataatttaaatattaaaacgtaaaaccaagagaaataaaaaattactaattaattttgggtccactgcgtttcggcgccaaaaaaaattataaaaattcaaatacttggttaaaatctacaaacaaaaaacaaaaataaaacttttttagttaatcaatttcatcgaatatg

SEQ ID NO: 100313 - DNA, 198 bp, Heterodera glycines
  Promoter: Source sequence=SeqID_5082; Location=4214..4411; Strand=+; Gene=SeqID_56826
ttcctgatttttttttttcaaaattccttcccgaaattgatctgaccacgcctgatcagtcgagtccgccggagggaaatgatcggagtttgggattgggttatttttcgggcggtttgcccttttccgttttcgaaggactgtccttaacactcgaaggtattcttacgatgcttgagcggtccgccggaggtaatg

SEQ ID NO: 100314 - DNA, 1003 bp, Heterodera glycines
  Promoter: Source sequence=SeqID_8738; Location=243..1245; Strand=+; Gene=SeqID_69031
tgaaaaaattcccttgatggatgactatgaatggaaaatggaaaaataaaaagccaccaatttcttgtgaattttgaaggtcctaaccatccataaccaatatattgccaaaattttagtgcccaattttttttgcggaaatatttttaaaattttccaccaaaaaaggaattaagaggttcagaaaagaatcgggaatccaacctttcaacattcattcggtaacatgccagttaccactgatataagcggtttagagacaagaatgcctaaatcaattctgtgtgttttgttggagattcatgtgtttttaggcattgaacggttcagtccaaagccatgttgccacttcagtcccagggtctgtaactcttcagggagtgtattcttcactttaaccaaattttgaatttcgactttttgcacgaatttgggtccggaattcgaagttagtcaatatgaatgttggattcggtttctccgacccagaaaacccttataaacatgttttcacgactttttgaacaaaaaaattttcttccaaaaaaggggtcaccccatctatagaataccgaattttcgtgtcaatttggcagtgaatgaatacctactaaattggtacataagcgaaattttaattttgcgaattcaatgcgtaaaaggaactcaaatttttttgtgtgggaacgggtcccagcggattacccgctcaaatcgaacattaaattttacagaattccgtgtgggattaagtgaattttgaaatttttcgaaaaactcaattaatagggcataagttaattatatgaattcattaggtaattgaatttatgtgaaaccaatacatacatatttacaaaacggcatataacattgaaatcaacacacatatataaacgcgcatattacatgcatttaaggggggtacatacaataagtagcacattttcgggaaatcaaaccaccagaaacatcggacaatttcaaggaaacagcaaaaatg

SEQ ID NO: 100315 - DNA, 108 bp, Heterodera glycines
  Promoter: Source sequence=SeqID_13953; Location=1322..1429; Strand=-; Gene=SeqID_77915
actggaaaattatttattttttcatttcgggggggggggggggaactgcaccctttgcccccccctggtcacggacctggggacgcgctaattcacaaagggcgaatg

SEQ ID NO: 100316 - DNA, 287 bp, Heterodera glycines
  Promoter: Source sequence=SeqID_13573; Location=852..1138; Strand=-; Gene=SeqID_77477
ggtttgtcaacgggaactaacaattaaggagtttgtttggttttttttttaagcaattttcggtcatggctccccacttgttaggcgtacagcaacggcggcacttgcatccgatgcagctgttcacagggctctctaaacctatatttattttttttctatcttttctctgaatggagttataacatttttcacaacagttttgcatttaacagacacattctaaaatatctaattagtatggtagtccaagcctattattttttttttagacttgtctatgaatg

SEQ ID NO: 100317 - DNA, 101 bp, Heterodera glycines
  Promoter: Source sequence=SeqID_28567; Location=29..129; Strand=+; Gene=SeqID_59167
ggttgggacagctttgacagacatatacatacatgaaaaatagttaatgcatacaaggtacttgctagtttaggcccataaatatatgtacatagaacatg

SEQ ID NO: 100318 - DNA, 270 bp, Heterodera glycines
  Promoter: Source sequence=SeqID_22513; Location=1643..1912; Strand=-; Gene=SeqID_53180
tcgtcaagcattttcgaaccgggcattggtggagtgcttacggatgcataaaacagcagcaacaaaagccaaatcagctaatgatggtgctttttcataaattaacattgaacctttaaaaaaatttaattttatttcaaaattttgcttgaaagaatgtttggtgcccgctatttactgtatttgtttacagtaccccatcgccattcctcaaacagtaccaattgtgaaaaagttgatcataatggtggaggagacattctccaaatg

SEQ ID NO: 100319 - DNA, 138 bp, Heterodera glycines
  Promoter: Source sequence=SeqID_113; Location=690..827; Strand=+; Gene=SeqID_71401
attcatccaattattgggctgtattgccatacaaaaaaaaatatttacattcattattacgatgaaaaaaacatgattatgttccatatatgtcctatgctattttttttatatttttaaaattaaaatttctagatg

SEQ ID NO: 100320 - DNA, 95 bp, Heterodera glycines
  Promoter: Source sequence=SeqID_34265; Location=1..95; Strand=+; Gene= SeqID_64097
tcattgattcccctccaaaaatcttttattacggatttgccattttgttaaaatttaattattattattttgataatacattgttatttgagatg

SEQ ID NO: 100321 - DNA, 107 bp, Heterodera glycines
  Promoter: Source sequence=SeqID_12092; Location=1..107; Strand=+; Gene=SeqID_75648
caaattttttgtttaaagcgatcgtggacaattccagggatggcacagtgatcgtttccttcggcacttttgccgatattaactcaatgaaaaggggaatgaaaatg

SEQ ID NO: 100322 - DNA, 361 bp, Heterodera glycines
  Promoter: Source sequence=SeqID_4873; Location=53..413; Strand=+; Gene=SeqID_56038
atttatcaaaaattttttaattacctagcctggttcggaaaaaattctagaaaaattcgaaaaaaaaatttattaaaaaattcaaggaaaaaaaaattatgttttttcgattttttcttagaaatcaacaattttagtttttattaacacttagattttcagaaaagctaaaataatttttaattttcttaaaattttgaaaaatttttaattttttttgctgcgacgtttcggcggcgacgttttggggtgtacccgtgtatgataagaaatggcccccatttcagctccctctcctcctttttaggactacgacctgtgcgaccagtgccgtgccaaaacagaccatccgcacgaaatg

SEQ ID NO: 100323 - DNA, 133 bp, Heterodera glycines
  Promoter: Source sequence=SeqID_5564; Location=3134..3266; Strand=-; Gene=SeqID_58476
ggtaaattgtgaaatcacagagaaagggggggggggggagaacaaaccccatccccttttatttcttttaaatctaaattttattcaaaaaattttagaaggaatttacagttggatagccataaattatatg

SEQ ID NO: 100324 - DNA, 201 bp, Heterodera glycines
  Promoter: Source sequence=SeqID_37409; Location=684..884; Strand=-; Gene=SeqID_66489
cccctaatgattaggcttttcataataagaaaatgagcttatgaatgagaattttttatggaaaaatattgacattatgccaataaataaagatgaaatattttattcgtttcacacacatattttagttgtagtccttaattttgaacttttttagagtaatggatccggaaatttctgataattttccggctgaaaatg

SEQ ID NO: 100325 - DNA, 151 bp, Heterodera glycines
  Promoter: Source sequence=SeqID_15208; Location=552..702; Strand=+; Gene=SeqID_47277
ggtatttgttactgaacaatttaaaaatgccctcaaactttaagcatcacgatgatcctctgggaccattaccggagggatgggaacggcgtgaagacccaaacaccgggcgtcattactttgtcaaccatcagaataaaactacgcaatg

SEQ ID NO: 100326 - DNA, 71 bp, Heterodera glycines
  Promoter: Source sequence=SeqID_1093; Location=1670..1740; Strand=-; Gene=SeqID_67694
ggtcggaaaagccgtttctaacactttaaatcaaccgaaaaacaaaacagagaaacggagagcaaacaatg

SEQ ID NO: 100327 - DNA, 269 bp, Heterodera glycines
  Promoter: Source sequence=SeqID_21515; Location=1..269; Strand=+; Gene=SeqID_52125
gcttacattaaatttttggaatcaggtgaatttccggcaggttttgatgagaatgaaaaagagcaaatgaccattttcgcaattaatttatgtttaaattctggtatactgtactttaaacctcatggacataaaccccgaatttacataccaatttctctcagattattagtattcgaatcttttcataattctccactgggaggcggacatatgagcactaacaaaactgttaaaaagtgccggacacggtactttggccaaaaatg

SEQ ID NO: 100328 - DNA, 65 bp, Heterodera glycines
  Promoter: Source sequence=SeqID_19767; Location=1..65; Strand=+; Gene= SeqID_84503
tgcaggtcgaaaacaagaagcaacccaaggaggcgatcaaggagccccgttaagagtcggaaatg

SEQ ID NO: 100329 - DNA, 404 bp, Heterodera glycines
  Promoter: Source sequence=SeqID_12674; Location=385..788; Strand=-; Gene=SeqID_76354
aaaaaaatatcgctagattttcaaaattttatgctaaaattttcatattaaaagattagtatgacttttagaaaatttcgggttgaaaatgattaaaaaaaaaagttttacgatgaattttggcacattaggaacatcaacaacagcagcaacaacaacaacatgacggttatggaaattgtgaggacggtgttacgacatcacaacatttgtacacagcgtcaggtaaacagaggcgcttaagattttttgcggttttccatttttaaaattttaaaaaccaaaaattaggcgtgcaattgtcgtccgccggctgttcaccactgtccacgccgacgtcgctcatccaccaacagcagcatcacttttccgcccaaccgcagcaactgcagcagttgaccatg

SEQ ID NO: 100330 - DNA, 605 bp, Heterodera glycines
  Promoter: Source sequence=SeqID_27847; Location=221..825; Strand=-; Gene=SeqID_58522
aatatacataaattaaggacactgagtaccaaaaattggcggaggaaaaattccatttgaatttcccgggttgggacgcactgttcgccaagagccgctttttcttcatcaattcgctgcccgaaattgattttgctcagtccaaaattttgaagagcgatcaacgggtcaaattcattggcggcttaaattttggccatccgtcggaaattgacgaaaaagcaatggaaaatgtaaaataaaaaaaataatttaaataaaaataatggattaaaagtcatgagatccatgcttaatgagattcattctgttcttgactcaataattcttcaattttcgaacactttccgtctcgagactaattagtgtctttgaaaattggcttcgattacatttgcttgtgccttttaatcgcctgtcagcttctttcattcagcagtgagattaaattctaatccaacaaaaacctaatccgacagacaaattcactgatcagtcggagtttgggcacaaaagagggcgttgttttggtcagttttggcacaaacgatgcttttaccgggcccagcaatgcgcaattcgtcgaagcattggccggcacaatg

SEQ ID NO: 100331 - DNA, 217 bp, Heterodera glycines
  Promoter: Source sequence=SeqID_7848; Location=1..217; Strand=+; Gene= SeqID_66153
cccgtagctgaactgactatagtttctaaaaataccgtaataggacggactaaaccgggacattattcttctttcattactgtaattgcactaaacaaaggtttaagtaataaaatgataattctttgctccattaattaaatagtcataaccaatttcaagtagccaaatcaataacatactgtactattttacagtcctcaattttctgtcgatg

SEQ ID NO: 100332 - DNA, 247 bp, Heterodera glycines
  Promoter: Source sequence=SeqID_11825; Location=1002..1248; Strand=-; Gene=SeqID_75326
ggttggttgatgatcattttagaaatctaggcgaaaatgaccaatgcattcaaatatgtttaaaaattcagcttaaaagtttgcttaacattgaaaattgacaaatctgtttttacaccaaatcggaaattgggtctccattcccaaaagagaataaaacttttaaaccaatgatagtccgtcctttcattgtgttattaccccctctgcctgtccgtgaatttgctaatcatgaaaacctcagatg

SEQ ID NO: 100333 - DNA, 111 bp, Heterodera glycines
  Promoter: Source sequence=SeqID_25712; Location=1664..1774; Strand=-; Gene=SeqID_56453
tgcgggattctcctccgcttccgttcagcgacaattcctgtgttggccgacgttcagggcgcctttcatgccatcgaagtcgaacccgaggacaggcgcttttgcaaaatg

SEQ ID NO: 100334 - DNA, 1003 bp, Heterodera glycines
  Promoter: Source sequence=SeqID_15467; Location=51..1053; Strand=+; Gene=SeqID_79738
gaccgggactttttgggttgaaaaaccgggaaaaaagccgggaatttcccggtcaaaactggtcaaaaccgggaccttggtactcagttgttctcagttgcccgtgttcaggtcccggtcccgctgcactctactttcatcatatttctccaatttgctttagtggacctcgccggttgtgcggggatgcgcctgccggcaacggataagcagggtcacacaatcatttgcgccggggctggctacccatcgcctaccgcggcatgtccgtccggctatcggtgcacaatgttggcgcacatggggtacggtagtggaatttcaatacgataacgaggagaaaattgaattttgcataagttagtcaagttccaattttgggttgattttaagaattgaatgtttttaaggaaaaaattccacacgtttcgataggcaatagagaaaattttggaattttagagaaatttattttgaaaattttttttgtaccttgccaattcgacagtcttttgaacattttgttcatttttagagtttgctgtcattcagcgacgcaaggtttgttatttccatgtttattctttccacttttctgaatgaaaatacgcaagtcaaatcagggataggcgccgcctggaaaatacgaaatacccaaattaaggtgtagctttaacaaaacaaattaaaaataattaaatctgattattaattgctaaataaatcgaaatacgggtagccctttaaataaaaaatagaaaatttttttataaaaataatcttacaagaaatcgtctcgaaaaataatccaaaagtcaaattacggatcaaaattgcggaaaaatcccaaaaatccgtaatccgcaactccaaaaaccccgcaatttccgtaatccgcaatggcgcccagccctgctaggatcagtacttaatgcatcaattcttgtcttttttctgattagaatgcatcatcaatttatataattaaatttattaaaaaatg

SEQ ID NO: 100335 - DNA, 125 bp, Heterodera glycines
  Promoter: Source sequence=SeqID_15505; Location=2223..2347; Strand=-; Gene=SeqID_79785
aattaatttaaagcacctcataaaatcactcgaaagataagaaacagaaaagttgatctcggcatttgttgtacgcaattagacagcaaagcggtctggaactcattgaatgtccctgaagaatg

SEQ ID NO: 100336 - DNA, 692 bp, Heterodera glycines
  Promoter: Source sequence=SeqID_14121; Location=1026..1717; Strand=-; Gene=SeqID_78111
aattccggatgaggacatcgaagacccgctcgatgtgatcaatggcacttttggcctcccaattccattaagggaccaaaatttggcagaagtcccgccatccaatcaatcaccgccagtccgccgttatccgattcgaaatcgccggcctgttaaccgccttcaaatcgaccccagccgatcgtcctatgtgtgactgatcatggcactgatcagttggacttaaaaggggaggtgttagagaggcaaataattcaaatatttgcaattccctctcttgggctctttgaccccatattgattttccccatttattcctgcccttcccttcgtccagcacacattcattctgttatatttccttcttatttggtgctccccaatttgcttcgtccctccgacaaatattttttgtattatttttccatttgtgttaaataaatattttggtgttcgacattcacaaataattgtttgagcaattaaccggctcaacattggcgacgcccgttcttcaggacttcacttcgaacattttctcgtgttgaaattgttcgaattgtggaaattcaaaaatctcgtgttgatttttggatttcgcagaaatcttcaaaaaaccaatcactaatcttgtgtgcggttctgctatgtgcagtttcttcgtctaaagtccatcctccaaatcaacaatg

SEQ ID NO: 100337 - DNA, 194 bp, Heterodera glycines
  Promoter: Source sequence=SeqID_23987; Location=1..194; Strand=+; Gene=SeqID_54690
ctcaccaacatagtttgacataaatccattacctttcccactttgcaacttaattggcttacccatccttaatcggtctcattttgtttttcgctaatgatcaatgatcattttatcactgtctgaccaatcacttaactgatcactcacattttgacattttgttgcatccttcaatttccatttgccaaatg

SEQ ID NO: 100338 - DNA, 1003 bp, Heterodera glycines
  Promoter: Source sequence=SeqID_34580; Location=49..1051; Strand=+; Gene=SeqID_64332
atcgaacctagcgcactaaaatcgatataatctctccaaattttgcaggccttctccattgtaaaggactaacttaacctgaaaaaatgccaacgcttgttgtttttaaaatttttcgaaattctgactttttcattaattatttattattttgcaaaattaattcataaatattttttagaacgtgctctgaaacgcaccaaatgttaattaaaagttaaataaggctctctgatgctttcactatcaaaaagggagatgaataaaaaatctaaaaatttttaattgctttttaaatttgcgaaaaattttaggcttaactttttttttataaactgatcagaagcgaaccagattttgcgagggcatcaaaaagacaaggaaaagcactgctatgatgctaactccagtaattctgaatttaaaattttttattaatttttaaagcttcactattttatttttttagcaaaattaattcataaatattttttcacaaactgctctgaaacgcaccaaattttatttacaagttattttaggcactcagatgctttcactatcaaaaagggagatgaataaaaatctaaaaatttttaataattgtttgagtaccccaaacggacacttgaaaaaatcgatttttttgttttcggggcagtccccccgaaccgatgcgcccagatttatggggagaccgaatcctttcggaatagcttccctatagcctgtactttaattctgcgttggatttttgctccccataatgttgagtaccccaaacggacacttgaaaaatcgatttttttggtttcggggcagtccccccgaacgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatg

SEQ ID NO: 100339 - DNA, 111 bp, Heterodera glycines
  Promoter: Source sequence=SeqID_3126; Location=2160..2270; Strand=-; Gene=SeqID_83305
ctgaagttgacccaaggaaatcggcaaggactcgagaaaccgggcaatttggtccccggaacgtcatgtaccacgaaaacggaggcgcaattcaaccaaagaactgggatg

SEQ ID NO: 100340 - DNA, 169 bp, Heterodera glycines
  misc_feature (31)..(31): n is a, c, g, or t
  misc_feature (120)..(120): n is a, c, g, or t
  Promoter: Source sequence=SeqID_5742; Location=1818..1986; Strand=-; Gene=SeqID_59088
tgaattattataaaaatgttgtcaaattaantgaaataatagattaaatagtggttaatattgattgattgaagaaaaattaagccatgctataaaattaataattacaaaattcattgncgaaaaatatttttataaaaataattcattatatttttacaaaaaaatg

SEQ ID NO: 100341 - DNA, 981 bp, Heterodera glycines
  Promoter: Source sequence=SeqID_20605; Location=836..1816; Strand=-; Gene=SeqID_51156
tggttttgaattttgcaatgaaaaatttggacgttagcaaatcttttaaggggaaggcccaactcaaaatcttgcgcgcagccttaaaacagaaaaaatgaaaaaaccaaacgggatttttaacgctttctaaaaatgctaaaactttctctttcgaatggcatttgcaaattatcactcaatttaattgaaacttttttaaatcagcaaacaaaaaaaaaaattctcttttattacagaacttaaacaaccagtagaatatgagaaaaggcacaaaacattttaaaagaaaaagcaaaagactattttattaaatatttattataaacttgccgttatttatgagaatcattaaaatgacgaacaaaaaataatttagcgccataaaaatgtgaaagaaattaaagaaaaacgaaaaaattcataaaaatgagaagctgggcggctttggaaatgcttataaataaaagaagaaatcaatttccagtaatcaatgtgcaattatttgcattgattatttcatcgtaagaaattcagaaaatcattttatgaagaaaaacaaataaattaatattaatgaaattatattgtttttacgaaaaattccaaaaaaatagcaataacaatttagtggagaaagctaaaccaaaaataattttttcaaatattcccaatttattaattgcctgccccactttaaagtcacaagggcaataaaaatgttgcggaattttttaatttaaattcattaatcacaaattaattgcgttccaccccatggacaattcgtccatctgacgaagcgaaggcggacagcgcaaatggtcgacggactcatcaaatcttgtgatgggcaaccttgtagataaactttggtttctgagctccaagaaaaacgaagcgctgttatttaaacagttaacaagtgaacaaaaacacattggcaattccttcgctcggtcgaatcattcgctgagaatg

SEQ ID NO: 100342 - DNA, 74 bp, Heterodera glycines
  Promoter: Source sequence=SeqID_2460; Location=1..74; Strand=+; Gene =SeqID_79828
cccccatttttgtggcggtatttttttacattttaaataatatttattttttaatatttaaaagcattgaaatg

SEQ ID NO: 100343 - DNA, 83 bp, Heterodera glycines
  Promoter: Source sequence=SeqID_31608; Location=1..83; Strand=+; Gene= SeqID_61928
aatgttcagcgcgggacttggtttgtgcagtgcatctgcagagtgtttttaaaagggcgcgtgaggatgacttgctcacgatg

SEQ ID NO: 100344 - DNA, 164 bp, Heterodera glycines
  Promoter: Source sequence=SeqID_25816; Location=23..186; Strand=+; Gene=SeqID_56580
tttcaccattaacgtggaaaaaatgaataaactaattagtttgtttagttgttatattacccgctttatatcgtcatggaccaatataaaagcggtggaaatattcacaaaaaagcactttcgatttattcgactattcaattaaacaatttcaattgaaaatg

SEQ ID NO: 100345 - DNA, 668 bp, Heterodera glycines
  Promoter: Source sequence=SeqID_15690; Location=1..668; Strand=+; Gene=SeqID_80000
ataaaaatattttcttatagaaaaaaaatctcctctattcatccatataaattttattgttaaattttaagggaatcatttaggaaaaaacatgctaaaaagttgacgaaaaagggaaaggcgcgttcatttcacaaaattataagtagggctaaatatatttttttgtacatatttcgctattcttgaggattttttaatgaaattttatgggtacatttttgaatataggcaatttttcgtaacaaagtgcactcaaattttcaaattttttttcaaaaaattttcacttgggaaaattcccggttggtcccagtcccggacgaaaatcgaggtcccggtcccgacttttctgatcccggtaagtcccggtcccggtttttgtcaaaattcccggtcccgtgcaactctaataattaccttttttgctaccttgctatagcctaatatgcacgaaaacgagtttttaacttggcttgaagcttttatcttgaactttttggtgcattttttgcctattttttttgaaaaaacggtaaatttttttaaaattttgcaacttttcctaccatattttattacaatttccaaaaaattttccggcggcgcttatcggcaccgccggaccttcattttaccttaatttttgaaattttaaccacaaaatg

SEQ ID NO: 100346 - DNA, 352 bp, Heterodera glycines
  Promoter: Source sequence=SeqID_28986; Location=479..830; Strand=+; Gene=SeqID_59555
ttaggccgccaattagcggacgtaatgaatgatgatgcgatttgctgttgatgatgggtgaaggtcgagaagattctttgaaattactctctccgtgttgaacttggtccctataaaaagtgaacagggttcccccaaggggatataatcaaattacattggaatgctgaattaatttttaatgctcaagaatgcacattttgccgaatttggcagaaaaaatgcaaagacataaaaatatttattttttaaattaaatttttatttgaatttaaatagaggaccttttatataaacaattttaataaaaatattttacaattttatagcgtgaatttgtctactcaaaatg

SEQ ID NO: 100347 - DNA, 208 bp, Heterodera glycines
  Promoter: Source sequence=SeqID_39515; Location=1192..1399; Strand=-; Gene=SeqID_68068
cttcgtccattttcctttcctttgcgtcttattctttgttaattttggcattgtgccgagcccaaaatgaatcagctgcccaaggcgatgcgcagcccccgccattcttaacagaggccagccaagagaaaatcaacgaattctaccaatacgtcacgagcctggggcatttaaaagaaacggaaatagcggaaaaagtgaaggaatg

SEQ ID NO: 100348 - DNA, 245 bp, Heterodera glycines
  Promoter: Source sequence=SeqID_4976; Location=818..1062; Strand=+; Gene=SeqID_56424
gattgagttcaagggaattgtcaaacagtttggatacgtcctaagcgttgagactatctacttcgacaaagaaaagggaattgatgaattctataacttcctccgtaacaatgtcatgtgtttcttcagtgttgattcataaagtgaattgaaatgttcaattatttagcgtgctgtttactgtacaaatatttcatattttaattttcctcaatcttattttacgatttttattgaaaaaaatg

SEQ ID NO: 100349 - DNA, 399 bp, Heterodera glycines
  Promoter: Source sequence=SeqID_20147; Location=998..1396; Strand=+; Gene=SeqID_84932
tcagcagccgactcgtcgtcttgcccaaccagtggcaagacactcggccatcagcagccgactcatttagcctaacccatcaaagggaaggctcattcggccatcgccgccgactcattcgcctgacccatcaaagggaaggcttattcggccatcagcagcctactcatttagccgaacccatcaaagggtaggcacattcggccaccagtcgccgacttctttgtcttgcccaaccagtggcaagacacattcggccatcgccgccgacccaagtctcacccaacaaggggagacacaaccggccaccagcagccgaatcttcgagtcttcaccaacaagggttaaaggactccggccatcagcagccgaacctcccaaagcaggagaatcaacatg

SEQ ID NO: 100350 - DNA, 455 bp, Heterodera glycines
  Promoter: Source sequence=SeqID_12865; Location=194..648; Strand=+; Gene=SeqID_76594
tcggtgttggccgcgaactcacgatctctggccccctcgttctacgaatctatgctggtgcccttcttcttgccctattctctgttgcccttgtcgatggccaatcatctattgccggtctctgccctgctcattcttttgccctttgctcttcacggctgcacaaattttcttgccttggtccgtcgctttttggtccttccgcgtttgattttgtgcaaatcacgaacaaatttgcttcgttggcttactcaccgcttcctggcagcgaacacttcgctgaaagctatgccgaagcagctgactcacccatctctccgctgtgttctgccattctgccatttttgctctctggcctagttcgtatttggccgctatttaagccatggatcgcaagaacgggccaccattcatttccctccgactacctaattctcaacaccttctgtgccatg

SEQ ID NO: 100351 - DNA, 232 bp, Heterodera glycines
  Promoter: Source sequence=SeqID_21790; Location=1..232; Strand=+; Gene=SeqID_52402
gaagttgacggaagaggaggaagaatgttctgctgctgctgttgaccactcgtcgaaaggtgaagccccaaaagcttatgcgacatttgaagagcacactgtgggttctgctgcacgatgccggccaaaaacatgtcgtcgtcgagccgtgagagcacaaaacgctgttgctcttcaatgaacatggagttattgaaatctgctggtactgttgctgctgcggctggagatg

SEQ ID NO: 100352 - DNA, 486 bp, Heterodera glycines
  misc_feature (39)..(39): n is a, c, g, or t
  Promoter: Source sequence=SeqID_25997; Location=1..486; Strand=+; Gene=SeqID_56749
aaaaaatggggaacaatttgattttaaaaaaatgaacantgggcgcaaatgtccgaggcgcaaaatgtctggacacgtttggaatgcattaaattaaaaaaaaaattttttccaatttcttttttctcacaaatttttatcaaaaataacaaatatgtgcaaaattccaaataatgtgtgaattgtttcaaattgagaattttgattaaattttttagcagattttcattaaaaatcataattagttgattttcgaaaaaattgataattttcatgtatttatgaaatttttttttggaaaatttggtgaaataatttcgtttttgattgctctattaaaaaaccaaattaaaagattgtcaaacattatgccaatatatcaaaataatcaaaattttaacagatctggcgattttctcctcaaaatttctcaaaaatacacaaaaaagctcaattcactcaaataaatcaaaatttagaaatatg

SEQ ID NO: 100353 - DNA, 699 bp, Heterodera glycines
  Promoter: Source sequence=SeqID_296; Location=1610..2308; Strand=-; Gene=SeqID_81646
agcttatcacccataaaattgctttatgttgaaagaatcattttatatctgaactaatcagtatctatctgattagatcctgtacactgattaaccagagttaagagccgaagaatttgtgtttaggttttgcaaattgaagggtccgactatgccgaaggggttataaacattaaaatttttgaaattttctaggctctttgaaaattttatgataaattactaagtttttcataaattttaacaaaaaaaaattgctaatttttttttattagtcttctttataaaaatattttactgtttatttaaaaaaatatattttaaaaatttttaaagaattttcgaagggcggaagttctgctgagaaattttttgaaaaaccgctcatatcccaatgacttccagcaaaccttttttggcatcaaatttttcaacgagtcaaccaccgccggcatcggcccgtccgatcagcgccagttcaatttgaccgccgctttgctcaacgcggcacagtccagcgacgccgaaaacggcaccaccggaagcggtggcggtggcatccttgacgaagtgatgctggacgaaggggcagctaatggacgtgccgaggacggcggcaatttgacgtccggcgcgacaaatttggcactcgtagcgggggacgaccaacaaaattggcaacagcacgtgaccaacatg

SEQ ID NO: 100354 - DNA, 420 bp, Heterodera glycines
  Promoter: Source sequence=SeqID_4122; Location=1866..2285; Strand=-; Gene=SeqID_45722
ctgtgagagtaaaatatggaaatttcaaatataatataggtatttatttaccatggtattgacatcctctcttacaaattagtttttagcgtattacccttaaaattagagttttagcgttttcctatcttaatttaaaaaataaaattaaaaaaaagtatttatttctttctaaaactatcgagtgatattctgtataaggttttgtttgggatgcgttgggtgatcaaaaaaaaacgaccagtttttttgaatctgactagttttttgaattaacgcgcataaaattacgcaacttggcgttatggatcattttgtctaacaaaggcggaggcgttgacccagccattgtgccgttgctgactttttcagtctttttctaattagaattgcttggtcatcttccaattagttttaatg

SEQ ID NO: 100355 - DNA, 55 bp, Heterodera glycines
  Promoter: Source sequence=SeqID_2644; Location=494..548; Strand=+; Gene=SeqID_80876
ttttaaaggttgtgaatttttggatgattaaagtcgatatttgaattctaaaatg

SEQ ID NO: 100356 - DNA, 60 bp, Heterodera glycines
  Promoter: Source sequence=SeqID_10012; Location=1143..1202; Strand=-; Gene=SeqID_73062
agtgagtgaattttggaataatgaaagaaccttcattgcattactattgataatcagatg

SEQ ID NO: 100357 - DNA, 287 bp, Heterodera glycines
  Promoter: Source sequence=SeqID_29706; Location=991..1277; Strand=-; Gene=SeqID_60177
ccccgattgcgccaaaaaaactttttgcacccgctccaactttaaaaaatgtgtgtccccccccccggctaattgacgtcctcgcctatataaaaggcatgccttcgtatgggtaaccactgagtttcttgcctgatcgcccaaaaagcaatttgaatctcctgcctgatcgcccaaaacaaatttgaatctcctgcctgatcgcccaaaagcaatttgaatctcctgcctgatcgcccaaaacaatttgaatctcctgcctgatcaatctccccccccccccgatg

SEQ ID NO: 100358 - DNA, 670 bp, Heterodera glycines
  Promoter: Source sequence=SeqID_39658; Location=238..907; Strand=-; Gene=SeqID_68168
tctttaaacttttgacaggaacagttaaaattggcaagaaaattgaaggcgaattaagctatagagaggtcaaagagaatgatgaaactgtggtaatgttttttaggctttaaaaaaccccataaaaggtagtaaaaatgggaaaataggtgccaaaaagttttaaatttagggatgtaatcgtaaaattttactcaaaaagcaacagaatttggaacaaaatcagtattgagattcacgttgcaaacaagtaacattttgagttgttcgggagaaagacgagagcgattgtcagtcaaaattcatatttttgggtgtatttttctggaatttttgtgtcaattcttaggggagcatttttcgtttttattgcatttttgttaacaaattttgggcaaaacgccaaaataattgtaaattattttttaaaattattttttagatttttagattctaaaaataaaagactagaaaatagttgctaataattcgaaaactagcttaacaacaaccgaaaaaacatgtttttcatccatttcagtccataggtagtccagaaaaaaataagtaaaacctaaaaattgtagcactaataaccatatatatattttatattaaatataaacttataaatattttaaaatatattttttaaattatcatttagatg

SEQ ID NO: 100359 - DNA, 384 bp, Heterodera glycines
  Promoter: Source sequence=SeqID_1977; Location=3604..3987; Strand=-; Gene=SeqID_77141
tgcggtcagggtcgttttcgtaccgccgttttcgtaccgccgttttcgtaccgcaattttcgtaccggggacattttcgtacgagttcttgtacaagcgtcagattcgattagaaaaacttaagaactaatagaaccaaaatttatcattttttgtttcccattcataaaattttgtagaaaattcataactttaacaaaaataacaaaatccgggacaataaggtcgcatctcatagtttcgggaaatacacacgaagaaaattgttaaggttttcgggactgacattggcattggcataattatgatcattttgagggacaatattgttaagtccatctttactgaatttgtggaacacatagagtagagtgcaccatcatg

SEQ ID NO: 100360 - DNA, 1003 bp, Heterodera glycines
  Promoter: Source sequence=SeqID_21632; Location=546..1548; Strand=+; Gene=SeqID_52235
gcgctaaggcagagacatccgggaataataaataattgtcgtcctgagacaccttacttttctatgtctcaaaatcataaaacatttttggcattttttgtcgaaatttaagtagatttttattggccataattttcaatagagagcatgtacgggccgggcccgtatacggatttttacgggcccgtaacccgtatttttttcggctgatacgggttaagggttttacgggtttttagcccgtaacccgtatcggtgtcaaacccgtaacccttacccttatccgtacaattacgatacgggttattttattgggttgtttaataaatgaatagaaagaggaagagaaagggaagagtttttaagtggtcatattaaaagttagagtttaatgaaaaaattaattgaattccatgccaaaaaatccattgccatcttataaaggtttttggcgcgtagcgccctctagagacagtgtttaatagcgaagctatttcaattttaaaaaataaatttaaatcagttactttcagtgcccgtagggcactggttacaaatattaatttattatctcgttctggtcaaaactattgttaaatgttcgtaataaaatttagaacaaatctatattggtattttagtaaaaaaaaacttgttttttctttataaaaaatattttcaaaaaacccttacccgtatacgggcccgtatttttcctggatacgggtttttacggactacgggttttacgggtttttagcccgtaacccgtattggtgtcaagcccgtaacccttacccttatccgtattttctcaaaatcacgctctctaattttcaaccaaaaaatcatttttggcaaaaaatcgggactaaaaaataattcacatttaaccataaattttcgtatcttacaaattaacggaataattaacaatggaattggtccaacaaatattatgagggaatatgtaaaaaaagacaccgtttagcaagcggaaatg

SEQ ID NO: 100361 - DNA, 1003 bp, Heterodera glycines
  Promoter: Source sequence=SeqID_3197; Location=1467..2469; Strand=+; Gene=SeqID_83640
aaataaaaactttgtgttcattttttaatcatcgtcatttaatttgttgttttaaaaaattaaaatatttaaataacgattaaataaaaaattaataattgatataattatttattttttaatttacttacatttcgtctacctccacaattttttctttctttttttttttggttgggtcacttccagagcaggaatcataaattatttgcttaaggacctccccgaatttatttaatccaatgaaaatcaaacaccggtgaattttgtttgggagaacaagatttttgacgacaaatgcatatttatataccttatttgctaatttatcgcgaaacaagctgagcgacaaaatgttgctaattaatatttcttcaaaaaccttttttatttatttttgttatattgctgccatgtgtaaggtaattttttaaatgatggtttaataaatttgaaaatcggaataaatagaaaataataattcccgaatgttgcttgactccggcgggccttcccggacaaaagtttaataatacaaaaaataaattaattaaattagaaaataaaaaatttcaaattaatgtttttggaaagtcatttttgaaaattaattaattatcgaataaatattgtttattcaccgggttttggaaattaaataatagaaaaaaaataaattctaaaataaaaattgctaattattcatacgttaaaaagtaaaatttttttagcggtttgcaacttcatcaattttatgcgacaggtctttctataactttttaattaaaaaaaatttttaattaatatttaaaacagaaatttgggaatgacatgctgctgtcatgcaacgtcaaccaaatttcaagagcaaaattcgcatgtcgacgaatttaattcagtccatcagtaaaatttacaaaattccaaaaataataattaaataaatttgttcagtcggtttcaatcaaaattcaatcggtcgccatttatggaatcaaaaatg

SEQ ID NO: 100362 - DNA, 63 bp, Heterodera glycines
  Promoter: Source sequence=SeqID_36686; Location=424..486; Strand=-; Gene=SeqID_65945
ttcttatggaaggttatttgtatattgcaatactaagtccatagaacattattttagaatatg

SEQ ID NO: 100363 - DNA, 77 bp, Heterodera glycines
  Promoter: Source sequence=SeqID_11920; Location=668..744; Strand=+; Gene=SeqID_75431
cctaaaaatgggtaaaatgccaaaataacaaattgaagcattattacgttttcagtggtgccgcggtcgttcagatg

SEQ ID NO: 100364 - DNA, 70 bp, Heterodera glycines
  Promoter: Source sequence=SeqID_31855; Location=795..864; Strand=-; Gene=SeqID_62168
tggtcttttttttgagatttgacgctgtattttgaactttcagaatgtaaaaaatctcaacgagaaaatg

SEQ ID NO: 100365 - DNA, 254 bp, Heterodera glycines
  Promoter: Source sequence=SeqID_6786; Location=1130..1383; Strand=+; Gene=SeqID_62905
tcgggacctgaaaatttaatacgcttacaattttggtattactcacccgggcaacaaaaaatgtttcggtactcttttgattgttccttttcatcccaaaacttcccccatcaaaaattaaaacaattccaatccccccacagcaaaagcactccgtcggactgatttggtggctgttggctcgtgaagttttgctgttgcgcggcaaaatcagtcgccagacgggctttgtggtggacgacaagctgatcatg

SEQ ID NO: 100366 - DNA, 124 bp, Heterodera glycines
  misc_feature (69)..(69): n is a, c, g, or t
  misc_feature (99)..(101): n is a, c, g, or t
  Promoter: Source sequence=SeqID_6861; Location=1..124; Strand=+; Gene= SeqID_46318
aagcatcaccagttggcataaaaatgtatgctgacgatgttaaatatatatgcccatgaaaacgatgancatcaaatcagttgataaagcgatgagctnnnggaaaaatggtcaaaaataaatg

SEQ ID NO: 100367 - DNA, 141 bp, Heterodera glycines
  Promoter: Source sequence=SeqID_9707; Location=275..415; Strand=+; Gene=SeqID_72435
ttggcttcggatgttttatctctttgctgcgtcggaaattggcctcgctgccgatcactcccgccggatttgtggcgaaccgtcgctgcacaccgtcgtattgtccgattcccgtgctgcaattttggctgctccgatatg

SEQ ID NO: 100368 - DNA, 333 bp, Heterodera glycines
  misc_feature (59)..(59): n is a, c, g, or t
  misc_feature (69)..(69): n is a, c, g, or t
  misc_feature (102)..(102): n is a, c, g, or t
  Promoter: Source sequence=SeqID_13074; Location=1..333; Strand=+; Gene=SeqID_76861
aaaattctgaaaaaattcatgctaacgtaacttttgatgctgatcaaaaaagtctctgntaccaactgnatcagatcactccttcatggtgatctaaaaacncaaaaatggctgaaaatcgggaaaattttcgaaaaaaatccctagggggttgggaaaaattttctggaaatttttagtatgcccattggaaagagcaccaaatttactaccgatttgcgctttgaatggtggatctatgacttttatccgctgagatatgggcactttcatttcgctgtcttcaaaaactactgtatttcttaagaaaatagtgcattttacagaaaaatg

SEQ ID NO: 100369 - DNA, 576 bp, Heterodera glycines
  Promoter: Source sequence=SeqID_33714; Location=1..576; Strand=+; Gene=SeqID_63686
tttggattgggcgccgtccgcccgccccattgggccaatgctcccaaccctccctcgggcgttggcatcgccgggggggatggcccttcccccgagggccaaccggcgcagtgttacgggcggccctcgcccaactctctgctgccacggcgcactttcgacggtcgccggccttcgccctcctcttcctcacgtctcgttgtggtgcccacacatcgaccaaattgtaccaccgatgcggcaaagcctctcccgcagccattacattcgctcctttcaattggcccaaaaagagtttggcattggcactccgtcgccggaggcaaaacgaaaattagccgacaaaagcctttttttgattgctaacagagaaaactgatttgggaagtgttgtctctttgggtcttcacttctcatccgttcagtctcttttctcacgtcgattcacttcccccccattcccgacgatcttttcaatttaatgtccatttgaccaccgtcgcccttttttccacaataaaaaattccttttcatttatcgcttctttttttaaaggatttattttcaggaaaatg

SEQ ID NO: 100370 - DNA, 1003 bp, Heterodera glycines
  Promoter: Source sequence=SeqID_1706; Location=407..1409; Strand=-; Gene=SeqID_75420
tttagcttttcacatttgtccattcgttggtcaatgaatgaatgagtcattaataatgactcattcattatccattctttcgttcgtcgccgtttattcgccaaataatcggaaaatgtttcagtgccgacaatacatcccccaaatttggagaaagcattatcaaaagaattcatcctttgcttcagcagaattcattcattcgttctgtcatcgcttcccatttttatttttatatttcttaaattattttattttttaaatttgttttttatttttagcttttttctcccatgccaatcgcacttttccacgtgctaacatttgctgctggtgttgcgatcggtgccttttttgtggctgtttttgggaagttaatcattcggaagcggcggagagaaaatgcgaaaaatgcacaaattaaagcataatttgattttaaatatttaaaataattatatttttacatttcattattaatatctaattccctttgtgttgtgtaaatttttatttccaaattcttactaataaaacatttcccaatttctctccgcgggagtctcgaaagtgtcgcggcgggcgacgatgactcacccgcccctctctcccgcccattttcccttttcttttctcccctttgtccattgtttatcaaatgcgctctgtttgtccgatcatattttggagcgcaaccccaaataaaatgaaataaatggagaatgaatgaatgaatgatcacgggatcaacgaacttcgcggcccatttcacagactgacgaagaagggaaggaccatcgatttcgtcgtttaagttctcgaagatgtgtaattcgtaataaaaatatttccacaaactgtacttactttgatttacttctgttttatctcaatttttctttcgtttttttaatttgattttattcaaatgtttattattttaggttttaaataattccgctaatatttgttaattcatttttggcctttctctgctcaaatg

SEQ ID NO: 100371 - DNA, 378 bp, Heterodera glycines
  Promoter: Source sequence=SeqID_41560; Location=715..1092; Strand=-; Gene=SeqID_69645
aattcagagagttgacaaataaatttaaaattttctgaaaaaattccgaaattttaaatattgtttaagaaatacgaaaatatttggctttacccgaccaatatattgcagttgctccgaattgaattctttccaattttgagcagctggacttaaaaattgggcccacaaatgttggccatttgcctcaatttgaataattcgaaatgggaaaattctaaaatatgaaaaaaaatatctaaagtaaattcataattttttttttaaattgattaagtttttatctaagtcttactaccagcagtttttaatagagagcccggacaggagtatgtataagatttcttcgggtctggtcatgaatattttgtaaaaatg

SEQ ID NO: 100372 - DNA, 499 bp, Heterodera glycines
  Promoter: Source sequence=SeqID_18764; Location=1..499; Strand=+; Gene=SeqID_83442
ttctataagccatattctaaaaatttgaattttggtttgtgtccgaattcgggcccggggctcagaattggtttaaatggacgtaggattcgtgatcactagggctcggatttttaaggacgaaaaagtccaaaataaggccgtaaatttcaaaatgttattatcaaaaattataaaatataatcataaacataattctaaattcgagaatgaattaagtcactattagcgaaaagcaccgccgaaatttttggaatttttatattaaaattttgggggaaatattaatttaaagaggagtaacaattattgatctaatgtatatcttaataaaattttaattataatttaattatttttgtatattttttcctatatatatatattaaataacaggaaaagcatcaatttattgaataaaaatcaatttttcaatgtttataaaatggtttatgacatgttaaaatgcatatttaacaaaaattaaaaattttaaatg

SEQ ID NO: 100373 - DNA, 250 bp, Heterodera glycines
  Promoter: Source sequence=SeqID_225; Location=1..250; Strand=+; Gene =SeqID_78601
cactcagacacccgcaccagtctaccaattaccacctcctccacccccgccacaactcccaaaaagaaaacagaaggaacgacaacaagcggatgctcccgcatttttttccgcactttcggcagcatcattaggagttgaattggcccaaactaccgtcaatccttcggctcagcaaactcagtcacaagagtcaaattttgcttcttctatttcggcggctacaactgggctcgattttggtcaaatg

SEQ ID NO: 100374 - DNA, 57 bp, Heterodera glycines
  Promoter: Source sequence=SeqID_31786; Location=1610..1666; Strand=-; Gene=SeqID_62081
ttttttcagattgcattctacggggatgctggctatactgaagcatctgccaaaatg

SEQ ID NO: 100375 - DNA, 1003 bp, Heterodera glycines
  Promoter: Source sequence=SeqID_1005; Location=876..1878; Strand=+; Gene=SeqID_65887
tttcgaatttcacatttttggtttaaaaaaagttttaatattttattgaaccaaggatgactttcacttcgtttccgtgtatttacacagcgtccgggaaatgagctcctgtaccagaaaagatttgcatgtgtggctcagtggtttttgtaagatagtaaagggacaaagggtggtggttcgagtccgttgtgcaacatgaatattttcatttatttttgtcaaaatattaaaaaatcacgatatttgggaattatttttgaaggtttttgccaaccaaattggataatcttggtatctttcgaaagctcttgataatgagaagctttttctaagcaaatgctaagcgatttggtgtaccagagaaaagttatgaggctctaaaattttgtttttcttataacttttgaaatagagcattaacaaaaataaattcagcattaatagatgcagaatttttttctctaacgatatgcaaaatttcctatggatctaacatatagaaaagaagctaaacatagcgaagtaaatgttgtttttcctaataataaaaatattagatagtacgccaaaaggagacaaaaaattagagaaaaaaagataatgttttctctggcactctctatttattggtacacatctcgttttttcggacggtgtgtttagactaagtttgaaccaaaaataaaattcaaagatttgaattttcgactttttgttcgagttcgggtccggggttccgaattggtcgaaatggatgccggattcgtgatcagcaccctgacaaccattggaaccatgttttcatgacttttgaaaacaaaaaaaaattggcgctatatgttatcatggttttttatcacaaaaaaattttgcaaaacaaaagggtcccaccccttttgtttcaaaaaggcccactttccatatagcgccaaaaaatttcttcaaaaaaggggggctaccatcggcagtattaccaaattaactttaagagtattaaatg

SEQ ID NO: 100376 - DNA, 445 bp, Heterodera glycines
  Promoter: Source sequence=SeqID_7632; Location=1166..1610; Strand=+; Gene=SeqID_65477
ttttgagggtggggggcgaagttcggatccgatcggtgtacattatttttatgtgcattttttgattacttttacatgtttaatttcatttaaaattaaataaatattatattattaattttcattttaataaatataaatagttttgattaatccataaaaaataaaattttttaatttaaattaaattatttttttgtgaaaaatgttttaaattaaaataataatttatttacttttattaaagaactcctgtattttttaaattagaatttgtaatattaatttcaatttaaataaatattcaatccctgtacatttcaaactctctttttaattaataaaaggaaatttattttatttttaaaaatttattaattacattcaatttttaatcttactttttaataaacgatttccttaattatttaattttaaaaccatg

SEQ ID NO: 100377 - DNA, 758 bp, Heterodera glycines
  Promoter: Source sequence=SeqID_20437; Location=1329..2086; Strand=+; Gene=SeqID_50975
tttacgaaagtctaggattggcggctggacgcaagagtcgggcttggttggtcgagagcctagagaaggcggctgtcggttggtgggttgagtggagattagccgagagcccgagagggacggctgacgataagagttgagtggtgaaagccgggagcctaaagggtcggcttaagaggacggctgacgactcaattgagggcttgtcggaagcctaaaggggggctggcgacaaagagttgagtgatgaaagccgggagcctgaaagggcggctggcggcttggagaagagtgatgaatggtcgaaagcctgaaatgggcggctgacgactcggtgagggtttgtcggttgtcgggagcctaaaagggcggctggcgacttgagttgagtgatgagtgccggaggcctaagatggtcggcggacagcgaagggttgagttgccgggagcctaaagggtcggctggcggcagagaggagtgatgaatggtcgaaagcctgaaaggggcggctgacgactcggtgagggtttgtcgggagcctaagagggggcggctggcgacttgagttgagtgccggaggcctaagatggtcggcggacggcgaagggttgagttgccgggagcctaaagggtcggctggcggcagagagaagagtgatggatggtcgaaagtgaattgaatggtgaagggtttgtgttcccgggtcgtggcaccagaaagtttgtcggaaaaggagggggacaaactggggggatg

SEQ ID NO: 100378 - DNA, 98 bp, Heterodera glycines
  Promoter: Source sequence=SeqID_11249; Location=904..1001; Strand=-; Gene=SeqID_74613
ggtttgatgagcaaatcaaaggcaattttgaggccgaagagcaatttattgcggaatgctgggaccaatttggaataaaaattgatcgaacaaaaatg

SEQ ID NO: 100379 - DNA, 1003 bp, Heterodera glycines
  Promoter: Source sequence=SeqID_2399; Location=2358..3360; Strand=+; Gene=SeqID_79530
tgaatatacttaattctgttttaatgcataaaaataataaaatttgttaccaaaatatatatatatatatatattgcattatcgtgcttattattttcattattttaaggaagtaaacgctaatgtattgattcaaaaatggcaagatggcattttaggccagcaattcgaaaagtgccacctaaaaaacagaaaaaatcagctggattagacatgaaaaggaaaattattcaaatagcaaaaaaaaaaagtaaattttaagggaaaggaaatttgacaatttttaaaatttaattgcctttggaaaaaaaagaaataattgccaattgaatttaatgggtggtttttaggggtaatgaacctgtggcttcatctgaaaatgcttgattaattttctctgtatagattttgctaaatctaacaattttgaggatttttttttgtgtgacacctgataatgagtcgaatttggttctatttttggttattgaacttggtttggtttgcggttgttaattaatttgctttccaattaatgggtcattaaaatttgcagcagccaattgaacatttatttgttcatcactttttacagttaactttcagtgatcagaccgaacaaagtcattatcatttgatttcttaattgactgatcttcggttggatcgccgccccttttgggtcggtcggtcgctgctgcgcaatgacaatttctcaccattaattacacttttaattgcactacctttctgcgcaactttaaaagtcatcaaattaatatcaaaaaaatagctgaagtttaatttttgcaaaattaattcatcgatggataaaaaataacaaagcaaacaaaaaaaagtgatggaaatgggaaaaaggcaaaagagggaatgagagaatgactgtttaaaaggcgccaaaaatggacaaattgtcagccaatcacacccaattaccattgcctaattagttaataattgtccatcaattaacccgccgatg

SEQ ID NO: 100380 - DNA, 1003 bp, Heterodera glycines
  Promoter: Source sequence=SeqID_10770; Location=1422..2424; Strand=-; Gene=SeqID_74027
aatatgtaaaatatcccgaaatatgtaagaaaaacccaaaatatgtaccaaatatgtaaataaaatttttaaaatggttatttttttggaaaaaaaaattcttcggaaagggtgaaataggcacaaaatgccataaaaatgacctaaataggcctataatcacattttagtattttaaaaattagtttggttaagttttatttttcactacaaattttataaatttacaaaaattctcaaaatatgtaataaaaatatgaaaatatatacgaaaaatttgccgaaattttggatttttttttttgagaatttccgaaaatttctctaaaaaagccttaaaatatgtaaaaaaaaatgtatgaaaaagtccgaaaaagtccaaaatatgtaccaaatatgtataaaatttcgaaatatgtaaaatatgtataaaaccccgaaatatgtaaataaaaatcccactttttgtccgcaaacataaaaaagaaagtgtttttcctactatttagagcatggagaagccaggaaaaaaatatgtatttacataaaattgacatccctaattatgccccaattaagtgaattatgtgttccattaaaaggcaaaacacataaatctttcgaacgacgtgaagaaaccaaatgggaaaacgaaaaggacagaaaaatcacgtgaaaatgagaaaattgaacttcttacataaaagtggggaagaaattttttttttttgtaaaagaccatcatggccatgtggttatgagcaaaagctaaatctaaaacctaagctttaggcttaggcctaagcttagacttggttgggcttaggtcaaagattacgctttagtttgtaaaactttttattagagttgaccgggaccgggatcggggcgggaaatcccgggtttttcaggtcccggttccggtcccggtttttggaaaaacagaaatcccggtcccggttttgccagtcccggcgggactaaataagcactggtaaaaatg

SEQ ID NO: 100381 - DNA, 223 bp, Heterodera glycines
  Promoter: Source sequence=SeqID_23215; Location=1244..1466; Strand=-; Gene=SeqID_53934
ttttcggggaaaaccccgaccccgaaccccgagcttcataccccgacaaccccgaaccccgacccttaaccccgatcggggtcggggttaaatatacacccctaagaatggcattttcgtgggagaaaatgcaaaaaagttagacgaaatttgaatttttttaaccatttgccaaatttttattaaataaagaaaatttgctcaattttggacatttggaatg

SEQ ID NO: 100382 - DNA, 687 bp, Heterodera glycines
  Promoter: Source sequence=SeqID_27296; Location=1219..1905; Strand=-; Gene=SeqID_57977
atttggatgcagaaaacacggattttgagcgaacagcgcccacgctttgaattgattcattcaccaccataatttaaatctcggcgttgtgataaaaaaaaaagcgccccaataattatctattaataaacaacttaaaaatatataaaattttcataaataaaacttttaaagtaaattttgtgaatttctgatgatctgatgacaattattctgaaattttaaaatttatttgctattgttgtaacttatagaaaatacttaactctatcaaaaaattgtctttttgagtaaattttatgaattttgccgaaataggtcccattttgacggatttacgaaatacgctagcatattattacgcaaacatatttttaaataaaaattatgcattcattttccttgaaaaattggcaaacatttattaatttggtgccatttcccctgtctttgtttatcaaatgacgcagctgaatttattgattttatttatttttttattaataataaattggatttagaaattttattatattttaaacataaaaaaatttatacacctgaaaataatatttaaacatttataacaacaaaataatgatgcgatcttttttattaatacttttgctgataagcttgatccatcaacattgtgaaagcagtgataataaaaatagcatcagcatg

SEQ ID NO: 100383 - DNA, 457 bp, Heterodera glycines
  Promoter: Source sequence=SeqID_3413; Location=4643..5099; Strand=-; Gene=SeqID_84585
ggtggggaagtaaaaccaatcaattccgaggccttaaaaaagcaaaaaggtgaggggagcgcgacaggagcggaaggcagcagccagtcagacagcagtgatcagtattttcggcaaatcgcccactcagtgcacaaacttgaacgtttctctgtctcacgccacatcaccgaatttgtgctgaatgcccgggtcgaagaaccggatgaggtgttgcgaaatgcattacaaatgttgatggcccgcgcaattcataactcagagcagcaaagtggacgaaaagttgtcaaaattggcatcacgttgcagggcagaggtctaatattgggggagggggtgaacgctttcattatgtatgtagaatgaattctgtacgttctattattgtacaggattacaagagccaatcgtgctgcctcttcgaccgcccgaacagaacaccagtgatacactgatg

SEQ ID NO: 100384 - DNA, 274 bp, Heterodera glycines
  Promoter: Source sequence=SeqID_11135; Location=3370..3643; Strand=-; Gene=SeqID_74478
tccgttttggcacgggtggcgaaatggatcaaaaacccccccgatgtgtggtgagaaaatttcgctaactgatcgtctgatggttgacagagaaacaagtaattaaaattaaaattaataattttaattgaaaaaaatatttatataaaaatattaaatattataaatatttaaataaaaacatatttatttcattccatttttatcagtccataaaaattgctttgcttgttgcttttgtggggcaaatttaaagcccggtcacgcggccatg

SEQ ID NO: 100385 - DNA, 88 bp, Heterodera glycines
  Promoter: Source sequence=SeqID_7151; Location=364..451; Strand=-; Gene=SeqID_63969
ttattaatttttgaacaaatatacaccaacatttaaacccataatttgattaaattcgaccctataattccatggatcggtaagaatg

SEQ ID NO: 100386 - DNA, 69 bp, Heterodera glycines
  misc_feature (21)..(21): n is a, c, g, or t
  Promoter: Source sequence=SeqID_5494; Location=1..69; Strand=+; Gene =SeqID_58244
aatgagcttctgcattattgntgccacggacgacttggacgaaatttgttcgagatttatttcgtgatg

SEQ ID NO: 100387 - DNA, 651 bp, Heterodera glycines
  Promoter: Source sequence=SeqID_802; Location=1..651; Strand=+; Gene =SeqID_61590
aattttcccgattcaagtgccttttcaaaaaacattcgatggccacgttcttttccctttagttatttaatgttctgttctcatcaaataatccttcattcattcattaattaattttggattaatgaaatcttttacggaggaaatctaatcacttttactaatctcagatacatccataccaaaaaattgatcttttttgttcgagatcccttattaagggggttgtgacttgaaaaaaccggggattaaaaattttttggaatcagaaacaagaaaattgcaaaaaatcgggaaaactttattctaataatataagtaaggcccattaaaaacaatcaatcaatcaatcttaatcactgatcaatcttttacgaatcagactcaaatcacacctaataatacactggattaaaaaaaatcccgcaaaattatggttcaataaatgtcgggtcagcaccatgttccgcgcacccatttccacgtaaagcagcgagacaacaatggcattgcggtaacgaaaaagaaacaaaaatggcaaaaaaaattttaccaattttaattgaatgccaaaaatgaatgaatgaaagttcggtccttttttttggttagggtagcatcagagaaaggggcaaaaacgagccgagaatg

SEQ ID NO: 100388 - DNA, 61 bp, Heterodera glycines
  Promoter: Source sequence=SeqID_42699; Location=90..150; Strand=+; Gene=SeqID_70522
ccaaaaaacctttaatttatttatattactgtattattacagttattccttccttcgaatg

SEQ ID NO: 100389 - DNA, 141 bp, Heterodera glycines
  Promoter: Source sequence=SeqID_38792; Location=894..1034; Strand=-; Gene=SeqID_67511
aaaaaaagtcattggtttacatggcccggatatatccgcaaaaatttcggtgaccctcccctttttttcatgtgtgacccactccgtttccttttttttaacaaaaaaaaaaagtgaattcgacaattttcaggtctcatg

SEQ ID NO: 100390 - DNA, 127 bp, Heterodera glycines
  misc_feature (79)..(79): n is a, c, g, or t
  Promoter: Source sequence=SeqID_12601; Location=1..127; Strand=+; Gene=SeqID_76264
gcattcagctcaatgatacatgaccgggtgaagagaggtgaagacgcacaatgacaaattgatggaaacacttcgacanccagagagaggaccgagagaaacggcgacggagttttcacgaggcatg

SEQ ID NO: 100391 - DNA, 1003 bp, Heterodera glycines
  Promoter: Source sequence=SeqID_1453; Location=191..1193; Strand=+; Gene=SeqID_73628
atttctaacaaaaaaatgctcaaattgatcatggacaatcaaaaatataacatttgaacattttaaacgtgttttgaataaatttgtgaaaatgaggctttttgacccaaaatgaggcttttttgcctgccaaatgaggcttttgaaaattttaatctggcaaccctgattaataataatgtgtaaataatgtatttatttatatgtacatacataaataaatcagtgttttttttcatgaagtattttttgtcgcatggcaaatgaaattttcaaaaccaattcaaaattaattaaaaatcagctctaaattcatattcgttttcacttaaaaaaattacagtattgaaaaaattgtggtgaaattttattttaatatgttacggaaggacctgaataaattaatggatttaaaaatacaaaaaaaataagaaaattattttaaattagcaaaagtataatttactgttaaataatttgtttgaattttggacattatgagaatcaagcaagcccgcgcaccaattagcttcgatctttaaattgtcaaaaatgatgaaatttacgaattgaaaaggtttccattagcagcagaaacaaatttctctttacgctttacgtcactcgctttgttaagctttaatgcttaatattaaaaattgattgttaatagaaataataattacgtaattcgatttgctgcaaaattattttttgcaaattcttctgtttgtttatgattttccattttcaataataatttaatcgcttttttttttgcaaattccatcgttttcaaatgtgccaatgccaatggtcgcgccaatgtgcgtaattcaattgattccatcgattgtatgcatagcaaattttccctcttcctcataaatttatgcgcgtaaaatgttcagacatacatttattccctcataataatatttaattattattaaactatcactaatattttaaattaattctcgctcatttagtgactgaaatg

SEQ ID NO: 100392 - DNA, 672 bp, Heterodera glycines
  Promoter: Source sequence=SeqID_10218; Location=610..1281; Strand=+; Gene=SeqID_73358
ggttgtacttgtgatttgtttttgttttacctttccccaaagtgatgccgttgcccattctcttcgccaatccgctgattttgccccgacaaattgtgcaccgccgcgtccaaaaaagaagtctctcctgaagcagtccgctgttgctcctcccaccatcgtcactgcccatcggacggaagtcgctgctgcaaacggaccggacaatggacaaactttggagcaaacgcggccgatagtgggccattgacaagcgataacgaattgataatttatcttacaattagtcagtttcgatgaccaactccaaacggagtgtgacgtttcgggacggcgttaacccaggccatgatggaaccacgcccaattcacagctgtccggacaaaacagtaccaatgcggagtgcgtaattttattaaaatgcaactaattgccctactttgtcattttccgcaggtctgaccgattggttgcaggtccatctctgtaccaatggttggtcagtgggagcgaccgaccgaactcgacagatggccattctcttgttaaaaacccattcattccaatggcggccaatggcacaaatatttcgccaaacgacaacaaaaaagtccgtcatattagtaaaacggagcaatccaatttccatcgaacagttgccacggaaaatg

SEQ ID NO: 100393 - DNA, 537 bp, Heterodera glycines
  Promoter: Source sequence=SeqID_24569; Location=332..868; Strand=+; Gene=SeqID_55294
atggcgagaaatgttcataaaatgcaatggaaaatgaatggatttttttaaatttggacgggttcatttgcacgaaaaagtgttgcctaaaatggatggaacgagggcgagaaaacagcactaaaaatatttaattaaattcaaaattcaaaaaattgacatggagaagagagaagcattggttaatttcacccattttacaataattatagctaattttttgtgggtcccaaaaaccattttcttattaaattccacaagttaacattcttaaaaaaataatcctcttcattcaggcgagcaacacttttaagtgttaatccaacaacattatgatttgctattgtgcatattgactataaaatcggaaagattgcattttttttaattttaaatgtttaaatttcgagtgttttcaataattatttttatttataattttattttgtatgattatataaattccatttgcgttggtttcccgttgaatgtcatttgttgtgccaccaatttttgccattttttcctccccaaatg

SEQ ID NO: 100394 - DNA, 421 bp, Heterodera glycines
  Promoter: Source sequence=SeqID_10915; Location=1..421; Strand=+; Gene=SeqID_74218
tttgaagcttctaggatggatttctatatccatatttttccatatttcgcgatttatgtccatatttccatagttttccatattttggcattttggtccatattttatgtccatattttggcatttttcaaaaaaacctctattagaacggcccccatcagctaaattagcctttttgagcccaaaaaccgaaaatttttcaaaaaatcattttttcgccaaaatttctcgagaatattgaataaatttaaattttcttaaaaattaataaatttatgtcaaaaataagcaaaaaagcgaaaagttcgcttttgttgttgattttgcgctaaaaaaataataaattttagctttcatgttttttttcttctaaaatgattgcacagaattgccgaaaaaattcgagaccaatttccgaatg

SEQ ID NO: 100395 - DNA, 118 bp, Heterodera glycines
  Promoter: Source sequence=SeqID_44951; Location=645..762; Strand=+; Gene=SeqID_72356
tttcttgtcttcattctcatttttcctccgctccttatttttcattttttccattttccattttctttttttcaatttttatttttttttatttttcagtttttcatttgtttagatg

SEQ ID NO: 100396 - DNA, 1003 bp, Heterodera glycines
  Promoter: Source sequence=SeqID_24417; Location=316..1318; Strand=+; Gene=SeqID_55144
tgtataaaaatttgtaattcaaaattataaaattaatttaatttaaaatttgcaaaaattacaagcaaaccctaaaatatccgatgaataaatgatctctttataatattttgcacaacatataaattaccaaatggaatataagaaattatggctatgttgcgaagtataaataataaaattaaatttcaaatcaaattaataattagattttaaaaagtttatggtaatttaaaaacgcaatgaagaaacattttatgaaatggcattgtgaaaattaatatactaaaaaaattatttttaattttacaatttaagaaaacaaccaccaaatctggaattcatatacctattaattatttatgcaagcattatttataagacaataagatcaatttcaggtgaagaagcttaagtcatggcttagattataaaaattattataataataattatttaaaaacaaacaaatttttaattattgttgtatcaacattaattacctagcaatcactatatatatatatttgatatttatttttttttgttgcaatattttttagtgatgtcttgatgttaaacaaacaataaatgtactttaaattaatgaaaaaatttaataaaaatacactttaaatttataaaaaaaaggtttttgctactgaaatagggttttacaatacatgtacgtggggaaaattaaggcacgtggtgtgggtaaacatcaaaataaggattactttaaaatttcaaagtttttgattataaaaaataagaatattaaattgctaacaaggcataaaaatcagaaatttttaatgccgatttcgactaaacttcaatagattaaaaaacccgagtttgcatcgacttttccaccggcctcaacaattcgctcgagttgaatagacaccctttgccccggcctgaagacatttacagggccatcagcggctccgtctatttctccaatctcgacctccgagacgcgtatttgcagatg

SEQ ID NO: 100397 - DNA, 327 bp, Heterodera glycines
  Promoter: Source sequence=SeqID_940; Location=1..327; Strand=+; Gene =SeqID_64603
ttcctgaaggattaaatggttaattagataattcctttatttttgacgaccttcttgcaaccattaattatctaattaaccatttaattccttcaggaatggcacggcccaattaggtaaaattgtcagaatgtttagctgaaaataacccattgttcttagatgcgatcttttatcaaaatgggaaaatgaagcaattgatgatgccacaaaagaatggatccaaaagaacaccgtgccctcgttgcaaagtttcgaaatacaaaaatttgaaatttttagttaatgtagatcgaaattgagattaactatggctgcccccaaatg

SEQ ID NO: 100398 - DNA, 95 bp, Heterodera glycines
  Promoter: Source sequence=SeqID_16836; Location=2262..2356; Strand=-; Gene=SeqID_81255
ggtgacccaaaaaagaaacaaatttgaattggattttgcttatcccccaatattcccattgatttttatttcagcaaaatgatgacccaaaaatg

SEQ ID NO: 100399 - DNA, 183 bp, Heterodera glycines
  Promoter: Source sequence=SeqID_2338; Location=1203..1385; Strand=-; Gene=SeqID_79203
attattttaatttgataggtaaatgtttggacttatcgcctaaaaagtgacgaaaaattgggaaaaaactcataccaaaatttgaaaaatgcacaaaaatatttaattgaatcggcaaataaagcaaaaaatctgcaaaatcgtaaaaaagatggtggaagagacgcaaaattattaaaaatg

SEQ ID NO: 100400 - DNA, 844 bp, Heterodera glycines
  Promoter: Source sequence=SeqID_7100; Location=1..844; Strand=+; Gene= SeqID_63846
ttactagagaccgacatttccaaatctgccggaccagaccggactggtattttcaaaaagtaccggattctggatccggtctctcataatccggtcaatccggtaatccggtcaatccctatttttcaaattgccggatccgtaaccggattccggattggtaaaaatttcaatgttaatttagggaaaaaacccgcaaaatgtcatcaattatatgtaaaattcggggcaccagaaaatgtcgccatagtaaagacaacgcgccgaaaaaataaaaataaaatttcaagaaaaaattttaaaaaattttattttaaagttttttatttttgaaaacctatgtttaatggaaaaataataataatgcttttttgcggcgtccttattacaaaaaaaactttgggaatggggccggcggtgccgataggcgccaccgggaaaattttttgaaaatttaaggcaatttgttaacagattttcactaaaatgacaattttttgattttttgggctccggtcaatccctattacaactttttaaggaagctgtgatacaacctaaactattaccaaaataagggagggttgcgcgacaaatttcccattgtatcttcctttcctttattttactccattgtcattgactctccctttttcccactccctccctctcgcacacacacgcacgcgacaacagatacgggattcaaattgtttgagtgaatgcatagtataaaagggagttgtttcagcatttccggccattcctttccaaataatattaatttattcctgcatccgtgccatcatcaaacgtatttggcgcaccaccgcggcgacgcatg

SEQ ID NO: 100401 - DNA, 485 bp, Heterodera glycines
  misc_feature (29)..(29): n is a, c, g, or t
  misc_feature (59)..(59): n is a, c, g, or t
  misc_feature (218)..(218): n is a, c, g, or t
  Promoter: Source sequence=SeqID_18239; Location=1..485; Strand=+; Gene=SeqID_82836
caaaagttggacacaattcggcagtatancagcgcgacatcattcgtacaagccgccanaacggcaattgaagtgaatttgtttttttcgaatcgaattagcatttcactcatccgtagtgcgcagatttcaggaattagggaaagactcaaaaccgggaattcggggggtggggtgtccgtatttattagactgtctaataatcgtgggcgggaggnatatgtggtggattagggataagtccttaatagtcagaagaattgaggaggctactgggttaagccttttttaacagattccttttctatatatttttttgaaaatcctctaatgaattttaacattaaaaatttttagtttaaaaaaattttccttgactttggataacagagtaggataaaaggtcgctgaacgattttttggatcataactttttctttctaaaaaattaaatcattcttggaactcttttaaatttcgtcatg

SEQ ID NO: 100402 - DNA, 438 bp, Heterodera glycines
  Promoter: Source sequence=SeqID_129; Location=12188..12625; Strand=-; Gene=SeqID_46877
aaatttgcataggtatttcttttaaaaatccttatttaaggaatcaaattggcccacccattccactttattatttcttctgcctttttttctgccttcatcgccttgattaatttgctaatttaatttctaaaccaaaatttgtcaccttttctgtttgtcctttgttactctaaaactgtgaaccttctgaatccgaattcggattctgattgattttcattgactgtttgctgaaattgagcactcacatttctggatttctttccctacattttaaaaagaatttcttgatttcagttttttcgatgataagacacgacatacaaatttaactaatttttattgttttttcattttcgtcataagtatgccattatttgttcagaaaaaataagcccagtccttaatattcatcataacccatccttctaaatg

SEQ ID NO: 100403 - DNA, 54 bp, Heterodera glycines
  Promoter: Source sequence=SeqID_437; Location=11235..11288; Strand=-; Gene=SeqID_52738
agttcaccaccccatccttttcgaccttaatattttgggcttttaaaggtgatg

SEQ ID NO: 100404 - DNA, 157 bp, Heterodera glycines
  Promoter: Source sequence=SeqID_29402; Location=1136..1292; Strand=-; Gene=SeqID_59906
ggtccgaatttgtgaaaaatttttaggagttctgagccatttaaaaacaatttttgaccaccggcttgagggtacaaaaaatatggaaaattccttcactattttcagggtcgtgaacgtcttttgagctgtctgtccgagtgtggtgcggaacatg

SEQ ID NO: 100405 - DNA, 91 bp, Heterodera glycines
  Promoter: Source sequence=SeqID_28340; Location=392..482; Strand=+; Gene=SeqID_58971
tcggaatgggtacaatttaaaccctttaacgagtatctatgagagggcaagtctggtgccagcagccgcggtaattccagctctcaaaatg

SEQ ID NO: 100406 - DNA, 344 bp, Heterodera glycines
  Promoter: Source sequence=SeqID_42946; Location=670..1013; Strand=-; Gene=SeqID_70737
agcgttttgtgttttttgactttaagtgtacaacgaactttaagccggacccgcaactgatgcgattcaagcatcaggtaatttttttgagtgggtaattaaatttgaaaaattcaaaggtcaacttctgcttcgcccacgtgacttgcaccaggtgcattgaaaagggcatatgggaccaggaattggagaaggcctgcgcgctttgtggccgattccgaacttatgcctggtccccgttcgaattctggcacacggacgtggaatgccgcaaggtcgtcgaagacccactggcagccttcaccaagtggttgctgaacttcgaaacggaagtcctcggcatg

SEQ ID NO: 100407 - DNA, 114 bp, Heterodera glycines
  Promoter: Source sequence=SeqID_18742; Location=935..1048; Strand=+; Gene=SeqID_83414
aatttttgataatcaattttcatttttgattattcttttttgcataataaattataattctcttaaaattaggtttgaaattacattaattgttttcccatttgctaggccatg

SEQ ID NO: 100408 - DNA, 561 bp, Heterodera glycines
  Promoter: Source sequence=SeqID_15294; Location=4196..4756; Strand=+; Gene=SeqID_79521
atctatattttggcactcccttcccagcagaaaatgttccccccgtcttcccatcagttcattctgttggcagtgcgctttcatatttgtattttgttcttattttcctccgactcttcccccattttattgttgcggttttaaataaagtgatttgtctccgtcttggaaatatttgtggaggagaagcagtgatttagccccgacccaaacagcatttatttagcacgcggcgctcctggcgaagagttagctgtgccggcataatggattttggactgctaaaaaactgatttggagaagcgaccagaacaaaacgcattgctgcggttctgcattcgtcttttgcttctgacagaacaaacgcattgctgcggttctgctttttaacgcattgctgcgaatttcaccgatttcgtcccactgctaacgcattgctgcgagaagtgaggattggtatttaacgcattgttgcgaacgctttgagtttggaatcgccgacttttgtgcgcgtcttcaagaattatgcaaattgttcgaccgccgttgcttagagggatg

SEQ ID NO: 100409 - DNA, 311 bp, Heterodera glycines
  Promoter: Source sequence=SeqID_8029; Location=3908..4218; Strand=-; Gene=SeqID_66743
aatcaatttacgaaaaaactaacatttccccgtgaaataaatatgaatttatattggggaaattattagacagagacatatgtatttgtagacaatttttaatattttcattctaaaagaataattatttcacgggcatttcatacttcgatgacattctctcctacaattaaatttaaatataatattatatcccagataaaaaaaacgaaaattgaaatctttcgcttttttaaatgttttgaccaaaaattaatcagaggttgccatttggggtcaaatctgccccgtccattattcagaaattaatg

SEQ ID NO: 100410 - DNA, 586 bp, Heterodera glycines
  Promoter: Source sequence=SeqID_16047; Location=1..586; Strand=+; Gene=SeqID_80403
tacaaacaaaaaaagttatggtggtctaaacttagttcagacgcaactggcccgtttcgtgcctggctgaccagctcacccaaacaatgaaaatgccgcaatgaaatttttttggatttcatttctgaatttttcatgcaattagcctttagattttctcacaaaaaataatttcgtttaaggaaatgtttgcgcagaaagaataaatgaattttttaattataaatatatttaaaaagcaatcaactacaaaaaagaaaaacttttttcgtgtaacctgtttttcggctaaaaattatcatttatattttcgttttatgtgggttttcaatttttattcatttcacaatactcaaaaaaattattattcttaaatcaacgtattactaataaattggcatcgctaaaatcaatgtttgtgagatttccataagattttttttaatttttcatacgtcattaatataaattcatggattacgcaaatatttacaatgtttaagcacttatttaataatattattgttcatttttataaaaatataaaaataattctaaaattaattcaattctttcagtgaaaatg

SEQ ID NO: 100411 - DNA, 497 bp, Heterodera glycines
  misc_feature (37)..(37): n is a, c, g, or t
  Promoter: Source sequence=SeqID_19828; Location=1..497; Strand=+; Gene=SeqID_84576
gcatatcggtcttttcaaactgtttgttcatggctanaatttcaaagttacattgatgcgacaaaagcaattccatctcatcaacaaattcagaaggttggcaggagtcgagtcagaaaaatacaatttttaatttaaaagaaatttcattgaaaactaaaaaattttttttgctaatttttcaatttttgctagcaaaaaaatcattttaagaaaaaaattaaaaatttatacgaattttatttgatcgaaaaataagcattgaaaaaaatgaaaaatcgctagactacctaaccgaaaaacaaaaaagaccaccaatccgctgggggtacccaaaaggaatccatttattgcactttatccgacttttgattctggcaaacatttcccacttttcttaacagtgtctcgttgacatcggtgacaagccgtcaaattttgttggcagtaaaaaatggattggatcattggaattgagcttttgcttggagacaatg

SEQ ID NO: 100412 - DNA, 618 bp, Heterodera glycines
  Promoter: Source sequence=SeqID_14681; Location=1..618; Strand=+; Gene=SeqID_78790
cccttagtcaaatagacatttaatgcttggctaccgtttcattgtttttcgtcgagggccaaacatttctgcagtattcaacatgctagtattccattttctagatatatacagccaccatttaaaaaagttttaaattcaaagacataatgtgaatatatgctctttaaagggaaatttatagcggattaactaaatttctgaaatttcaatttatgttctattttattactcattttcattgtctttttcagacttttctcggcacaagaaattaaatagttctctatttatttaaatgctaactttgcataaataatttgataaaaacaaaattttaccgaaaattttttctctcagttgaaccaatggcaaaacgaacggtggcattgaaacgcaaccgaaaaagacgacggaaaaaacgtaaaggcatttggcaattttcaaaaggttttccaaattttcagttctgccttttgccctttcgttgtgaatcaggcgcctgttaaggtcgaatgcaaatccgccaaatgtatcgtaatttcgggtgttatttagtctaattgttaactaaaatgggaggaaaacattttatttatttttttctataaggatatg

SEQ ID NO: 100413 - DNA, 188 bp, Heterodera glycines
  Promoter: Source sequence=SeqID_21325; Location=1677..1864; Strand=+; Gene=SeqID_51920
ttacccgctgtcattcattaatttttttctctctcaattaatgcataatgggattaccaaataatttttttagcaaaataaaacaaaatcttattacaactgaacgacttcgaatgtctacatcagggggctcgtcaaatgagttcccctttggtacatcccaagccttcgggcaggaaacaaaaatg

SEQ ID NO: 100414 - DNA, 1003 bp, Heterodera glycines
  Promoter: Source sequence=SeqID_18467; Location=245..1247; Strand=+; Gene=SeqID_83069
aaaggaagaagatattcagccaaagaatgggaataaaattaattcgaaaatagcgaaaaaattggggaaaaatcgtcaataaatttatgaatggattaaagaatttggtcttcaaaaaacccaaaaattaatcattagcacattataaatttgttttcatgtttattttttgtcatcataacaatgggatggatttatttttaaaaattaaataatgctcatggcaaaaggagtaggatttttgtttgcagattaaaaattgattatccataaatccatttaacttgacaaatctgcataaaaatttttcttagattcgcaaagatctttttttaatttgtattagaaaaataaatgaatttttataataataataataattatacatttaatagctctttatatttgttagaaaaatattttaatacaaaaatggatcatatggaagcaactttgacaaagtaaaagcaatattttgaggtttttcacataaataattcaaatcatttatttttttaattcagaataagatgaaccaaagaaaatgccaaagaataaaaggcaaaaatggaaagggcaaaagcaaatcaaccgaatgatcagcaaaaatacttgcgcccatttttttctaatttgagcctaaaaatcacaaaattttccatttgcgatataattattaatgacagaaataattcaaatgtttgcacagttgactttacattttatgtgcaagcattttcctccgccatttaaccaaaaatacatttatgattgacggataattaaaattcgtaaaaacgagtttctcaacgccaaacaaaatagattaagaattactaatgatgtcattaaatgcagcacagattagtcagcccaatgctaagtctccgttcccaaaatatttttcacaaaatttttgctatttaaacggaatccaattttgcaaatttcaatcattgcttacaattaaatccgaaaattatataatttatcttgaatgatg

SEQ ID NO: 100415 - DNA, 205 bp, Heterodera glycines
  Promoter: Source sequence=SeqID_10859; Location=1..205; Strand=+; Gene=SeqID_74137
ctgattgagggggtcccttcgggcggccgcagtcaaccgcctgtggcgctcgtcagactgcttcctccgccctccgtctcgccccactacttgctccgtcttccatgctcccttttgcgaagttcgaaagctgcaagtggtcttaagcgttttttggctcacttaaattggttttttttatcagtaatttttagagtttttgatg

SEQ ID NO: 100416 - DNA, 141 bp, Heterodera glycines
  Promoter: Source sequence=SeqID_37420; Location=1..141; Strand=+; Gene=SeqID_66498
tcagtacattttcatgacaacatatgtcctcttgtttcgtccattttcggacggaatatgcgtcgcgatgaacgcctttctccttcagccctttcttcgtgcgaaagtattaaaaagttacgcgaagcaatcaccgaaatg

SEQ ID NO: 100417 - DNA, 154 bp, Heterodera glycines
  Promoter: Source sequence=SeqID_15547; Location=2060..2213; Strand=-; Gene=SeqID_79829
ttttgcctgtttttggtctccaaattttcttaaaatttgctaggctgttttccgtgccttgaggggtttggaattaattcgataatccatacataattaaacgcattcaaagaatggcatcatcagtgacgggaaaggccactcgcgacgcatg

SEQ ID NO: 100418 - DNA, 912 bp, Heterodera glycines
  Promoter: Source sequence=SeqID_5450; Location=1..912; Strand=+; Gene= SeqID_58093
ttggatggacattttcccactgttgaccgtcctcaactcggtttaaaattggaactgctttcgcccgtttcgatgttttagtggacaaatattttgatggcaaaaaaagtgattttttagggttttttttaaggattttgtgcgaaaaggggcctccaatttcaaacgaattttgcttaaaagcaaaattcggttttttttgttgtaaaagtgaaccttttttttagggtttttgcttatttgctgattttttatgttagaaaatcacatacatttttaccaactccagctagacagatttattttcctttttcatgtaaaaatagtaactttttttagggttttcgttaatcatatttttgtattttataaaatatttcgttactttttcagcacatgagcaacgacgtttggatggaaattttcctttttttgaccatgctcaactcggcctcaaattggcactgctttcgcccgtttcgatgttttagtggacaaatattttgatgacaaaagcaaaatgactgtgggccacaaatcgaaaggactaacttaaatgcggtaagtatttaaagttttctcggttctaaaaatggcccgaaaaataaaaaaaaattcaaaattcgtaatgtgtgtcaggtttttttagtgtcttattgttacgtatttttggatttaatgatttttaagctggaccttacatttatatttttccattatagtcataaatttctttgtttggcaattacatggcataaaaaatttttttggtaattttgtatgtttttgcatttttaatagaaaaatttttgtttcgtgtaaaattgctcagagtttcggtcaacaaatttttgtccagccctattgcttccctttccgctaaattattaattttcataatttcagttgatg

SEQ ID NO: 100419 - DNA, 115 bp, Heterodera glycines
  Promoter: Source sequence=SeqID_8443; Location=993..1107; Strand=-; Gene=SeqID_68085
tgtccaccaccaccacttccaactagaccaccaccagtcgaatcattttttaaattaatatattttaattcgaaattttaagccattaccaccacgagttccatcacgagaaatg

SEQ ID NO: 100420 - DNA, 139 bp, Heterodera glycines
  Promoter: Source sequence=SeqID_15224; Location=1..139; Strand=+; Gene=SeqID_47279
gctcaagtcggcaccattcagggaattggtcaaacatttgttcaacaactaaaagtctcagttggaaacactgaaatttacgacagcggaaatttgtacccatataaggtttacattacgaacactttcgtttccgatg

SEQ ID NO: 100421 - DNA, 408 bp, Heterodera glycines
  Promoter: Source sequence=SeqID_2076; Location=1076..1483; Strand=+; Gene=SeqID_77713
tctcttctctctcattccttctcgacttattcccgaaaataaattggtgccaaccacacacacattcattaaagaattaaattcctgtttagcgtttttctctttttagttaaaaaaagaatatttgaaaaatttaaaattgaattaagaaaaagcaacccaaaaggtaaaaatatttttgaaaattttcgagagaaatatttttcaaaattcaaaaattttggaatttgttttaaatattaaacagcactcaaacaaaatcatcagctcttgctcgctaacattttgtaatgtcgaaattcgcttccaaaattttagtttactaaaataattattgttaaaagagaaaaatccaattaactcagctcatcaacaagcaatttccacgcctaattacggcacaaaatg

SEQ ID NO: 100422 - DNA, 200 bp, Heterodera glycines
  Promoter: Source sequence=SeqID_29545; Location=1379..1578; Strand=-; Gene=SeqID_60034
ctttagctttaagttgaaattttattatccttgaactaataaaaattttgttttaagtgatctaaatttaaataaatgtaagattattcaaaaatatttttttttgtttaaatctaaagaatttcgattgatttcgggagcttgtccaaatttaataattaaattttattttttcagttggggcgacaattttacaaatg

SEQ ID NO: 100423 - DNA, 561 bp, Heterodera glycines
  Promoter: Source sequence=SeqID_35243; Location=1..561; Strand=+; Gene=SeqID_64843
atttctgttggagacagagttttactcagaaattattcaggaaaaataggtacttcaaagaaattccacttaccttggaaaggtgtatttagagtcatagacatagaaggggtcagaacaacaatactaagctgtaattcgcctcagtctaatccaagagtagtacatattaaccaacttaaaaaatgcatagaaccccttgggccagcatgcactattcctaagcttgatgatgatgaagaaaaagcattacatgaggcaaatgcaaaggaattaataaatgaaccgggacattcccacaaattaggtcaaaaatcaaattctgaagttgaaaaagaagtagaagaaacggatgaacctgagcaaatcagtccgagatataatcttaggaaaaaaaaatccgagagcaagaaaactcagtttaaataattaattttgctttggcaagtaaaagttcagaaagaggggttaaaaaaaaaatataaataaataaaacagttttaatttaataagaaaataaggaaacaaataaaattattagtgtcgtatccattcagcatg

SEQ ID NO: 100424 - DNA, 1003 bp, Heterodera glycines
  Promoter: Source sequence=SeqID_1141; Location=1982..2984; Strand=+; Gene=SeqID_68546
tcgacagtgttgacatatgtatttggatgccatttacgtactttgaaccgtgctgagtcgaacaaaaaactcagtgatcgataaaataattaaatttaattattcgattctctaaattcatataattattatattcatcaattattgaagattttttaattttaaaatttaaaaaaatgaataatttatttacttcgaggttattcttggacaagcaaaatcttaattaggttggacttattaatattttttcagaatcattaaaataataaatttattaaaatggcaaatttttatattattccttttttaatttataattaaattataatcgtatacttaaattcattgacaccgatcaatcactgagttttttttggatcgacctagcactttttgaaataggccctaatgcttagaaattttcaaatttgatttatttccaagattgtacttggaatcagcaattttctgaaaaaggacaaaaattataattaaaagtcattgtaacagtaaattataaaactcggagaccgaaatgatttgaatacgttgtaatgtttatttaatttattatttatttttagcacattttttgttttttttttaatttcattatgacttcaaacaaaagaaaaaattttccaatccgaattgggaaaataaataaaccagcgcctgaaggcacataaaaactttcccctctatacctcgagatgttcaagagtcttcttggtcttagtcttgaattattagggattgtttttttctcagtctcagctttgagtcacctttggcgccgaaatggctgtggtgctgaaaattgtctacaccgaatgtgtgattgattctcagccgatgattcatcaaatttcataaaactgatttttccgtaaaataacagaaaaacaaatcgaaaaattccacaaaaatgaatcattttgtaaataaccattaaataaatatttctgttcacttcaaaagatcaaattaatttccaatg

SEQ ID NO: 100425 - DNA, 98 bp, Heterodera glycines
  Promoter: Source sequence=SeqID_3361; Location=1752..1849; Strand=+; Gene=SeqID_84373
aaaacttgtccttggtagtattttttggttttgacgtgtcgtttgtgcggttatttaaagcggttgaaagttgttgtgatcatcattcgagcaaaatg

SEQ ID NO: 100426 - DNA, 263 bp, Heterodera glycines
  misc_feature (21)..(21): n is a, c, g, or t
  misc_feature (38)..(38): n is a, c, g, or t
  misc_feature (44)..(45): n is a, c, g, or t
  Promoter: Source sequence=SeqID_644; Location=1225..1487; Strand=-; Gene=SeqID_58004
ggaaattgcatctgctgatgntgagaatgcgggcgctntggtannatgcgaagcagcggaagagcagccaaaggaacagcgaatgtgaggggaaaagagagggggggggggaaaagacacccccctgggccaatggcattttattttccatgggtccaatggcagtggaaacgaaacaaaattaaaaaaacttcattaaattttcaatattttcaaattaataatttaccctttcctttcccattttcagttatttgccaatg

SEQ ID NO: 100427 - DNA, 148 bp, Heterodera glycines
  Promoter: Source sequence=SeqID_15120; Location=1108..1255; Strand=+; Gene=SeqID_79304
ataaaacattctactgatggaaaaccaacccgtaatataccatgattagggctctaaaaaaaccaaaatttccgtaatctgtcattacgcgtccagctctgttctctgcactctgttttgtaagcatcccctattataaaaacagatg

SEQ ID NO: 100428 - DNA, 128 bp, Heterodera glycines
  Promoter: Source sequence=SeqID_7873; Location=1..128; Strand=+; Gene= SeqID_66243
atgatctccgcaatgtttcatggtccaatccgacgtcacaacgcaacaaaatcaaaacaaatgccgactttcggagaaattcgtcccaactcggcctgatcagaagcgaacttcgcaacgtagaaatg

SEQ ID NO: 100429 - DNA, 64 bp, Heterodera glycines; identical to SEQ ID NO: 99473
  Promoter: Source sequence=SeqID_32520; Location=480..543; Strand=+; Gene=SeqID_62824

SEQ ID NO: 100430 - DNA, 79 bp, Heterodera glycines
  Promoter: Source sequence=SeqID_25723; Location=321..399; Strand=+; Gene=SeqID_56466
cgtagggttttgttggtcgctgaccttcactccatttcgacaggccgacatgaacctgcccaagtgactgctgacaatg

SEQ ID NO: 100431 - DNA, 394 bp, Heterodera glycines
  Promoter: Source sequence=SeqID_1882; Location=987..1380; Strand=-; Gene=SeqID_76554
tcgctaatcacggctttaactcttatttaattccatccaattgaaccgcacaaaacacgcgagaaaaatttagcaacgcagattaaatactagaaatagcaattaatattttccgtcacaaagctttcaagtcaaccgccttagaaaatattagtgcatgacatgccactgccctgttgtgctgaatttcctctattagagccacatgggttctatttttcaaccccccccctggaaaagcaaatttattggagggtggctcaaatagagggaatataaaaattgctcttatgatataagaatcacttgttcatttggcttataaactgtcaatacactctcctcatctttttgagcaaccgaataaaatctatcagaaatccacacaaaaatg

SEQ ID NO: 100432 - DNA, 147 bp, Heterodera glycines
  Promoter: Source sequence=SeqID_6264; Location=416..562; Strand=+; Gene=SeqID_60939
ggtgaccaaatggctaaaactgtcctaattacgctaattgctttaatgcctttaagaagcatatcggcagtttgcaccttggtcattacacatcgactgtggttaatctgacaagcactgatcagcaatggctaagctttaacgatg

SEQ ID NO: 100433 - DNA, 642 bp, Heterodera glycines
  Promoter: Source sequence=SeqID_39; Location=15831..16472; Strand=-; Gene=SeqID_54453
ttgaaaagcatcaaagatggaagaaacaattaaaaagtgagaaaattcagtatacattcaaaaaaatttatgataaataaaagaaaaattgttgaaaaatattttaaaataaaaaatgcatttatgcaaaatggaaaacattccgcgaagggatggaaagaatttaaagcaaaaattcaaatatttgccgtatgttatttgtaatttgaagaaccaaaaaagctggaaaaaattttgtttaataatggtaacgcaaaatttaattatttttaataaatcgtttttgacaaaaaaaattagatattataatcatatttattattaagaaaatttactcattttactgtcactttcatcaaaacattattattatttaatatgcgaaatttttttattggtattaatcaaattaataaaaataattaaaaaacaaaaatattcacatgaaattgtattcccggacatcctttgcaatgtcatcatcataacattgttcaaatgatagaagccggaaattatggcaaacattaagcctaccatttggcatataaaaaatgccaaaaaatcatggaaaaaacacaaattattatttaattatttattaaatattcatattttaatttttaacaaattaaaaaaatg

SEQ ID NO: 100434 - DNA, 228 bp, Heterodera glycines
  Promoter: Source sequence=SeqID_17101; Location=1808..2035; Strand=+; Gene=SeqID_81534
ttacaaggttccgcgagctcagttcagttccgttgactagagcttaaccggaaatgatgcaaccaggaagaacacaaatgttcaagccacatcggatagttcagtatccttaaatgcttggctcccagatcaagaagcaggcgctcagcatcatcagcaacatccaaatcaggaaacttacaacaatatcatacaacaaactcagttagcaatcaaattaatggcatg

SEQ ID NO: 100435 - DNA, 507 bp, Heterodera glycines
  Promoter: Source sequence=SeqID_6923; Location=759..1265; Strand=-; Gene=SeqID_46328
tttacgataatttttgtctctaaatacaactttataagttgattgagggcgtgttatttggagggaccctttgcctaatgaccaatctgaacattgaaaccgaacttgtacaaaaagttataattcaatttttcgaattttttttttcagaaaatgcctcccaatttttaagtttatcgattggatttagttgaatgacgtcgtcaaacaatctcaatcattctatttttcattttctattttattaattaaattttatggcgttttatttaaaagcaaaatattttcaaaaatcttcatcacatttcttataccaatccaaaattcatctgtttcttctgtttggctttccctttgatttaatgctttatctcaattaatttaatccatttttaaaattgtattttcttttattttgacgttaagacattatttattatccatatatactaacttctttcatttgttatgaaagaaaattccaagtatttgggtccagaaaaaatg

SEQ ID NO: 100436 - DNA, 158 bp, Heterodera glycines
  Promoter: Source sequence=SeqID_2475; Location=6147..6304; Strand=-; Gene=SeqID_79914
cagtactaaatcgacccttaaaattaatttacccgttagaaattaattcaaatgatgataaagagcaagaaactctctctaatctaataattaatcaaaaacccaattatttcaacagaaaaaggaagatggataatcccttagtccctataaaaatg

SEQ ID NO: 100437 - DNA, 1003 bp, Heterodera glycines
  Promoter: Source sequence=SeqID_14139; Location=1265..2267; Strand=-; Gene=SeqID_78135
gtttttcgtgaaggacaatgttggagggggcgacaaaaccgttgtcgatgagtttcgaatttacggcatgccaattgcgaagactacgaacatgcaggatttcacacgggtatttttacagcagcgcacttttctagctgtaaaagcaccgatgctttcagttgctttccttcgaaaataattgaattttctttttaaaaaaactagtggggagatccttttggattgtttttttggcattataattcgtgaaaattgtttgcataggttttcagggtcactgatcaagaacttatgacaacaaaaaaaatttgtttctagctggaaaattggaaaaaaattttagaataactaaatcttaaaattgacatttgaatttgacaggtggctggcaaggcgggtgaatcagagcagtgaaatggtctttttttgttacgcaatatggttctgtaattcattttttggtaaagcgtataaaatatatgtatttattggtgctttttccgtttgatattttgcaatattcgtcgttttactttttttgttttgttttttttttgctaatcaaatattgggaaaggtcataataatgagtagtggtgacttaaataacgtggaccgaatgatgagggagcttaatgttgaacagctcgtccaaatccaatcgtcactaaagtggggttttgtttgtttgccgatatggcacttcccaggctcttatgaagtttagcccccacaaatttttcactttacatgcaaaaaccaccaatatatatttccgtggtcgctgatcacgaatccggcactattccgaccaatttcgtttattaaatcattaaaaagttaattctcgactttttgttcgggttagggttcaaaaataggtcgaatgggtgccggattcgtgaccaacgaacccaaaaacctatgtattggtatattttttgattgggaaattaaaaataataatttaaaaaaatacaatcgttgcagaggcgagatg

SEQ ID NO: 100438 - DNA, 190 bp, Heterodera glycines
  Promoter: Source sequence=SeqID_21644; Location=1..190; Strand=+; Gene=SeqID_52243
tcagccggactattcactcactggcggagcatcaactgggcacaacatacacagagctgcacaaattcagcagcctaccgcttctctggcctcgtctcttcctgctcatcatcaacaacaattgctgcaaacccaatcattgctcctcccgcagcaacagcactttcaacatgttcgtctcggaactatg

SEQ ID NO: 100439 - DNA, 399 bp, Heterodera glycines
  Promoter: Source sequence=SeqID_8269; Location=1885..2283; Strand=-; Gene=SeqID_67507
ataactcgaaaagtaccttaacaaccaccaaaaaacaacaacaacttgtttttcgtgtattgcagaccatagggagctcagcaaataaaaattgaagccctagtgatgaagtgtgaaaacatccaatgggacgtaattacgaaatggcatttgaaattatgatgaaattcatggcttttaattattttaatattatttattaatattttattattaagaaaatctattgatgatcagtttcacttattgatcgcctttttggcaatgcttctccacattcattaaaatgaaataaaaaattattttccgaagaaattagcttaattttaatacaaatatatatattaaaaatattaaaaacttattaattaattatttattatactttttttagtgatg

SEQ ID NO: 100440 - DNA, 1003 bp, Heterodera glycines
  Promoter: Source sequence=SeqID_9189; Location=852..1854; Strand=+; Gene=SeqID_70540
gtaaatcgacgagctttttctttttttttgctttccaaacaacttttttcggcactctttttccaaagaaccttttgggtccgatggtggcgataggcgccgccggggaaatctttgaaaatttgagagtgtaatttgtttaacagattttcaccaaaaaatgataaatttttgcgattttgagcaaaattttgaaggaaaattggggaccatatgtgccgataggagccgccgggatttttaagaatttttatgaatttgcttagagaaaattatgggaaattaatctcagagataaataacaccaaatgaacattgaattgattgatcgggggatggattggggaaaaatggcacacaaaaagaaaagccattccaaaatgagagcatttgtgatggaatttgcatttgataagtcactcaatttaatttgtatgtttaaaaagtagaccatttactgctgctgtggtgtgactgacaattcaatcatttcggcttttgatcaaattcaaaagggtggtctggcgatccgaccgttcatccgtcacttccccctaatgaggctgttaaataatgtaaatgcaaaagttggacttgaaggaaggaagtgaagctgacggattaattaatatgcattaggcgaaagatgctataaacggacgttgtcgaatttatgtgaaaatgggaaactgcagctgatcgtgacggctaatgtgtccggtttttctgctccgtccaaaattgcaattagcaaattgccccaggcaaatgcccattaatttgccattagcatcgcatataaatttggttcggttgtcaaaaaataaattattttttcttttatattttaaccgaaaatcttttaattttttttttgtttgtttgtttgtttttcaataaaatgtgaatggatacgaaaaaaattttgaatttggcggccgctctttcggtattttccttcggagccgtgctaattggggttcctttgatgttcgccgacatg

SEQ ID NO: 100441 - DNA, 194 bp, Heterodera glycines
  Promoter: Source sequence=SeqID_20621; Location=1181..1374; Strand=+; Gene=SeqID_51176
ttcttattgagatgtgtgagccctgactgatggatttcagcacaggacgactacactccacggcgaagaatgatgacagaataacctttttgcgcaattttaaataaatatttttattttctgtgcatcatatggttattttcctcatactttgtgccacatttgcaacactttctgatttgttgtttcagatg

SEQ ID NO: 100442 - DNA, 87 bp, Heterodera glycines
  Promoter: Source sequence=SeqID_19952; Location=853..939; Strand=+; Gene=SeqID_84714
ggtgtgctgcagctagaattgcgtttttgttcaacaaatgcttgtattattacactcatttttgtcaaggaacgccctgcgctgatg

SEQ ID NO: 100443 - DNA, 86 bp, Heterodera glycines
  Promoter: Source sequence=SeqID_2491; Location=2494..2579; Strand=-; Gene=SeqID_80032
gctgcaaaaaacgaatatgtgacggcatcaacgtttacagtgccgacggcgattcggcacaaccactgcagaaatagcggaaaatg

SEQ ID NO: 100444 - DNA, 347 bp, Heterodera glycines
  Promoter: Source sequence=SeqID_30684; Location=1462..1808; Strand=-; Gene=SeqID_61091
tttcccaaattttaaatttaaatcatataattggtatcatttaaaaggttactgctctcagtgagaagctttttctaaaaacaattgtcaagcatttgggccaatcagaaaattaaagtgtctttgaaaatatgttttctaatatcttatgttaaaatgataaatggtaaacttaaaaataattttatttcggctattttagatagaagaaaataattttttcattttattttcgttttccaaatcgccaagtgttcgagtcttgtggcaaagttcagtctttcggctttgaacaccatggcaattaatgtaaatccaaacggatatatgtaatgacttaagaaatg

SEQ ID NO: 100445 - DNA, 349 bp, Heterodera glycines
  misc_feature (21)..(21): n is a, c, g, or t
  misc_feature (57)..(57): n is a, c, g, or t
  Promoter: Source sequence=SeqID_11343; Location=820..1168; Strand=-; Gene=SeqID_74727
ccgaaattttccaaaataatnaggcgataaatactaattcttttcgagagtctcggnctcgattcaggaaaatctcgggttttttggtctcggtctcgaggttttggtctcggggtcaagtctaggtctcgagaaattttcggtctcgaacagcactaataaatactaccgattccgccctctttttaaaaaaaattttcatgtcctaaaaaggtgtctagggcatgttgccaggttcgctactggtcaagaatatcatattcatcccggacaatttcgaaactgaattccacaagaagtcgaaattttgacttttttcggtttcacgttgtggaatttgtccgaaatg

SEQ ID NO: 100446 - DNA, 356 bp, Heterodera glycines
  Promoter: Source sequence=SeqID_17897; Location=344..699; Strand=-; Gene=SeqID_82448
agcaagcaaatctaatgttgtgttgtcagaaatttagtatgaaattttgcaggaaaatatttggcataatgctaccagcctgcaaaatttcaaaaatttccatgcattttttgaaaataaatttctgtaaaattttaaaaatttcgtcggagcaaaaaaaaacctaacaaaattttattgtcgaaatcatgaaaaccaaaataattaaacttatattaattgtcgaaaaatgtcttaaatatatttgtttgatttgatgttttaaataattttttctgaaattttcaaaaaaaaatttttcattcatttgagctgcgagttggcgggcgcgtgcgcagacagtccctgccgcaatg

SEQ ID NO: 100447 - DNA, 1003 bp, Heterodera glycines
  Promoter: Source sequence=SeqID_4292; Location=3523..4525; Strand=+; Gene=SeqID_53927
aagtgacaaaatatatggatgatcacaggaattaaaaaaagacaaaaatatgtgaaaataaataataaataaattgaggtcaaagtcaaatgaggtcgaaataccaaatcacttagaaatttgttacattctaactttcccggtcttacagattaccctagtgaactttaagttttattttaaatcccccgggcagataaatagagaaggggagattatttttcaacctacttcgaaaggggtagattattggtgacttgcatataattagagaaatacggtagtttgactttattattagggcttacatttttaggtgctaaaaactgccaaaataggtaggttttaggttctaaaaaaccccaaaaataggtgctaaaaatgggaaaataggtgccaaaaagttccgaacttaggggtgtaaaatgacaaaaattttattaaaaagtcaacaaatattaagacaaattgagaaaaataatttttaaaatcaaaaattctcgtaaataggtaaaaatctaaaaatgtaagccctatttattattacgttggtcagttttcaaatttcaaaaaacaaatgcgcgtctaacatttgcaaatgaaagttggataaaaataatccgtcaaattgattttttattgattgatttgggggtaggggctaaaacgcccggcaaatgtcatcattttgcaaaatatattctcctctgttgcgtgcgttccttccattccaaagcactgccattccctttttctgctcgctttttgtcaatgattttcgtctcccattggcatattgtccaacccctcgggcccatttgcaacaatttaaggcaaacaaaattcaaaagttgtttggataaaatgtgattttcgttagaatttttggttttccgcttttctaattatataaaaataaagtttccaacgcaattaattcttctgttatttgtgtgacatcattcggaactcggccaaattgtgctaattgctgccaaaaatg

SEQ ID NO: 100448 - DNA, 572 bp, Heterodera glycines
  Promoter: Source sequence=SeqID_10976; Location=612..1183; Strand=-; Gene=SeqID_74282
aagatttggggggccggcggtgccgataggcgccgccgggaaattttttttgagaattagtaattttggtagcatttatatcagcaaaataaatcattaagcacaaaaatttaaaaagtttgtgaaaaaaacgacaatcttaaaaaaaggacacttgggaactctggtcaaactgtttgttatatacctatgtctgtgggtttaattacgttaatcgcaggcccacatggccacgggccagaaatcaaaataaaaattatcaaaaaatggtaaaaaaaaattgacatttttttggtcgaaaacggctaatatttgtccccggcactgaaaaatttgaataaaagcatttacataaaatattttggatttttttctctcttctctgtcccttgaaattaaaaaaaaaattgtggatagctgacgaagtagcgcgccttgaaaaatgggtgtatctttaaattcgactgggccggggaggaacaattgggtgaaaaacccctaaaatatcgctaaaatgccaatttttttttttgtcacgtttaagaagaggcgacgtctcgaggctgacgatg

SEQ ID NO: 100449 - DNA, 410 bp, Heterodera glycines
  Promoter: Source sequence=SeqID_21801; Location=2184..2593; Strand=-; Gene=SeqID_52429
aacggttgagactaatcacaaagcaaaagcataaacaccgacaagttcaacaacagaacaacaacaacagaagaaggagttactgtttgctgttgaggctcatcagacagtgacgacgacgacgtcgagcagtacaaaccatcaccaaaaaaacaaattgttttcattgttttttgttgttatttgcattttgttagggttcatctacagcatcagcctcacattttcttcgctccatccacccaaacaacaaaaattagggtagcaccaaaagacataaacagagcagccagatttttattcaacgccacctctctctcatcactctcatttttgccttcaattcctcattctcacacacataccaaaaaaagtgatcagcaaagagtgatcaaaaccccccaaaaatg

SEQ ID NO: 100450 - DNA, 478 bp, Heterodera glycines
  Promoter: Source sequence=SeqID_2312; Location=1..478; Strand=+; Gene= SeqID_79035
actctgatcatctattctattatcggcacgactattgtttaatcaattgaatttattgggataaaaatgcactctggtcattagaagagccaagttggctaattaccgcaaaatttgctaaattatcgtcatccctctactaaatttgctagcgccgccgtctctaacgcttaattagctaattatcattgcatcttctatttttatttaaataacactttcgggagcagctcttcccccctggattagtttaccaatgtcgtttccaccgatttttttttaatttcaaagttagaatttcaaaaaaattttcgaaattttttttttaaatttcaagaacaaaatgatttggttcaggtcctccaatttgaaattactgattgatttggttcgggtcttccagtttgatcaattattgattgatgatcattgtcttacgcatcattaatccgctttttcctaggatgagttgaacatg

SEQ ID NO: 100451 - DNA, 56 bp, Heterodera glycines
  Promoter: Source sequence=SeqID_644; Location=1..56; Strand=+; Gene =SeqID_46037
taagaattccacggttcttcgatatgttcgaccgaagttgaaatgggtatattatg

SEQ ID NO: 100452 - DNA, 1003 bp, Heterodera glycines
  Promoter: Source sequence=SeqID_9414; Location=953..1955; Strand=+; Gene=SeqID_71329
gtaatttaatttcaaaattaatccggtgtttaatccaaagaatacaaggaaattataatggaagaagcggtcttaaaatggatttatcaagagattaaggatcatccccgacggattattagattacaattattgtattttgcaacaatgattaattgggcattgaaaagatcttactaaaaaaacccccatcaaaaactgaaatgagggccagattaaaattccccagggggcactaacagttcaattgtgataataatacgaagaagcaatttgtgtgttcagccgagcggagggaggagggcaaagggttgtcatagagaaaggaattaatgaaaaaaatttttttttcaagtgtgtgtgaattgcgccgctgctgtgcggacgtgtatgtgcaatgatggcattttcattcatctcgccaatgtgcgtgatgagtgccgtcgccctttttgtattacacttattttttgatgaagaagccaactaacaatgcggccctgtccggtcggttgcctctctgctgctgctgcgtgagcggtgaatgaatgaatggtatgatgaatgatggatggacggacggacggcacggcacacacgcgcacactcacatacatacaaattttggcaccatgagtgagcatgcgccgagagagaacattcattgtcctcccccgttttcgctctactcttcgcttaaatttcataaaaaatggcacccatccatcatccatccatacataagcaaccataaaacacataggttcttctcggtaacacacccacacagtgtcgaatgtgccgccgtgtcctgtgcgaacccacccccctccaaagagaaagaggacaagacaaatgtgtggggtataaatagctcacatgtacatgtaagacagacagtgcgcaccaatttgggcaaaaatgagggcggtggggaagggtacataaagacggtcatacttttggcacacatgtgcctagaaaaaaaagacagagaaaaatg

SEQ ID NO: 100453 - DNA, 746 bp, Heterodera glycines
  Promoter: Source sequence=SeqID_6532; Location=743..1488; Strand=-; Gene=SeqID_61917
aatgttttgaggcactaattgaatgttaaaaatttgcgcgcttttttctacccaagaaaatttcaataaggaacgcgaaaaaggaacggtccggccaaaaattagggtcacagaaacgcgtcctatggacttttaagtgtcccatcaaaattttgcgagtccatgcgattttagctaattgtatgtaagaacatcagatccaatacaatttcctgggttttttttggactgttgtaaattcatttgtcaaaagacagagtctgtaaagagaaaatatcacaaatttttctgcaatttgaaaaaaatgccgacaaatttttcatttttttcgcttaattttttattcaaatgatagtcaaaattattttgttcattgaaacttatgaaatgttatggtccaggaaacccaaaggaatgccaattttattgggttttttcaacaaaattgccatttgagcgaaaacaaaattaaaattgtgaaaaattaattttttttcaatttttaccctccgttttttaaggcgactttcgcttgtgcaccagcttcgcaaggacgacaacggaggctattccaaacacattctcaaggtttcatcaaaaaaaaaaagaaaaagaagcaatttctgtagattttctaacttttgcgggtccaaactgaaaaaatgcccggcctttgtatatgaaaaactgccccccccccctttgaagttggcactgcactcggactatcgtaaggacgtcgcatg

SEQ ID NO: 100454 - DNA, 119 bp, Heterodera glycines
  Promoter: Source sequence=SeqID_17195; Location=884..1002; Strand=-; Gene=SeqID_81656
attacatagttttattgcattcacaaattttttgcaaaaatttgcttgaattaagattcttgaactaaaaatcctacctcttaatcagtgaacaaatgaataattaattgtaaatcatg

SEQ ID NO: 100455 - DNA, 181 bp, Heterodera glycines
  Promoter: Source sequence=SeqID_15839; Location=743..923; Strand=+; Gene=SeqID_80169
ttggattattcaaattttataaatccaaaaagtcttaaatttaaattctctacttagtcattatttttattttaggctaattattttttcagaaattaaataatttttaatacagaatacaaaatcttagtttttaagaagttttcccttttcttgatcatataaatgatcaatcagaatg

SEQ ID NO: 100456 - DNA, 774 bp, Heterodera glycines
  Promoter: Source sequence=SeqID_25163; Location=1..774; Strand=+; Gene=SeqID_55891
ctttgcctattttagacttttggtgcttaatgcctattttcctatttttatgcatatttcgccatttttggcgcctttttcagaattttcggaaaaatccttaaccaaaataaataaaaacgaaaaatacacccctaagaatcgaccccaaaaaatttcagaaaatacatccataggattgaaaaaaaattttcacaaataaatttttgctttgcaaaattttttggtttaaaaatttgtccttattcgaaaagaactttaaaatatttaatttaattcatttacaattgaaatataaccagaataactttttaaattaagttttacgtgttttgctacctaaaaaagagtttaaaaaattttacttgcctattttagtgcctatttaatggctattgcgatttttttgccttttaagtgcctatttcgctatttttagtgcctaaaaaacgaatccttattaattgctaattgcatgtgcaggtatttattggctatgtgaagaaaagtgcaacttacgaaggatgcgttgcgataaaaatattcaatcaaaatttttacaatgtttatgagaattcaaaaaattttatgcaaaagattcaaagcattcttccgcctgacgagagaaagcatttgatcacaatggttgacgcgtaagaaatttataaaaaattattttaaaaaatattatttttaaattaatatttggaatttaatatttaaaaaataaatagcggaaaactgaagaaacagaataaaggattagtcataatg

SEQ ID NO: 100457 - DNA, 749 bp, Heterodera glycines
  misc_feature (7)..(7): n is a, c, g, or t
  Promoter: Source sequence=SeqID_29964; Location=1..749; Strand=+; Gene=SeqID_60432
ctcacanttttctactacatatgccataattgttttgattttttctattgaataaaaactgataatggaaatcatcaaaaacccttaaaaaaaactccgagaaacaagaccgatacagagaacctcggtttccgagactaaaaacccgagactcgagtcgagactctcgcacagccctaggatttatattccaatacaatacaatatttgtttgctagctttacattttaataaggattctcacccattgttacataataatccatttatcgcgtcatatttttatagatttacaatttatgtaaaaaataaataaaaattattaatgcttattcaacaaaatatattattgcaaataattttagcatttatttaatttttattattttgaaatttaggttagcataattaataaaatattttgtataattattatgtatttgctgtttctttttccatttcttattatgtttattatgggaagggaatgcaacgaaataaaaaatgaaaatggcaaataatatttaatttaaattattattaaattcatttttaagacacaaaaattgaaagcggaaaatatttggttaagacagctccaagagcattttttactgctgataatcatttgattgataagtggttgcaaaaatatgttaatgaatttttgtgcaacgaaaaaaatgaaattgaaaaaaatcattcaaaaattggaaattttatttttttacgaaaaagcagaaaaaatg

SEQ ID NO: 100458 - DNA, 83 bp, Heterodera glycines
  Promoter: Source sequence=SeqID_14567; Location=1..83; Strand=+; Gene= SeqID_78638
ttcaggctggtttcgcgggcgatgacgcgccccgtgcggtgttcccgtcaattgtgggtcgtccccgtcaccagggcgtcatg

SEQ ID NO: 100459 - DNA, 719 bp, Heterodera glycines
  Promoter: Source sequence=SeqID_1323; Location=2517..3235; Strand=-; Gene=SeqID_72490
tttttttggcaatttgagtgtgatttgtagaaaattttgtctaaacgtgaccaatttttgttttaagtcaatttttaaaaaaaattcaaaatttggattttttgtgcgattttttatgtaacagattttagacaaaaaggccatttttatagaaaaaaagacggagttcatcccttaccgcgataggagccgccttagaaaaaatggaagttttgatatttttttcagactttactgaaaaatgggtatttcagattccaattttgaaatcttaggggaatatttctcggtttccgagactaaaaacccccagatcgggaaccgaggccgggaagcgaaaaacccggaaaatttcccgagtcaggaaccgagactctcgcacatccctagcagccactacccaaaattagaacatttcttagaaataaaaacagatctcacccttttcatctaaatccaacaatcttggtgagaattttttgagttcaattcacgtatttattatacagttttgtttcaatatttggtctttttgtgatttttttagcaaatatttagatggtttttttggcaaatacatagatatgtatatggtatacatattttgttttttagcaaaaataaatctgtgtcctgattatcattttgtcgaataaaaaatagcctttggcgcataattaagtaactttttaattctagtggatttttataagcatatg

SEQ ID NO: 100460 - DNA, 872 bp, Heterodera glycines
  Promoter: Source sequence=SeqID_22877; Location=1..872; Strand=+; Gene=SeqID_53587
cgtttgtggacatgtatgccggtcttgggttggatgactttgacacaaaaacggtgtccattggactccaacgtttcctaaactggatgggctttcttcgtcatcccaatgacctcaacgctggatgatacggacgggtttgagctgatccgacagggcacgtgcacgcttaaagtccaatttgagaagcctataaaagatgacggttacgaaatgttgatcctcggcgagtttgattccgtcctttccattaacgctgaccgtgtgttgagcacagacggaagtgtttaaacaaagagagatagagagagagagagagagagagaaaatgaattctgcacaaattgacacgttgctgagaagattgcgtgcaacaagaggtaagttcatcggtgtctacccgtcaaacaaagtgccgctgattcacgacagacagagacgactgcagcgctatccgcactgcatggttgtcaacacggaccgggaaggcacacggggagaacactgggtggctttttatgtgcctagtgcaactcaaattgagtactttgacagcctaggtgtggcaccaaaccctgatctgtctgcctatctcaacaattttcgccatgttcaagtgaacacgcagcaaattcagttcccctcatcggacgcttgcggccacttttgtgtctatttcttggccagccgttgttccggtgtcccgttttgtgtggtggttgagacgttacgcaaaacgcgcgggatggcggactggttggtcaaatggtatgtacgcatgttagtccatcatgtataaaagggtgactaaaagagagggatgccacacaaatgcccgctcgctataaggcggataggcactagaaaaaatg

SEQ ID NO: 100461 - DNA, 393 bp, Heterodera glycines
  Promoter: Source sequence=SeqID_1011; Location=4621..5013; Strand=+; Gene=SeqID_66046
attttaccatttatttcttttttggtattataaatgtgcttttgttgtctaaaatttcctcagaatttcactgattcaaatcgcaacaacaaaggccgtttttctggtcgatgtcctcgtgttggaagagagtcggacgatgactgaaagtcaatggttaaatttcttcgacgcacttttatgcactgacgtaacgaggaaaattggtgggatttgtttttgtgccatcgtttatcgcttgtttaaaggggagtaaattcctttcttttcggcatttcctttcaatggcaaatccctttaggctacgactttcgcaatgatatgcgtgtcttgcgcagcactttccctttcatcgcaaagcttttcccgacggtgagaaaggtcgtctgtatg

SEQ ID NO: 100462 - DNA, 440 bp, Heterodera glycines
  Promoter: Source sequence=SeqID_9340; Location=358..797; Strand=+; Gene=SeqID_46736
aaaactaccacaagcaggtggttgcgctatgaattgcgcgtgattaatgggcttattggccggaagataattatttaaaacgttaggtgtttaaaaaattttaaaattacatttttccaaaattgatatattttcaaatttttgtatggtgaagagcggcattattttcggacgaattaatgatcagtgagaggaaggaaaatttcgaattccactgtggaaaagttgaaattaacaaattttaccgggattaatatcgagaatatcactcatatttccaactactaatatttatgatatcatgaattgctgccatttagctgctccgtgagattgagctgcacgagaagcagttcaacgacgtgcataacctgggcgccgttctgatcaaacagggccacccggcgggcgaagtgatcgaggtgtacctgcgcaccatg

SEQ ID NO: 100463 - DNA, 72 bp, Heterodera glycines
  Promoter: Source sequence=SeqID_16915; Location=850..921; Strand=+; Gene=SeqID_81345
tgtgttgaacagcaggcaatttagcgactaaccaattaaacattgttaattaatttgcagccttccgttatg

SEQ ID NO: 100464 - DNA, 191 bp, Heterodera glycines
  Promoter: Source sequence=SeqID_45367; Location=1..191; Strand=+; Gene=SeqID_72671
ccccccccccccccccctcgtccgtattcacatatccttttcccgctgagaggcctttcggcgccacagatttttggagatagttaatgttgtgatctcaaaaattccgttgcgtcgcaggcctcgtccggcggtggacaaaatgccacttttttggacaaatatcaccatacctccttatggacaaaatg

SEQ ID NO: 100465 - DNA, 64 bp, Heterodera glycines
  Promoter: Source sequence=SeqID_17433; Location=1..64; Strand=+; Gene= SeqID_81916
gagtttgcctcgcgacccagcgtgtttcagtcgtgggtgtttgagcgtggacgcgagctggatg

SEQ ID NO: 100466 - DNA, 399 bp, Heterodera glycines
  Promoter: Source sequence=SeqID_8854; Location=1..399; Strand=+; Gene= SeqID_69431
atgagcaataattaagctctagaattactctgattgttgaaaattggtctttttaatttttttttttttaaatgcaaaaaatgtgaacacaattactatcaaatcttccccaggatttaatccgggatggcaccatcggaaaattgtttttttgattttccctcatttttaacagattttcaccaaaataggtaattttggtggattttggaaaatttccgcgtaatattttgggaaatttttggtgaggtagaggtaggtcttggaggtgcaccaatagtaaacagttacaatgaaaaatttcttgtttttttacaaaattaaacaaaattaaatttactacaattagagccatggttaaatattaaaaaaataatttctttttcaattattcagatg

SEQ ID NO: 100467 - DNA, 469 bp, Heterodera glycines
  Promoter: Source sequence=SeqID_3552; Location=328..796; Strand=+; Gene=SeqID_50832
ggtgggaaatgcgacggactgtcctctgacggcaaagggtgtcaacccaaaaaacaaatgagatgattccgcaaattgtagcgtgtgaccttcagaatttcctaggctttctgagttataaagtacgactttgcagcgggacggtcccaggatttggcttgaaggatggtacccggtccttggtgatatcccttttttacactattttttgcatattttttcgccgagtgaaatcccttgtttttttagattttcatctctaaattgctaatttagttgatttttgaaaaaatttagcaaattgattggaaatttaatgagggaggtcttggagggggtaccattaagaattggaaattttcgtcaaaaatactatcccccccttgtcgtcttcttccctccctcaagatatttacattaaaattaattcagctttcgtatatcctaaaccttttaggtcatcaatatg

SEQ ID NO: 100468 - DNA, 254 bp, Heterodera glycines
  Promoter: Source sequence=SeqID_14852; Location=1..254; Strand=+; Gene=SeqID_79002
acggaaaaattggaattcgaaataagaaaaattcacttcacagcgaactgtgatactaatataatttaattagctaatcaatctacaacgtatttccaataaatatatagtcaattatgatgaatagccaacatataaaaatcgatgatcagatttattaatttatttatattttttaataaataaatacaaaaaatatttctctaatttgcccaaaacattttattcattttcgtcaattatatttaaaaatg

SEQ ID NO: 100469 - DNA, 999 bp, Heterodera glycines
  Promoter: Source sequence=SeqID_23070; Location=121..1119; Strand=-; Gene=SeqID_53771
agatttagggggaagaccgaatcctttcgggaaaaacttccctaatagcccgtactttaaattctgggttggatttttgctccccataatgttttgagtaccccaaacggacacttgaaaaaatcgatttatttttgttttcggggcagtccccccgaaccgatgcgcccagatttatggggagaccgaatctttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacattgaaaaattttcttgaaaaaatcgatttttttgtttcataaatatttttttcagaaagtcatg

SEQ ID NO: 100470 - DNA, 78 bp, Heterodera glycines
  Promoter: Source sequence=SeqID_2195; Location=2137..2214; Strand=-; Gene=SeqID_47197
gacaatagccacaataaacatcaaaacgaagtggcaaacaaacaaaaacaaacaacaacaccaacaacaccaataatg

SEQ ID NO: 100471 - DNA, 853 bp, Heterodera glycines
  Promoter: Source sequence=SeqID_13095; Location=890..1742; Strand=-; Gene=SeqID_76884
tctaaaaattaaaatataaagaaaaaattaaaaaccccatcaataaataaaaaaaaagaaaaagccaaactacatccacaaaatgtcaataaatattaaaaaaatctgccaacccaaaaaaaatatagaaaaaaaataaaaacaacagaaaaataaaaaaatctaaaaaaaaatcaaaaaaaaaatcttaattttaaatttaaaaaaatgagactttaattaggattacatgttccatcaaaatgatgacaaattgacaaacaatgtggaatatgagcttaaacaggtacagtaaacacatatattgttttggtaagcaattaaatttaaaaattcaattaaaaaaattattatcataattgatttttaaattcaatatattctttttttttaaattgtataattgccaaaaatatatgtatttgaaattaaattttaattaaaaattttttttttatatttttgtaatgttttgaggatttttctatgatttatactatttttattctgtttatttaatatattttataaattcatctattccttaataatgaaaagcaattttttttttaaattttaacagcgttattattgtataatattttgttttacgattattttatatacaatattttattattatatttacataattgattttcgaaaacttcgtccttaataacaaaaattaattattttttaattatttttgtttttttctttttgacagattgagtttaattcgggcaattatggcggcccagcttttgctgtccgggccacagaattgcatcgctacattatggaggtttcaggacgtaaaatgtcgaataaatttttgccaaacaatatg

SEQ ID NO: 100472 - DNA, 183 bp, Heterodera glycines
  Promoter: Source sequence=SeqID_15708; Location=665..847; Strand=-; Gene=SeqID_80022
tttttggccacaaattgaaagaattaaattctttgcgattgttttcagctttttgaagtgcggcaacgaccaaaaaccctttacctttgccgaatgtccgctgggcagcgtttttgtgggcaaacaatgcaagggaaacgcattcattcgctcgtaaataatgaaactttgacaggcaaaatg

SEQ ID NO: 100473 - DNA, 119 bp, Heterodera glycines
  Promoter: Source sequence=SeqID_10938; Location=1..119; Strand=+; Gene=SeqID_74246
atctctttcaatccgcccattcgataattgctaagttctttaatgtgattaattaattgtctattagcataaaaaaaatataattttcttccgccgtttagcccctcccattcgaaatg

SEQ ID NO: 100474 - DNA, 54 bp, Heterodera glycines
  Promoter: Source sequence=SeqID_13913; Location=1008..1061; Strand=+; Gene=SeqID_47171
aatagaattcttgttcaacacattgccaattttgtttttccccattgtcagatg

SEQ ID NO: 100475 - DNA, 215 bp, Heterodera glycines
  misc_feature (119)..(119): n is a, c, g, or t
  misc_feature (139)..(139): n is a, c, g, or t
  misc_feature (189)..(189): n is a, c, g, or t
  Promoter: Source sequence=SeqID_266; Location=1..215; Strand=+; Gene =SeqID_80657
ttttgcccatcgtatttcaatctcgaccaattagcagaaaatattaaagtgattactaagtctgatgccccgtttccgtaaaagccatttttactttgtttatttggacggccacacancgtctttcatgtcattctantcgaaaataaataaattaaagcttttttagaaggattcacaattattaanaattagcgagtgagagagagaaaatg

SEQ ID NO: 100476 - DNA, 124 bp, Heterodera glycines
  Promoter: Source sequence=SeqID_39099; Location=610..733; Strand=-; Gene=SeqID_67744
gatggttaacagatagtcgttttccttagtcagtggaatctatcaagagagggaggagaaggtgagagaatggggggggacaagcgtacggaaagggggggggggtaagttaaagccaaccatg

SEQ ID NO: 100477 - DNA, 182 bp, Heterodera glycines
  misc_feature (48)..(48): n is a, c, g, or t
  Promoter: Source sequence=SeqID_21423; Location=1..182; Strand=+; Gene=SeqID_45652
tatgaggtgtgtttgctttaataaatcacattgaataaatatcatttntaattccattttttccctttaaaggttttttacttagacgacgtggcggccattgagcgcaatggattgccccaccgggtgtcttcgccggtccggaccgcgacgtggtaatcgacgggacggcttatcgaatg

SEQ ID NO: 100478 - DNA, 1003 bp, Heterodera glycines
  Promoter: Source sequence=SeqID_14313; Location=988..1990; Strand=+; Gene=SeqID_78343
cgttgaaagggatcgaaatccctttctcttttttgtccattccgcgacaaatttgctttttttaattttaaaacaaaaaatttgggatatattttattcatttcttctcatgggttttttcaattcaggacaactatgaaaaaccaggacacctgtgtgcatttttttacatgttaatatgtttgaacattcgtggcaaaatcaaataaaattaaaaataattatatttaggcatttttgcaattttatttctttatttttaacattataagaaattatagaaaaatgaaatttaaattattattattattcctattaatgatcctactatatacaattaagcagaccgtgcaagtgaaattaaaacaagaaaaaagctttgatgaaatatttgacaaagatgtgacgatggagcagaagaaattctctgccgaattgatcacataattcacggagaaattgctgatcagtaatcaaattcaacaaaatagtcgacaatttgatcaattttttgatgaaattttggaagtaaaaaaaaaagatagtgaagaaatgtccaataattgtgatgaattggaacaattaaaattgggatcaactcaaaagaaaatttatgaattgaaaaaagaatttggattgaccaaaaatagttattcaaaggaggaaaaacgcaaaataataaaacaatttgatcaattatatgacaaaataaaatataaattaaataaaaattgaagggaaaaagaaaaatatgtcaaaaaaataatagcaaaacatttgggcacaaatatcagaagcattttttattggaagaaagaattaaatgttgaaaattcgaaggagaatcaaaaaaatgatgatgcaaaacggaaattgttgaaaaatattttaaaataaaaaatgaatttatgaaaaatgggaaacattcacggaaggaatgggaagaatttagagcagaaattaaacaaatgtttggtgtgggttattggacgattgaaaaatg

SEQ ID NO: 100479 - DNA, 1003 bp, Heterodera glycines
  Promoter: Source sequence=SeqID_2880; Location=1850..2852; Strand=-; Gene=SeqID_82143
gaaaaaaataataatattattaattcacaaagctaaaaaatatatttatcaaaggatggaatttcggtgctaggtcgtttcgtaaaaattgccaattttaccgatttttcgagaaaaatcacttataacttttcttaattataacataaagaataagaatcatactgtagctcttggcttgcaaaatttcagaaaatttcattgagtttttacaaagttctaaccaaaaatgtttaaaaaaatagacataactttctaaaaacttaataaaatattcggaaaattttcatgataatagagcaagccaagagctatcgtattataccaagattatttttttaggttgtatttaagagaagttatgactgatttttctcgaaaaatctgtaaaattggcagttttatgaaacgatccagcatgtgaaatttcctcacaaaaaatgaaaaaaaaattccactaaaaaattcacccattttttttctttcctttattttattgaaaaatggaacttctctctaaaaaaaaatcgaattttcccacgagttaaaatcaaagtgaatctgtctatcaaatccatgcgttccattttgatgaagaaagaatgggggcgggggaaaatgcccatgggaaaacggcactcacttaaagtgcatttgggcccattcatttaaaacacttggccaaaaccgtaccaaaaaattggtgtatgacctcattaataaaaatatttttaatttaaatatttacatatttcttagtagtaagacattttgaaaaagcctggacctgggctttggttccatgttggacctggacctggatgtcctggacaaaaacccaggaaaattcaggtccaggaaaaccccaggttttgtcaagcctgtggatccatgcccaggtcgaactttataattcatagtattaatttgtggcattcccagagaactcaaaaaaaaaagatttttaaaaattttgtcaagaaatttttaaaaattttagatg

SEQ ID NO: 100480 - DNA, 720 bp, Heterodera glycines
  Promoter: Source sequence=SeqID_16355; Location=1148..1867; Strand=-; Gene=SeqID_80745
ttatttttagaaaaaaaaataaaaaatttaaattattttctttttattaataataatattaaaataaaaaaagtaaaatgaccttttctccggctaaagattttgatcggtttcgctgaacaaatgaattgggctggtttttatcgacttttggtattttgctatattattcattgtatctgtccttcgatgtgccggcgcgtaaacggtgcaaaaatgcgccaaggtcgtcgattaattgcgctattttcaaataaaaaatgaatatttaaaattaggtattgtttgtgtcgtctctctatccccaaaattttggtcatttcttggggaatccccgtcccaaaagtttgtttcttccccgcactccacgcttttttattctcattaatatattaaattagttcttttttcatataacatgcgagcctttaattacttattatttttaaaaatgacctttggttgaaagctctacgatgtgcctccgttgaggaacgtaagcttacaaattgacgactccaaaacttacattattgtttttgtcaggtcccgtgcaccaaaccagcgtcaacccaacgttgaggtagtggtgcaaatcacttaaagaacaaaaacaaggatttggcaacggggaacaacatcgattgttccgacacttcgctcgcctttaccgcaaagacccgtcaaattctcgtcaacattgtgtttgttcaaaacatg

SEQ ID NO: 100481 - DNA, 174 bp, Heterodera glycines
  Promoter: Source sequence=SeqID_4400; Location=2860..3033; Strand=-; Gene=SeqID_54321
gctaaatggcattacatttttaggtagatgaatccgccgttgctgctccaattacctcttggcaagtgatttcctggtggactgcctccccgcacaatgtgcagcgtttcattttgcaaccgaagcaaatcatcggactgccaacggctccattcgccgttcccttcgacaatg

SEQ ID NO: 100482 - DNA, 237 bp, Heterodera glycines
  Promoter: Source sequence=SeqID_24102; Location=790..1026; Strand=-; Gene=SeqID_54806
cccatcagcatttcaatctctcgatactcaattctcaggctttccaatcgctggaactcaacccaccagcatttcaatctctgggactcaaatctccggcattccatacactgggactcaacctaccaactttcaatgacattccaatctctgggactcaacccaacagcattccaaacaatggactcaaatctccggcattccaaacactgggactcaacccactaacgttcaatg

SEQ ID NO: 100483 - DNA, 125 bp, Heterodera glycines
  Promoter: Source sequence=SeqID_40808; Location=528..652; Strand=-; Gene=SeqID_69046
ttctttgtggcaggcactcctcactggctactcgacctaggcatattctgttaagtgtctaccccatatggaatttttgagagagaaagacagccctaaattgaggctattgggtccaggaaatg

SEQ ID NO: 100484 - DNA, 825 bp, Heterodera glycines
  Promoter: Source sequence=SeqID_3709; Location=1026..1850; Strand=-; Gene=SeqID_51566
ttcattccatcaatttttctgcccctccggggctgttttgttttagaatttatatttttatgtgtttgtgtgtacacacaaatatttttacccgccgccgccgcattaattctttcttatcgccccgcccagaaaaatttgaaaatgaaattgcatacacacacaaattggacgaacgaacgaacattcatttatttctttcatttttttgcccctcgccaataaattcttcggaatttttgaggggccccaattttgggaattattaatattttagcattcacgagatgctgctgcttgtgctgcctgtgctgacaaaattccgttttaacaaaatgattataattgttttgctctaaaaaactttttgtttgccattttgttttttttttggttagctttgttttttggtaccattaatgctttctgatcagtgatcagaaagatgaatgatcaaaaaatcacaagttttaaaatggaaattaccaaactttgagaatgatttggcattacaaatcaagcagtggccgggaccaaatttatctctgtcattcatcagcggaaaaatcaaagaaattatcagaccgaaaacagcactgattagcggagaccaaatctgatccttcactgattaacttgaaccaaacacttaattatctgtaagtgggaaactattattttttttttgactaagaatggcagactgatcccaacgcttacaaggactatcaaaatacagaactgatcaaagtttatgataccatattccctaaattgagccccccccccctgctaacatttggcatggcatttcccccaaaaatg

SEQ ID NO: 100485 - DNA, 218 bp, Heterodera glycines
  misc_feature (22)..(22): n is a, c, g, or t
  Promoter: Source sequence=SeqID_5588; Location=1..218; Strand=+; Gene= SeqID_58566
aaacccccgggtacttggtttncaggaccttactaacaaaaaaaaaaatgtgaccaaaaaaagtgaaaaaaaatttcaaaaaggaccgctttgcaagtagcgccaaaaaacatttaaataccgtatggctcttctgcagttaattctttttattaaaagttaaattattacccacatcttattagtccgtctcaaatcgtcaaaatttgtccaaaatg

SEQ ID NO: 100486 - DNA, 443 bp, Heterodera glycines
  Promoter: Source sequence=SeqID_2149; Location=2442..2884; Strand=+; Gene=SeqID_78093
atttctatgttcatcagtttttggttttaaaacggcacattcatttattttttgaagaattttttattaatacaatattttttcgaaattcaaaaatcccgcaatcccgcgcgggatcccgcaaattttaaatgcgggatttgcaggattgcgggatttgcgggattaatcccgcgggatcccgtcccgcaaaaaattttgagttccagtcccgcagcgggatccgcaaattgaaaatttccagtctctagataaaattataatatcttcttatgcgattcactaaattcatgtgtaaaatcaataacactcaatattatataatttagcgctgcctcgtaaatgtaaaattaatattcatatgatgaatattttatatattttttgacaagaaaatattggatacctatataattataatattattataatctagaaaaatg

SEQ ID NO: 100487 - DNA, 451 bp, Heterodera glycines
  Promoter: Source sequence=SeqID_16257; Location=2683..3133; Strand=-; Gene=SeqID_80635
tttttgtatatattttttggcaagccgatgttctggcattcctttctgccgtgtgattgagactttgcgcaagactcgaggcatggcagattacctcgtgaaatggtttgtcagaaacttgatcaacggtctataaaagctcacgtttcctaagcagtaagaaagatgctggttcatttcatgaatgttttttacgcaggtatagtcctcagctgtgtgccgtcacgattgcaatcggagctgataaatgtagattttacggttgacaatcaaaactattttgacagcggcaaatatcgtaccttttcaaaagatgctacagcagcagaacactttggttatagtcggaatacagcgtgccgaatagagaaatgtgagcgtgacagcgaatgggccgtttcgcttcaaaatgtgtacactttgcacagctatcagtgtgtttttcgaaatg

SEQ ID NO: 100488 - DNA, 196 bp, Heterodera glycines
  misc_feature (76)..(77): n is a, c, g, or t
  Promoter: Source sequence=SeqID_3450; Location=1..196; Strand=+; Gene= SeqID_84728
aaataaaagaaaaaataaaggaaaaggaagaaaatatcagaaaagaaatgaataaatgaaagaaaaaatagcgaannaattggggacaaatcgaatcaaaatttataaatggattaaagaaattggactttataaatatcacaaatcaaaaactgatgaacaaaaactcgaaattgtgcaaaaattcattgtaatg

SEQ ID NO: 100489 - DNA, 983 bp, Heterodera glycines
  Promoter: Source sequence=SeqID_17801; Location=804..1786; Strand=-; Gene=SeqID_82333
tttctccactttttgctccgcattcagcaaagtattcttattttaccagcagacggcaatgtgaatgaggtcaatgaagattaaatttaatggtactcaaaaattaacttagaaaaaagtacccgtaagaaaatgggtgaaatatgcataaaatgctataaaaataagatcacctttatagattttgaaattaatttttggtattttttggtttaaaaaaaataaaatttttcacaagaattttgtgatttagatcgaatttttttttaggaaaaattaatggttttgtttttgtccgctccaacggggaaattagaattatgaaacgaatttttgagaaaaatttgatcgttttaggcgtcgccgcgtgaaaaagtgcaaattttggctctatttattaaataaactagggttgctctccgaccccgagccccccgacccgagaccatacactttgactaattcaacaattcgcgtcaaattttgctgaatatgagcagcgagcagcagtttcatttcattttggccaagttaatttcatgatcaacgacctcgaaacccatatttttatttttaaatttcaaaaatttacgagaaaggggggctatcattggtactcttaccaaaaattagttttagagagcttttaaaataatttttttataataagagacgaatgaacagtaatgaataagaaatgtaaattttgtgtaaatatgtattttttgaaaaataatagaaattcttgtgaaaaattttatttttttaaaccaaaaaataccaaaaattaatttcaaaatctataaaggtgatcttatttttatagcattttatgcatatttcacccattttcttacgggtacttttttctaagttaatttttgagtaccattaaatttaatcttcattgacctcattcacattgccgtctgctggtaaaataagaatactttgctgaatgcggagcaaaaagtggagaaatg

SEQ ID NO: 100490 - DNA, 332 bp, Heterodera glycines
  Promoter: Source sequence=SeqID_29140; Location=1..332; Strand=+; Gene=SeqID_59687
taatgaattttgttaagaaaatggccagctgatttttcataaaaatcggtcgattgtttcagttttttgattatttcggtcggtcggtttcggttaaaaaccgaaaaactcaaaaatgtctcggtcggttttttcggtcaaaaaccgaaagagctgaccggtccgatctctactcaaaatgttgtttgccaaattggcatagtgttggctcgaaagtcacaatttgacccttcgagacaagggcataggctttagcctcccccgtggctaagcctttgcttcaaaagtatcttgaatgatcatcacaattaatttttttggtattgcagatg

SEQ ID NO: 100491 - DNA, 1003 bp, Heterodera glycines
  Promoter: Source sequence=SeqID_42710; Location=6..1008; Strand=+; Gene=SeqID_70536
tgttttgtgtgcaaaagcggtcaaatggcagaaataattgacggaagaaaaagcgaaaagaacggcgtgaaggaatgccgaaagaaaaaccacggaagaaatatgccgaacacagcttaaaagaaaaaaaaaatatttttgaattaaaagtttaagcagcgaatttaaaaaaatttaaaattaacaaaattattttgaaattaaattttttatcggtttcaaataaaaaaaaagtttaatttaaataatttttttaattaagtacagttgaaaaaataaaacaattactttaaatgattcgttcagatttatttattttcttcctatttttttgggcagtttttagcattagaaacttctaattttctttcaaaatttttgtcataaactaatggaaaacacatattggttattaattgcaattagcataaccaaaaaaaaaaaaaaccgatttcgttttccttaaattttgtttatttttgtttctttctgtttctgtgatgtgatcgatcctttttgtttacattttccattccgtttcattgtgcttttgacggataacagatgctaatattgctcagcgccgatcgccccgttttgtcatcccttcctttccttaatgatgctaataaatgaaactgatgatcgttgtggcaaaagccgcttcttccgatgggttaagcccgggcaaaagcatgaaacattcattcattccatggtcagaagaagcagctgtttctttctcactacgtatttcattccatttgatttttccgaacttatttgttaactcattcataatcatatttttgatgaatttcatttttattcgaaagcattcttttcatttttcatttaaaattataaatttattttaatattattttcaaattttggagtaaaaattttattagttttatattgaatattaaaccagtaataagaaataaataactttaaacttataatttccttacgcactgtaacacattgagtcaaaatg

SEQ ID NO: 100492 - DNA, 221 bp, Heterodera glycines
  Promoter: Source sequence=SeqID_36944; Location=1..221; Strand=+; Gene=SeqID_66139
gaattgaaattgaaggaccaataaattatgcggtgaattgtttggtcaaaatttcgcaattttattttaattcaattgacgacgacctttattctgaatataaattaaacatacatttcaataattataataattttgaaccaaaattgttgaatgagcaaagattgacttatttaattaattttgaaaatgaattaccaaaagtgccaattaatgaaatg

SEQ ID NO: 100493 - DNA, 468 bp, Heterodera glycines
  Promoter: Source sequence=SeqID_503; Location=2578..3045; Strand=-; Gene=SeqID_54651
accaggctgggcttccctgtcaactcgggtccggtcccaaattttcttggcgcccgccgggctcgggctttttccagaatttgtggaagtttatttataaaataaaaaatgtgtaatcgtctattcagaacgagaaataaattctattagaataaaatttaaaattttttatctccgtctaatatatatttttgaatatataaatttaaatgggatcaacaaccaaaaaaccattccgaattttgtttttgatcataatttttcaaaaaaattttctcttcagtggaaggtccggcaccggaaagttttttttaatataaattaggtataatcactagaattgagcagtaccagtaccggcaaaaattgaaaattacctgtacccctcaacttttaatattataaagtatcacgtcgtctttttataaaatgtaaattttggtcaaaaaaataattttcttaatgatg

SEQ ID NO: 100494 - DNA, 363 bp, Heterodera glycines
  Promoter: Source sequence=SeqID_23423; Location=707..1069; Strand=-; Gene=SeqID_54127
tagtgcttgttatcagtcagttgcgatttctcttccataccatattaaaatggtaaggacagcagaacattctcacaggcaacccatttcagaatttttgtttgtcaaaaaaattactgacaataattctctggtcgatattcaattaataacaaatcgctcattgtttatttcaacttccattaaaataaaggttatatttcagcgcagcgcaattgatcgagccaaccgggcagaaattaacaaaataagtatttaaagtttcattcttataatgctaaaagaaattaagaataaatctattcgttattgaaatttatttttaattaacctaatttcattaactttgtttaagtgaagatg

SEQ ID NO: 100495 - DNA, 127 bp, Heterodera glycines
  Promoter: Source sequence=SeqID_20279; Location=1311..1437; Strand=-; Gene=SeqID_85080
gccaaaagcataagagagccagccaattgaatttgaatggcatcaactgattaggaatgccatgatcaaatgattagaatgttcaagccaatctctgccaaattctcttcatcttatatccccaatg

SEQ ID NO: 100496 - DNA, 1003 bp, Heterodera glycines
  Promoter: Source sequence=SeqID_13061; Location=1232..2234; Strand=-; Gene=SeqID_76845
gttttcgacagcaatttagtcaactgtatttggctgaatatctctcataatgatggattgattgccacaattccatgtgcaaactcttctaaaagagcctcttttttcaacgagtttgtataaaaactcgaaaatgacaaaaattaatttaaataaaatattgcatgagttgcggaaaatgataactaattaacctgaccatatgtcaaatattcgctaatagcaatttctttttttttaataaaagttgcctttatgtaaaatttttaaagtgacatccaatataaatttcttatttcacagagtttatatttatgcaaatttaattttgaatattgtttgtcggctataaaagtcacaatgaaaaatctgtttccatttacaattaaaaacttaatttaaaaaagagcaaatggtaataattgaatatgataaatgacgcagaaatagtattagtttggcaatatgttttaccacgaattattttgtaaaaatggtcatatggtcaaggcaggcatactgtagacagtgaaaatcgctgctacagtaatacaaaaattgatgcatttgtacgctaagggatttcatcaaccaaaatttaaaaaaaattatatgtataaaacgcaaatatgcgaagaccagtgatagatttcaggcaaatttaacaaaaagcaacagattcgaaaaatgggatacggtaatgaacaaaaatgtatactgtaatgagcataacggtaaattgacgagatggggcgaataatataatttgtaatatttaaatggtggaagtgctcaacatatgaaatgggaacataacaaataaataaataaaacagataattagaattaaaacgtaacgcaagtgcatttgatacggtaaatgataatgtatcccctatttatcgtctaaatttaaaaaaaaaaaatttaaagttgagcaccatcacatttaattggtttaatagcaattaaataatacattaaatcaaatcagtgcggaatg

SEQ ID NO: 100497 - DNA, 243 bp, Heterodera glycines
  Promoter: Source sequence=SeqID_28274; Location=718..960; Strand=-; Gene=SeqID_58906
tcagcccgacaaaaacgcgaacaaattgcttttcagttgaaatccggtggaattttgaccaaattgtgatcagttttgctttacgcgaacaaattgcttttcagtcgaaatcctatgctttttttgaccaaattgaaatcagttttgcttttgtcgggttacgagttgcaaaaatttgcttgttttccattgagtcggttactaattttgtttttcatttttaagtgcttcgactattgcatg

SEQ ID NO: 100498 - DNA, 154 bp, Heterodera glycines
  misc_feature (22)..(22): n is a, c, g, or t
  Promoter: Source sequence=SeqID_2818; Location=1..154; Strand=+; Gene= SeqID_81774
gcagcaccggcacggctgcacngacgacaagcgatgcggcaggcaacggaccgccggctttgagcagtccacgctgcgacaacgtctgctcatcacgcgcattcagtggtcaaaggatctgaccattgtgtcggcggacgatgaagcggagatg

SEQ ID NO: 100499 - DNA, 523 bp, Heterodera glycines
  Promoter: Source sequence=SeqID_1951; Location=4175..4697; Strand=+; Gene=SeqID_76980
gactttttgcaaaaatgggcacttcgcgaaacgtgcaaatttaaccgaaagagaccgggcctcatcagtacggtgtctctttgggttaaataatttaaattaattattatgtgtgtttcggccctaaaccgtatacacacaaagccacagcaatcaagcaaagcaaataaattttattaagcaaaataaatatttatattggtttattttattttatttttaactaattattttgaatatcattattcaattttataatttgttagtagtatttttaaatttattttgagcttgcaaggctccaacatttgcattatctgtgtaaaatcagttacacatgtacaagtctaaacgttttccattggctaaacaatatagcaagataaggggaaggttttcttcgtctttgtggatttctctctgcttttgtacttgtcgcgaaatgacatagcaccccgaaaatgggggactgtgaaatttggcatttttattaaattttttaaaaatggggcatcaaaaaatg

SEQ ID NO: 100500 - DNA, 63 bp, Heterodera glycines
  Promoter: Source sequence=SeqID_40088; Location=1205..1267; Strand=-; Gene=SeqID_68520
gctgcaaaaaatgatttttttaggaataataaagagaaaaaataacttcaaatccaggaaatg

SEQ ID NO: 100501 - DNA, 149 bp, Heterodera glycines
  Promoter: Source sequence=SeqID_10237; Location=1276..1424; Strand=-; Gene=SeqID_46852
agtcccttttttgcatggtattccttttccaatgccacttcaggtttcttcaattatcgatgttaacgttgtgccggcaagccaccggcgagtgaaactttgtaaatatggcggagacgaccggaagttgggctttttcataagagatg

SEQ ID NO: 100502 - DNA, 1003 bp, Heterodera glycines
  Promoter: Source sequence=SeqID_14229; Location=750..1752; Strand=-; Gene=SeqID_78245
caatttttattcgaagccgaagccgaagctcgaagcccaaaaaacccgaagttttcgaagccgaagttttttcaaaattttttttaattctaaaatttttttcatcacataatttcggttaaatatcaaatttaatcaattgacgcagtttctagagcccaaccaacccttttcgataaataaatataatgaatttttttagcaatgtattttgtaaatttttatacttcttagaatattcacagtttttgagtcgatttaaaaaataaaggaaattttggagctccggcggtgccgataggcgccgccggtgaaaattttgaaatttttagtgcattgttaacagatttagtccaaaaatgaaaaaaattttgcgattttaattgttaaattttattaaatttctgtcgaaaaaaatgaatatttttgaaaattagaagaaaagcaactactttgatgggaactgacccaaaggaaacataatgaaaagagccgagagaattaccactcgaccaagcatgcgaaaaagcacaaataagcaaatagtttaaatatatattaattttaagtttaccaaaagtcaatcactagtggtgcattttcacattgaaaactcaatctttagaggtgtatttttcccgaaacttcgggtaaaatagccgaagccgaagcacgaagttcgaagctcaaaaaacccgaagttttcgaagccgaagccgaagtttcgcccagccctgatccgccggatcccgaccaaactcccccctcccgttacgtttcgggtatttcaccatgtaatcatttacccctacggaataaagaacgttatcacattgaacatcttaaataggggaaatgttaggccatcatattcaataatttgccaaataaaaaatgtaacaataaaaaaaaattaacgacagataatgatgtaattaagttttgattaacatcaattgtttacaataaaattgctgattaaggagcagcgtacaatgtgatg

SEQ ID NO: 100503 - DNA, 135 bp, Heterodera glycines
  Promoter: Source sequence=SeqID_12945; Location=1580..1714; Strand=-; Gene=SeqID_76698
aaacaacatgtttcaacgttttacttcaaaacccgccaaacgaaaattctgaaaaaaaattttaaaaaaatattaacaaaactgataaatgaagcaaagaaagcggaagagcccgggtggaaaatcgagaaaatg

SEQ ID NO: 100504 - DNA, 1003 bp, Heterodera glycines
  Promoter: Source sequence=SeqID_4596; Location=973..1975; Strand=-; Gene=SeqID_55030
ttctttcgctgtgcgcttccgctgccgtcgctctcttcggtaatccgtcgcccccccctcctccgcttatttccgtaattattttcaatcctccaatattacccccccccattcgtttttggccattcgtttgacttttctccgtcacttttggccattttcgccactttcgtccatttgcctttcttcgcgtgttctttcctttttcgaattgcgcacttcgctttcattttactaattaattaataagtttgatttccgtctacaaatttggcttttccttttccttctttggcttttgttctccgtgttaaatgttccttcactttttgtatttttacggcatatcttttggccaatcttttggcccttaaactctcaatgatctcaggtttttaataaccgaaattcaatcccgaagtatccccctggtctcgaaattattcaaaaccatttgggttttttgtctaatctaagatcgtttcacactggaagaatatagacattcggtttccaatcagctgaccgtcacaccgacaaagggcgtccgtctgtcactttccccccccccttttttggtaacaaatttggcatttttcttttaaagtttctccgcccccgctgcaattgattctaatcccaaattaaactcctcccattgtccgttgttttgttaatcgttctccgattgccaatttcgccaatttttcattaattcccccccccccgccgccgcttctcattttcattttgctcattcactttttctcggctttacatccgaattggcccttttcctttggctttcctcacagagtgcttttgttttttcctcgtccattttccccaaagaaatgcaaatttgaatttgaatttcaagttttttcccctttatttttcagtttcctcagactgactttttaatttcaaattcacttttctcctctgcttcttctcccccttcgggtttccttttcattttggcattttttttcctccaatg

SEQ ID NO: 100505 - DNA, 245 bp, Heterodera glycines
  Promoter: Source sequence=SeqID_38160; Location=911..1155; Strand=-; Gene=SeqID_67059
ttgtgcactatttcgtttcaaattgaatcatttttttttgtcttttgaaataaattgtgaaaaatatacaaaattattttcggttttaattatgctgtacaatgcttttaagccccgccgtgcggcggctccccttttgtgcactattttagtttttaaaattggttccggactttttggctttttgaaataaattgtgaaaaatatacgaaaattattttagcttttaattacgctgtacaatg

SEQ ID NO: 100506 - DNA, 1003 bp, Heterodera glycines
  Promoter: Source sequence=SeqID_982; Location=191..1193; Strand=+; Gene=SeqID_65461
attggttttttgagggccggcgatgccgataggcagcgccgtggcgaattttgaaatttaaggtctatttctaatagtttttcaccaaaaatttattaatttccgtgaaatttttattttattttttatattttgtaaaaaagattttgaaaaatattaactttttatgatttagtcaaggaaaattaaattttttaatttcaacgaaaggaagattggatttaatttgtcaataaattatgccaatgatgaccaatttttatgggatttttgtttaaaaaaccatattacctaatcacaaaaaaataaattaaaataataacgtcaaccggtttcgaactatgacagaaagtatttaagtgtgatgcacttacccactacacttccccggattagtcgtccccgctctttccccggtttgaccggggctccccccccccccccccccgactgcaatcaaatcgataccagagaaaaaagttttcacattgtttgccacaagtatgaatttatttctattcctatcaaaaattctaaaactcaaaaattccaaaaaaaaaccacaagtactcatttgaaaatttagccattttcagacctaaaagggaataaaatgaggctaaagcatatgctaatcctaaccaataaattttatcatctgctcaaaaaatcttaattaattaagcttcaacattggaacaaatctgcgcaaattttccattgtttttggtgactttcacaatggttcattcacgacgctttcgcccgccgttggtactggattttagcaattatatttttagttttttatttgaaaaattaaaaatttttgaatattaattatttgggataaattttgcgtaaaacaaatctttttccccaatttttgatagaaaagaataagaaagtaaatttaaaaaattatatactggattttatcgtggtgcgacatttgctggcgaatatttgtggattaaactgtctaacaaaggaaggtcctatg

SEQ ID NO: 100507 - DNA, 508 bp, Heterodera glycines
  Promoter: Source sequence=SeqID_6093; Location=3652..4159; Strand=-; Gene=SeqID_60307
ggtgagcccataaaatatttggttggattttgtaaaaagtaaatttgatttctaaatttttttaatttaaataagaaaatcctaagttttatttaatttaatactttttcaaataaaaaattaatttaaaatttaatatttttatgagagtttataattgttccaacattttttatatcaaaatttaaaaaaatgaattttccgattttttatgcttttttcatttaaaactaaatcaaattttatttttaatttttatattcaaaatacgagtcaaaaaaatttactattttgtgaacttttaatatttattagatttgcaatttttttagcattttttaaatttaaaaaattgtcaaaattttgaatttctaattgatgccttaaaaattatggataaattgtgggggacaaaaggacattcattttttgccattaatgataattagtttcataatgcaccgcaggctggcaagtggccgccgatgcgaacacggttggcgacatg

SEQ ID NO: 100508 - DNA, 157 bp, Heterodera glycines
  Promoter: Source sequence=SeqID_5680; Location=4153..4309; Strand=-; Gene=SeqID_58892
aaatcagaacaccagcgttgcgcgaaaaccagagctaaattttgccagtcaaaatcgctcacaacttccgcaatcacgcaattttctgaaacagaattagttggtggaacagaacgaagtgaaagatgaagatgttttcaaatgcggagccgtcatg

SEQ ID NO: 100509 - DNA, 51 bp, Heterodera glycines
  Promoter: Source sequence=SeqID_38083; Location=772..822; Strand=-; Gene=SeqID_67003
aaaaagccacgccgcgcctttttgtcggattgcgacgaatccaacggaatg

SEQ ID NO: 100510 - DNA, 363 bp, Heterodera glycines
  Promoter: Source sequence=SeqID_25413; Location=1424..1786; Strand=-; Gene=SeqID_56156
gaaaaatattcaataaattaaaaatatatttctattaaaatagtaaaatggtcaatgaaaaacgttacgctttcgaagcagacgtcgccccgtaagaaatcaaaaattaatatttatgaaaaagtaagacacaatacgtatttgctcaaaaatgctattttttttctttcacgacgttcaaattttgtttttattcgagcaaaaaagtttattttaagagccaaaaaggggccaaaagttaaaaaaatgaataatttttcagcttggtgccctcaatgccaccgtccacacaacaaatttgcaaggcgcgatatccttgacagaatttaagcctttgatgttgcttttactgttgaaaaaatg

SEQ ID NO: 100511 - DNA, 573 bp, Heterodera glycines
  misc_feature (14)..(14): n is a, c, g, or t
  Promoter: Source sequence=SeqID_10528; Location=728..1300; Strand=-; Gene=SeqID_73754
aattttcaaaattntttccaatttccttgtcacttatttttggtttttctctttttatttgccaaaaaatgctcacaaaggaaggtctggaggtgtccgtggagtttcggaatgaaatttggtgggtgcatagagcacccatgggttcttaagaaaagtggttttattttctgcgaaatgagtacgagtgccgagatatgacgtgccaaacttttttctatcccaataaatcgaataaacatttgcaccgttttgtgttgttcggtggtgcggaggttgtgcgtttggcgtttgtttttgcccccacaggttcgaatccctcttatgcaaattaatttcccccatcttatttttgcttttatgcaattgaatggccaaaaaatcaatcccactcacacccaaaaatttatttttcgtccccgttcctaaataaaatgtccataaatccctaaaatattctcaccctcctcaataaatatttttctaaatataatgaggaaaccccaaccaacgagcatgaaatattcttggccaaaagttttgcagcatcaattgaaaggtgcattaaaaatg

SEQ ID NO: 100512 - DNA, 187 bp, Heterodera glycines
  Promoter: Source sequence=SeqID_1401; Location=3167..3353; Strand=+; Gene=SeqID_73291
aaaacacaatcatttaacaaaatataatcctgaattattttattatttgaaaacgaatggtaaaaagaagagtttacgttgttaatgaatttgagtttgtattttaaaacaattggcatagaaataattttaaaataaaaaaagaaaataataaattataattagggtctccatttttaggcaaatg

SEQ ID NO: 100513 - DNA, 1003 bp, Heterodera glycines
  Promoter: Source sequence=SeqID_22259; Location=407..1409; Strand=+; Gene=SeqID_52930
gcatttgttgcaaaagtcatagtgtgtgtttgtagttgtgttgttgcaaaagttagagttgtgtttgttgttacggttgggcacctaatttttgtaagaatttcgaatctgaaaattatctttcaaatttaatgcttcaaaattttacatattatctaaatatttatatatatttccaagaattaaaaaatgagagtgtcttcattatcaacacctattaattagttaagcggcggaagagccgcttcagcagtccgctctgttttttgcaccaataacgggttgctgaaaattgggaagttttgcgggtaattaaatgaaggaacgaagaagcgacacaatgcttttggtttctgtttcatgaaaaccacaacagctattttattgacacccctcagcatttgtaatgatcttcaaagagtgactgacttaattaaacacacaaaaaacagctgcaattggttacattttatgggccataactactgaaaacaacaaacaaaatctgtcacacgacgacacaataccggtgggtgattgatattaatatttatatccccatattttttcctggactgggagacctgatattaacgaaaaacatatttattagctttatttgaagcatttaggatagaattctttattcgaatttccatatttctccatatttgggtatttaaaaaatcctctatttctacttagggtggaacataatttttgatacccaaattttttccaatttttaaaaattcataactccgttatttctgcgcctatttaaatgattctttttttattttgttcttcatggtgtcctctttttatattactatcgtttcactttttatttgattgatagatttttctgccttttttcccgaccatgccaaaattgaaaattggcccactaattttcgaaatttttatggtcaaaaaccaaagctgatataacaaaatcttggtttttctatacaatttagaccagtagattccgaatatg

SEQ ID NO: 100514 - DNA, 203 bp, Heterodera glycines
  Promoter: Source sequence=SeqID_18757; Location=813..1015; Strand=-; Gene=SeqID_83431
tttcggtggcaaaaaggtgaattgttttttagtgtttttaaaggattttgtgccaaaagggtgcctccaatttcaaagaatttttgcctaaaaaccaaattcggttttttggtgtaaaagcactcttttttagtgtttttgcttctttttttgctattttgtattcttatattcttgaaattttcagcaaccgctcaacaatg

SEQ ID NO: 100515 - DNA, 228 bp, Heterodera glycines
  Promoter: Source sequence=SeqID_3006; Location=2252..2479; Strand=+; Gene=SeqID_82727
acaaatccaacaaaaagtgattttgttgattatgtaatattttattaataattaaagacccgatttaaaaatagacaaatggtaaaaaagcacaaaaattgaagaataatactgaggaatttttaaatagaacaaaataaaaaattagaaatagatttttggtgttttaggccataacggctagacaaataatcagcaaaatgctgcaaaacggtcccaattaaaatg

SEQ ID NO: 100516 - DNA, 607 bp, Heterodera glycines
  Promoter: Source sequence=SeqID_14702; Location=499..1105; Strand=-; Gene=SeqID_78820
tagcaattaaattttattgctttgtttgttttttgaatcgaaactttccatcattttgaggaattttttgacacaaaaaagggacaaatattaatcactgaatctttcagcactcattggttaatgcaggttagttttcggctcaattttacattttcaaattttataaaatgccgaaaatgcctgaaattagacgattcgggatcggggctgggggtgaatgtcgggcttgtgagtgagagtttgtgggcagaatgtcagctgggatcaagaaaatcctacaaaacacagggactcgggatcgggatttgcataggttgattgaggatgaatttgtgaggtccgggttcttgaaagcagatattttgtatgtcggaaacctctcaaaggttcacattgtgttctaaatttccaacagggcctgaactgctttggggccgagttggaacaaatatggaaatgtaattgaattgatcaaaccaaacgatcagtatcagagaaaattgatcagttcagtcagaaattacagagaccgaaataagagagatagagagaaacaaagagaaagagagagacagtgagaaaaaacagaaacaaaagagaaatg

SEQ ID NO: 100517 - DNA, 1003 bp, Heterodera glycines
  Promoter: Source sequence=SeqID_7563; Location=652..1654; Strand=+; Gene=SeqID_65234
ttccccggcggcgcctgtcggcaccgccggacctctcccctcgcacattcagcaaattttttggaaaaatgtaccgcaagaaaaatttaaaaaatctgagttccaattttccttgagtaaatcatgattagggctgctaattttatgtaaatacatattttttcctggcttctccatagcctaatcagtaggaaaaacactttcttttttgtgtttgcaaacaaaagtttggacttttatttacatattttagtagatattttgcaaatttgaatatctgttagaaataaatttaaaattcgctcctatcggcacgccggcccccccccccaaaaaaaaacctttttttcttaaaaaattacccaaaaatcgctaaatttgattatttttagtcaaaatctgtgcaatttatgtcaaaataaatattatcaaggcgatcaacgaataaaagaatgtggagccaaagaaattattcataaaaaatattttttttgtgggatttttggagctaattcaaagcaaacccccgcccccgcccccgcgggggcggaattatcgtgcccccgccaccgcccccgcgactctgacccccgccaacccccgcccccgcgaaaagccacccccgcccacggggctcgaaccctaattaggaggaagagggacatcgttgaaataaggtaaataattttagtccgtcagtgtttggacttttttgatcagcacaaaaaattgggatagattggaatttataaaattttaggtggaatttgctatcattttatgtttgacaaacactttttccatcacatattttgtcgactcttaattaactcttcgctttcctcacgaacaattgcaaaaatttattgaagaaaatttgtttttaaagtaaaaagtgtgttttgccaaaggtcagtcggttcattcaacagaatattgaaaaagaactgaccaattttggtgcttattcagcagaagacttttgtccaccagcgtaaaaatg

SEQ ID NO: 100518 - DNA, 646 bp, Heterodera glycines
  Promoter: Source sequence=SeqID_1424; Location=535..1180; Strand=+; Gene=SeqID_73483
tctgctacaacgacgggagcgagcaacgacaagctgaatgtggacaaactgttcgaaaaaataaactttgaagtgcgcggtcacgacttcacagtcctcaagtcgtattcgctttttgttatggtgagtgaggacaacgtttatggaaaaggctctaatgcactttatgagtccaatcaattgacaatcctgggtttttatacaataactttgttcatgttcgaacaaaccctatctttttggtatcattcgaaagcacaaaatctaacgaagctaaaatatataaaatcgcagcgttcaggcaattaccaaaaaagatttgattaattaagtaattgctgattttcgtttgtaactttcttggaatgttagaattctcggtaatagtttagatggtatgacaccttttttgaaaaatttttcaaaagtcttaaaaacatgtttctaggggtttataggtacgctgagcacgaatctgacatccatttcgaccaattccgaaccctggacccgaattcgaacaaaaagtcgaaaattcatttttcatcaaaattcacattcatgcaactaaagcaatacaaatgcacgaaaagacgcataaagaaaataagacagactattcgcatgggtaaaactcagaaatatg

SEQ ID NO: 100519 - DNA, 782 bp, Heterodera glycines
  Promoter: Source sequence=SeqID_10887; Location=1868..2649; Strand=-; Gene=SeqID_74166
aaaacgctttgaacgcgccaaaatggtgagttttcgaaatttaaaaaaatacaagaaatttttaaaatttatatgtattcacagacggagcaggacaaaactccgccgccgaaactccgccaaaaaaaaaatttcaaaaatttttctaacctagaaatttctcaagaaaaaaatcatagaaaaattttttcttagaaaactcgaagaaaaaaattataaaaagtttccagcgatgtttttctaacttaatgatgaaaaactaagtttttttcaaaaaaaaattctaaaaaggatcctggaaaatttctttgaaatatatgtcttggaattttttaagaaaaaatttttctaaaaaaattttctagatttttttcttgaaaaatttctaagtttcccggcggagttatgtctcggcggaatttcggcggcggagttttggcgtgtaccgattcacagaccatcatatacccgttttgatttggcacttttcgagattaagattttcttgaaattttttaaaataattatagaattaaatattaaaagaaatacattaaaaatcctttcaattttttatattcaacaattattttatgaaatcttttggtttcccccaaaagaaaaatttttttattgacggattgtagtttacaagaaacttttttcgagttttccaatttttcattttcaaatatttcttaaaatgtaaaaaatacttattcccatgtgtttcggttccatattttccattcttaaaaaaatcggaccaccctacaaatatg

SEQ ID NO: 100520 - DNA, 1003 bp, Heterodera glycines
  Promoter: Source sequence=SeqID_9796; Location=760..1762; Strand=+; Gene=SeqID_72724
caactgatcggccaatgtaacggttgggtaaaggtccgatgtttcctcgtcaacatacaaattggtgatgtcttaattaggtaattaggcaattagccagtttatgtaaattgccatcataaacacaaactcaagcgttgtccattcttcgtgaaaaaactacgatcattatttgtgtaatgttactcattaatgggggcggacacaacacaattaattggccgatgagttgggactgcaggccaatgatcaaaaaattcaccagcaggcgaacattttcacagttctacgaaggcatatttgtgctgaaaatgaaaggatttgagaaaagcatttcgccagtgttcagcacagctgccgctaattatagttaattaattaattatcagcccggcacagcgcctaatttgaaggtgtgtcagggggttcttggcttgtcattttagcatgtcaacaacccctgacacgccgatcaaattaggcgctgtgatcgtctgcctgctaattattaacgtcagctgttgctgcacatttgcgagatgtgctgctttcctcaatgttttcaattttcaataatataaagccataattaaacatcgttaaagcaacaactgctgcttgcctttgattactgctgctggtcagcgaccctatttaatgggcctttgagtgcggaaccgctcaatttgggcgccggcaaaatgatgcaaaatcagtgattgcccaaaatcattgcataaccctggggtgggggggtggactcatagtgctgcttgagaccgaagatttcctgagactcgagaccgagacctaaaaaaacccgagacttttctcgagtcgagaccgagactctcgagcagcactagcgactcagttccgtctgattgtgggccaaactttttcgggccataacttttttttagaatcagtcaaatttttacaaaatttgttgttatttgaaagttttaatatttagaatttcgtgtattgtgacaataaaatg

SEQ ID NO: 100521 - DNA, 226 bp, Heterodera glycines
  Promoter: Source sequence=SeqID_27869; Location=963..1188; Strand=-; Gene=SeqID_58540
tctagagtcaaaaaaataaatttataaaaattggagtgaccaaattagttttttttctgatttttccgagttggacattacctttaaacagcaatctgatcaacttatgcaatcaacaccgaaagaattcttttatttttaagaagtttagtttccattgataaacatagatgtatttaattgctcgttttaattttggatcaatggttttagaacagcaaatatg

SEQ ID NO: 100522 - DNA, 677 bp, Heterodera glycines
  Promoter: Source sequence=SeqID_10774; Location=1..677; Strand=+; Gene=SeqID_74030
tatcattcgaaagccctcagcatgctgtactaaccagcataatttagaaaaatgttgtaaaggttcaaaaaacattatgtccaacaatatgccaatccccggtttctgatgtactttcggtcagaagttcgttgaaaattaacgaaattttttgaaattttgtaggctagtagaggattcttagggctattgaatgatgtcaagaaagttggatttggttggcaatgaaaaaacttttagttcaaaaactaggctggcgcgaaaacgacctggcccggtgattttgagggtattaatcggctcaaaaattttttttaaaaacctaaaaaaagtttttaatgcgttgattaaaattccctaaagaattctttcacccaataaatattcgtatttacgggtttcccgccgggtctccgtccgaaatttttatattctaataaggttcgctagcatttgatgaatgaaaatcttaaaaattaagggactcacaaaatccgtaactaccaaaatttatccgcttttattcaatcgtttttcaattcgtgcattgtcggataacgttctcgaacaccaaattggttccattttagctatttaaaataaaatcaactatgattatgtgattaataatgttatttgcaaaaaaagtcttaaatgagaagaaattagaaaaaatg

SEQ ID NO: 100523 - DNA, 55 bp, Heterodera glycines
  Promoter: Source sequence=SeqID_32282; Location=1..55; Strand=+; Gene= SeqID_62594
gggtaattgtcgaatccaattacaaaacccccatgggagaagacggaacgccatg

SEQ ID NO: 100524 - DNA, 197 bp, Heterodera glycines
  misc_feature (57)..(57): n is a, c, g, or t
  Promoter: Source sequence=SeqID_12713; Location=1..197; Strand=+; Gene=SeqID_76404
cttatgcatatatgtagagacggaaatggacacaatgacgataagtcagattctagncgggaaacacaaagaccagagaacactacttgggatgcttcccttgcgacaaactcccaaacataatcaacaagtacccttcaacattggtggcgaataatgacccatcgaataaggaaggaacgcattggatagcaatg

SEQ ID NO: 100525 - DNA, 72 bp, Heterodera glycines
  Promoter: Source sequence=SeqID_38398; Location=297..368; Strand=+; Gene=SeqID_67219
ggtgactgccacaaatgccaatgcttttccatttttacttttagtgtcactttttcgacattttcggcgatg

SEQ ID NO: 100526 - DNA, 62 bp, Heterodera glycines
  Promoter: Source sequence=SeqID_2651; Location=1..62; Strand=+; Gene =SeqID_80892
tgaatgaaatctgccaacagcagaagcagaacaattgctttgcgaacactgcacaaaatatg

SEQ ID NO: 100527 - DNA, 686 bp, Heterodera glycines
  Promoter: Source sequence=SeqID_11092; Location=1..686; Strand=+; Gene=SeqID_74425
atcaaatgtccttcaatgtcactttcattgttgtgatcggtgcttgtctgctgctcaaagtctaatattttaaattaaattcaatacggaggatttgagggtgactgattctgagaataaaattttgggatttttgctgcaagcaaaaaaacttaacaaatttggcactaaataaccattttacgtggtttaagtcaatatttatttaactaattataaggcgtttgagcgctggtggcgccggtaagcgccgcaggggaattttggtatttaatgcgaatttttacatttttatagtcagtactcagaatcagaactttctgagaagcgaaaaattctaataattcagaacatatggaacccctgctgatattatcgcatatttaacaaaataataaaaataaaaaattgatgaaaaattaattggccaacatttttataatagcatgaaaattgaagtttagttaaataatttataaaataaaaattattttggaattgttactttttttaccacaattttgatggatttttcgcatatgaaagttaagacctaccaattttgaactgagagggttacggtatcaaatcccaggcgatctaccgttatcattaatcatacaccaatcacattgttaattttttttatacatttgttccagtgccaaactcagcagcagacaatg

SEQ ID NO: 100528 - DNA, 195 bp, Heterodera glycines
  Promoter: Source sequence=SeqID_21473; Location=2186..2380; Strand=-; Gene=SeqID_52085
ttaacttaaaacatattatctctttatttatattaatttttaaataatttttcttaatttttcgaaaaggaagaaaaaagaattgattaaatttttttattgaataattcaattcgtctttaaattcgaataaagaaaaatttatggcaagagagaaaataaaaataaataattaaataaaatttaagatttatg

SEQ ID NO: 100529 - DNA, 161 bp, Heterodera glycines
  Promoter: Source sequence=SeqID_11869; Location=1248..1408; Strand=-; Gene=SeqID_75365
atctttcgtcgaatgcgagcagcatttcgacaggaacacggagcagcaatcgatcgcaacgcgtatgttggcgatgcggtttgagccattcgtcgaggaattgtcgacatgaaaaaaccgtttgccgaaagtgcaagaagagtggccacttggaaaggatg

SEQ ID NO: 100530 - DNA, 1003 bp, Heterodera glycines
  Promoter: Source sequence=SeqID_5334; Location=612..1614; Strand=-; Gene=SeqID_57709
tgatttgctccttttatttcgatgatcatttgattatttgcttattctaaaaataactattaaattctctcatttttatttacgttctttttttacttaattaacaaataaatttttcagtttttttcaagttttaattgtttaaaatgatccaatttccaattcttccgctttgtttctcatttgcacaaactcacgcaatttcttccggcattaaaatgaaaagcggcgaacaacaaacattctctgctgctttttgctttatctgttcgtttatttcattataaattcggcttcctctcaaaatgaatgtcgagaatatttattctctataccaaaacatttactttttttttataaatccgccaaaattatttgcccggagctttttttaggatttgataccgattctatgtgatcggtcgtccaaaaaaatcttaaaattcaaatctcccatttctctatgtttttctttggcactttctccccccccccaatttctaatctctcaactttcgcctctttctcaaattcccaagtggtcggttcatcgtccgtctgctgctgtgcccttatttataagttatccctcctcaacccaaattttttcccgtcaaatttggccggcttaacccatccatccccgggggcatttgatgtgtgctctcggggcaccagtaaattcattttacacattttacaagaataaaaacggaagtttttttttctatatacacactaagaaataaaatttgtgaaaacttcgcaaatttatttatttgaattttcatagaatatttgtttattgaataaatattttatttaacaaaataaaagttgaaaatgccacgttatttcctttaatccctccgatgaattcatatgctctttaaatatgcattactttttcatttttacctgtctctattcctcaaactttgcatattttccaaattcttatcccaaaaaggaaatccaattccgctgaaaatgcataaaaatg

SEQ ID NO: 100531 - DNA, 757 bp, Heterodera glycines
  Promoter: Source sequence=SeqID_30523; Location=727..1483; Strand=-; Gene=SeqID_60942
ccaattttatagcgaaaataaaaacattttaaaataaaattaactgatgagaattacgtcaaaaaaaattgggggaaaaaagatagtatgaattataaaattggaattttaatgaaattttgtttttaattttaccaaaaacttgcctcttttacaacaacccaccctcaaccgttgctaaacaacatatgtttttcaaaatccacgcgatcatgactaaattttcaaaaaaacaaacaaaaatggcatataatcaataccaattaaaatagtaaataaaatgaattaactaatgcaattattttaggtatattgcctatcaattggtgatgttgttctcttctgtgctcgggccaggcaccatctttttaatggtccttttaattaacaattttatttatttatttttttgattttttttaaatttaatgttccttttaaaaattgttgtacttagggtgtaacataagtttccgcgcaattttttttgacaaattcaaaaattcataactccgtaatttctgcagttattttaataattctttttttattttgttcgtcagaaagtcttctttcatttcatgccattgtttcattttttatttgcttattcaattttttagtattttttcccgaccatgcaaaaattgaaaattggcccactaatttttctcgattttttatggtcaaaaaagtaacctgatataacaaaaaagaaggttttctgtacaaattagaccagtagaatccgaatatg

SEQ ID NO: 100532 - DNA, 587 bp, Heterodera glycines
  Promoter: Source sequence=SeqID_2506; Location=2900..3486; Strand=+; Gene=SeqID_80122
gtgaaaaaactttttttttgctcaattgttttgaagaaaggagctcaaaaaacgcatttctgcgttaaatttttttcatttggacgtcatttttcatcactgaaatcactattttggcgtttcgtcacttaaaatagtgaaaattctctttttcggctttttgtcactgttttttcactttttcgacattttttcgtcactattttagttaactatcgggatttttcgtcactaaaagttgcgaccctagtgattaataaaggaacaaaacacaatgaattaataatgaaagtaaacaatgttcactaatcattggctaaaaaaaggggggggggtcgcttcttttttgctttttcaaaccaaaaaatgttgtaatccgatttgttaacaaagattttgagcaaatttttaaggaaaatttggattttgtggtccggcggtgccgataggcgccgccggaaattttcaagcacttttttccacttcgaaatcggcaccggtactgcctttattctactattggcattaagattcgaattggagttgcaattggtcggcaacctttagaattgtcgcgcaaaacaatg

SEQ ID NO: 100533 - DNA, 1003 bp, Heterodera glycines
  Promoter: Source sequence=SeqID_21383; Location=1323..2325; Strand=+; Gene=SeqID_51996
aattaacgaaattcgaaatttaattaaattttgaaaaaagcaaaaaaaaaaaaaaacgtaacctaaatacccacatagataaaaatgaataaaagtcaatctttttatatagaatttatgacgcataaagttttgtccttgtgataaatttggccatgacacagggtggcatagtcagaattgggcacattgttaaatttcaaaaaggtcccaaaatggcatattttaaacaaaatttgtgccaactccccacacaaataaagtgaaatgtatgatgaaatgccgaaaaaatggacactaatttttgacagaacacatcggctggatgtcggtgccattagtggtggtgatgctaccataaattgaatttaaagacgaataggaagacacaaattttttgtgacatttcctttttcaggcttagttcccggtttatgaagaagaagaaaaaatgctgaaatccgatgcaaattacttttttgttttatttatttaaataaattaaataaatatatatttattttgattttttgccgaattttgtttatctgctccaaaatgcatctgtggaaatgcggagcttttgaaacaactaactgacaaaatgtaaaatatactgtgaaaatgggatactgtaagtttgtttcaatacaaattacgacaaagaattaagaatcatcctattacagtgtcatatttaaaaaatatactgtatcattaaagaatttttcacactatcttattttcagaatacattgaactttccgaaaataaatattagtcgctaattaatagattaaaaatgaaatttatatattttaatttcattattattgtggaaatccttcaaatttacccacgagtgtttttttccacattcgctgtttaaaaggttcaatagaaagaagaatcatcattcagtccacccaatgaagaaaaaaaaaagtgggacaaggacagaatgccaacaaggcaatgaaggatagataattggcacagaatg

SEQ ID NO: 100534 - DNA, 178 bp, Heterodera glycines
  misc_feature (22)..(22): n is a, c, g, or t
  Promoter: Source sequence=SeqID_22813; Location=1310..1487; Strand=-; Gene=SeqID_53519
aaaattcctaaaattgaccctntttggggtagaatcccccactgcttcaattttttgttgattaatattgatcagaagattgcttagataatttttaaattagcaatcattttgatcatttaatatattttttaattagttttctatttttaattgccttttttaaattttcagaatg

SEQ ID NO: 100535 - DNA, 430 bp, Heterodera glycines
  Promoter: Source sequence=SeqID_10104; Location=1..430; Strand=+; Gene=SeqID_73185
tacaagcaaatcgaacgcaacaattttacaaaattctctgctaggagaagggaaatcccaactgccaaaagtgaaaactatagtaagacccaaaatacagtttactgtttcgaatcataccatttcacatactaccaaattaccgaaagtaccaaaaacaaatttcaaatcaactgtaaaaccaacccaaaaaataaaactcaagggggaaatttcaacgcctaaaccaatttcagtaacggaaatgccaaaaataacacttactccaaatgttacagtaacacctactgtaaacattacggtacaattttcggagaaggcaattttttcaaacaaaaattctgaaaatgaggttaagataattacgccaaaaaatataaatgaaaaatttgaaaatgggactaccgaaaacattttgacaacgaaaatg

SEQ ID NO: 100536 - DNA, 442 bp, Heterodera glycines
  misc_feature (20)..(20): n is a, c, g, or t
  Promoter: Source sequence=SeqID_17008; Location=1..442; Strand=+; Gene=SeqID_81430
ttcacatacgcccaaacacntttggagaattatgacatttctttaagaaaaaaaaattaatcaaaaaatattcaagaaaaaagtcgaatgggaattattttaaaatgagctttaattaggagggaaaaaatttcaagcctctaaaaaactgcacgtgattaaatcataagcaaaaatattgtattgtaattgcctaattttttcaattaatcaaaatcagtgttatttaattttttccaggcgtggaattccctggtccttttttatcaaaaaaaaaaaaaattcaaaattatgcgaaaatttcctgggagaaaaaaagaattcaaaactttgacttttccttttgacaaaattccaaaaggggcgaaattgacctttgttaccaaaaaatatccttttgagactcgagaatgaatgtctgttttgatagtgcaaaacaatg

SEQ ID NO: 100537 - DNA, 558 bp, Heterodera glycines
  Promoter: Source sequence=SeqID_19964; Location=1370..1927; Strand=+; Gene=SeqID_84727
tgtgaggcgcgtaataagtgagtgtcaatggccaaaactaatcagaagccagcgccggcgggggcgggggggggcgcccagcggagtgacagcgccagcccagcgacgaaaatggacagaataaagaaaaagcaaatcccgcccccttcccctggggcacggacgtacaaaagcttgctgtgccgccaaacaatggaaatgcgcgaaaaaggatttattaataaattaataatatcggaactggcgattgaaagctaacaaaataaaagggcggagagcggcggaaggaaattattacaaatgtacaatataataataattgtgcatttattgaatttagcatttttgtcatttattgtaaaatttgctctttagaaatgcatgggattgcattgcatttatatatgccatcggaaaattaattaatgggttattaatttccgagtgcaataaatttttgagtgtcacacattccgattatcaattttgacgacttttaatacaaataattccaaaaacgaaattttttttagcctagtttcagtgtttcggagaatg

SEQ ID NO: 100538 - DNA, 159 bp, Heterodera glycines
  misc_feature (46)..(46): n is a, c, g, or t
  Promoter: Source sequence=SeqID_30695; Location=1..159; Strand=+; Gene=SeqID_61100
tcgctttcagtaaatgcatttaatcactgcaaaaaaacaaatattnaataggatgcgtgacagccaaaaatactgagccgcccatcgttctattaatcaaggacattcacaaagtttcggaagatctcttccgaccatttgactgcaccagacaaaatg

SEQ ID NO: 100539 - DNA, 96 bp, Heterodera glycines
  Promoter: Source sequence=SeqID_25839; Location=258..353; Strand=+; Gene=SeqID_56607
cctcaaggtttttatatttttcaaaaattggggaggaatttacaaaaaatcgcataaaatttgcaaaatttctacggcttgaactagttaaacatg

SEQ ID NO: 100540 - DNA, 224 bp, Heterodera glycines
  Promoter: Source sequence=SeqID_27485; Location=1082..1305; Strand=+; Gene=SeqID_58176
gatttattattgtcattagtcgtaatttcaaatgattaaattttctctttttgttgattacttttaacatttttttaaatttaatttttcaaattttagtttctaaattttaaaatttaaaaggaatttatgaaaatatttttcgttcattattcatcgttttctttcagctgtcatcgttttcccttttccatcctttcaattcaattcgatgtcaatcgatg

SEQ ID NO: 100541 - DNA, 426 bp, Heterodera glycines
  Promoter: Source sequence=SeqID_15726; Location=364..789; Strand=-; Gene=SeqID_80050
ttcagttttttttttgaatagcttttgaacacaattcgtctgatatttcgtgcccaaaacatcacaattgtccaatattttcttgatatgtttctcaataacactgaacagaaacaattgggaaaggttaaaaataaatcaaattaaaattattaaataaaaataaacaaattttaaaaatgctaagataatacgcattttggagaagcagagaaaagtgttcgacatgagcagatatgagaagaaaatggaggcgactgaagcggatttggagagtatcactttccaattggagaccaattttaaacaaaatgagttcaattttaattacagtaatttaccaatacttttttccacaggaattcgaaaatgaaatcggctattccttccaagaacatttagacaccattaggaagatcaaaaatg

SEQ ID NO: 100542 - DNA, 852 bp, Heterodera glycines
  Promoter: Source sequence=SeqID_2035; Location=6729..7580; Strand=-; Gene=SeqID_77433
agcttcggatagcgcgcaacaactgtcactacatggtgttgatgcgcaacccggccggcgcacttcagatccgcaacctcggcgcacaactgtttccgggcggggcgctacgctacttcttggaagcgtacgaggacgcaacggccgaaccgtttggctacctgttggtcgacatgaacccaaccacggagcaacagttgcgcctgaaaacgcatatatacccgggggaaatgtgcgtggtgtacatgccacgagcgcgcgcgaattttaatgcaaacgcttagagcaattagcaaacagcagtcgacaccgaaaaaaaattgaaaggggcggagccaacaacaacaacacattgaagaagaggaccgaagggtctggcgaggaaagacgaccagcagccgcaagctcgccccgtctcgccccccagtgcttagcgaacacgtgaggcgccacattgatttcttccgacaactaaaggcagcacgcggatcgcctccccgttgccaagcgctggtcgccggagccagcagcgagcagcttctctgccttgtggagagtgcactgaacattttacgcgcgcgtgtgcccatccaacggcgtcatctggcccgcctcagacagcgtgcgagcgacgtccgcacactgagcagggtgcgtagcacacgctccgcccgtcgccttctgctcaacgcccacgcaccgtcaacagcgcaaactggtcgtggcataccgcctctggtcgggttgctcgccagcgtgctggtgcccgtgctcgtccaacgcgtattcgagacaaccagcaatagtagctgaaaggcacccacacgcacgcttgcccacgaagaaacaatg

SEQ ID NO: 100543 - DNA, 746 bp, Heterodera glycines
  Promoter: Source sequence=SeqID_22726; Location=557..1302; Strand=-; Gene=SeqID_53416
tataataagtatgggatgtcaaaaatatgtacaaaaattggtcaaaatatgtacataaatatgtaaaaaaaaatcccgaaatatgtaagaaaaacccaaaatatgtaccaaatatgtaaataaaattttttaaatggttatttttttggaaaaaaaaattcttcagaaagggtgaaataggcacaaaatgtcataaaataaggtaaataggcgtagaaccagataagttatttgaaaaatcgatttttggttaatttttattttttcacaagaaattttataaattttcaaaaatgtaaaaaaaaaatatggaaatatgtaagaaaaatttgccgaagttttggatttttttgagaatttccaataatttctgcaaaaaatcctcaaaatatgtaaaaaaaaatgtatgaaaaagtccgaaaaagtccaaaatatgtactaaatatgcataaactcacgaaatatgtaaaatatgtataaaaccccgaaatatgtaaacatatgtaaataaaagtcccaacttttgttcgcaaacacaaaaaagaaagtgttgttcttattcctatttagagcatggagaatccaggaaaaaatatatttacataaaattgacatccctaataataagcactacttttgtcacttttgtcctttattctcacatatactaattatactcttaaataaaattgataatgtgcctaattatttgcaaagaaaaattgtgtgcttaatcattcaaaatg

SEQ ID NO: 100544 - DNA, 403 bp, Heterodera glycines
  misc_feature (128)..(128): n is a, c, g, or t
  Promoter: Source sequence=SeqID_28767; Location=1277..1679; Strand=-; Gene=SeqID_59339
aatttttaatccgtgttattattcgatagatctaagtgttctttatgatttatgaggggttatttcataaatattgtccgcctaattcgattattattggcataattttgaattctcacatttttctntgaaaatgatgtttaggttggacaatatttttatgaaatgacctaatattatgcaacaaattaacaattattggcatcattccattttggcatataaagtttcgagttttttagccataaattcatattatagtatttgatgaaattttcttagttaatgagaaaaattattaagaatttaaaaaaatatataattaaacagcctcactaaacgatttattgctattttcataatgtttttaaaattttatttctcataggacccaacatttatg

SEQ ID NO: 100545 - DNA, 346 bp, Heterodera glycines
  Promoter: Source sequence=SeqID_7981; Location=2176..2521; Strand=-; Gene=SeqID_66580
ttttggataataaaatttaaaaaagatattttatcttttattctatttatttaatattttaattttgttaccaacttttaaatttgtgaatcccaaaaattgataataaagaaaagagttaattgtatatttcataaattaaaacgaaaataattaaattaaaaaattgttatattgattgtggaaatcgattcagattcgtgtaattattatgaagaattgaaaatgttgcttaatttttgcctgaatttgcttttccattatttattactttttttattttgtataatataaaaataataattatattataaaagatttaacaaatttcaaaggttgaacaatg

SEQ ID NO: 100546 - DNA, 161 bp, Heterodera glycines
  Promoter: Source sequence=SeqID_4121; Location=2647..2807; Strand=-; Gene=SeqID_53261
gatttatagcatatatgtatatctcccgaatgtgaatcagtaaataggataaattatgtcattttcagtactacaaaacctttatatgagtttttttgtgccaaatctctctgacttgttcgttttaataaattttggaatttagaagcaatttaatgatg

SEQ ID NO: 100547 - DNA, 226 bp, Heterodera glycines
  Promoter: Source sequence=SeqID_2977; Location=1..226; Strand=+; Gene= SeqID_82603
atttttacttttgggaaattgaattcattgcataataaatgaatttattaatatttatccgctttttaatatgaatattcaattttgttatttttctcttcaacaaatcttttctaaattgataaatccattaattattagccgaaaaatcaattttttactaaaatttttagaatttttcttaaaataaatgaaataaaattctttaacgaaaatattaaaaatg

SEQ ID NO: 100548 - DNA, 870 bp, Heterodera glycines
  Promoter: Source sequence=SeqID_2717; Location=863..1732; Strand=+; Gene=SeqID_81236
atggccttttgaatttaatcccataatcatttaactcatttttcatttgccttttaaatttaactcaataatcatttaactttttttcatttggcttttaattacatacttatatggaaaataaaaaggataataaggagaggtttaaaataacgatttattttattgtacacagactatggtaacaaattaggcgaaatgttaggcttggattttacaaaaatttgaattcgtcatgcatatttaattaggaggaatatttgatcatacaaattaggacagatgttaggaccaatatttgaattcgttgtccaattattgcatatttaattcgtatgaatattaaatcatacgaattaggtcaaattcgcggcttggatttgccaaaatttaaattcagcgaccgatttgtacatatttaattatcaaatgcgtggcttgggttgatctaaatttgaattcgtcgtccgatcggtgcatagataattagggaatttttaattttgcatatacatcaaaattttgtcggtattaagtaaagcaaaaattcaaatttaccgacaacactaaacaattaaaatgggtcaagaattgtgattaattagattttttggatataaaaggcagtacgaaggttttccgttcataaaccaaattcataattcccttcaaatattgtttttatgcaaaaataaaatatattttaaattgactcatttgccccccccccaccctgctcttttcgtttcttaaaatttttcacatttactgtttacattttaccatattgcattattccaataaatttaaaaataaaattttgtttagcatttatccatatacatttatttattccaaattttaaaaatg

SEQ ID NO: 100549 - DNA, 95 bp, Heterodera glycines
  Promoter: Source sequence=SeqID_332; Location=9627..9721; Strand=-; Gene=SeqID_82788
tttttttaaagaatctgtaaaagaaatctaattgtatttatatatatatatatatatataaaaaatgccaacgaatttataataaataaaaaatg

SEQ ID NO: 100550 - DNA, 261 bp, Heterodera glycines
  Promoter: Source sequence=SeqID_12338; Location=1..261; Strand=+; Gene=SeqID_75937
ccatcccatcggcggattgtgatgggtgcccgagctgtcattggattagccacataaaactgctggtcaattagagttcgtaaacggagaattccctcatttttgcgggagtgcgattctcggggcacaaaatgccgcggggggaagagaagggaagggaagggaattcgttgcgttggccgcgggggcggcacattttgccaatgcgttttattatgtttttgtttgtttgtttgttgtctctgttcccttttctcaatg

SEQ ID NO: 100551 - DNA, 159 bp, Heterodera glycines
  Promoter: Source sequence=SeqID_14587; Location=244..402; Strand=+; Gene=SeqID_78659
gggatggaaaaaatgcttataaattttatgaggtttgaaaaagctggtttcttatatttacgttttaaaaacacacgaatatttgtttgtaaaaaaaactttaaaaaaatctgctttcaaacttcttgaaatttgtgcatataatggaatttccaaatg

SEQ ID NO: 100552 - DNA, 165 bp, Heterodera glycines
  Promoter: Source sequence=SeqID_22888; Location=1..165; Strand=+; Gene=SeqID_53596
cagaaggaaaattgtaaatagttaataacgtaatgaattctgttcaaataaaaaaatgcgtatttttcaaatgagtaaaaattttaatttaatggttatgtcctaaaataattttactaatttaaacatttatggttttaaattcagaaattaagaaaagaaatg

SEQ ID NO: 100553 - DNA, 574 bp, Heterodera glycines
  Promoter: Source sequence=SeqID_1359; Location=3352..3925; Strand=-; Gene=SeqID_73013
actgctcgtggacccacctttcgatggacgagtgatgtttttgaggcgaggacgcctctcgagattgttcgggggtgttggagattttaatttaattaagatatttgttttaattttaaattattatggcattttatctctatttattttatgtttgttgacctctttaatttatgtttggtacttttcacttctcattattctcattaatttgttttccaaaatttcctctctaaatttcgttctcaatttgcttcacattggtgatctcctcggacttcaaaaaaaaatattgtgtgtggctttgtcttcgtgtgtttggtctccaccccccaattcaattgaaggaaaacggtttttctttcctattttccgcttacagcagtttttttgatgttggcatttttgcaggtgtatattaacaaaaacaacactcaacaaatccatggactaattacaataaaaattattaccaatttgaacttttggcattaaatattttgaattttttttggacaaacatttaaaaaaatttcattttttcaaaggctcttctgatactgccatcattatg

SEQ ID NO: 100554 - DNA, 116 bp, Heterodera glycines
  Promoter: Source sequence=SeqID_4737; Location=1..116; Strand=+; Gene= SeqID_55570
gatcaaatgattaattcattgaagttaataatgtagagcgaaattcggtgcacatcatttatcaggcgaccataccatctcacaacgaaaatttcgtttattcggccggacaaatg

SEQ ID NO: 100555 - DNA, 244 bp, Heterodera glycines
  Promoter: Source sequence=SeqID_1624; Location=2830..3073; Strand=-; Gene=SeqID_74918
ccatcgtaaggccaacgacacaacagtagccaatgttcctgcggaagtgccgacctcaaataccagtgccgatggtctctcatctgccgctttaaacacagttcggacagaaatcgcaaaaagcgggggagtgccatctccagtggcgaaacaatcggcaaaagacgcaggggcaaccacgggtaattagggggttattctacaggatttgtaaccgtttttcaccaaaaaataaaatattatg

SEQ ID NO: 100556 - DNA, 791 bp, Heterodera glycines
  Promoter: Source sequence=SeqID_1167; Location=1..791; Strand=+; Gene= SeqID_69228
gcaataaaattacgaaatgcctcccgacctttagttgtttactgttttttgtgatcagcaaaataaaagttgcattttttgccattgttagcacctgttgctgacaaaagtccaaaagcgcgtccctggcctgcaattcgccctcatataaacacaacagctcgagcatttccttgctgctgtaaagcggtggcgactgcaatttctccacagagtgcgccgtatttttcattgtcacagaccaaggaacagcagcaggaaaggacggacgtgaagcaaaaacccgaaaaatttatttttttgactcgaaataaaatgcagatataatgccaaaaattggaaattttcaaattcaaaatttacctcaaacagaggtatgtaaaaacatatggaaaaattaaaaaatataaaataggtaaaaccccaagttcagatccagacttttttaaaatgtcgaactctattaaaatattcccagcggaatctaaacacacaaggcaattaaaacagaaaccaaaagtgcatttatttagcgttcataagaaagattcggaggtggacagaattttaaaattcctcgtaattttttacaagtaatgtgcaaagaacagaagcgttgttgatatgccgattaaagcatacctaattctttcattttttatttatattatcaatatgaaaaaacctttatcgatatgtatatgtcaaaattttttcccttgttcattttagcattgaatttctggtaattattgtagttgaaacacagcgccagtgacgcattgaccatg

SEQ ID NO: 100557 - DNA, 357 bp, Heterodera glycines
  misc_feature (227)..(227): n is a, c, g, or t
  misc_feature (248)..(250): n is a, c, g, or t
  misc_feature (258)..(258): n is a, c, g, or t
  misc_feature (280)..(281): n is a, c, g, or t
  misc_feature (288)..(288): n is a, c, g, or t
  misc_feature (290)..(290): n is a, c, g, or t
  misc_feature (320)..(320): n is a, c, g, or t
  Promoter: Source sequence=SeqID_10747; Location=4025..4381; Strand=-; Gene=SeqID_73994
atagagagagagagagagagaaagatatagagaggaagtatagagtgtgtgagagagagagagcgaaagaaagagagagaggaagtatagagagagagagagaaagagagagagagagaggggagagcggtgagaagttatgcgatacagactgttagaaaccgacgagagattactgacctacctagctaatgagtctctttcataattatgcaacaattaccctntaattccctatgatatgtaannntactttcnccaaaagtgtatccctttaatnntgtaacntnaattaagaatgatggcgttggcacagtgtntaatgacatcgcaccgcagatgatcaatggcaccatg

SEQ ID NO: 100558 - DNA, 1003 bp, Heterodera glycines
  Promoter: Source sequence=SeqID_8881; Location=920..1922; Strand=-; Gene=SeqID_69512
aaagaaacaaagttttattttagataggattgccattttttatgcaattttagcacattgactaaccatcgcccattttcgtgcatgttttggcacattgatcaatcatcgtgcatgttgaatgcctgatttactctaacaaataattccttaattcattaatccatttacccttcataaatttatttttcaccccaattcctggctttattttaagaaattggtgtccagttttccggtgtccaattttctggtgtccaattttctggcgtccaatttaccggtccccacaggcggggaatgattaaaccggggatcaccgaaaatgggaattcgtaaaccggagaaacgggaccctctaatggggaattgaatcaaatcttcaaacccatcttaactttatattcctattttgtgatttttacaattaaatccgtgccttgtgtataaataattgaatacctaattcaaatcattgtcttttaattttctcaccaaacaatgttccaaaaaatttcgcttcacattttgcaaaattcttctaattcttctaagaaattggtcccgtgggttcatgtttttttacataatcatgcctaagtaatgaaaaattaagggatcggaaattaatttataatataaatggaaaacggataattaaggttttaaaaagaagcaaattaatagagaaatttggttttttaaaatttttcatcaaaaattattaagaatattgatgcaaaaagaaaatttgaatgagtaatttgtaaataaaattttaaaatcaaaggaaggaaaacgaaaatagcatatacagaccaatggaaaaaaagattggcattggcatcatttccgggcaaaaaattttggaaaaacatttccaatttcaatgaaaataaacgattttggaggaatataaaagccaaaagaaagccaagcgaaaaacatattcgaattattttaatttaattaataatttccttttccaaaaacctttaaaatg

SEQ ID NO: 100559 - DNA, 675 bp, Heterodera glycines
  Promoter: Source sequence=SeqID_42406; Location=669..1343; Strand=-; Gene=SeqID_70303
gtaggattcatcgctttaacaaatagggcacattatgcttttataaataggcaaataaattttgttttatttttgtatattgttaaactttgaagaaattttcgctttttttgtataaattaataaaaattaattatttataaaaaaataaaaatgggaagatgcccaaccaattgcaaaaattcaatactatgaaaataatatataaaattttttacgtcacatgtcacgtttcaaatgatgaaaaaaaatgggtgaatggcataaaaattttctctgatgagttaggaagcaataaatcttattgaaaccgaaaaatatacatattacaaggtgagtgttgaaaaaatttaaaaaattcgaaaagcacgcattttcaaggacaattcagggatgtccgtaggtatttctagcggatccattttcaaggattgtccctattttctgaattgctttacttaatataatcaatacgtaaatcgttaatacatatgcacataattttatttgtggaaattgaaaaaaattattttattttaaaataagaaaaaatatacaaattatattacaatgaaaaaatttaaatgaaattaataaaatgaataaatattcaaaaattttagataaaaacactaattactaaaaaatttatttattttttagacaaattaaatg

SEQ ID NO: 100560 - DNA, 547 bp, Heterodera glycines
  Promoter: Source sequence=SeqID_32425; Location=201..747; Strand=-; Gene=SeqID_62734
tcgaaagtttttgggtgggactgtcgcgcgaggagtggcgccgaccgaacacagaaccattgagcagcagcagagaactctctaaaagctaacaattcggagacaaaattggcactctgccaactttttgggttcgtccccaaattggcattttttgttggcctggtcaaatgcgaagtgcgcaccaccgaatcatcgtcagttgtccgaatcagtaccaaacttgggggagaaaagtactaatagagaaagaggacggagggggaggggggctgacaaatgagaaacgggcaggccgaatttggcagccgtttttcaaggacaggtccggccgaggagacgaaaaaatcaaataataatcgaaaagaccaaaaaaaacgtaaaaaattacccaatgctcgcgtaaattgtaaagagcaaagtcaacgggagaatgtaccaaaccatcagattaacggaggacaccaattggagaacattaatgtccgacctttgggtggggaggggggacagatcaaacagttattctaccgaaggattaggcatg

SEQ ID NO: 100561 - DNA, 252 bp, Heterodera glycines
  Promoter: Source sequence=SeqID_44239; Location=1..252; Strand=+; Gene=SeqID_71750
acgacgggtaacggaggaaagggttcgacttccggagatggggcccgagaaaacggccactccgtctaaggacggcagcaggcgcgcaaattcacccactctcaacgcgaggaggtagtgacgagaaataacgagaccgatctcttctcgaggccggtcatcggaacgggtacaatttaaaccctttaacgagtatctatgagagggcaagtctcggtgccagcagccgcggtaattccagctctcaaaatg

SEQ ID NO: 100562 - DNA, 404 bp, Heterodera glycines
  Promoter: Source sequence=SeqID_10962; Location=900..1303; Strand=-; Gene=SeqID_74271
tttgtccgtctccgtcccccgcctcccccctccccccgaaagtgtttcggccgagtgcgtttccccctccgccgctctcctccgtttgcgtttcttctccgattcgtcgtccatcgttgtgcgtctccgcggtttgcggtctttcacatttaattactgtcttaattgtttctaagttcaatggagccgttccgcccaattttcttcggtcgatggctttttagaggcggacaatgtccgttcccaatcgtttatcgttgatggccttcccttgggccatgcgttcgcctttcgcgtttccttcgcctcaatttgggggtggggccctccggcaatggcagtgccgacaatgctacgaatctcaagcaagaaaagaacaaaaaaaggattgatgataagcaatg

SEQ ID NO: 100563 - DNA, 55 bp, Heterodera glycines
  Promoter: Source sequence=SeqID_29008; Location=564..618; Strand=-; Gene=SeqID_59576
gcgccggcaaaggcatgaagcggtgatttttgtgttggcactgaacgtgccgatg

SEQ ID NO: 100564 - DNA, 130 bp, Heterodera glycines
  Promoter: Source sequence=SeqID_13702; Location=1707..1836; Strand=+; Gene=SeqID_77618
tccgatcgcactccgaagggttcagctgttgcagcttatggccaaactcggcgaacaaagtgccgaaacactcaaattggagggggagggggaagcgtcatgccgtcatcgtttgtaccgtaccaacatg

SEQ ID NO: 100565 - DNA, 1003 bp, Heterodera glycines
  Promoter: Source sequence=SeqID_6116; Location=698..1700; Strand=-; Gene=SeqID_60419
acaaaattgattatgaattgactgactacttaaagttcaaaaagataatttaatacaggaagttccattaaaatttactttgattaaaatcgttataattatttattaatgatcgaaaaatctattggagaaataataatttaaattaatgaatggattaacacatcaattgataaaatttttaaatgaaattctttcatgtgagacgtattttattaaaaaaaattcaaaagtcacattatttttattttaacctaaacaatttttttaaattatgtttgatgattttaaataacttttacaatactttttttcatattttccaaaatttttatgaaaagtgaaggctttaataaaaatgttctattgatccacacaaatatatcaatcattcaacacgggacaattgctcattcgaacactttagaaatttgatcaacttttatttgtcgcttcgtttaaaaacaaaagtggcttcaaaataatatcgacttttatatatttaagtcttcttttcgtccatcaattatattttgtttgtaattaaagtttgttttttgatataaacgaaacatttaatttatattttacacaaataaatctttttaatgtaattttatgacggaattttttttctctttaagttgattattttgtttttttatgtttgttaaaggcactcacaaattaaattataggattttttgaattggattatagcatcaattgttttgtttaaaaggacaaaaagaagaatataatatttaatccaattacatttctgtgttgaaaaatgaacaataataaatatttgaatttaaattacgaataaataaatttttagaatatatttaaaccagtccacttttttaaattatcataatgttttaacagaaatcagcattataaaatatatttatagaaacaaaacttttttaacttttctgttcgttgtaatttttacaataaagcaaataattttttcccagctctgttgttcatg

SEQ ID NO: 100566 - DNA, 625 bp, Heterodera glycines
  Promoter: Source sequence=SeqID_2915; Location=229..853; Strand=-; Gene=SeqID_82321
tttcagcgtaattaacaaattcgcttataatacgtttatcgggtcccttctccgccaaaatcgttattttttctgccgatttagtgcttatgtaattttcttttaaaaaattattgttgtgtatgtttttgtagaaattccattcgagattgccttctttgtcagtcaaaagagtatactgttttgggccgtcttaaacaacaaagcacaattcatttttataaaattgccctattatatgatctttcaattttaatgctacattataataaacattttaaatcaaatataatcctcaccataagggccaactgcaaaaataattttatactggccactcggataaatgacatatctgctttctcccaccgtaattcattttttgttttctgattttctgaatcgaaatacgaatggattggttaatggtttatttccattgataccgaaattatctccaggatttttcaactgagtcatttcccaaacgcttgatcccttaccatttttggcgattattgttttgagtgtcaccaatactggcgattttattacgaaaattgtgcagttttctcaactccgaagaaagtcactgagttgcctgaaaattgtttctttagaaatg

SEQ ID NO: 100567 - DNA, 337 bp, Heterodera glycines
  Promoter: Source sequence=SeqID_12471; Location=1401..1737; Strand=-; Gene=SeqID_76099
tccggaaaataccaagtttagaaaatttgatttccactaatttgaaacactcgagaatggaatttttttttgtttcattaaatttgaattactcccgccgggtctaccgttaaaaatttatagcattttttacgggagttccagttccgttcccggaaagtttcggactcccgctcccgtaaatttttttttttaccagtttctagatttcgcttccgctttattttcttctattttaattttgatgcttcgaaaaaatcaatttgccgaattaaatattcgccacagaggaaattccgagcgaacacttgccacagtgcgacgagcagttcgaatg

SEQ ID NO: 100568 - DNA, 527 bp, Heterodera glycines
  Promoter: Source sequence=SeqID_24113; Location=1..527; Strand=+; Gene=SeqID_54815
gcttagtgctatcgaagaaatgaataaaatatttagttcgtctttgagcaaaaattatgggtaatttttcgtcaaaatttttcatattggtggttttttaaaaaacgactctgacccattaaaaataaaaagatgtaggcataattatcatggtgaacacttaaaaacaaaattacttgttaaaattttgtggagaataaatgtcaataattaaaattatgaggtgaaaaattctgccaatctttcggctctaacagccacaagcacgctggaaaaggtgaatcgtgcacccatttaagaggttgcactccttcaaagtacggctgttatcaagccgacgtcctgaagaattttaatttatgcgcaaaataagaatcaaggattatcgaaacaagtttaaaaaattagtttctcttatattggcacaaatcgctaaaattagtacaaattctgttaataaattgccactcggaactctgtttttcgaaattgggcctcttaatgccaaatttttccaggcccctatg

SEQ ID NO: 100569 - DNA, 287 bp, Heterodera glycines
  Promoter: Source sequence=SeqID_4434; Location=2770..3056; Strand=-; Gene=SeqID_54434
tcggcctcaagaaccgctgtatgaggccatattcgcttaacaaaaatttttacgcatagattttcattacggtatttatttatattgaaatacggtagataaattacggtactcagtgtgtaatattaaagtaaaaatagtaaaagtaaaattctgggaaagaatatttaagccttggccaaatattttgtcatggcaagcacattagctaatccgaattcaggataaaggcatttttaaatgttttaaaattggaaaaataaattggcattttgtctcacaaaatg

SEQ ID NO: 100570 - DNA, 338 bp, Heterodera glycines
  Promoter: Source sequence=SeqID_7684; Location=1522..1859; Strand=-; Gene=SeqID_65621
aaaatacatcagtggagtatgcggcagtagaaaatgcgtcagtgatgcaaatattttaaaataaaattctatggcattagtattgtaatatagaagtaaacttctataagaaaatcattctcaattgcgaaccccggacccaaactcgaataaaaaatcgaaagtcaaaattttcgaaattagtgtttttcttcaaatcggtttaaaaactgaaatacatcaatcctgcaataggagatcatttatgccgtttttgaacaaaaaaagcttaattcgaaaatttagacttgcaactttttgttcgaattcgcgtccggggttcagaattggccgaaatg

SEQ ID NO: 100571 - DNA, 527 bp, Heterodera glycines
  Promoter: Source sequence=SeqID_2977; Location=1706..2232; Strand=-; Gene=SeqID_82604
aaaatttaatgcaattaaagaaaagttgagggaaaaaggaaaatatcaacgaaaaaataacaataaaattgagatgaaaattgcaaaattactaggaacaaatcgcgcaaaaatatataaatggaaaaaaggattaaatttaaacaaaatccaaacaatgaaaaagaatttttatgagcagaaaaagcgcgaattcattgaacgaattgatgaatttaaaaatttatatgctcaaggcaaacagaaagaatttgtgaaggaattgggcatttctaaagacacattccgaagatggaaaaacgaattgttgccaaatgaccataaaagtaagataatttttttaagatatattttttattttttatataccttaagcacaaaagaactgtcccatttcgaatcttgcccaaaaaagttgtcatttgtatcttgaccgtatttttttattcccgagtcgagtttggttccaatgattcgagtcccgcggaactagttttgtagattttcggaaaaaaattggtaaaatg

SEQ ID NO: 100572 - DNA, 119 bp, Heterodera glycines
  Promoter: Source sequence=SeqID_20762; Location=1..119; Strand=+; Gene=SeqID_51329
attgaaaataaattttgacctttcctgaagaacgttgactcatttgccaatcacttgggaatgcccgcaaaggaatttgagcacacaatggtaactgagaaggaggaaatgccaaaatg

SEQ ID NO: 100573 - DNA, 569 bp, Heterodera glycines
  misc_feature (20)..(20): n is a, c, g, or t
  Promoter: Source sequence=SeqID_27318; Location=711..1279; Strand=-; Gene=SeqID_58000
agttattattatgttttttnttgtgttttttacacaccgagtcaattttgagcccctagttcaaaaagtaaatgcatatgtggcgaaatggtttttgtaagatagtaaagggacaaagggtggtggttcgagtccgttgtgcaacacgaatatttttatttatttttgtccaaaatattaaaaaatgacgatatttgggaattatttttgaagctttttcccaaccaaattggacaatcttagtatcattcgaaagctcttgatgaggagaagctttttctaagcaaatgctaagcaatttgatgagttagaaaaaagatatgatgcttcgaaattttattttttgaataactttttagaacaacatttaagctataaaaacaaacagagaaaacgatgcagaatttttttctctgtcgctatgcaaaatttgaagcgcatttaacataggacaaaaaaactaaacatagaaatgtaaattccgtttttctctattaacacagataaagaaatagtacgccaaaaagagagatgtttttttctctgcactctctctttattgacacatg

SEQ ID NO: 100574 - DNA, 418 bp, Heterodera glycines
  Promoter: Source sequence=SeqID_8952; Location=909..1326; Strand=+; Gene=SeqID_69791
tctttgttggtggttttaaagggattaaatggggatccccaaaatctcgccgagacaaaacctcgtcccgaaatttgtttttttttaaattttcaaaagatattttttctagcgtttttagagttttataatgaattactaatatgtattttcaaaaaatttttctaaatcgctagaaaatttttaaaatgaaatgtttaagattttttttcttcaagttttatttttttttcatttttaaagaattttgcctttttctaacaaaatgcgttgaatttttcaaaaactaggcaccgctggttccttcctcgctcagaaatttttttttttttttttgaaaaagcaaccaaaaatggttgaaatttttttatgatgctcaactcccctccgcataatttaaaaattctcttttggcatg

SEQ ID NO: 100575 - DNA, 360 bp, Heterodera glycines
  Promoter: Source sequence=SeqID_22014; Location=1838..2197; Strand=-; Gene=SeqID_52649
aacaaagcatgagaatgaattaattaacaaaagaatggtaattagtagacaaagcatgggataattttaattgtcaaagaatgagtaaataatgtttgcaaatgatatttaaaaatggatttagcatggataactaattaataaaattaacaaaaaatcttttcaactaaaattgctgtaccattaattctgcaatttgttttaatttttctgagaatgggctaatactgacacaatgttccaatttttgatgatttcttttagtttttccaatctttggattcaatttcgtcgattccaaaatacactgaccaaaattttccgatcaaattcgtcaacagcaggaatcagtcgcaaatg

SEQ ID NO: 100576 - DNA, 1003 bp, Heterodera glycines
  Promoter: Source sequence=SeqID_2295; Location=803..1805; Strand=-; Gene=SeqID_78974
attttcatataaaaacaccaatttaaaaaattataccccttgatttttttttgcgttttgcccaaaacttatgaataaaaatgtaataaaaacgaaaaataaccccctaagaatcgtccaaaaaaaatttcagaaaatatatcctactaggtcgttgcataaaaacttgccgttttgtcatttttacacgaatattgaaaaatttttggttggagaaaaatctgcttttatgttttttaaatacccctatatgtcctctataaaatgacaccaaaagtttttggccaagctttgttaatgccgagaaaaaaattcttaaaccggtttaatttgaaaagtgccaaaacggtttttccggttttaaagcggtttaacattttgaaactccttggttttatacccccatctaatgcccaagcttatttatttatttcttttcttgacaagaatcttttgttttaaaaattatgttttcaacaattaattaacttaattttgttgctttttggataaattttacgattttacacccctaaatttgaaacttaattattatttattgtcgaaaagtccccacctaaaatttataatatttctgtcgaatggaataaatccatatttggccataatcaatcgttttataccgtatcacaaatattataaagtgcccaactatgatataatttgaaattctctttttgttattaccaaatttttgttcactgcagaatttaattttgggtatttgtgcttttgttatttcagcttttgatgagtaattaaatgattaatgaataaatgattaattaattgtattcctttgtcgttccattttgataattatttcgaaatttgcgttaaacaaaagcaaaaatgttattaaattaacactacaactattcaaataaagcaacacaaaattgttagtcaaaatggaataatggaaacatttcttattaaaagaattgaaaaaatagcttaattccaattcgaattaaaaatg

SEQ ID NO: 100577 - DNA, 201 bp, Heterodera glycines
  Promoter: Source sequence=SeqID_17818; Location=602..802; Strand=-; Gene=SeqID_82349
atctctaactatttccacttttaaaattaaaataacaactttttaggaactttttctttttatttactatttcttacattgaaaatgtgtagaatattgtttttagacgatataaaaaaggtctgagtgataaatataatcaaattttcaaattcacttttcatttcatttcgcttttagaacggtgttgtgccacaaatg

SEQ ID NO: 100578 - DNA, 1003 bp, Heterodera glycines
  Promoter: Source sequence=SeqID_1359; Location=6301..7303; Strand=-; Gene=SeqID_73014
cccgggaccgggaaccgggaccgggacctcggatgaccgggaatttccggtcccggtcccgtggcactctaatttaaagttttcatttgacgaatggcactgacggagtaaagcttatacagcttcgtgccacaaatgaaacggatgaagcaataaaaaagccctatggcattgaattttggcttgcacatgacgggggaatttgtgacgaaaggtgggagaaaatatttgaactgttattgaattaaaatggcaaataattttttaaattgttaactttttagcgcattgggacatttgttgattatttttggaaaaacaaattaagaaaaaattttctgaaggtttggccttgtaagtacgtctcttcaaattccaaatcgcagagagtgtctttacatgagtttccggagagtttttttttaataatttaagaaaaattcaataatttttttatggtgtaaaaaattgttcggcgaagtcttgtcttgattcattctccattgttgaaaaaccgcaacaatagattaaaattaaaattatttttgtttctatctgaaattaggaagtgcgcaattaatgcggcacacttttccattcattttttcttgaaattgtctgtaaatgtcccaatgcaatttttagattactgatctgttaccaggcattgcttcaacttggcaatcaatcggaaactgtgaaaaactttaaagtgaaaagagcattcacaattagtgacaaaaaagtaatatataaattttaaaatttaattgcgtacaaattaaatattatggaaaggacgacattgccaaggaatgcgtggaaattgattgcttcacacccgtttgaaataaatttaaaataataattaataaatttaaatattttaaatatttatgaaaaaattaaatattaccattaaattatgatattcatttcacgggctaatgaaccgccgttgaacgtcgtcaaatcgttagaaccattagaattggtctgcatg

SEQ ID NO: 100579 - DNA, 177 bp, Heterodera glycines
  Promoter: Source sequence=SeqID_1048; Location=4181..4357; Strand=-; Gene=SeqID_66889
tcaatttaatttatgctttcttaactatagctactgttaatattcatatttatttaattttgtttaggttcgtttcggttttgttaatggcacaggttaacaattattttaattttactctttcaaattttcggcacttttccccttaagacgctttcccaacgctgcaaaaagatg

SEQ ID NO: 100580 - DNA, 740 bp, Heterodera glycines
  misc_feature (69)..(69): n is a, c, g, or t
  misc_feature (89)..(89): n is a, c, g, or t
  Promoter: Source sequence=SeqID_899; Location=1325..2064; Strand=-; Gene=SeqID_63491
aaaaatgcaggagtccaaatttgggagcgggattctcgtaaaaatcccgtctattttttatgggagtcncagtgagagcgggagcaatntaataatttattaaataatagaaatgtatttacctaatatttaaattttaattctttctataaaagacaaaataataaaaaattagtcaaaaatacgttaaatttttggtacactcccaaaaaattttagggaaggtgtagtgtcgataggcgtcgccgggtaaaatagagtacctagtttgttaacaggaatatttggcaaattttgtttattagtaccaaaaaccaaattttatttaataaaatgccttttgtagaggaaaaaatagcggtttttattatttaaaaaatttaaataaagttacgatggaaaaaagcaaaggtcctaggttcgagttctacttctatgtactgtgtgtaaactaagaaagacagtaaaaagtagacactaactatatagatcttacattttttacaaggaaaacttcaaattaaatttaataattttggcgttacgattaaaaaattatttttaaatttgaacttgagttcaaaattggctcgctgtgtgtttttatccaaaaatgatcaaacttcgtttttgagccaattttttgaggatttttggaaaaaatagcgatttttttggaaattatgtgagagaggtcttggagagggattataagaacaacgcttttcagatttacaatg

SEQ ID NO: 100581 - DNA, 93 bp, Heterodera glycines
  Promoter: Source sequence=SeqID_42721; Location=1..93; Strand=+; Gene= SeqID_70546
ttagtaggctagagtctcgctcgttatcgaataaaccagacaaatcgctccacgaactaagaacggccatgcaccaccatccaccgaatcatg

SEQ ID NO: 100582 - DNA, 1003 bp, Heterodera glycines
  Promoter: Source sequence=SeqID_5755; Location=2893..3895; Strand=-; Gene=SeqID_59130
acatgggaacattcaaaagctaattacaggcaattttcttagtaattaataattataaaagaatgccaaattaaaaaaagttcacaaaaattatgaaaaaaacaccaaaaattgtgacttttctgtgagccatttaattgcttagcattagcattttgaaaatttcttttaaacatttcgagtttttgaatgttgccaaaattgttagaggtttgaccaacaaagaaaacttcggctgagtcggagttttagccaacatcgacccgagagaaaaaaaaagtctaaggctttatccctacccctcccaattgcacggagcccccgaggggcagaaaagcgaatgctccctctccccatccaagaagaagccatccatgatgatgatgaggccaaaagcatagactgtgctctccctggggcgcaacgggggcagagaaaagggcacgggagaggcttcatctacccaaatgcatgagccctgctgaggggattagagtaggtcgagagtggcgagaatgatgaagccagaccagccgactgtctgtctgtctgtcactcaatcattgtgtgtctttatccctctgtccctcggcacatggttaccgtctcgcagtcccgaccgacccgcgccgcggcactggccaaaccctcattatttccattcattccgcttcaacgccatccatcactctggcactgtctgtgtgagtgtgtgccatcgatttgtggcacaagtagtgccccgcgtgggcgggattggccgagaagcattggcacaagaatttctcactcgccatacccccgctcccggacacatttccttgatgcttttaacttttgcatgagggacgaaacattcatcattgtttggctggcaaaataatatttttgatatatttttttgtggcatccgtccgtcgagagtctcgacgactacttgtcaaacaaaagacacacttttcacacaattcccccgagggaatgaagaagaacgagaaaaatg

SEQ ID NO: 100583 - DNA, 449 bp, Heterodera glycines
  Promoter: Source sequence=SeqID_16599; Location=1424..1872; Strand=-; Gene=SeqID_81009
ataaaagcaagcaaataaataaattaattgtctcttatgtatgtcatgggaatttttttttgggggggggggggaaccactttaaactactaccaaattctttagacaatctttcaattatcctaaaccaattggccaacaaaaaaaatcgagaaaaataaatgagtatgtatattatagaaggaatgaattaacaagcatttctgagagaaaataagcacaacaattgagatcgatcatttctcaaatacaataatattcatttccatacacttaatcagacgacatctttgttgcttctatccgcttcttcttttcttccatcactttttcttctgctgctcaccgcactaaaaaaagaaatgcgtatttttgtttaaggtatagtgagtaaacatacgcggctggagcggtccttctggcgttcaacgtaatccgattttgccatg

SEQ ID NO: 100584 - DNA, 286 bp, Heterodera glycines
  Promoter: Source sequence=SeqID_20291; Location=1..286; Strand=+; Gene=SeqID_85094
tgatttttaataccatatttagccatttttgaatggctttactttatattaacaaatttaaagaaatttttgggaaattataccctcaatttgaaaaatttatgtccatatttttgccattttatgtccatatttcgcgattttatatccatattttgacagccctagttatttatggccattatttttggccagcagaccattttaatcttccttttcgcatccctttcaaatatataatgaggtcaaaaagactttttcattcataatacatatcgcaaaaatg

SEQ ID NO: 100585 - DNA, 1003 bp, Heterodera glycines
  Promoter: Source sequence=SeqID_13082; Location=29..1031; Strand=+; Gene=SeqID_76871
gcttattctatcaataatatgcttaaatcataaaatatataaaaaaatacaattgtgaataataaaagtgcaatgcattgaatgggtaaaatatattgatggattttttgcctccaaataatatttaaaaataatatatttaaaataattattaattaattaaaatcatttgttccgtactgaaatgacccgcctcttctgatcacccacatcgatacttttgacacttcatcacagcacctttagctttgttgcatttttttaaacaaaggcaataaaaaaatgcatggtttaaaattaaaattaaactatcgtttttgattttgaaaagctcctgctggttaaaggagataatttagcagaagataggtcaacaatttgccttgtgcggtcggggggggcgaatctgtgcaatttcattttgccggtaaaatatttttgaatttctaaatttgccttgggcaaaaaagagtgaaaacgaacgatggcaaatggaaagaaagaaaatggttaaaacaggggcaaataatggagagagaaagggccgaatactagtgatgaatattctcaaacaaattatttcattcaaataaaataatgttaaaataattcattgaaaaataattaaattactttattatttattcatgtggaatttgaaagggtaaacccctaaaattcaactcaatcattacggtcactgttctctcaattaattaatacgagataaatgaattaaacggaaattttagggttcttttgggtttcgctacccacatctgaaatctttttaaattttattcgttgttgatcatgaatcagaaaccataaataaaaattttattatttgtttcagagtaacaaaaccaaaaagtaccatttttcatagagcttccactgctgcttattcgccttgttcccattgtgaacttgtaaattttctccccaattaagcccactcaaaaagaaataaattgataattttagacaatttctaaaaatg

SEQ ID NO: 100586 - DNA, 1003 bp, Heterodera glycines
  Promoter: Source sequence=SeqID_12654; Location=1658..2660; Strand=+; Gene=SeqID_76330
tgaattgttaagaaatgatcgaccaatttggattatggaattattgacgtgatcataaacattgttttcttttttgtaaattggactgttcatgtttggttatgttatgtcattatgatattttgtggttttctaaaacaaaacatacgcttcaattttcaatattttccccagcaaatgtgttggaatgatcaacttggatttgtgttattatgtcattaggataatttactgattttctgaaataaatgtgaaaatattattttggggtctgaatgttttcatatgaaaagttaggcccgtcaattttttattcacccaaaatggacagtggtgcactttaggcgtccaatgttatgtgaatggatcatttgcagtttaaatttggaaaatgaaagtctgtttcgatgtgctcattaaatgtttattttcaacatggatttatgcctgaattagaaataaatcccaaatttcttttcaaaatttcaggtgaattcgagagttggaccattcccgaatttgcccttcaatcgccccaccctgtcctcaagaatttccatttcagtagcagttccatgtcgttgtcgcagtgatgtcattatgcaaatggaatttgacctaattttaaattaattttttattaccacgactgttttgccaatttcgcaatccaatcacttcaaacaattaattccctttccctcttttcattcagtttaatgttgatgttgtttcatttcatttcgtttgtgtgttttctctcaatttttaaaataaaatccgccgtttcccaatttcacttctctttcaaagtgttgacaaaacaaaaacaccaaatctacacaaaaacgagaactattccatttaaattgaccatttgaacagttttttttctctttcgtttttataaaggaatacaagctaatttttcttaatttttttggttttactaagctaatttcaaatccgtctaaatctctcaattatttacctcatcaaaatg

SEQ ID NO: 100587 - DNA, 236 bp, Heterodera glycines
  Promoter: Source sequence=SeqID_11189; Location=430..665; Strand=-; Gene=SeqID_74542
aagagaacaattagttcaaattctggtctggggttcggatattacatattttattgtattttattaagggattttctgaaaatctggaaaataagcactaaatgtctaaataagacaataataggcattataagaatcttccaaatctatttctccaactatatattttttattctatcttttaattcataattttagcttcccactagtcttttaattacgggttctccaaaatg

SEQ ID NO: 100588 - DNA, 1003 bp, Heterodera glycines
  Promoter: Source sequence=SeqID_19; Location=887..1889; Strand=-; Gene=SeqID_76507
gggattgcctatttttgaacgctttttgcatgtcttaaaatgggtcaaataaaaaattgaatatgcctatcccctccattaaagtcttggctttctagtgatgtataaattgtcagggtccgggtccgggaagtgccctaaaaagggagttcaagcacttttgatcaggattttttcaaaaaaagaaggaaaaggaaaagggaattaaacgggtaggaggcaagcgactcggtggtcaagtggttagtgtgcctgcctttggtcatggggtgttgtgggttcgagtcccattaatttattggattttcccgtcaaatattatatttaaattatttggttttaaatttgtttttaatatttttcctataaaaaattttatgggtttataaaagagaaagacataataacaaaaatttggagcaaagtacttttggataaaaattgattactttcctttctttcctttttttatatgtaatgcacgctcgccagtggtctttaacctcgccttttcaataagcaaaaaatgttcattatcaattgtttccatttacatcatcagttttttactgctcctacttttattcaataaatatttccaactaaattattgctgttttaatagcataaatttttagtttttgcctttggtggtggtgggcgacggctcgggtcccacctattctgggtgttttcatccattattttattacattttttgaatgattttatttttttaaaattaattaagtttattaaaataatttattttaaatattaaaaataataattctttcttcctaatttagcccaaaaatctattgtttgaccttttttgtgcaaaatcatttaaaaaatggagacaaattaataagttacctaaacataaaattataaatattttatgccaaaaaagaaggaaagtgaaaaggaaattaaaaggaggcaagcgatccggtggtcaagtagttagtgtgccttactttggtgctggcttcccatg

SEQ ID NO: 100589 - DNA, 210 bp, Heterodera glycines
  Promoter: Source sequence=SeqID_2852; Location=1..210; Strand=+; Gene= SeqID_81941
cccgcgtcgtttcgtcccgcgtcatttcgtcccgcgtcttttcgtcccgcgtcatttcgtcccgcgtcgtttcgtcccccaagccaaaatgagtcatttcgtccccaaatttctttttatttataaaatatttagtttttaaagtgttaccactaaaaatttttctgggtttagttaaacaaatcataaatttacgaatttagacgtatg

SEQ ID NO: 100590 - DNA, 155 bp, Heterodera glycines
  Promoter: Source sequence=SeqID_13769; Location=2170..2324; Strand=-; Gene=SeqID_77695
ggtaccaatggacaattaaatccctttaaaatcatctattattttttaattgaaattcaatttctattaatttggttcctaattagatgagtgtgctcgctctctcggcttcgtccgtgccatgttcgaaattgccgcttccgccgcttcccatg

SEQ ID NO: 100591 - DNA, 473 bp, Heterodera glycines
  Promoter: Source sequence=SeqID_19134; Location=1..473; Strand=+; Gene=SeqID_83888
aggtcttcaaaaaaatttttaagatttttccttgggaatttacgttttcgagttaaatttcctcagtattaaaatcggaaaacttccgtcatttccctcgttttggttttttctttttataaatttacaataacaacgacaaatattttttttgactttaaaaattttcccgcgtcggaaaaaataaaaaataattgcaatttgcaacgtttcctaagaaataaaaacaataaaaaatgggaagcggaaggcggaagtgtggcgggggcggggaattcacggctcgtcctgggcgcttccccaaaattataaaatataaaatgttgccaattttgagcaaatacatatgaattttgaatgataatttttattttttcataatataacttataattatttttctctccgttttcgcattttccagcagagtttttgaattttatttgtctttttccattaaaatccccaaaatg

SEQ ID NO: 100592 - DNA, 174 bp, Heterodera glycines
  Promoter: Source sequence=SeqID_25277; Location=1..174; Strand=+; Gene=SeqID_56024
taattaatgattttttcaaaaattaatttactgacttcaaattatcaggcacaatcgctttctatcacatatatatatataaggcttgttcaaccgatcgggaattgaaaaaaacttaattttgaatccgattttggacaaaggcgcaaatgtcgggacacggagaaacccatg

SEQ ID NO: 100593 - DNA, 243 bp, Heterodera glycines
  Promoter: Source sequence=SeqID_10262; Location=778..1020; Strand=-; Gene=SeqID_73420
tcctcgtctttttcagttccgaatgaggtaaaaaaagaaaaaatggggccctaaattatggacgattttacttggttttgtgagcaattttttgcgtcttaatccggctcaaattttttttttattacccaaatggttcaaacttcttaatgaaaaaaagcattaaagttttagcatttcgctcaaaaagcctcaaaattttgcaaatctttgtccaaatttgtaataaacggcctaaaaatg

SEQ ID NO: 100594 - DNA, 137 bp, Heterodera glycines
  Promoter: Source sequence=SeqID_24439; Location=1..137; Strand=+; Gene=SeqID_55173
ttttgcgtctgtttctgcccgccgatgtggtgacgacgagagcggcacttgcgaatacgacgcggaggagggtgggcatggaatggcattattgttagtcattgttttcgttttccggcattttcacggtccgaatg

SEQ ID NO: 100595 - DNA, 171 bp, Heterodera glycines
  Promoter: Source sequence=SeqID_7360; Location=6673..6843; Strand=-; Gene=SeqID_64593
gataatttagcgtcataatgggatgtataagggcgattgtagaggaattggaagcgctaaaatgtttgaggagctttttgagcgtaattacgatttttacttacaccattttttgctaggcttagatcacatgcgattttcggcactctgataattttagcgctcataatg

SEQ ID NO: 100596 - DNA, 166 bp, Heterodera glycines
  Promoter: Source sequence=SeqID_29252; Location=163..328; Strand=+; Gene=SeqID_59781
ggttcaaatattattactattttgacagtgctgatcaaatgactcccaattctttttttaggacaatgaagggaaaaaaggcctcattttcgatagtcacattgacataacgccttatgtgtttttcttggagtctgctttaaaaagtaaccaaaccctgtacatg

SEQ ID NO: 100597 - DNA, 457 bp, Heterodera glycines
  misc_feature (40)..(40): n is a, c, g, or t
  Promoter: Source sequence=SeqID_5936; Location=1..457; Strand=+; Gene= SeqID_59726
tttaaaatttttttgaatttttaaaatttcccggttggtncccggttcccggtttttcttgcggtcccggtcccgaaaaaaaaatcgaggtcccggtcccggcttctcaggtcccggcaagtcccggtcccggttttggcaaaaattcccggtcccgtggcactctaataaagaaataaaaaaaaaaatagtaaccattttaagaatgccttttgcaaatgagaaaataaaacaaataaaatcaaatatttctttttttaactcatttttacgcaaaaactccagccatccaaatccaattataaattgcttaaattcaaacattcacttttaataaggatttttgcttcctatgtatctttttttaaatattaaataattatgcatttatattttttaccttttaatttatattaattatgacgatatttttttcctttagctttgtgagaaaatg

SEQ ID NO: 100598 - DNA, 147 bp, Heterodera glycines
  Promoter: Source sequence=SeqID_42001; Location=610..756; Strand=-; Gene=SeqID_70016
tttaatagaaaattgtaaatatttttgcttaaaattctttccattaccctgcaaagtgagcaggttaatgaaattggcctatagttttcgggattatttttgtcaccctttttaaaaagcggaaaaacaattgattctttccagatg

SEQ ID NO: 100599 - DNA, 207 bp, Heterodera glycines
  Promoter: Source sequence=SeqID_795; Location=1496..1702; Strand=+; Gene=SeqID_61499
gaaggtgtatttagagacataattaggttagataacgaagcaaaagaattttctttttctgcacataataccatggttgaagcccaaaatataaaaaataaaaaccctgataaacctggtgtaaatttttggcatagcaaattattagatggagttttaaaaattcatgccctatttgacaaaataaaaaaagaagaaaaaaatatg

SEQ ID NO: 100600 - DNA, 209 bp, Heterodera glycines
  Promoter: Source sequence=SeqID_28428; Location=1261..1469; Strand=-; Gene=SeqID_59054
aatcatccattgcccaacttcatggctttgaacgtatacgtaaagagagccagtcaatgtgttcattgcggagatcagcagaacttggagaaatatctaaaaaaataagttaaaatttgaaatgaaaagaatttaaatttctaatccaaaaaattaattttaaaattatttaatagatattttaaattttagtattaaaaagataaatg

SEQ ID NO: 100601 - DNA, 894 bp, Heterodera glycines
  Promoter: Source sequence=SeqID_38094; Location=592..1485; Strand=-; Gene=SeqID_67011
tgcagataaattgggttctaaaattatttgaaaataattccatttcatattttgcggcacaatactctaaatatgctttgtagagattttttttgatattgttgatgaagtggaatatttcgaattaatccaattttatgaaaatttaatagcattttattcgaggaaaatttttttgcgtccagaatttacggacagaactcgtctgtacggtccctttcggcccaactgtagaaacacctaacttaaaaggcgcataacaacacaaacaaacaaaaaatgtaaaacaaatatatttattttcttcgctaaattaataatataaatttattaatggcttgccgaaggcccaactggcaatttaaacataatcagagacactcaattagttttagtttttttatcattctgaattacatataaaatcgtgtagccaatccatgcttgtcggacttagtgttttgctttgtccatcgggcccttaatagctgttttatatttatatttcatgaaaatttttatcgaaaaaatattgtaatttttcatattttaatttaacaaggatctattaaattaattttatttatttaaatatcttaatttagtatttttttgcaggacatattccatattattatgataaatatttattattaaaattttattgtctttttctgagtctaagctattcgcaaaaactcagaatccttaaattaaatatgtaaaaattaaagtgttttttatttgtaattttttttcacatacatttgccggttctgagtcactttgatttaaaacaataattattttgtaaaatttttggaaataatgttataaattcaaatcatatcaatgatgtgttgccatttttcaggtaaaagatcaatcccaatg

SEQ ID NO: 100602 - DNA, 1003 bp, Heterodera glycines
  Promoter: Source sequence=SeqID_1017; Location=3618..4620; Strand=-; Gene=SeqID_66122
tgatgcgtcagtgagtcacacccaccatttactcattaattaattataattaattcgctcatttccattttttgctaatcaaattttgctgacagcccagtctttgctaataagctgtatgtgacagatgctcttctctctctttgttctttgttgtctgctgctgttccttttccctatcatttccatggcatataatgaattattatttttgcccccccccccccattaatgtgccattcacacgaaacagcgaaaaaacgcgaggttcgcccggtgccgccgattgggcaaaaattcttggccaacaaaatgtttggccacaaaaacttttacggtgccttatttatttgtggggcaaaatttgtgaaagcaaagaacaaaataattttatttaattaaaaaatattttaacttttaagttttttagttttaaatcaattagcaatagaaaagggctgcaacttttagtgattgaattcgacctgtgtatttttttcaaaattgaattcgtctaaaattaaaatttgaattttgtgtaaaaattttccgccattttatgaaaattcttatgaaaaaatcaaatttttactataaaattagtttttccgtctacagtttaagtttactcttttagaattatttagaaaatttcaagttgcagccctaaatacctatattaataaatcatttcaaaacatgtccaggaccaaacgagccccactcgtcgtaagttcttctcatcaggcattttttttctataatgccacacttttttggcatttacattaccacgacgtggtaactccgtctggccaactctgtctcagccagttttaagaatgctgctttacctttttctaagctccattgactcaaattttgccgtactgagttggcccctttccgattgattcgccatttaattttgctttttattttttatatttgcatttattgcgcttccttttggctccccactgaatgcgacttttggtggatg

SEQ ID NO: 100603 - DNA, 257 bp, Heterodera glycines
  Promoter: Source sequence=SeqID_5032; Location=1..257; Strand=+; Gene= SeqID_56651
tgccgaaaaacttcagaatggcccgaccaaaacacaatacgaacatgtatgcatatgcattttaatttgtcaatggctgacgcgccatatgaagaatcgaaatgatttttggcatcatgcatgaaatggtgcaggaaatggcgtaattattaaattttttaaatattcctcatgaaatgtatttcgactaaataagtaacagcccacttgaatcactttattgtagaaagaagctcaataaaatccatttgcagatg

SEQ ID NO: 100604 - DNA, 412 bp, Heterodera glycines
  Promoter: Source sequence=SeqID_7206; Location=1..412; Strand=+; Gene= SeqID_64137
aattttttttcaaaatacgcattatgtcgatttattttggcgtaagatgcatattttctatgaaattaatagctaagcattattttggatcaaaataaatagttgttaaatgaattcaaagctttttcccagaaaaatttacctttggaaaaaaaattcgaaattttttgttcgaattcgggtccggggtttggaattgagaaattcgacttcagtttagtgatcagcacccccgaaaacccccaaatactcattttgagctcaaataaaaaataataattttatatttgggacccccattctttacgattgccgtttatggcattgcccaatttataacaccaattttggtttattaaataggtgggacagacttttggatgaagtgcagcaagtgggcgcttacccgatg

SEQ ID NO: 100605 - DNA, 1003 bp, Heterodera glycines
  Promoter: Source sequence=SeqID_13633; Location=625..1627; Strand=+; Gene=SeqID_77537
tcattcaaaagttctacatgtttagaagcttttggtaaggtatttctaagcgattgaacaacttatgtataaaaaagttgcaacaataaaaccaaaaaaagtcagaatttgcatattttaatttataacttttttacatgtcggtaaatctttatgttttttgggaagccgatagagcttgttaagagctttcgaatgataccaactttattggatttggtcaacaaagaaaaaaaagttataattgcgatattagagacgaaaaatttcgaaaaatatgtagttaatcttgaaaatcggcaaattttaaattttcttgcatgagggtcgatttcgagtacataggtaggtgccaataagtactaatccaagctaaacgagtaacattcaatgatttcgttcatttgaacgtgcatcggtgagtacatattactaaatccggaaaaattcggatcagagagtccaactcaatttcatagcactttttgcatgtttttgatttttttctaccacaattttttgggtcggggtcactttggcgcgggacattttggcgccgcaaaataggtctaagtgttctctaatagcctgcaagatgctagaaaaatatattcgttttaacaaaagatatggcgtgctgcgcgaaaatggccagaaaaagtcagttttttaggtttttggccaaacttttttgtatctcaactagattttttgaaattttgcaggctattagcgactatcaagcgcttaaaatcacatcaagattttttaatttgaatgataaataaaaatgttatagcgtttggcgccaaaatggagagtcttgcgccaaaatgaccggttcccaatttttcaatcattctatgttagttgacaataaaataatatagaaaatttgcttattgtttagaaaaggattttgcaggacaattattttgttcatcattttgtgccactaattaattgaaaaagggaaaagtgtgctaattgaaccacaaaaatg

SEQ ID NO: 100606 - DNA, 147 bp, Heterodera glycines
  Promoter: Source sequence=SeqID_11787; Location=872..1018; Strand=-; Gene=SeqID_75285
ttctgatggctcaggcgcttctgctcattttgcccaaggccatttggtttttgttcatccaaaaaaatggcattttttgctcaaaatttccgttgctaattaattctttcattaggctttgccgtcagttttttgtttgacaaaatg

SEQ ID NO: 100607 - DNA, 193 bp, Heterodera glycines
  Promoter: Source sequence=SeqID_34298; Location=662..854; Strand=-; Gene=SeqID_64120
taatgtaaaaaatcaaagaatgtcctgcatttacataacgtgtcctaattttgaaaaagccaataaacaggcgaaaaattttctaattaacgtcatcaaatttatatagttaatcattttaataataacattaaacaaattctgccaaattgtgcattttatttttaaaaattagtaatattttaaaataatg

SEQ ID NO: 100608 - DNA, 91 bp, Heterodera glycines; identical to SEQ ID NO: 100405
  Promoter: Source sequence=SeqID_42721; Location=750..840; Strand=-; Gene=SeqID_70547

SEQ ID NO: 100609 - DNA, 1003 bp, Heterodera glycines
  Promoter: Source sequence=SeqID_40; Location=3906..4908; Strand=-; Gene=SeqID_55508
aatagagactgggctataattagagcaaatacggtacatgtctgaacatttgtggcggaagcattttggcgattatgacgccgtttttcaacatttttggtcccaagttgctgaattgtacccatgcgaaaattgatctaacatctccatattgtcgattttgggactttgctgtatttgattgtgttgaactttactttattttatatatattacgtgtttaactttgtagaatttatggattgttgcattttattagcagtttatcaatttagagtctaaaaatgagaaatgtgaaaattttgaattttcgacctttgttcgaattcgggttaggggtttgaaattggtcggaatggatgtcagattcgtgatcagcgaccccaaaaacccacggaaaattgttttttatgccttttaacaaaaaaaaatttatggggcctaaactgtatatcctgtaaaaattagtataaaaatggttgctcttcctccaccacttttcattattattttttccatttgccatttgtttattttcgtctctttcttacgttttttaggccattttttaagaaaagtttgaaattttggagcccggcggctaattgaaagtaccaaaatttcgtgtttttgacttttttgatttctttctcattcgtgtcgctacatttgcggactgacatgcttaagaaattttttgttaaaaaaaacttcaaaaaattcgtccgcaaatgtcggcttttctgctgatgatgatgacgcatcgcttaaatgaccccactttattcattttaattcttttaaatttaaattccttcgggcataacatttagtttctaaatgaaaacttaaatcgaaaaatgacagtgaaaaatagcaatgagactataattcttttatgatattttatgaaaatacctattcatttttatatgaatcttgaagaaaataaagcccatttaagtgccgaaaactgtcttaataatttgccaacaacaaaatg

SEQ ID NO: 100610 - DNA, 85 bp, Heterodera glycines
  Promoter: Source sequence=SeqID_19580; Location=1..85; Strand=+; Gene= SeqID_84318
tttctactgatccgttgtccaattgcgcgagacgaaagcaaatggaccaaatgggaagaagaagcgattggctggcaaattgatg

SEQ ID NO: 100611 - DNA, 267 bp, Heterodera glycines
  Promoter: Source sequence=SeqID_9985; Location=722..988; Strand=+; Gene=SeqID_73028
gtgaatcggcaagcgatcactcaccatttaaccaatcgatcgatttttcactttaaaataaaattttaaaaatgtttgaaaataggatcgctctacaaataaaataggaattcacaaaaataggtacaatcatcaaataaaatttgaaatatggaattagaagcatttaaagaatgtgggtgggcgctcgcgctatataaataactgcgcgtgtccccgtcggcccatttcactctgttcaatttttcaatgacgatcagcagcatg

SEQ ID NO: 100612 - DNA, 329 bp, Heterodera glycines
  Promoter: Source sequence=SeqID_15258; Location=1..329; Strand=+; Gene=SeqID_79471
tgcaggtcttcaaaaacaaacttggcattttaaatttttgaattttacctacttgtcttcctcaagaatgggcccagactaatattgcaattgtttagaaaatcggtgggaatttcgtagaaaaatgccatttcggtctcaaatttaaaattccaaccataaaatataaaaatgccaatattcagctaatttgtagaaatttgccgaaaaactcaaatactttctgcataaaataagcttcaaaaaatcgttttggactcgtaaaaactgcaatagagctgcaccctggattttctcattttgaaggcgataactcctcttttaatatg

SEQ ID NO: 100613 - DNA, 96 bp, Heterodera glycines
  Promoter: Source sequence=SeqID_2159; Location=1178..1273; Strand=-; Gene=SeqID_78159
tatttaggccttatatttttataattgcatccaaaatatttaaattaaaatttattacaatatctttcatttaggcaaattattatttttttaatg

SEQ ID NO: 100614 - DNA, 58 bp, Heterodera glycines
  Promoter: Source sequence=SeqID_11560; Location=1..58; Strand=+; Gene= SeqID_75002
ataccaccagacgaagagggggaatttgaccacatcgcttttgaatcatcgacgaatg

SEQ ID NO: 100615 - DNA, 1003 bp, Heterodera glycines
  Promoter: Source sequence=SeqID_5892; Location=1078..2080; Strand=+; Gene=SeqID_59592
attcgtgtgttacgcctgacccacagaaccggttcaatccggcaccaaatttttcttgtgccaatatcaagcatgccatgaaaatcaattgcatatcagggaagtgtcggaatccgattcccgaatttagggctatcgaaagataccaagaatatgtatgccttaatatttttcgggactagaaaaggaattgaaaaaaaaattagacgaaaattgtcatcaattctttgattggttttggcgaaaagtgtggccaaaagcgggggtcatcaaaggcaaaatatttatggccaaattgatgagcgaaagtgctataaagattggttgttgtaatagcacaatttcttgcaggaaaagcacataaaatgcaggcacacacgacgcacgcaaacattcattcattcaaataatttgttgtaataaaaatgattattgcaaaaatgatttttgttacaaaattttatggccaaagggtattataatatgtggccgaccaagcaaatgaatgggcagggaaattaattgttatgtggccaaaaccataatccaaaacacaacaatgaagtagggtttcaagggcccgatccgggtattgccgggtccagaaaagccgagtccggggtccaagtttttaaaccgagtccgggtccggaaatcgtcttcaatcagaccctaaaaaattactcattttttcaaaaaaataatgaaatatttcactaaatatttaatttatattttagattaattcaatgagcaaccaaaaatattttaagatttagtaaaatatcaataaaattttcaattttacaaagtggggaacatgaattgtgaagagtattttcgtaaaaattgaaaaaaaaatagaatttatgcacaatgaaatgaccatctgtgattatggagcaatataccgttattaggtgcgcttttttgcaagccaaccgaagaaagaatttgtgccagatggttttggtaaaagtataaaaaaaaaaactaaaaaatg

SEQ ID NO: 100616 - DNA, 507 bp, Heterodera glycines
  Promoter: Source sequence=SeqID_6923; Location=761..1267; Strand=+; Gene=SeqID_46329
ttttttctggacccaaatacttggaattttctttcataacaaatgaaagaagttagtatatatggataataaataatgtcttaacgtcaaaataaaagaaaatacaattttaaaaatggattaaattaattgagataaagcattaaatcaaagggaaagccaaacagaagaaacagatgaattttggattggtataagaaatgtgatgaagatttttgaaaatattttgcttttaaataaaacgccataaaatttaattaataaaatagaaaatgaaaaatagaatgattgagattgtttgacgacgtcattcaactaaatccaatcgataaacttaaaaattgggaggcattttctgaaaaaaaaaattcgaaaaattgaattataactttttgtacaagttcggtttcaatgttcagattggtcattaggcaaagggtccctccaaataacacgccctcaatcaacttataaagttgtatttagagacaaaaattatcgtaaatg

SEQ ID NO: 100617 - DNA, 1003 bp, Heterodera glycines
  Promoter: Source sequence=SeqID_8984; Location=482..1484; Strand=-; Gene=SeqID_69915
cagcattccaatcactgggactcaatccttcacttttcacggattcttcggcatcgcaatcaccgagactcagttctccgacattccaatcactgggactcaattatccggcattccaatcaccgggactcaatccttcactattccaaacaatgaactcaattttacggattcatcggcatttcaatcacgggacttaattcagacctgttaagcataattttggaattttaaaaacgtatttcaattatgaaatacaatttgcgtagaaaatccttttcattataaatacttgttctctttcattttaataatgcgataaatccatccaattaaaccgtatccagtaaaagaggcataattgacatccgctttaattacaaaaacaaaaaaactccatttcaaagtcaaaacaatttctcaaaccaaaactttttcaatacaataccaaaactaattgtaagatcatttccattgactttgcatatacaaaaacaattctttttctttcttttttacaaaaattaagagcattcatttccatatgcactttgctaatataacaaaatacttttctcttaacaaatgcaatagaaagcaatcatttctattacattattattaatataaaaactattttgtcattaaaaaagaaaaacaaaaaagtagacatttatttaaaattgtgctttttgcaaaaactgacaaaacaaaaatgaaaaaaagcaaaacaaacatttcttttttcaaatcgctgcccgtcaaaatgtcgccgcgtcataatgtcgccgcgtcaaaatgtcgccgcgtcataatgtcgccgcgtcgaaatgtcgccgcgtcataatgtcgccgcgtcgaaatgtcgccgcgtcgaaatgtcgcccaagctaaaaagagtcaaaatgtcgccaagctaaaaattagtgaaaaaactgaaaattatataattatatgccttcatacgatctgcttttaaaatttatgctttagcatcaatatg

SEQ ID NO: 100618 - DNA, 1003 bp, Heterodera glycines
  Promoter: Source sequence=SeqID_732; Location=1815..2817; Strand=-; Gene=SeqID_60014
aattgacacttttcggtatttgtcgaaaagtggacaaaaccgtgcgaatgaggcactattttaccagcttgtcgagccgaatataatggtaccgaaaatcaacaaatctgttcagtcttccacaaattcctatagtgtcaattttttttttgaaaaatcagtggtcatcgaaattgacacttacggcatttaaatgaatagatttgtgtattttcggtaccattttggccagaaatgtcaatttcaatattatatgattttatggcttggtaacctatttttactaatttgcagcatctattcgttgccctcttcgtttccaatttggtacatcatggatgtactcagttcgtcatgttcgacggcggtaccgggggggggggggtgacagattatattcaacgaattcactgtcgttcatttttcattgagatagtaatttgctgaaatatttgcttccttctctcggtccttattaggggtgcatcaatcctcgtatctcttgggtttagtttcccactcagtgttggtttttcgaaagtttaattcgtcttgtatgccattctaggaatgatttttaattgattccgacaaaattgcgtcctcgcgatggggtggggtgctgtaatatatttaatattcattaaataaaaaatttgggtcaggacgaggaaaacgtcggtatacagacagtactcggattcggtactcgatacaattgaaaaatatagggatttaaggcgagaaaaacatcgagaactgggattcagaattaggcggctacctagaaatagagttggctaatggtgtctgattttatacgatttctttttaaaatacgaagcttcactatggtctttttcatgtttttattttcatcgttagtattatttttctattgataaataattttatttttgcatctttcaaagttattttcttcatatatttatgatgcattattaaattggcttaatttttcatatatttagtgaatgaaatg

SEQ ID NO: 100619 - DNA, 56 bp, Heterodera glycines
  Promoter: Source sequence=SeqID_7465; Location=1937..1992; Strand=-; Gene=SeqID_64904
atagccatatgacaatttgcctggggcggtccttccctttgtctcctcccccaatg

SEQ ID NO: 100620 - DNA, 1003 bp, Heterodera glycines
  Promoter: Source sequence=SeqID_15155; Location=888..1890; Strand=+; Gene=SeqID_79349
ggtaccccgcccaaagccacgaacagcctaaatccttggaccgtcaatggttttatgcagactaaatgatttcaattagaaaaaaaatggcgaaaagtttccttgaacttgttagcctgtataaattattctatgtttaaagtgttcttttctaattacggtattaacaaaaaagcacaaccaatttcgctgacaaatgaattttttcgttactgcttgacttcactcgcattatgtttaaaggtacaattgtggtatgactgtatgaattacactttattccgcgttctcttcttcctcattccgtgtgctaattggtctcgagaccgtaccaaaatttaaattgaaaaggtcaaactcaagaactcggtcattcggcctctgtgcctttttctattttcgaccttcaccgcggtgccgtccatccctccaccgtttttgccaccatttcctcgaattggtgtgaagcttaatttgccgcttcggtgtaattttgtgcattttttacacttcgccgcctgccaaagcactgattttacgccattcctcctcatttaatgacgtacaaaagggcgtccaatgcaaagccagcgaaagatgagccacaaaaacccctcgggggggggggggggcggtggaggcaaaaaatgtactcattttgttgtggtggtaaggcgttgtcaacccttaacatttaaccaccaccaccaccaccattaccgcactcagtccttttatggcatttataggaaaagaggcggagagggaaggcacaccccggggaaggaggaggagggcatatcactttccatcaaaaaaaaacatttcacaaccaactgcttcctttctcgcacttgagacgccttcttaagtgagtcacagccatttttgcgaagagaataggcaccacggcaccacactccccccccacccaaaatgccaatgaatacggtccatccccacccaaaatgccaatgaatacggtccatccccacccaaaatg

SEQ ID NO: 100621 - DNA, 379 bp, Heterodera glycines
  Promoter: Source sequence=SeqID_32293; Location=840..1218; Strand=-; Gene=SeqID_62602
ggcttgtcaatccaaaacgaaacaacaaagatgctgttcttcctcgaataaagggcataggttattttgaagaagtgtcacataacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaaccaattttcgttgctctaattaaccgggataaaaacattcgaatcaattaaatagcttctgagataataaggtttatcataaaatttcaattaaaaataaaccctcaattattggtatgaacgatactttccaaacatg

SEQ ID NO: 100622 - DNA, 242 bp, Heterodera glycines
  Promoter: Source sequence=SeqID_5711; Location=3199..3440; Strand=-; Gene=SeqID_58992
ggtttagatcacttaaacgcgtggccggcgttgccagaagcgcggcccggaaaaattcaaaatttatttttatgaactgttaacattttgaaaattatatatatctctaattggataatttaaaaaatcatttaaattaggcgccccaaaaacgtttcgattggtgggctctgccgaagggaagtgcgccgttggattgtgctcgtctgtttgccaatgacgaagaatacattggcaaaatg

SEQ ID NO: 100623 - DNA, 179 bp, Heterodera glycines
  Promoter: Source sequence=SeqID_44107; Location=1..179; Strand=+; Gene=SeqID_71645
tccaatcgcctttatacatcgcattatgagcggtaaaattagcagagtgcgaaaaatcgcatggatttaagcctagaaaaaatggtctaagtaaaaatcgtaaatacgctcaaaaagcttctcaaacaattttagcgcttccaattccttctacaatcgcctttatacatcccattatg

SEQ ID NO: 100624 - DNA, 1003 bp, Heterodera glycines
  Promoter: Source sequence=SeqID_25745; Location=1084..2086; Strand=-; Gene=SeqID_56486
tttcgaactttagccctattttccttttcaaagcaaacggccaaaggaaatgaaggccgaaatgtgattaaaaacgactaaaatgacaaaggacaaatccaggggttttgattttttttactactttcaattgcaaattattatcactagggatttgtttttaggcaaatgcctaaaactacgctccaataagcatgaaaaacgcgttttggtatgaggtttctaggacctattttattataatgcctttctttgcctatttcggggggtttttattcttaatgcctagacgcctaatttgttcctaatttcaccattttggcgcttattttgaggcttttctaaaaaagccttaaaaatgcaataaaacgaaaaatatacccttgagaaatgatctgaaaaatttcagaaaatacgccacaaaggatgaaaaatttttcttcaaattggtccccaaaatttaaattttttttcttgataaaaatttttggtacaaaaattgttcttattcgaaaaaaaattctaataaatttgaatataacacttaaataagtttttgattagtttttatttcctttgctacctaaaaagcgttcataaacaattttattcccctattttatgcctattttgcgatttttgtgcttaaaagctaatccctactgataatataaaattctattaattaattatcggacagtgaggacaatcggacagaggtggacaatcggacagtggacaatccgacagtcaaatatacaaatagataagaaaatgccggtcgccgaaagggaccgattttgccatatcaagaaaaaaaaggaaaataggcaaataaattaattattttttgcgaatgacctagaaaatgtaaatgatgtgaaaatgcgatgataaaaatgtttgccaaattacttgcaagtaaaaatgaccattctcgtgcactgcacaaattaacacttccttttccttcgaaaattttcatttattccctcaaaaaatg

SEQ ID NO: 100625 - DNA, 277 bp, Heterodera glycines
  Promoter: Source sequence=SeqID_20435; Location=1873..2149; Strand=-; Gene=SeqID_50970
aaatattttcttaaaacattaaaaaaaaaatttcggggaccaataacctttaccattgccgtaattttttttatccaaaaccaatgggaggagaactcggtagtaacactgccgtttttgttttcaaaaaccataaaatgttttcggagttgctgatcacgaataatgcatcccactttgatcaatttctaactccgagccagaattggaaccaaaagtcgaaattttaaaattttggtcaaataaaaatatgtaaagtatttttagaacaaaaatg

SEQ ID NO: 100626 - DNA, 486 bp, Heterodera glycines
  Promoter: Source sequence=SeqID_1962; Location=403..888; Strand=-; Gene=SeqID_77037
agcatgaaagagaagaagatgggcttaaactcgaacaggaaaatgtcgctaattgtgcctgtctggggccatttggggtggcaaaaggcaatttgggcgtatttgaggctcatcaaagtgccgaaaaacagcgaaacaagcacaaaagtgccgaggtaaacagtgcgattcacttttgcatgccttaattttgaaattgcattttatatttaatgccaattcttaattcatttaatcaatttattaatgttgcaattcggcaccatttttcaaatgccaattggatgagtctgtccagcccggaaaaataaatggaaattttattttatatcattataaaaagaaaatgcctttccattataaaaagaagaaaatgcctttcccaagggccaacgggagcgaatataaaactaactattcgttctctggatcatcccaattttcaaaatcattgcgcataagtcggtattgcaaagatctgagatg

SEQ ID NO: 100627 - DNA, 72 bp, Heterodera glycines
  Promoter: Source sequence=SeqID_31469; Location=223..294; Strand=-; Gene=SeqID_61809
tcactattttgtttaaattctaaatttataatattcattaaattaaattaatttttatattctagaaaaatg

SEQ ID NO: 100628 - DNA, 452 bp, Heterodera glycines
  Promoter: Source sequence=SeqID_30534; Location=966..1417; Strand=-; Gene=SeqID_60952
tagtaaaattgagttaatctcgaccagagaaatcccgctttggttgggtccagttcgaaccagagacgatctcgggagtggaggggagcgggggggggggtaaaattcgtgagaaaacgacgaaaaatccgaataaatggctaaaaaattttttttttttcaagcgggtcgcctctccttaagccccgaaaaatcctaaataccaactaagaccgtcgctgagtgcttcttattaaaattttcagtctcaatttccccattaatcattgctttttagcacagattttgacatccattttgccattcattattattcagcagcgccaactaattttgatatttgatgaatttttctgtgttcacaaaacagatatgccggttcctaatccaaaggtttttttggttttacacaccctaaaaatccaaaaatttatgccatttttagatatatg

SEQ ID NO: 100629 - DNA, 1003 bp, Heterodera glycines
  Promoter: Source sequence=SeqID_3180; Location=802..1804; Strand=-; Gene=SeqID_83557
ggaattgaaattaaactactgaaaaaagggatttgtttgataaatgcggaaaaataatgggaacgttgggaagttggaagacgggggggggcaaatttgatgataaaggaattattggaatatggaactcaaaattttgccaaaaaatgtatatatgaaattatttaattatttcgaatgtttggaattataaagataaaagaaatcatttccaaacatttaaaaaaaaataattaaatttcacaaattttttttagaaagattaaatgaattaaaaattgtgcaatttatctcttaaaaaaatttaataacaaattgttgatgagaaatgatttttttaccataatttttcgtcagtaataaattttatgagttttcttaggtgctgaaactatagaaaacccaaaaaaaaaaattgcggcaaagcgttcaaacctgattttgaaccggttctaaacttaaaaaatggagaaatttgtggcacttataacttttttaaaaagcttgaacccagatatatttggtatcattcaaaagctcttgatgagcttatctctgcggatcacgcgcggacttcttccggagcccggagtctcgccccacctactgtagtcgagtgtgcgctggttaatagcgcaatatgcaaattaaacctttaaaaccaagccatttccaatttcttcagattttgaaccggttcagtaattagtttacacgctttgctatagacttttttggtttgttttcctatcattttcagcacctaagaaaacttcagttttgtgtgttttggtctggagactacaataaatattttcaattttgtttgtaatttagtttttagtccttaaataaaaaaaattttctttattattattttttaaattttattataagcctaagcctaggcctattaaataaacaattttggctaatttttttttataaaggtaatcaaatctgcgcaaatgccaaatttcagctgccccaaaatctcacgatg

SEQ ID NO: 100630 - DNA, 414 bp, Heterodera glycines
  Promoter: Source sequence=SeqID_36232; Location=1..414; Strand=+; Gene=SeqID_46457
tgacttgacattattaaatgaatattaaaatttctggaaaatgagtcaaatgttggtccctttcaaaaaatttttctagctttttaaatttcttgaaattttgtataggcctatattttgaccccctctagcgattccaagtttattttatggaacttaagtttttaactcgagatcggctcttcagttcttacaagggaaaatctcggcaaaatttttaaattagtggggttttttggcgttttgaatatatgtaatgagaatatccgaaattcagtttttttcaattatactttggaattattttttgtttatgtctcgagcacaaaaattagttacacaaacattttgcagacagcttttaattgataccacgaattagtttgtattgttttagatttgacaaataaaatg

SEQ ID NO: 100631 - DNA, 201 bp, Heterodera glycines
  Promoter: Source sequence=SeqID_4470; Location=1..201; Strand=+; Gene= SeqID_54555
atcaaccccaagaaagcatcaattttcctttcatccctctttgtaaagaattaccaaaagaggcaaatgtgtattcacatattttttgttgggcaatgattatccttttcggattgtccgtgatcagtctaattatctaccaatttcgctcaattctttggctaaaattcactttgacggaacggtacagtaagaccaatg

SEQ ID NO: 100632 - DNA, 335 bp, Heterodera glycines
  misc_feature (217)..(217): n is a, c, g, or t
  misc_feature (327)..(327): n is a, c, g, or t
  Promoter: Source sequence=SeqID_27562; Location=1..335; Strand=+; Gene=SeqID_58262
ttttaaaaaaacctgaaaatttttttaaaaatttttaaatttatttttttttttttaattttgggaggggatttttcccttcccaaaaatttgttaaaaaatcccaaaattttcaattttttgattggctgcataaatatgaaaatcggatttttttattttcgacattgttcaagtcagggttcggggtcggacatagctttccctaatcatcaantatgtaaattaaaaaataattttctttcagtggtggagcattgcattgataaaatcatggcgttcaattcggggctccccattgacaacatttactacagaacacaggcncaaccatg

SEQ ID NO: 100633 - DNA, 1003 bp, Heterodera glycines
  Promoter: Source sequence=SeqID_10435; Location=468..1470; Strand=+; Gene=SeqID_73634
aaactttattatttctattttattcattcaaaaatttaccaaatataataaatattttcaaccaagcattaccaattctaacattttggagaagaaataagtatatcaaacaaaaccagacttttatttttcatttttagtgcgttttgaattaattttgttcaccaaagtccaaattttgcgattttgaggacagtttttaagggggaaaaaagtttagaggattcgacgttggggaaatttttttggaaattttggctctatttgttaataaattttcataaataattgaaaaacttgtggaaatattttttgaaaaatattaaaaaataaaattgcgggattttaagtcaatcccatccctggtattaacaaaatttttgtgaaaagtaacaaaaaatcttcgataatttctagcgagatttcatcattagggggtgtatttttaaaaaacgaaagaaaccggtatcccagttttcggtttagatttttggcccaaaaagccggttttcggttcggttaaaggaccgtgacctaccctacaaaaaaggtcatttgcggacaaaatttataaacaaatacaacgaaattttacaaaaaaattttccctggaggcgcctgttgaagcagcggaccatcaaaacctaaaaaattttactcgaaattctaaattaaacatttttgatgaaatctgccaaagaagcaggcaaaatttatagttaaaaatccttaaatggtaaattataaaatattaaaaaagtaataaaaatattattattttaaaaagctctacaaaatcacaaagtctttgtaaattcacgtgaaagcgtattataagaaaagcagcaatttccgcaaaaaaggttttttctatgtttttgtcaataaaagccacgtccattaaggaaatgaaaaatggggtatttaagcgaacagaaaaaacaaaaatgacatcacatatatttttcattcattaattaaattaaatatattttttgccatg

SEQ ID NO: 100634 - DNA, 53 bp, Heterodera glycines
  Promoter: Source sequence=SeqID_39376; Location=913..965; Strand=-; Gene=SeqID_67955
ttctcaccgattgtccaccacttcgttgtgtcgtttacttacacaaaaatatg

SEQ ID NO: 100635 - DNA, 169 bp, Heterodera glycines
  Promoter: Source sequence=SeqID_10930; Location=1237..1405; Strand=+; Gene=SeqID_74234
gacaaagtgatgcaaacattggagcatttgtcacctttttgttatttgttttactaaagcaatacaaaacggtcccccctttccgtaaatttcaaaaaaattttcaatataatgacgttaaatttaattttacatgaaaaaatttaaggacctacatttaacgaaaatg

SEQ ID NO: 100636 - DNA, 338 bp, Heterodera glycines
  Promoter: Source sequence=SeqID_963; Location=3385..3722; Strand=-; Gene=SeqID_65063
ataaaactaaatgaattttggaaattgtttcaacgaaaatgattaaatgaaaagaataaaaaaaaagttgttaagttttactcatccctaaatgaattgcctgcccatttaaaaatgacaattcattaatttgtttttcgtatttcataaagcaaaaagttccatcaaataaaccaatgcccgaagatcaaatcgtacgattttgagtcaaatttcttaaaaacagaaaacactcgaaaagttttggaaattttatgaaatttgttctaaaaaataacaaataaaaaacaaatattttcaatgtagtcaattttcagcctaaaataaacgaacaaatg

SEQ ID NO: 100637 - DNA, 965 bp, Heterodera glycines
  Promoter: Source sequence=SeqID_32436; Location=1..965; Strand=+; Gene=SeqID_62742
cccaaaatacgggagtaaaaaaatccactggtaagaattgaaatttttggcaaaatgaataattttttgatcgaaaaactgttaaatatatacccaaaatttcaaaaaaaatttccggcggcgcctatcggcaccgccggacctttaaaatccttaattttcttaaaaaaattgctcaaaaaattgcaaaaattggtcatttttggacaaaatctgacaatgtattgtattcaaatataattttttcccggcggcgcctaccggcaccgccggcctccctcctcctccctggatcccaaaaagttttttcaaaaaatacggcgcaaaaaattgttaaaattaataaaggattcggaaatacaaagtttaaacctttttgttcgaataaattgattaaaaaaaattatttgaagcaattttgaaaaatttttctgattttcgaccctaaaatctattttttttttatttcgtttctgcatattataatttttctgtattttataaaaggattgtccttcaaatttgtgcattaaaaatttttttgtgggtatttaattaaattttcgaattactcccgctcccgcccgggactcccgttaaaaatggacgggagttttcgggagcgggagttttacgggattcccgctcccgctcccggaaaaatttgaactcccgctcccgtaaattattttttaccggtctctaatttttatacatagtagtcatatattgctcaatttattagtcgattttcacatttatataaacatagtcaccaaataggtctaaaaaattaagaatagggattggaatgacatagaatacaataagagcacacagcaaatagtgggcaacagttaattttagaatttctaggaaaggaaaaacaatccttgagaaaagcataaggggaaataaagaaggaatggaataaatgtcggtcccgggcacattccgtcacaatg

SEQ ID NO: 100638 - DNA, 313 bp, Heterodera glycines
  Promoter: Source sequence=SeqID_1472; Location=1437..1749; Strand=-; Gene=SeqID_46878
ccctaaaaaactatgaaatcagaaaaattaggaaaaaatattgcgggtctttaagcatggtttgtgctacatatatttcgacaaaaaatgccttataacctctctaaaaaaccttaggttgtaccagtctgaaagtaaattatttcgtcaaattataaaaaaaaaaaaaaaatcaaattttgggattctgcaatgacaaaaattccccccccccccattttccaatgccaattttttggtgttaccattgatggatggccccggtactcctcgggtttgggtcaatttttgcaatcttaatatcatcgcaatg

SEQ ID NO: 100639 - DNA, 1003 bp, Heterodera glycines
  Promoter: Source sequence=SeqID_25011; Location=664..1666; Strand=-; Gene=SeqID_55746
aaaagagaaaagagaaaaaaaaacaaaaaaatttaattttaaaatttcggccaaatgtttgaatttgtgttcggggttcggaattggccgaaatggatgccggattcgtgatcagcgaccccgaaaaccattggaaacatgttttcatgacttttgaaaacaaaaaaaaattctccgaaaaatgggggcaaccatccctactattaccggattgtttgttatctttaggtttctgcgaacacaatacatgcttcagaaaaatgataaaactaacattttcatagggcatggcggcggtgggcactgattgttagtgaattaaacgttgtttttagttttgtttagtcaaaaatcggtacaaaatgttaattgatgtattaattagaagcagagacgacaccaattctgaaaatgaatccatgaattttcttttatttgcaggacatctatttcagatatgaaaagttgaaaatctttaggcggaatctcggcgttttaatccaaaaattagaattatgaacgaaaaccctcaaaaaaatattcgcagctaaaaattgacgccttttaggaaccgaaaaaaatgattcagttcatccacccgttttgacttgataattgacgaatcccattttagaagtgaaaaatctggactaaaaagagacaaaatgtgaggcgaagacaattgtgttgtgtttcggtcttttggtgattcaataatgggaagagtagtgacattctcttttcaaatcctaccgtatgacaggttaatgagtttaaatttttaaaaattcaactgtcattttatcaaaccggtcagttcagtcgtgctgggcctttttaaaattttccgaaaattcacaattttttgatgaaaatctgctaaaaatatgacaaagttcacaatttttctaccggcggcgcctaacggcactgccggaccctctgttacaaaaaatgagaccatccgctggcgtccgttagccaattgtgcgttgactacatg

SEQ ID NO: 100640 - DNA, 440 bp, Heterodera glycines
  Promoter: Source sequence=SeqID_9817; Location=2961..3400; Strand=-; Gene=SeqID_72810
taatgatcagttgtgtgatcagcgcttctcatatcagtttctttttatttggttattttttcctatttttttgatcacaaactgtcaaaatatcgctaaaacgggaaaatttttattaaaaagattacttttttgggttaagaattttgcaccgtagttaacatctcacaaattcatagggccaccatcccaaaacgccatggaattttatattctttcaagggctttatcttttttccaattttttcatcaccctcggaatcttcgaatattttcttctttatatttttattgattaaagttttagtttttggtaaaaaattggttcatgtttcccttataaaatggatcgtgtttgatccgagggtctgaatctttatgaggaatacgactactggactctggagcgggaccgtaaattattggcttatgacccaatg

SEQ ID NO: 100641 - DNA, 66 bp, Heterodera glycines
  Promoter: Source sequence=SeqID_3786; Location=1532..1597; Strand=-; Gene=SeqID_51871
tgagacggagaacaatggcattgacaccgtttcgtcatcaccaatcaccactaacttgccatgatg

SEQ ID NO: 100642 - DNA, 55 bp, Heterodera glycines
  Promoter: Source sequence=SeqID_2750; Location=737..791; Strand=+; Gene=SeqID_47403
gtatttaaatattcattttcacattatagtatatattaataattgaataaatatg

SEQ ID NO: 100643 - DNA, 416 bp, Heterodera glycines
  Promoter: Source sequence=SeqID_36547; Location=844..1259; Strand=-; Gene=SeqID_65833
ccaaaattttgtcccacattttaaaggggaaagtccaagttccttattggacaaaaacgtgtcaataagcacagtcgcctttttccagttgtggaacggaaaaatgggaatatcagacggggtgcgctcttttctaaaaattcctattttcgtctaaccatccctccctttagtgcactatttcttttcaaaattgaatcattttttttgtcttttgaaataaattgagaaaaatatacgaaaattattatcggttttaattatcctgtacaatgcttataaccccctctgtgcggcgcctcccctcttgtgcactattttagtttttaaaattggttccggtctttttggctttttgaaataaattgtgaaaaatatacgaaaattattttagcttttaattatgcagtacaatg

SEQ ID NO: 100644 - DNA, 414 bp, Heterodera glycines
  misc_feature (50)..(50): n is a, c, g, or t
  misc_feature (54)..(55): n is a, c, g, or t
  misc_feature (61)..(62): n is a, c, g, or t
  misc_feature (65)..(65): n is a, c, g, or t
  misc_feature (261)..(261): n is a, c, g, or t
  Promoter: Source sequence=SeqID_29986; Location=1..414; Strand=+; Gene=SeqID_60449
tctaattggaggaatatcttttctattctttaagttctcacgagggaagngtannggtgtnnggnggggggtgggggccctaaaattggagaaaaatgaaaaaaaaaagatttgaaaattagagaggaattatttgatttttttgttgatgttttaaatttgaaaaaaaagtgtgtaggaataaaagatgaattaataattttttatgtgtattaaatgttgaaggtttttgagtgtatgtaataattaaataaatatttntgtgatttatttatgtatatgtttagattgaggatgttatagagtaggtgattaatggtggtggaagtgggaaggtgggtgaaggtggtggatattgtgatggtacgaaatgggtgattgagaggtgtgtagttgaagagggtgttaaagatg

SEQ ID NO: 100645 - DNA, 57 bp, Heterodera glycines
  Promoter: Source sequence=SeqID_7924; Location=1..57; Strand=+; Gene =SeqID_66397
tgttgggacgaactcaaagaagccaagagcaagactgaatttaatgttggcctaatg

SEQ ID NO: 100646 - DNA, 484 bp, Heterodera glycines
  Promoter: Source sequence=SeqID_1694; Location=479..962; Strand=-; Gene=SeqID_75340
ttttaatgactttgtcgataataaattaaagttagataacatcttgttcgttattatcagatatttcaacaattttcttctgttcagttattaatattaattattgatagccgtatttttatttatctatgaaaatttttttattttctcagtaattatttgatttagttatcacgcgttcaaaaagtaaaatatttttgctttattttgtcagttcaagtcaaattttttctagctgttgatccattcatttcttacataatttgatcattttttatttcaattatataatcttttggttttttgtcattttgtcatgtatttattcattaaaaaactatttaatttataataattttttcttctcgcattgcttctatttaattattattttcttatttgtagaagctttgatttcataatacttatatctttacagaattgaaccgccaaatcggaagtccatggttgagccgttgcaatg

SEQ ID NO: 100647 - DNA, 914 bp, Heterodera glycines
  Promoter: Source sequence=SeqID_14606; Location=1..914; Strand=+; Gene=SeqID_78686
tccacattaactttaaatacatttgcatgattctcttttttctaattccaactgctcatttccatttttgttgttcatttccttcgtccaaatgatgatatttgcattgttttgcttgtgttgtcgtacttttttgctggacaaacacacactctcttctcttcctgcgcattgccaaagtttccccccccccctctcctcctccctcttctcgagagtgcttcgcccaattctcgagaccggcgatcggacggaggataaatggacaccggcggagagagaagaaacggacggaagggacgacaaaaaggaagagaagagaaaaaggcattgtctcctcctccgtccgccccttttcttggttaaaaatatttcattttatttgttttgttttgtcgtcacatttttcgcgcatttttttcttttgcgattttggcgtattattgaaaaaactttgaattatttgtcatttttgctcaaattttttgttcctctcatcagcaaaatatttagtgggagagcgccggaatttgtttacatttattccattgtttggcttcaatggtttttgtccccgtgccttatattaattagttgcgaggtgtgcaaatcgtaaatgaatctcataatattttcacgtattaacaatgtgttgattttaatcaccattttaattaattaaatgtttgctttatttatttataattattttatttaattcgttttaaaatgcctttcttttccgccgctttttcctttttgcccgtttttctcttttccgcttctcttttggtcagtttatcaactgtttcgcttttgctcattcttcagttccttttcctcagttcgcttttgcttcggcttctgctgcgtcaccgccgcaccaaaagcagccccaattttcgcccgcaatg

SEQ ID NO: 100648 - DNA, 707 bp, Heterodera glycines
  misc_feature (98)..(98): n is a, c, g, or t
  misc_feature (136)..(136): n is a, c, g, or t
  Promoter: Source sequence=SeqID_4774; Location=1..707; Strand=+; Gene= SeqID_45898
aagtgcgctaattgactcgggcaatggcattttggtgagttttgcgcctcaccccaaatattttctaaaatttaaaaattttttcgttccgttttttnagtcaaattcggcccttctttctgagcccatttctccncaaaatgttccacaatttcgccatcatcccaattttggctcccgacgatcgcccacccctcccgccgctcataatcaaccaactcatctcagttttattgcgttctctgacacaactgttgtttgatcaattcatttattatttttaaaaaatatatatttttttctatacatactaccattaaataaataaattattgtgttctctgtttaaataaatccttatccaagctaaaactcgatcgcatagaaattttgacggtgtttcagttctctacttcgactgtcccttatgaagggtatgcatatttttgtagatttccctctctttctttctctgcatacaaaaaatgcacaatggaaagagagaaaaagaattaaggaaatagtgtgtggaaaagaaattctctatcgttgtttttcggtgtaaaagtggacagggacagtgaagaagagaaaaaaaaatacgtaatacatagttacctattatttgtccttatttttcgcgaggctcacaattggaaaagtattcaatactgtatgttaacttttattttttatgataaagcatg

SEQ ID NO: 100649 - DNA, 173 bp, Heterodera glycines
  Promoter: Source sequence=SeqID_1219; Location=141..313; Strand=+; Gene=SeqID_70090
tatcggcttttggaattttaatgagtaaatcagtaaccgtaaatgaaattctatgattctcttgttggatacacgggaagaaataatagttagtccttttgttgaatttttagaaattctatccgtcaaatcggcttttggaattttaatgagtaaatcagtaaccataaatg

SEQ ID NO: 100650 - DNA, 154 bp, Heterodera glycines
  misc_feature (60)..(60): n is a, c, g, or t
  Promoter: Source sequence=SeqID_8903; Location=1..154; Strand=+; Gene= SeqID_69587
caaacttaatcgggcattttaaacaagcacactaattcccgtaacacacattcaaattgnaaaaaagccaacaaagagcgcgtttaaatattcaaaaacagcgcttcaattgggaggtgtaaaaacaacaatttgggccaaagatcaccaaatg

SEQ ID NO: 100651 - DNA, 281 bp, Heterodera glycines
  Promoter: Source sequence=SeqID_21229; Location=1..281; Strand=+; Gene=SeqID_51820
aaaagaaggcatcaaattcctttttctaaatttcttcaattaggtttcttagatattggaaaaaaattttttttttaagagtagcgatttttaatgcttttttctatgtaaaacattaaaaaaggttgttaagaattttctgttttacgtgtcttttctaaatatttttcatggtctgctcacaaatgatgacgtggcagtcggaaggacagttcaccggcatgttcactataattatataatgtctgattattaatgatgatttggtgaagccgcaaatg

SEQ ID NO: 100652 - DNA, 70 bp, Heterodera glycines
  Promoter: Source sequence=SeqID_4582; Location=4155..4224; Strand=-; Gene=SeqID_54976
ggtggaaaagggaaaagcggctaacaaaaaaatgcaaaaaatcaaaatttaatcatgtcattagggaatg

SEQ ID NO: 100653 - DNA, 795 bp, Heterodera glycines
  Promoter: Source sequence=SeqID_10126; Location=1..795; Strand=+; Gene=SeqID_73216
tccaaagagtcatgctttttatagtatcgagaaaattcatttaatcaagaaatattttttgtgtgcgtcgaaaatgtggaccgaaaaacaggagttttggttggaaaatcggcaacatggagttggaaagggggaactaatgggcgggaaagtgcttaaaacaattaggcatttggcttttcaaaaaaaacgctgagaaattttttgaaaaactttttattggtttctaaattttttaatttttccgggggggactgatccggggtcgggcatgtgctgctcccgtttgtcgcgatggacacttttttatttaacggattttctttaagttcaatttttttttctatttttcttggattttcttttattttgattccaatctctgaatatttaaattccttttttggtataagtgacagaagttttggtagaatattttttttaataacagggtttcacgggttgagcgcacctcgttttgatttgcgacgtttcggtacagtttttttcagggggatatattttttttgaattctcattcctaatttcttaaaacgaatcttaaaaattaacaacgcccccttgtctggcaaatatttgaaaatttttattttctataaatataaaaaaaaaattatttttacctgaatttgaaatggcattgaaaactgtatcgaaaacggagcaaatcagaagcggggtgaagtcatggggctttcctataggctagcatcatcaaccgtcggcaaaagcaactgcctccgctgagcatggccagtgtcaatagcaataatg

SEQ ID NO: 100654 - DNA, 796 bp, Heterodera glycines
  Promoter: Source sequence=SeqID_16128; Location=1329..2124; Strand=-; Gene=SeqID_80491
ttattaaaattaatttcattttttaatttcggtcactttccccatttatcaaatttcacactgatttcccacatttaaaggcgctattctttaaacaaatgtgacttttcataaatttttcgctaacaattatttcccatacataaatgaatgaaataatttactgttaattgcttttcccattaagtacaaaatattgaattcagttttcccatcttctgagtttaaccattaaaataaaaggaaaaatttttttttcattttttgggaataaattataattgccaaccctctattttataatttcagattatttaaaacacatgagaattgaagcattaattgaaatgcaatagtctcaggcttaacccctaggcccatcataagcagtgagcgagtggggggagaagtttttggaaaatttgtatttgttaaaagttagtgttaattttggtaacaatttgctcagaatttattgggattactcgccactaccgcgatgacaaaattttttatttctttgaatgtgaaccaaaatctttttttggacacttttaaaaacttatttttgttcccaactacactcgaaacaacagaaatttgttggcattttttgtagtctcggtttcgactctcataggtcgagtctcgaaaagatgacaataattttgcacaaccttgatttaaacagttaaaatttttgtgagtttaatcacattgttactaattgaattgatcaatcggcataaatttttttcttataatttagctttaaacaaatctttaaaataaaatg

SEQ ID NO: 100655 - DNA, 56 bp, Heterodera glycines
  misc_feature (48)..(48): n is a, c, g, or t
  Promoter: Source sequence=SeqID_34542; Location=911..966; Strand=-; Gene=SeqID_64308
agcaaaagcatcagttgcacacacaaaaaaacaaaacaaagacacacnaaaatatg

SEQ ID NO: 100656 - DNA, 149 bp, Heterodera glycines
  Promoter: Source sequence=SeqID_5248; Location=105..253; Strand=+; Gene=SeqID_57451
ggtccgtttactggttccactcacaatcaacgcactcaacgaaaaatttatcatttaattcaaaaaatgactgtttaaatgttttactcaatttgaaaagatttttaaaggttttgccatctgtcgctgacattgcgcagcacaaaatg

SEQ ID NO: 100657 - DNA, 1003 bp, Heterodera glycines
  Promoter: Source sequence=SeqID_1820; Location=1700..2702; Strand=-; Gene=SeqID_76176
taatttttaattatcctctgttagctttccaaagatctccatcataattgcctataattggcggtttagctaaaacgcttttcacaggatttaatattttgaattagggttcggacccagtgggcgggggtggcttttcgcggggcgggggatcgggggtcagagtcgcggggccggtggcggggacacgataattccgcccccgcggggacgggggcgggggtctgatttgaattagctccaaaaaatctcacaaaaaaattaatttttatgaatgatttgttggctccacattcctttagtcgatgcatcgcctcgattcaattccttgtggcataaattacacagattttgtctaaagaatgaccaaatttattgatttatgctaaggaaattttttttatgaattttgttagaaattagccaaaattttcagaaatttcattcttttggatgaaaatacgccctaaaatcagaacagttcttagcaataagaacataaagaaaccctgcattaatcagataaaaataaattcaaatgaaaacgtcaaccggtgtcgaactcctaacaagaaatactgttagtgttgaggcactaaccaccaaaccacaaatacattggaaattaacagcaaaatttactttatttcataaaaatttgtcaaagatggttaaaaattcaaatttgtataaattttttgccttttatcccacgaatatgccattcttaggggtggttttcagccccgtgcccccgcgggggcgaagatcgcgggggcggagattgcgggggtcagagtcgcgggggcgggggtgacgggggcggggtccgaaccctactattttgaattgaattatttttaattttaaatttaattatttaaaatttaaataaatatttaattaaaaattggcattatgtttgtttttttactggaaagggaattttgatttaatactttttatcgctaattttacaaattttctttcgagaaagataatg

SEQ ID NO: 100658 - DNA, 1003 bp, Heterodera glycines
  Promoter: Source sequence=SeqID_23693; Location=132..1134; Strand=-; Gene=SeqID_54386
atctatgagagggcaagtctggtgccagcagccgcggtaattccagctctcaaaatgcatagaattattgctgcggttaaaaagctcgtagttggatctgtgctagccgtccggtgcacactttgtgtgttactggtttggttggcttttctgccggtctttccccggcgttggcctttaccggtcggcgtcggtgggctggcgagtttactttgaacaaatcagagtgcttcaaacaggcgtttcgcttgaatgttcgtgcatggaataatagaagaaggatttcggtccgattttattggttttgctgaccgagataatggttaacagagatcatccgggggccattagtaatgctacgtgagaggtgaaattcttggaccgtagcaagcggtactacagcgaaagcattaggcaagaatgtcttcattaatcacgaacgaaagtcagaggttcgaaggcgatctgatatacgccttagttctggccgtaaccgatgccaactagcgatcgctccggcggatctattcgccctggtggggagcttcccggaaacgaaagtcttccggttccgggggaagtatggttgcaaagctgaaacttaaaggaattgatggaagggctgcaccaggagtggagcctgcggcttaatttgactcaacacggggaaactctttcggcccgggcactgtatggattgacagatagatagctttttcatgatccggtggatggtggtgcatggccgttcttagtttgtggagcgatttgtctggtttattccgatctacgaccgtgactctaacttactaaatagttggctcattgcttctgtgggcgctccttcttagagggattttctgtgttcatccactacgaaatagagcaataacagatctgtgatccccttagatgtccggggctgcgagcgcgatacatcggcaaaatgcagcgtattagtccttacccccccccccccccccaccaaaaatcccttgccatg

SEQ ID NO: 100659 - DNA, 234 bp, Heterodera glycines
  Promoter: Source sequence=SeqID_29019; Location=461..694; Strand=-; Gene=SeqID_59586
tttgggcattggcggagtgccgaaagccaaatttggttgccgttttagcagttacatcaaaaggatgatcaagcagaagagttcgctgccccatttggtgctgaagacgcgacttcttttgcagcatttctcattggccaccatttggctaaaccctcgcgtcgaaatgctttacaagtcaaaatgccaaaaagcaatgccaaaacatcggtcataattttaagatgcaaaatg

SEQ ID NO: 100660 - DNA, 226 bp, Heterodera glycines
  Promoter: Source sequence=SeqID_27157; Location=767..992; Strand=-; Gene=SeqID_57858
tgtgaaattcaattcctaaccgcactgcggggtgggggcggtcacttgtccctccccctccctcccccttgtccctccgccgtcgtcccccgggggcaatgaccaaaggcaaaggggcggggccaaaatgcccccactttttgttggcacttcccaataaatggcgaggataaaaacgaagaattaacatttaattgagaattaaaaagttaaaaattcagaaatg

SEQ ID NO: 100661 - DNA, 55 bp, Heterodera glycines
  Promoter: Source sequence=SeqID_22329; Location=491..545; Strand=+; Gene=SeqID_53009
agtgatcagaatgattttttgatttaaaccatggttttgatgagttcaggtgatg

SEQ ID NO: 100662 - DNA, 114 bp, Heterodera glycines
  misc_feature (64)..(64): n is a, c, g, or t
  Promoter: Source sequence=SeqID_2953; Location=1317..1430; Strand=-; Gene=SeqID_82493
tccgccaatttgcggagcaggagggcatccatctccggcccgacaacattgggcacaacccagngtctgcgtcagttggccaaggatttgctgaactcgctatggggcaaaatg

SEQ ID NO: 100663 - DNA, 112 bp, Heterodera glycines
  Promoter: Source sequence=SeqID_14356; Location=1..112; Strand=+; Gene=SeqID_78390
ataataaaaatttgaatttttgaatgtttgtttctttgtttttttcctccaaaggattgagcggcgtccaattggtgcggggactgctcgcccttttcggggaagtcagatg

SEQ ID NO: 100664 - DNA, 99 bp, Heterodera glycines
  Promoter: Source sequence=SeqID_16388; Location=1121..1219; Strand=-; Gene=SeqID_80780
ttgcaatatacataaggggaatttaaagcggataggatgcttatgcatgaaataggaagaaaactgacctaattttgtaatcttacagataagaaaatg

SEQ ID NO: 100665 - DNA, 605 bp, Heterodera glycines
  Promoter: Source sequence=SeqID_34714; Location=627..1231; Strand=-; Gene=SeqID_64437
tgaacatattataagtgggaagtatgaaaaaatcaaagaattttaattattagtgacagttgttaaatcagtttttgggtaatttaattaagaacaaattaatcaaataatcactatctatatgccattgtttttagatgagaaggtgtagtgaagctttgaacatattataagtgggaagtaagaaaaaatcaaataattttaattaatagtaacagttgttaaatcaatttttgggtaatttaattaagagccaattaatcattaaaatgcgggaaaattattaacaaagttttgatcgagatgttttacatttgtattttagcatggggtcgaatccccatgctaaaatactccaaattgctaatagggtatgacatctgcattaattataattataaccaattattctttaatttttacaaactgaatatttctgggggaaagaagggttatgatggaacttaaattatgtgccacatttttgctgtaattcaatgaagcagaatacttgaagctgagacaaaggaaatgatgaacactaaatgagtatgataattgttgacagattaacttagttatggtattgatggctaggaaatatg

SEQ ID NO: 100666 - DNA, 514 bp, Heterodera glycines
  Promoter: Source sequence=SeqID_16031; Location=1047..1560; Strand=+; Gene=SeqID_80391
tatgctatctgcaaaaaaataggtgaaaacctaaaaatccgttccctgattattatgaatttttatgtatgaagttctattagagaatttatggtcatttattcaaaattgctaaaaaaaccggggtaatgttttcaaaaaagttttcccggattgtctgtcccattcctcttcaaaatttaaaaaaaagcgcgacagaaaataaaaggatacaaatattataataacttttttgaattttattgttaaattttagcgggatcccgcaagtttgaaatgagggattgcagaattaatcccggtgttcctatcctgcaaaatttttagttccaatctcatagcgggatccttcaaattgaaatttccgggctctaattatgagcattcgaaaaatatgtacatgcgctaagcagtgatgatttggaaattggaattcaatgacatccctgatgctgagtataggtgttagagcattttataccattcttaatttatagcattgttaacgagaatg

SEQ ID NO: 100667 - DNA, 1003 bp, Heterodera glycines
  Promoter: Source sequence=SeqID_5098; Location=414..1416; Strand=-; Gene=SeqID_56891
agaattcttttttacaaaatcaacatttgtgtggtctcgaattatagaaacagtagtgtatctcaaaacatttctaataattacacataacatgcacactaatgtagttgtcttacacaaaccacactaatgtgattgactgacataaaccacacaccacactattgtctaacaaaaaccacacaacacactaaattttttgcttttgatagggcttgctttagaattttgaaaattttctcggcgccgaaaaagccatttatatagggcgccgaaggggtcggggtcactttggcgcgggtattttggcgcgaggttttggcgcgggccattttggcgcggccgttttggcgccctatataaaatgacttttttggcgccgtaaaagaattttttaaaaattttcaaaatttagaactaagcctgtcagaatcaattttttcctgctgtgcgctacattatcgatgtaattttgcttaaaaaataaaatttttatttgaagtgttttgtaccatcgaatattgggttgtgttacgaattttcgagtccaaatccagtatacatattctaatttgagtccggggttcgtaattagtcaaatctatggtcagattatgatcaaccccctcgaaaacccaccgaatagtaattttggaccaaaatataaaagttaaattaggcaccacaattctgcaccattgctagcaattgtattaacatggttcttttaaagaaaggcccgcgacagattttgtatttttatagtgttgaatagcttaatcaatgtactatcagattcgaaatagagtatttttttgttcgaattcggtcccggtgttcggaattgggtaaatccgagttaagattcgtaatcagcatcattcgaaaaccccttaaaatagggtacgagcccaaaatgaaaaatagtaaagtctaacttagaatttgcattattttagcagaactttatttttatccgttgactattcctcattcgagaatg

SEQ ID NO: 100668 - DNA, 497 bp, Heterodera glycines
  Promoter: Source sequence=SeqID_32031; Location=1..497; Strand=+; Gene=SeqID_62344
atgaattcaatgaattttcaaaagttttcggtccttattctattcgaaaaaaatttattaagaaaatttcaaggaaacaaaaacaaaacaaagatttttcaatgggttttctttttttctgaaatttagtaatttctttagagttaaaattcatgaaaaatgtaattttttgattttttttcccgtcaactttttgtcccgcgacgttttagggtgcacgagttttatcctatatgcttttgcagcacaaatttcttgaaaaatatatcttttggaaaaaattttagacaaaaatgtggcgatttgcacggcgaactggacgccagcctggagaccagtgccatttttcgacgccgattggacgaaaatgtggcacgcatggacacactgtgcacggaattgtaccagagcaggcaacgaaaaatttttttcaaaaagtttatactttaaaatttagggcccaaacgcagcaagcgttggacgacaaaaacatcatg

SEQ ID NO: 100669 - DNA, 300 bp, Heterodera glycines
  Promoter: Source sequence=SeqID_17224; Location=918..1217; Strand=-; Gene=SeqID_81691
ttgtgcccatttgctcagtgcattttattccgagggtttgcccgagtcggcgcttcgtgtcattctcagggcgacgctaaacgcactcgaacacctccactcgcgcggggtcattcacaggtcattattcccttcccttcgctttgtttccttttatgcgtttgctcttctctctgaaggagcgtttgtgccgagaacatttggctcgactcggatggtcaaattcgtctgtgagtccaaccaatgccaatcccttctttatcccccctttttttgctttaagtgcgctcactcgccatg

SEQ ID NO: 100670 - DNA, 245 bp, Heterodera glycines
  Promoter: Source sequence=SeqID_20100; Location=1292..1536; Strand=-; Gene=SeqID_84890
gcaaatgatgtgacgtcgagccgaggaaactgaaagtgaaacattgcgaaaagcgaagcgaaaacgcatatttatggcatgaccaaagccaagtgaggaagccgacacggcacaattcgtacaggtcaatcggcaaattgcactcggatttcgttatgtttcgccgtttgttcttaaggctttttgctcttggcgttttggctacggtttttcttttgctgattatttgtgccaacgttcaaatg

SEQ ID NO: 100671 - DNA, 148 bp, Heterodera glycines
  Promoter: Source sequence=SeqID_38653; Location=1..148; Strand=+; Gene=SeqID_67405
agaagtgtcattagacaaactcccaagcattccgctggagagcttctttgcccgtcggattcgggaggcccaactcatcatcattgatgagatcaccatgcttcacaacacggtgattgaggtcatcgaccgagtgtgcaaagagatg

SEQ ID NO: 100672 - DNA, 204 bp, Heterodera glycines
  misc_feature (7)..(7): n is a, c, g, or t
  Promoter: Source sequence=SeqID_2947; Location=3107..3310; Strand=-; Gene=SeqID_82468
aaaacancggaagtaccaaaaaatgacaaatttttgccattttgtggtaatttttcaaataatttaatttctcgacggtcttcagtttttttcagaattttcaattttttcaagtcagagttatgtcggaaaagcttgtttcaaaaagaatttgtacagaaacaaatacatattttgaaaatatattaacaaatttaagaaatg

SEQ ID NO: 100673 - DNA, 499 bp, Heterodera glycines
  Promoter: Source sequence=SeqID_12360; Location=1809..2307; Strand=-; Gene=SeqID_75962
atttaaattttactgttttttaaggtaaggggtaaattatttgagaaaatgtttaaaaattcgaaaaaggatttaaattagctcatgtatgtactaattcattattttattatagaaattaatcaaaaatttattatttatttaatttttaaattttgaaaattatgtatttgtttttgggggcagctcacttttaaaaattttccagcgattttttgggaaaattttttgacgaaaaacttagtgtaattcttcgtaaaataaaaaaaaaatcgctgcaaatttttcaaaaattttttcttataattttcttagaaacactttataaaaagtcttactttagaaaattttcaaaaattttcgcgggagggaaacgaaacagttgccctttatttttttacaatttttttacaaaatcaaaaaattgtcaggaaaccgtgccaaatggattgggttcggcacttttctgatcgcatgtgcccacattatcacggcaatg

SEQ ID NO: 100674 - DNA, 367 bp, Heterodera glycines
  Promoter: Source sequence=SeqID_20695; Location=1969..2335; Strand=+; Gene=SeqID_51257
acccagcacgcagaaaaggcaaaactagcagccatggcattaagaaccatatttttgccgatctatcaaaattgaaaagaaagcgattgcatttttattttttgctatgaattgccattttgcacaaaacaaaatcaatgttattgttttgtaaaaattaaaaacactttaaaaggtgtccactaaaagaacaatggccagaggctttcattgatttcgaccggcgatgggtaagaaaagtaaacgatcgtttgccagtgtacgacaagcgctaccgtaactcggcacaaaattctgaactgtcacggggcacaacggaggtggccaatgaaatgccggaaacggccagcgccacagtgccaacatg

SEQ ID NO: 100675 - DNA, 1003 bp, Heterodera glycines
  Promoter: Source sequence=SeqID_7027; Location=1854..2856; Strand=+; Gene=SeqID_63610
ttcttttttttttgagcgttgaggaacacactcacaaaggaaggtccccgggtgtccgtgggatttccgatgaaatttagtgggtggatagatcacccatggatccttaagaaaagtgtttttattttttgctgaatgaatacgagtgccgagtatgccgtgccaaagttttaactagagtagaacgggaccgggaattttgggcaaacccgggaccgggaccttttcgggttgaaaaaccgggaatttttggctgggaaaaccgggaaaaaacccgggactggtcccggtcccggtcaaaaccgggacctcggtactcagttgtccgtgttttggtcccggtcccgctctactctagttttaacctttttataattaaagaaagtaacaattgtttctgtactttacaagtgtgtaatggtgccacccaccaaaaagggcaatggtaaagaattgtgtattttgggctcgaaaccaattaccaagtccgagtctagattcgtaatcaacaccctcgaaaacctccggaaacttcttagctaaattttacgatatcacaaaaaaaaatcaaatacgggtcgacgatttgggggattaacttaaaaatttgcgaggatgattcatcattttacgcgttgtaattggacgatggaattgcgttttgggtggtgggcggtgcaacagacgcaccaatccgaaggaaatcccaccggactctcacaaattcatacagtccatcaatagttttgttcaattgtccgtccatttgtggaaagactgtcttggatgaatttcactttgacaggcgatggttggaaaacactgcagaaatattaacaacaacaaccaatgctttttatttgtcaatttgatttttaatagttttttgtttttcttacccaatgttcaaaatttataataaaaagaaaacaacattcagattaatagcaaatttctattgtttgtaaagtgcaattcttctcccttccttttcctaatgatg

SEQ ID NO: 100676 - DNA, 1003 bp, Heterodera glycines
  Promoter: Source sequence=SeqID_4150; Location=140..1142; Strand=+; Gene=SeqID_53378
gacaaatccgagaaattgagtcaaattgggacgaattggcgcacaattatcagggttgggtcgaagaaaccaaattaagcgaaatgggtgcactttatgatttcctagaacgtaggattataccgaaggaccccagggaacagcaaagcatttttgataagtgtcataaatattcggtcatcagtgggcttttgtatctgtttgaaagtggaagcaatatgagattgttcgtgcccaaaaagtttcgtgaggaattagtcaaagctcatcacgaaggaaactgtgctggccatatgagtggaaaaaagttgtgtaaacaactttccgaacaatatttctggcccaatatgcttgccgactgcgtcaagaatttgtgcgcacactcgaaatccgcgtgctaatgagccgccattaaatgtcgttaaatcaaccgaaccattggagttgatctgtatggacatcttagatgtggggccaagtcattcaaataaaaaatatatttgtgtaattgtggatcatttcacaaaatatttggtcgcagaaccaattccggataaatctgcaggttcagtggccaaaatttttgtcgaaaagttcatcttggtttatggtacgccaaaaaaggtccattcggacagagggaaagaatttttgaattcaaccatggaagaaatatcaaaaatgttgagcataaaaaggtcatttacggcagggtatgacccgcaggcaaatggtcttgctgaacgtgtcaaccgaattttaattggaattttaaaaaggtcaactgcaagcaattggacgtgggacgaaccattaggcttatgctactttttcatataacatcacaccttcaaataccacaggattttcaccttttgctctcatgtttggaaggattgcgcgctttccccttgatcaaaacgtacctttttccgtaaatcccgcttatacggtggattcggacaaatacattcagctgtttagagaaaaccttctaaatatg

SEQ ID NO: 100677 - DNA, 103 bp, Heterodera glycines
  misc_feature (9)..(9): n is a, c, g, or t
  misc_feature (45)..(45): n is a, c, g, or t
  misc_feature (54)..(54): n is a, c, g, or t
  misc_feature (56)..(56): n is a, c, g, or t
  misc_feature (61)..(62): n is a, c, g, or t
  misc_feature (64)..(64): n is a, c, g, or t
  misc_feature (66)..(67): n is a, c, g, or t
  misc_feature (69)..(69): n is a, c, g, or t
  misc_feature (74)..(75): n is a, c, g, or t
  Promoter: Source sequence=SeqID_13103; Location=1..103; Strand=+; Gene=SeqID_76894
tttattttnttgggatttttcttacctttaagtcttactcactanggtttaaanantttgnnantnnanttttnntttatttttatttaggaatcggaagatg

SEQ ID NO: 100678 - DNA, 119 bp, Heterodera glycines
  Promoter: Source sequence=SeqID_32751; Location=1..119; Strand=+; Gene=SeqID_63004
tacgtttcttcgaactgtatgacgaaaataacgaactgcgcggtagcttctacctcgatctgtatgcccgtgaaaacaagcgcggcggggcgtggatggatgactgcgtaggccagatg

SEQ ID NO: 100679 - DNA, 537 bp, Heterodera glycines
  Promoter: Source sequence=SeqID_28296; Location=1..537; Strand=+; Gene=SeqID_58922
gagattgctgtttattaaaatccacaggatttggctttgttgttttgttgctgttcaggagccgttcgttaattgcttcggctaatattttagtataaaaatgtttttttttttttctcctccgctcgcgtccagacatttgcggacaatttcgggaaaaaatatttataaaaatttttgttttaaatgcaatgcaaaatttggtctcatcagaacgtttctcttaattttagatataaaaaaatattttgaagatatgcttaatcatgatcaaaatttactttcactatttcaaattaacagatcgtaacaagtccgttcggttttactcattttaaacttaaagtgccaattttgaccaattgtaacatgggggtcaaaaaatgtgcttttccccactctgtcacctataattaacagcagaagtctttgctaaaaagacaaattcttttttctgaaactaaacacattcgatagaagtacgaaaggtctaaattattgatatcaatcaaaatactacaaatacacggtaagatg

SEQ ID NO: 100680 - DNA, 61 bp, Heterodera glycines
  Promoter: Source sequence=SeqID_19447; Location=1485..1545; Strand=-; Gene=SeqID_84172
ttttgtcagatggttggagaattgttctgtctccttccattccgttctgttggatgtgatg

SEQ ID NO: 100681 - DNA, 285 bp, Heterodera glycines
  Promoter: Source sequence=SeqID_41840; Location=1..285; Strand=+; Gene=SeqID_46685
aattccgggctttactaactgtgtgtgtaatagttaaccgatctcatataaataataattaggtgcattataaagaaatcgcttggatggccctttgggtggacaaatacagaccacgagacttttctaagctcactttccaccaagagcaagcagaacaacttgtcagtttggttagcaccagtgattttccacatttactcttctgcggaccaagcggagctggaaaacggacgcgaattcattgtttactgaagaaattatacgggaaaggcgtggaaaatg

SEQ ID NO: 100682 - DNA, 934 bp, Heterodera glycines
  Promoter: Source sequence=SeqID_9784; Location=355..1288; Strand=+; Gene=SeqID_46814
agatgacaggcgaagtgttgagctgttttcataccttttttgaggttgagggggggggggggggtcggcccccatctttcgtcataaatgctccggaggagggaggcctttgtaatcgggaagaggtcaaagggggaagggtcgacgaaggggggggggagagaaagagtaatacgatattccgggtgcaccccaaaatgtttttccgacggcgcctaaaatccttatttccctaaaaaatgacaaaatcgcaaacattggcctttttggacaaaatctgtaacaaatcccattaaaattacaaaaaaaaaaaaaatcccagcggcacctaccggcactgtcggaccccatatttcccaaaagttttttgaaaaacatgccgcaaaaaaggtggtaagaaaaaaaggccgtttacatggctgacccccttcgcaaagttagccgtcaatcccctcccctttgacccccctccctttttttaacgtatgactgtttttgccagcgattggtgtgacactgtcagtgttattgttggtataatattttgtttatatataatttgacactcaatattataaaccttaataaacaccttcgttgggttcaattgccaaaaactttaaaaaaatttggtatcatttgaaagataagaaattaggtttataattgagattcaatttcttatgcataactagttacctaatttgaactcataagacttgcttttaatgatatcaaagaactgagaagaaaaaatttcttgcaggctatgatcagataatcggtcccaaaaaatccaataaaaataagtgttgcaggaaaattagcacagattttcaaaaaattctccatggggaacaaaaacaggacattggctgataaaacttgaaaagatataacttttgtgttaggcgtgaagtaaatttttgaaatg

SEQ ID NO: 100683 - DNA, 353 bp, Heterodera glycines
  misc_feature (58)..(58): n is a, c, g, or t
  Promoter: Source sequence=SeqID_19149; Location=785..1137; Strand=-; Gene=SeqID_83900
aagccagagacgccggttcaaagccggcccgccccatagttttccctcaaaggcttcnccgctcgttcatatatttcatagttaaccaattaattattctcttttcatcacaatgagttcattgaaatattatggattaatagagaatatgattggctagccttaagtaaaacaaatttatgatttaaaaagtgcacagaaagtgacggaatttaattaattaatcctctaaaaaattcaatttgcataaataaactattacaaattaattgagctcgacattttgaaaaagcctgggcctggattttctgtggacaaaaacctaggaagccctgattgcggaaaaaagcatg

SEQ ID NO: 100684 - DNA, 712 bp, Heterodera glycines
  Promoter: Source sequence=SeqID_10294; Location=702..1413; Strand=-; Gene=SeqID_73458
ttgttacttttttctatatgaaaaataaatgatttgatttttatacatatttagaatataaaaacaaatactccatgacacactggtcgacagggagctgaaccgtttcttaaaaaagggtgcaattaagccggcggatttaagtaaatgtgccgcgtttcacgatttttccattttcgggttttcagaccaacatcaaggagtggtctaatgaaccaggtgtatttttatatgctgctcagctatttcattggtagcactggccaaatgaataggaacaacaatgaaaatgattaaaattaccacagaaatccaaatcattattttttttggaggcttaaaattgatcttcccggcgccatcaaatgatttggataaatgccaaagttcacgggtatccgttttaaacacggctttccagatacttttggcaatgtgcttaagggaaaactttaaaaaaaattaaataaaaatatctgagtttttatgatcagtaggattggaattttaattaatcgcgaaaatgttttatcatattattattttattattgcgaccaataagtagagagagaaattatcaatttttataatttaatgaatatattaaatatgtcaatattttacattaaaatgtagaaattatatgaaaaaaatattaaaaataattttttagaaatatttatataattatttatatcaattcagcaatg

SEQ ID NO: 100685 - DNA, 604 bp, Heterodera glycines
  Promoter: Source sequence=SeqID_17274; Location=1081..1684; Strand=+; Gene=SeqID_81743
ttttagccaaaatcagaaaagtatttagctaccttcgtttgtttttaaatgaaattatacaataatgaagcattgtggggttaaatgcttcaatctttttcggttttagacgtcctatgggcttttatgtgtttcttacttggtcaatgcttagattcctggtatcaatcaaaaacttaaaaattagtcaattctaggctagaatttctcgtataactgaattctaggctagaatttctaggcttaattaagctaaaagcagcagacaaaaaattacttttgaatgtattcgaattttcgattattttcacaccgagtcaaaaacgagagacgaaccaataaatagagagtgcggagaaaaaaacatctctcttatttttttatctctgataattgtgaaaattaattcacttcactctaagagattattatgaaaatttaagttacaaaaaatgcagacattggccggcttttcccgcggccgcggtaatcacgctaccgccgggctattattatacattcgcatttttattttttatctttttttaatgcaatttttttacaaataggtaaataaggagaagcaactttgattaatccaatg

SEQ ID NO: 100686 - DNA, 55 bp, Heterodera glycines
  Promoter: Source sequence=SeqID_41522; Location=841..895; Strand=-; Gene=SeqID_69619
actgaaaaatatatgaaataaaataaaataattttaattatttaacttaaagatg

SEQ ID NO: 100687 - DNA, 1003 bp, Heterodera glycines
  Promoter: Source sequence=SeqID_2722; Location=526..1528; Strand=-; Gene=SeqID_81263
atttttttttttgcgcggcgcgccgctcatttttttgcggcaaaatttttataaagaaatttttttgaagcgattgtcttttttgaatattcaaaattttaatgaaaaagttttgaaacttggattatttttcttaaaaaattcgtttcaaaattccaatttttcctcgtcagagctgacaaaacctttaatttttctttaaaaaaattggctctaaatcacaaaataggtcatttttccccgccctccccccttttttcagtcccgtcgcaaatcttatatgcaccgggatttaattaattttttataataaggaaattttaaaaaagtttaaaaaaatgtatgtttaaaaagttggaaaattttgagtttttaagcgagcgatccgtgaccgcgggatttttctgtgcgtgccccacccctgccgtacagacagtaaaacagcaattgtgatttagaggtatcatgacaacttgcacaaaaggcaactcgtacactgttgtacagaggcaactccaattacttaggttaggccttttaggtttaggcctaggccaaagctttaggctaggcctaggcttaggctttggcctaggtttaggcttaagcttaggctttattttataaaatatttttgtactagttgcttgtgtacgagttgctattgccccggtttggaaggcataaaaccggaaaatccggcattccgacctaaaaaactccaaaacccggtccaacccctcatgtatcgtatacagtttattttatttcacgtggggtagtaaaaatcaaatcctgcataaaattttgctgttttcaactctgcattgattatttaattggtttaaatttaattgtcgcgtttgaacacgtaaaatatgacgatcaaatttttaaattgactcaaaatgatactcgccgggcaaaaaatttggctaaaaatcaaaaagtttaactctaattatttggctgtaaatctaatcttggtctcatttttgaaatg

SEQ ID NO: 100688 - DNA, 120 bp, Heterodera glycines
  Promoter: Source sequence=SeqID_22096; Location=1661..1780; Strand=-; Gene=SeqID_52744
ttttgtagttaataaaagcttaactgtcaaaacattaaaagtaattaaaaaaaattaacaaattatttgaatgcaattttttccatactcactcgtacgaaaacgtcctggcccgatatg

SEQ ID NO: 100689 - DNA, 1003 bp, Heterodera glycines
  Promoter: Source sequence=SeqID_11323; Location=2607..3609; Strand=+; Gene=SeqID_74707
taaggtaaaacgcccggcaaatggtcatcattttgcaaaatattctcctctttggtggtcctcctctgttgcgttccctttttcttcctcttccaatcggtcattttatgccaaaatgtttccgccccttccgtttttgtcaatgatttttcgtttcccattggcacattgtccaaccccattgaaggcaaaaaacttcaaaaattgttttaataaaatgtgattttcgtgtttctttcatcaagtacaatccgtaaaaaataggaaaaatctaaaaaaatcagggctctctctattcatatacacggcgattcaattttgcgctccaagtacaattaagttggttttttcgtcttagtggtctgtgcgttagtcaccaaaaggggggtctcaggttcgagtcctccttatgttgtgtgttaatttcaatttcttcttttacagaagaaggcagaaatattttttattaataaaagttttcgtgtcaaaaaaaatcatattcaaaaagcgttggttacgtacaacatcgacaattttatgaaattttcttagcttataacttggtgaatactagagcaaataaaaccattttatgctcattttgaagggaaaattctagagaatattgtaaattttatttgggttggccttaaattgtggacttggctaaaaaagtattaaaattattgaaatttttactagggtcaaaaaaattttcctcgggtcagattttcttgaaattttgtataggcctatattttgacctcctctagcgattccaagtttattttatggaacttaagtttttaactcgagatcggctcttccatttttacaagggaaaatccccggaaaattttaagttttgcaaagttttggcgttctgattactaaataaataataaacttatttgtacttggagcccaaaattattaattcttctgctatttgtgtgacatcattcggaactcggccaaattgtgctaattgctgccaaaaatg

SEQ ID NO: 100690 - DNA, 303 bp, Heterodera glycines
  Promoter: Source sequence=SeqID_7187; Location=1..303; Strand=+; Gene= SeqID_64084
accgtccgaaaaaacgagatgtgtaccaataaatagagagtgccagagaaaaacattatctttttttctctaatttttgtctccttttggcgtactatctaatagtttcattattaggaaaaacaacatttacttcgctacgtttcattatttttctctacgttaaatcaacaccaaattttgcatatcgatagagaaaaaaattctgcatcgatttctatgtttattatcatcgcttaaatgttgtcttaaaaagttataagaaaaaaaagttaaattattattctttttaaagatttaatg

SEQ ID NO: 100691 - DNA, 457 bp, Heterodera glycines
  Promoter: Source sequence=SeqID_4501; Location=1..457; Strand=+; Gene= SeqID_54679
tgaatccttgtgtatcggtgccattttcgaatggcacccatcacaattgctatcaaaacaaataattttgcttataactttgctctaaatcatcaaccatattttaattcaaaagaacattcgatagctctaattattcgctattattctgccaaatttcaaaaaaaaattgttaaccttattcgaaaaaaggctttttgagtttatttggtcataggattttcaaaatttaatgaaatttttgaaattatccacactaataaagaacactttatggctatctaattatataatgaaattaacattttgttgcttttaagcaaagttattataattttcatcaaaaattttcataattggttttttaaattacgacgactccgcaccttttgccagggatgtggacacacatcagcgtgaactgagtgcgcagcaggagaagtgcgtgtggggcatg

SEQ ID NO: 100692 - DNA, 516 bp, Heterodera glycines
  Promoter: Source sequence=SeqID_18288; Location=2812..3327; Strand=-; Gene=SeqID_82875
taggtattatatttccgtttattttaagtgaggtgggcgatcatcacaaggaaatgcagcgcaaaccaaaaaaataaaacaaattacccatttaattaattcattaatccattaattcatttgcttggtggtagacacgctttaagtttttgtatattaacatgttatatgtaatatatgcatatgtgagtatattcttgcaaacatttataaataaaatatatgtaaaaacaaacaaaaaataatgcatgaaaagccatgaaattattatatatattcatttttattttaataattacctcccccgtaaaattgtcaatgccacaattaattcattaattctgttgaacgcatatgtatacttttatatttttaaattataataatccgtgcaagtgaaaaagcactgaaaatggacagaaaaatggcacgcctttaaaagttggcttcacttgttgagttggtccaagttgagttggtccaaccaaaaaagataagtttataaatgaccaaatg

SEQ ID NO: 100693 - DNA, 723 bp, Heterodera glycines
  Promoter: Source sequence=SeqID_875; Location=684..1406; Strand=-; Gene=SeqID_63066
atgaggagaaatatttaaaagcaaatcgaataaaaattatgttttttattttgagaaagacaaaattaccgtaagagtgtaaattttatcatttaattatttaaataaaaaaaaacattttgccaaaagccacgacgaattgtggtactgacaatgagaatgagtgttctctgccgtcgtgtcgtcgtcgtcgtaagcgcagctgttttggttttgctttcggattagtgcacgtggacgggtgccctctctcatgcccagctaaacaaatttcaaattgaaatgcgtgaaatcattctctaaatttttaatcaaatttttacgtttaattaaataaagttgttaattttggtaattgagcagattaattttatttttttctgacaacaattggatgattattcgttctgtgccaaaatccgcgttttgtcttcgttttttactctttctcagttcccttttggtgtttctttccttcgttcatttcgtcaattgtcagttcgactcgccccacagattttgcttttgcaaagtcggcgaagcgattgacagttgcgcgtgcgactcgaattcaatcgatgtgtttaacaacgcgaagatttacccggctttgcagaacattttgcaaaaggagcctttcaaattctacaaggtccgtcctccaaaagtcccaatttctgaccattttccctcaaattgtcccctcatattcaggtaaatatg

SEQ ID NO: 100694 - DNA, 327 bp, Heterodera glycines
  Promoter: Source sequence=SeqID_28124; Location=649..975; Strand=-; Gene=SeqID_58778
gcgaccgaatcattcattgttaaggacgaactcgcaaggcatagagaaaaataaaaagagagagagtgaagagaggaataaaggaagagagagagaggggagagagcgatagagcaaaaaggaaaagtcagacaacgggaaagagagaaaagcaaacggagaggagagaaaagaaaaacggccattccttctgctgctgctgtcgggacgaaacgggccaaaccaaattcaaagtgccagtgcgacggtttcgttcaatgctaatcagctaatttgctcactaattaccccaaataacaaaactgccccctgcatctcccaacaatg

SEQ ID NO: 100695 - DNA, 192 bp, Heterodera glycines
  misc_feature (45)..(45): n is a, c, g, or t
  Promoter: Source sequence=SeqID_31165; Location=1..192; Strand=+; Gene=SeqID_61541
aaaaaaccttttttttagctttatctcgatttgcttaattcagcnaattttgttctaagaaactatttcatcttacatctgatcaatatgattccacaattttggttcgtatttcaaatttataatataatgaactattcaaattaaaattgcaacgatagcccgtttttttaggcaaaatgtgccgctatg

SEQ ID NO: 100696 - DNA, 160 bp, Heterodera glycines
  Promoter: Source sequence=SeqID_24311; Location=698..857; Strand=-; Gene=SeqID_55034
taaaatctgaaattgaaagaataaattaaaatttaattttaaaacaacttttattttttaattttaatgacttcagttcagggctcccaacatttcccctaaaattttcaaaatttgaccttaaaaattgccaattttcagtgaaaatctgttaaagatg

SEQ ID NO: 100697 - DNA, 1003 bp, Heterodera glycines
  Promoter: Source sequence=SeqID_8124; Location=1691..2693; Strand=+; Gene=SeqID_67049
tactgaagcattttctactgatacattttctactgacgtattttccactgatgcattttctgggcaccgtttagtgtgtgtctaaagatagaattcggatcacttaggaaccctaaaactcattcgaattttggtgattatcctatgtagaagcatttaaactcattttgctattttatgttaatatttgggaaaccctaaattagacccattttccgggtttttatgagtttttttgagtttttgacatttcgtgattttttactcttttgaacattccgtggcttggagacactttttgggggcgccagttcaaaagttatagacagtaaagacaccgttttatatttgaatgcactgcattttgttttttgcgctaacaatttattggcgcttttttttcgttttttacaatccgtgcgcctgcggtttacctcagttcggctctcacggtttggccccagcatgtttttacttattttttctgcggttttaactcgacgagaaatgcacgaaaaacaattttttttgttcgaaaaactttttaacgcccctattcgaccctaggaatccctattttgagtgtttgcccctaaaataattttttttatccctattttggcgtttcgctcctatttagcgattttaaaaattttcatataaaattcacaaattctttaacaaaaatgcaatggaaaaaaaaaattgttttgacgcgatcactttttttgtcaaaaattttcaaaaaattttccactaattttttttgaccaaaatttctgtaatttattttctttcttgtcaaaattttgaagttttatttattttagaaaaatgtattcaaaaatttcgcataaaaataattatttgtaactgtaatcaaatgaataaaatcttagtatttacatagaaaatgaggatgaaaaacaaccccccgcttagtttttgtgccaattttttcaaaaaattgtccttatttaaggctaaattgtatttttaaatg

SEQ ID NO: 100698 - DNA, 665 bp, Heterodera glycines
  misc_feature (20)..(20): n is a, c, g, or t
  Promoter: Source sequence=SeqID_13652; Location=523..1187; Strand=-; Gene=SeqID_77552
cattatttggttttaacccnggaatccttctggtcaacttcaggtcagaacggtaggctctcaattgtttccgaagaggctaaactattttatggaggcatacaacgatgcaacaagcgaaccgttcagctatttggttataaatatgcatcctaatgcgcccgagtctgaacgtttaacaactaaaattttcccggatgaacagcgtgaggtgtacctaccaattgaatagagaaagagtataaaaggttgagaaaatctgtaattttcactacaaatgtatgaattcagtccatatataagtgaaaacgcagaatttttaaaaaaaatcgcctctacgaaatcggaaaaaaagaaaaacatccttctgcaagacgcaacagccgaacaaatattaggacttgttgaaatttgtgcaaacatattaaaattcaatttcagcctaaacagaaaccagaggaaacggttggccgaatacgcggactattatcgtgcaattgcacgctcgcgtagcgaaaagactgctagaaaaaggctacaacagggaagtggtatagcattaggagcaatattagtgcctattcttggcgcactagctcaacacctggtcgaaaaaattacggcctaacaggcgggagctaccaatgaaatatacaaaaaagatg

SEQ ID NO: 100699 - DNA, 739 bp, Heterodera glycines
  Promoter: Source sequence=SeqID_6719; Location=1..739; Strand=+; Gene= SeqID_62616
atttttttgctatttttccttcaattttattccattcttttgctgaatattttcttcctttttgcttaattttctcttttatcttattgaattttccaattatttctcttcttttctgttcttcgtttcttttttcttcccatttttctccaaatatttcgtcaaatgttttttgttccaattttttattttctgatccgatctgatcagttagggtgatcaaaaatataaataaaaagaataataagcataatttcatattttatttttgcgaaaacaaccttaaaaacaaattaaacaattaatattatttttaaaatgaattttgaaaatagtaaatggttaaatacccacagatatgaattaatattgaaataacgataaaaaataatttgttgatgaaaattacaaaaaaaaaaatgcttttttccttattgactatcattaaatcctaatattttatgtaaaaattcaccccaaaatcaatacaaatgtataaaataaggatatttttaattatttttttttcaaattataatgacaaaatataatctttaattaaaattttggcataattttttaacagaatttgtaatacaaatgttcattttatggatttttaatctaagttttaaaaattctatttttttgcaaaaatcaaatgtttttcacaaagatggaaatttttgaataaaatttttaaaaaaatcgaattttcagtgacgaaaaggaggacatg

SEQ ID NO: 100700 - DNA, 896 bp, Heterodera glycines
  Promoter: Source sequence=SeqID_9456; Location=2370..3265; Strand=-; Gene=SeqID_71486
ctgtagctcagctccctgacagtcgtttctttatttgaaggtaccattcgaaagagctcttttttctaggcctaatggctaaggtggcgtcatttttgacggaagaataaccggaatacaaattaatattttcaattaatttttggcactatactgctatagtggcttggccttggcttggaatttttttctgtatctcagcttctttttggcacttgatttgaaggtaccattcgaaagagctcttttttctaggcctaatggctaaggtggcgtcatttttgacggaagaataaccggaatattttcaattaatttttggcactatactgctatagtggtttggccttggcttggaatttttttctgtagctcagcttcctgacagtcgttttttgatttgaaggtaccattcgaaagagctcttttttctaggcctacataattccccactcggcggcgggcacatgaacatttaaaagacacttaaaaaatgcaaaaaatactttttggccaaagatgcatagagatatttaaatgtggaccaaaaagttgtgtcacgtgccaattaagacacaaccctatcccagcttatagagctgaaatgcaattagagtaaaggaagggaaatggaagggaagggacctaaagggaaggggatttatccctttcaagagatatccatggaacggataaaggcgggtattgcaaaaaagtgcaaaaattcccttgggagggggggttgctgtaacctaaaaaatgcaaaaaatacttttggccaaagatgcatagagatattttaatgtggaccaaaagttgtgtcacgtgccaattaagacacaaccctatcccagcttatagagctgaaatgcaattagagtaaaggaagggaaatg

SEQ ID NO: 100701 - DNA, 178 bp, Heterodera glycines
  Promoter: Source sequence=SeqID_2896; Location=3660..3837; Strand=+; Gene=SeqID_82234
tttttctatcctcggtacaaagtcacatttcgtgctcgagccatcttttgaattgaaaacaaaaggccaaatgctcaattggcacccattgtgtaaaatccgtaggtagtggggccattggcataatgttgcattcaaatttccttatttgtgccctctaaatggctcccggacaatg

SEQ ID NO: 100702 - DNA, 59 bp, Heterodera glycines
  Promoter: Source sequence=SeqID_1502; Location=387..445; Strand=+; Gene=SeqID_73999
tttgatctattaatattcctctcggggaagcttcttctctatctcacaacaaattaatg

SEQ ID NO: 100703 - DNA, 183 bp, Heterodera glycines
  misc_feature (51)..(51): n is a, c, g, or t
  Promoter: Source sequence=SeqID_33994; Location=538..720; Strand=-; Gene=SeqID_46373
tatcggcgatatgattcatagagtcatatctgggatatgatctgaattganataggccccagtgctcgagaaaaatggtcaattgctttctcccctttgtccatttaatttaatgagttttgtttaagctagttaattgatcattttgagttgccatttcagtgcgatgcactcgcccacatg

SEQ ID NO: 100704 - DNA, 633 bp, Heterodera glycines
  Promoter: Source sequence=SeqID_15273; Location=1..633; Strand=+; Gene=SeqID_79486
aaaaattgatttggataatcctactgatgatcattcactaatggtttataaggcatagcgatttaataatttttataaatgattttaatttaatttatttatcaaatttattttttaagtgatattggaattttttattatttttatatataaataattgttgttaaattaaaaataattttttttttaaattgatactgtaatttttttttgtaaaatataagctttagatagagtttcgaacaaaagttgggatttttatttagattttttttttgctttttcaaaaaatagataaaaaattatttataccaaaatattatgaaactgaaatttctgatcattttagaatcttttcttttttttttcttcttcctaagttacccttttatgttttttgataaataggtataaagtaaaaaggtcactagttaaaacagaaatttaaaactatataaacaggaatttcgaaattctactaaaagcaaacatccattttaataaataaatccatcagtatttaatgcaaataacaattatcttaaaaaagaagggattttaataatgattatttaaggcattttcatttcctttttgtttgacaatttatattttataaagaaaaacataatg

SEQ ID NO: 100705 - DNA, 1003 bp, Heterodera glycines
  Promoter: Source sequence=SeqID_11277; Location=2543..3545; Strand=-; Gene=SeqID_74647
aggccccaaaaacacgaaaatcggaattcagcccccaaaaatgtcggaaatcggaagtcggaattccgtgccttctgctgcttcccacgcctttcaattgaattgctaattaattgctctcactcattctcattccattatctttttttttcttttatctttcctatcttctaccttttgaagccaaaaaagaaaagactaaaaattactctgttggacgaccatttgaatgaatggaaaggaattgccgagaaatggctattttaagtgtgtggttgggttggccaagcgatcaccgtcaatttaatgggccaaattccattgggcacagctgtccctgcccaatcaaagaatcattcacagaaagaggagaagcatttgaaacaacgcagaatgaaaaattattaatatgagagtgattaatgtgaaaaaatcaaagattaaagaaaatccaacggaataaaatgaattgggacggcgcctgaaattttattaagcatttaaatccctaattaaaccattttaaagctaatttaagcaggttgaaaacaattcctacctaaaaaacagccgcgctttttttcttcaaaaattaaaatgaatatttaatatgctaatttaattaataattaactaataagcgcaatttaaaaaagttttacttaaaaacaaaacaatgaattctgttaattgttgagaaattagcaattagtttaactgacaacgtttggacaaattgctcaagtggtttaactttttatgcttttcgtcttttccttcgtccctggtccgaccgagcaccgatggccaaacaaaaagcgggggacacgggggaggggtcaaagcacaccaatcgccacaccaaatgaatgccgaacaaccacaaaaccaccccatccatcggcagatgattttactccttccttcgcttattattatcgttgggatcaaatttcaacactaaaactcttttgacttttctgagagcgatcggcggagaatg

SEQ ID NO: 100706 - DNA, 546 bp, Heterodera glycines
  Promoter: Source sequence=SeqID_5919; Location=2436..2981; Strand=-; Gene=SeqID_59682
ttcacacagagacagagagaaaagcagagcaaaaatgaaaatggcaacacagaaggaaacaatcaattaatacccgacagtgaaagacaagctaaaaatgaatttgacaatttaaaagtattaaaaattgaaaaaaattagtgagtgacagagactttgtggccgcaaaattgacagagaaaataaatggaaaataaaaacttatttggaaataaaatttttaattaagtaggaaaagcaaaacaaaatatgaaacagataaagctaaagagaaaaaaatagagaaaggaaagcaaaagtataggtccggtacagctacgttttaaagaagcctaagccaagcctaagcctaagacaattgtttttttgttattgacatgtttggcgttatgttttgcaaatttcaaaattgcaaatttaattttttagtgttgactgataaatccaatcatgctgctttatctataacataatttacgtgtgatatggtgtgctaaataagccaataattgaataaacaagctatcattttttttagagacaatg

SEQ ID NO: 100707 - DNA, 215 bp, Heterodera glycines
  Promoter: Source sequence=SeqID_17541; Location=1103..1317; Strand=-; Gene=SeqID_82041
ttatgaaaaaaattttcaaaagggaccacttttacagtagcgccaaattttttgttttcaaaagtcacaaaaatatattttaagaagttttcggtaattcgggtcagggttttctgggcttgaaaaagccgtgtatcttggtctgtacctgggctatgcattactatatatgatatattaaaggtaaatccaagtcaggatatcctacgaaaatg

SEQ ID NO: 100708 - DNA, 196 bp, Heterodera glycines
  Promoter: Source sequence=SeqID_37933; Location=679..874; Strand=-; Gene=SeqID_66902
tggatctgggtacgggtatggtggctacggtcgtggtacagctcggtacggttacggtggttattatggcttacgctacggttcttatggtcgcaattacgggcattatggtagaggcgctacttccacttgtggcggttgtggtggtggaggaccttggcaaggctatcgctcatggacctattcgccaagcatg

SEQ ID NO: 100709 - DNA, 96 bp, Heterodera glycines
  Promoter: Source sequence=SeqID_780; Location=413..508; Strand=+; Gene=SeqID_61025
ttttagcataattataccattaaatttataatggaattgttttatttatttattatttatttattttttgttagatagtacagtattactttcatg

SEQ ID NO: 100710 - DNA, 257 bp, Heterodera glycines
  misc_feature (11)..(12): n is a, c, g, or t
  misc_feature (22)..(23): n is a, c, g, or t
  misc_feature (40)..(40): n is a, c, g, or t
  Promoter: Source sequence=SeqID_19820; Location=1911..2167; Strand=-; Gene=SeqID_84559
tgcaggtcatnntagtaggacnnccgattctgacatacanttctgacaaattttacatcctgaacacgaattcgagcagaaagccataattcacaacatttacgcaacacttctttcaacacaaaatattatttgtcttcctttagttttaagtatttttaacttatttattattaatatttttgtggcatttcatttaaatttattaattaaattttttttattttaataaattttctagattttaacatacaatg

SEQ ID NO: 100711 - DNA, 774 bp, Heterodera glycines
  Promoter: Source sequence=SeqID_27891; Location=1..774; Strand=+; Gene=SeqID_58555
taaacacaccgtttcaaaaaacgagagatgaaccaataaagagagagcgcagagaaaaaaacatctctctttttggcgtactatttctttatctctgttaatagagaaaaacggaatttacatttctatgtttagtttttttgtcctatgttaaatgcgcttcaaattttgcataaagatagagaaaaaaattctgcatcgaatgttctataagattttacgatttttctatcccatttttgcatgagaccgttatgaaaatttgaaactctcactactcttttctgagatgtcaaattgcttagcatttgcttagaaaaagcttctcctcatcaagggctttcgaatgataccaagatggaccaatttggttggcaaaaagcttcaaaaataattcccaaaattcgtcattttttaatattttggacaaaaataaataaaaatattcatgttgcacaacggactcgaaccaccaccctttgtccctttactatcttacaaaaaccactgagccacacatgcaaatctttttggaactgggaggccaaaattgaaacggtgtgtaaagcgattctttttttgtttttaaattttagtccctcaagaacttattcgtaattcgatgcttttaagttttctttaatttatttgcgtttctttttccattttttttaaatttcaggctaaagttttcatttgacttccccacataaatactgacaaaaacaaaacgcccccgcattctttgtctaaccgactcaacgttgagacatg

SEQ ID NO: 100712 - DNA, 249 bp, Heterodera glycines
  Promoter: Source sequence=SeqID_12747; Location=695..943; Strand=-; Gene=SeqID_76454
tgtcgaagttggcgccgttttgttgctgcgcattttgcccaattttcgccggaggcaatgcgcgaaaaaggcgcgcattttccttcagcagcagcaactgctcggcgtaagcggtgtacgtgtcgcaaaactgtgccggatgatcacgctgatggacacagcaaaatgcgatgcgtgccaaaatggccgcgaccaaatgcaacgaagtgctaatgatagggagaaaaaaaagtaaatcgactaattatg

SEQ ID NO: 100713 - DNA, 826 bp, Heterodera glycines
  Promoter: Source sequence=SeqID_16775; Location=1..826; Strand=+; Gene=SeqID_81191
atgccatttcaacgatcgaatctttatttttcggcatcttctttgctggagttcaaattttgcacgaaaaagtgaaaaaaaagtcacgaaaaaagtcaaaaatcccagaaagtagaaaaaagtcaaataaaaagttagaagtttcaaaaaagtgtagaacactcattttaaagccatttcgattcagaaaaaaaatcatttgatacagtcctgttgaaatacttgttaaagataaaacggattaatttaattgttcccgtttacccatttccatttattgtaacttatttttatctcaaaattaatattttcagaagccttttacttcatttcctcagataagtcttgaaagaaggatattttacctttaatgatttaataattttattttaattattttaataattttctattttaaaatttacgaatatcgaaaatttagtgattttttggttggtaaaacgacaccaaaccaaaaatgaaggacaaatccttaaaaatcggaagctcgaactttatacatgctaatgtgtgccgaaatacattttattaattagacaaaataaaaatataattttgaaaatcaatccgatgcaatgcattgagttataatttaaaaaaaacatattcattaattgattgattttatggttgtcatttttaaatagatttccaccattacaaattattgtaaaatttagataaatttatatttccctatataaaaaaataatttaattaacaaaaaattaatttttggggtttttataaaattataaagcataaaattaaggaaaatagtttattttatttttgttttaaaatg

SEQ ID NO: 100714 - DNA, 58 bp, Heterodera glycines
  Promoter: Source sequence=SeqID_24877; Location=939..996; Strand=-; Gene=SeqID_55626
ttgccttttttcactgtttctgaaatttttatgtatattaattaacttttaaggaatg

SEQ ID NO: 100715 - DNA, 169 bp, Heterodera glycines
  Promoter: Source sequence=SeqID_28858; Location=1..169; Strand=+; Gene=SeqID_59433
cgcattcgagttcccttttttcacaacattcttaacccttctttgggcaactttcggcatcaatacttttttttccacctatatacattaaacaatttaaatacttaaatatttttaattacgggtgccaatccaggaattattttcttagtcgccgtagaaaacaatg

SEQ ID NO: 100716 - DNA, 378 bp, Heterodera glycines
  Promoter: Source sequence=SeqID_10149; Location=870..1247; Strand=-; Gene=SeqID_73248
tgatataaggacgatctcattttgaagaatttatacttgttgatcaaatgacaaactctttctttgtaattttgccgagcaacacgcctggctttgttggaaataaaacaaacaaattcaaagtgcacttgccaaagaagttggtgttcgatggggtcgggtggatggttggactgtcaggcataatttacccaaacaggtgggcgaaaatcatggctattgggtccgatttttggcttaagttgggcaaagctgggtacatcagaccgacaatatgtgattgttcacctgcacgacggccgaaaataccgtttccgtgtgccaaagggaagttttctctcgccacagcagcttgagaggggcattcatcatggcatg

SEQ ID NO: 100717 - DNA, 65 bp, Heterodera glycines
  Promoter: Source sequence=SeqID_22281; Location=1..65; Strand=+; Gene= SeqID_52956
atagatggataattcaataatttattgccttttttcctgcacagagttcggctagggacatcatg

SEQ ID NO: 100718 - DNA, 167 bp, Heterodera glycines
  misc_feature (65)..(65): n is a, c, g, or t
  Promoter: Source sequence=SeqID_8675; Location=2022..2188; Strand=-; Gene=SeqID_68828
tccatgcggcaaaatttgccaattattatgataatttatgcgctccttcaagaattagcgatagnccacagaagaatggcactttttccgatgtttttccattatttaatgtttcatcggtccttcgggcgaagttcactttggcaagtcgcacattggcacagatg

SEQ ID NO: 100719 - DNA, 653 bp, Heterodera glycines
  Promoter: Source sequence=SeqID_30717; Location=1..653; Strand=+; Gene=SeqID_61112
ttctaattttagaaaaaaatctagaaaaattgtcatacttttaatagctagcttaataagaaaaaaattcaaaaaaaaactttctatcaagaaaattcaaggaaatttttaaaaaaatttcaagttttttggttttttccggaaattcagcaaatttagtttttattaacacttagattttcaaaaagctaaaatacttttaagttttcttgaaatctagaaaatttttaattatttttttttttgcggcgacgttatgtcccggcgacgtttcggtgcgacgttttggggtgtaccctttagggacaccgattttttttttgagttaaatgcctccatttgggatcaattcctttcactttcccccaaaaattagaaatgggaaatttttaattcgatatttctattaagaaaaataaatctaattgtaagatatttttccaaaaagcatttcgcccaaaactttttgcaattttcaaaaaaaaattttttttttttaaagtccaactttcaaaagtcaccaagggttgttttttttttgactatgtttgtcgaactcctcagaaaacggcatgtttcaggacgacgaattcccaactctgtgcggtgcgcgcattgtccgcgtcgctgtccacccaaacttccaaggcatg

SEQ ID NO: 100720 - DNA, 492 bp, Heterodera glycines
  Promoter: Source sequence=SeqID_5010; Location=1596..2087; Strand=+; Gene=SeqID_56559
ttaagttaggtgaaggattgggtccaaaaattggtgagaaatttaagtgattatgtacggtttgtagcatttattttggttcagttgcgtgagagaaatagaatttttggatggtttacacaaatttaagcaaaaggagaagtaggatgctacttaaaacataaatagttcaaattataaaggataatgggggagattcaatttcggatgtgagggactctagaccgaaacatggatgaattggatttattgttagatgaattaggattaggtcatctaccccacgtcgaagtgcataggtttttgtgaaattccatgaaaaaaccaaaaaaaatatataattttaaaaaccgaagcagacactcctaagaataagaaattcccataattcaatgccagatagggttgagcggtaccggtaccggtaccggtactggccggtaattaccggtttttttggtaccggtaccggtaccggttttttcaaaaatg

SEQ ID NO: 100721 - DNA, 225 bp, Heterodera glycines
  Promoter: Source sequence=SeqID_3930; Location=961..1185; Strand=-; Gene=SeqID_52481
tcttgtgccattaatggcatccgtcccgctttttgtgtgccgccccatttccggcacacttttttttgtgtgtccccaaactgccaacaaaaaggcgctttttgaaagaatgccgcatcggcacaccgcggcaaaatattttttcagttttttggtccccaatttttccgcaatttttaccgttctacggaaggtcatgatgctgaggaaagccatggcaaaatg

SEQ ID NO: 100722 - DNA, 238 bp, Heterodera glycines
  Promoter: Source sequence=SeqID_26430; Location=947..1184; Strand=-; Gene=SeqID_57158
ttataataatcaaagggatgggatataattaattgatcaccgctttttccaaagggtttggatttcggagaattttcggcatcggaaatacgaaatttgggtgaaaatttaaaatttaattgctgagtcataggctggcacaaatttttcgcattgcccttcaggcacattgccacacaaagtgaaaattgtggtgcccggcaaccacgagctgggctttgaggacggcgaggagatg

SEQ ID NO: 100723 - DNA, 615 bp, Heterodera glycines
  Promoter: Source sequence=SeqID_22752; Location=97..711; Strand=-; Gene=SeqID_53444
attgcatttaattgttttatgcattacataacacaataagcgtattaaatttgttgattgggacaaaaggtcgaagccgtggattaagaagttttatgagtcggtctcttttaaataaacgaatttggcaaaatttgggagaaaaacataatgagaaatgttaattgtcagtcatttcgttgcctatttaagttggcccttttccacattttctgtcactttccgctttttgttacttcataatttgtaaaatttccttaccctctcaattatgctttgtttttttttttgtaattttaacaaacaaagcgatcctctcttaatcatacagaaaccaataatgtcttctcttgaacgccaatcgtcttcgcgctcttttaggccctctgatgacacggattcgcgggggtaaggcaaaaaactcaacggaaaaacaaaaaatttctttccttttattttgcagaagctgttcgtcacttttgatctgcttttcctattgttcttcaatcatatgtttcccttgcgccatttgtctttccatccgggcaattttttcaaatttcacacatttccaatttctaattctccctaatttacaggtcattcagcagtatg

SEQ ID NO: 100724 - DNA, 186 bp, Heterodera glycines
  Promoter: Source sequence=SeqID_29825; Location=1063..1248; Strand=-; Gene=SeqID_60293
aaaataaaaatttataaaaataagtcaaagaagaaattcttttatcgaaaaggtaatttatcattataaaattaaataaaaatttaactgttttaagatgaagaaaaattactaattattaaaaaattcattaaaataaaagagcaattggcaaatgaatttggagctggtctaattagcaaaatg

SEQ ID NO: 100725 - DNA, 1003 bp, Heterodera glycines
  Promoter: Source sequence=SeqID_41289; Location=92..1094; Strand=-; Gene=SeqID_69452
aaatatttttttttgaaataattattagttatttaaacatttttataattattttaataatattatttttattatatagtccctcgcttcattttgtctttaaaaacgtaaattggaaattatttaattgatttgtttatttggcaccttttcaacacccccgcccttcttgccacacgctctcgcccccctccccccgctggtgacgtcaatttttccctttatgagagcaaattaatgtttatcacccattgccaatgtggccgaatggttagtacgtcagtctggctaccccctccgtggttcggatccgctcagtgcggggaatttttgataaattttaatgcatttaaattcaacacgttaagatattttgacctttagatgtttaaattgaatttaaaattaattaaaataatttaaataaagtcgcgcagcaaaaaagtcgcgcagtaagaaaaaagccgcgcacccccttacaataggtttgggtttgcaagaaaagtcgcgcaaaaggttttgcttcagtactgaaaaattttggcgctcaaatggctggcgctcagttggccatgcacccctcccataggtgtggggggggggggggctaccgtaatccggacaaatggtgtgctctaactactaaccattaattgcaaaaataattttaaaaacaaatttctaaatttaataaaatattcttaatgctttatgaaaaatctaaataaaaccaacgatgtaatacaaattttttaaaacaaaacctgggattaaagcttgaaaataaaccaatgcttattatctcgtcgaaatcattttccctcaattttagctaatgtcagttctcttatttataaatattgaattgagtttaaataaattcttcaataaaattatttagtataattataaatttaatttaacttaattttgtcttaaaaaataattgaattatataaataatataaaatactattatttaagtgaaatttttacacctatg

SEQ ID NO: 100726 - DNA, 284 bp, Heterodera glycines
  Promoter: Source sequence=SeqID_23893; Location=1141..1424; Strand=-; Gene=SeqID_54584
aggacaaatccctcccggcacagtaattaattaatagggaaggggaaggaatgattgaatttctgggaaaagccttttcaatttgaaaaaatgcatttgctattcatttgtcataccgtacacaaaaaataaaaaaataaattttaaaatgaaagaattcatcttcatcaggcccttgaaaatgcgttatgtcacgtttttttatgtgcttttttcgccatttattttggcactttttggtgccaaatttggggtccttaattcgtacttcaacttaaaaaatg

SEQ ID NO: 100727 - DNA, 1003 bp, Heterodera glycines
  Promoter: Source sequence=SeqID_10494; Location=160..1162; Strand=+; Gene=SeqID_73707
attggccactccattggctaccggtaaaaataattaaattttatttcaattttttttattttttcaaacattttttagttctcgtttttcttcgtaaaaggattcctctgttggcttgtgtttatgcccaatttttgcctatcgctgcaggcagtaattcatacataaatctgttttggataagcattgaccgatttgtggcattggcattccctgttttgtataaattaataattaattagagtgtaattatgcccttactattattctacattaaaaatatttagtgttattcttttttttacgaacttttttttataaatattttcaattttagaaaatttaattcattttttcttctttttattcttaatcggtggatttaagaaaatctaagaatatttccgaccatgattattattagaatcagaattttactaattaaattttatactttaagagataaaatttatttaaagtgatttaaattaaagaaataattattatttaatttttaataaaaaatatattgctttagaaccttaaaataattgttttgaacatttcttcctcctttgatttaggttctggaccatatatttttctggtttctgtatttttctgtctttttatactgaaaaaacagatacaggtccatatgggaatacagtagtacaggcactctcgaaaacaccgaacatattttttattttcttatgaccagaaaattttttgaaaaatgcattcgcacgctataaaaattaataataaaaaataataaatcgactaatattatattaaaaaattaaaacttttcatctttagtttccgcaacatctcaagattatctggcaaatacgtgataattgctaatgtcttgtctttgtcaattattttttatgttgtttatttgtcgtttatatttgctctacaacatcccgaaatgtaactaattaattaattaactaattgaaaataatattttttatatttaaatagtatg

SEQ ID NO: 100728 - DNA, 95 bp, Heterodera glycines
  Promoter: Source sequence=SeqID_7150; Location=958..1052; Strand=+; Gene=SeqID_63968
ttttgtattgttttgttgcattttttaaaatttttaggtgtaggcccaaaacggaaaattactgtaattttctcttgctcaattggcacaaaatg

SEQ ID NO: 100729 - DNA, 342 bp, Heterodera glycines
  Promoter: Source sequence=SeqID_21837; Location=1412..1753; Strand=-; Gene=SeqID_52468
ttttacaaacgcgcatgagtggcagtttttaacaaacgcgctagcaccttttcgattattgcccaccccaccccaaaaggtgtcataaatctgacaacaaaaaaaaacaattctaggatagttttagcgctaactaagaatctggctgccctagtagagtttgcggttttttggcaaaatgctaatcacgagcataattgaagccggcatgaccgaaaggacaccaaattttatttaaaaggatatttaattgaattcatttctgaacacagaatttatgtgatgttcggtcatttgtagatgcaaataaaattctattaaggaataattgcagtagggatg

SEQ ID NO: 100730 - DNA, 145 bp, Heterodera glycines
  Promoter: Source sequence=SeqID_5493; Location=336..480; Strand=+; Gene=SeqID_58242
tttttgatgatgtttcgcaagactgatttgattgctcgtgaaaaatcggcttaaatacctttgcaaagtgggcgtggcctaattttccgggagtataaaagaccctgcaatttgtcagctatgtctcattcgttctgctacaatg

SEQ ID NO: 100731 - DNA, 802 bp, Heterodera glycines
  Promoter: Source sequence=SeqID_801; Location=388..1189; Strand=+; Gene=SeqID_61589
aaatagtcaaacagcgttttatgattttttaatagtctaattgatttcgaataaattagtcattgattaggggaggagggtaaatttaagaagcagactccataatgatttttctttttgaaaaatttaaaattaaatctttggtcccaaaaaataaacttcatatgattaggtaggtaggtaatttaaaaatagaaaagtttgtcgcggcgcgccaaatttttgcgattcaattagaaacagtcgtcacaacaattagactgaatgattgcgtgccttccttcttttatcacatcaggccagaacagctttgtcccaaaaatatatggtgttcttcttgtgttttatgcttttgtcgacgtgtcgccaaaaatattttgacgcgaacgccaaatcaaaaaaaaaaattttttttttgtcgccgccaaccgctcataatttgcacagcatcaaattacacacacacacacaccgcacatgaagtaaatgggggaattaggaccttagataagcggtctggggttaagcttttttgtggatacaatctgcgcgctgatttcggcggatttgcccctctgatcagacacattaaagcctctctcctctctgatcagcgttcggccgctgaaaaatcgttgttttgggttgggcagaggagagattagttcgacgaaacgcgagaagacgcaacaaattttgtcgaaaagcattgatcgaagcaccaccaccaccacaaattcgagagtggattaagcagcattttttctcgagagtgactctcgacggcaaaataaaaaaaatg

SEQ ID NO: 100732 - DNA, 79 bp, Heterodera glycines
  Promoter: Source sequence=SeqID_13181; Location=2357..2435; Strand=-; Gene=SeqID_77007
ttctcttttgatacttgaattcctctttcactcttatttccagttttttaggcagaaaagaaagatttacggcaacatg

SEQ ID NO: 100733 - DNA, 155 bp, Heterodera glycines
  Promoter: Source sequence=SeqID_37382; Location=343..497; Strand=+; Gene=SeqID_66474
ggtctgccaaaaaaaaaaaaaaatttggcattttgtacaatgtcatcgttccctcatccccccttcccaaaaaaagttttttttaattttgtctaaatttgaaagtctgccaccaaattgaatggtcttcattgagtgccagggtcaatttgatg

SEQ ID NO: 100734 - DNA, 726 bp, Heterodera glycines
  misc_feature (15)..(16): n is a, c, g, or t
  misc_feature (51)..(51): n is a, c, g, or t
  misc_feature (72)..(72): n is a, c, g, or t
  Promoter: Source sequence=SeqID_22442; Location=260..985; Strand=-; Gene=SeqID_53113
aattgtttgagtacnncaaacggacactgaaaaaaatcgattttttgtttncggggcagtccccccgagccngatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatg

SEQ ID NO: 100735 - DNA, 346 bp, Heterodera glycines
  Promoter: Source sequence=SeqID_24700; Location=1..346; Strand=+; Gene=SeqID_55449
atgccctgtgccaatggttgcattcgccgcggggggccgggcgccttaagattttgctgtgccaggaaatttggtcattcgctgacaaaattcgggaactaaaaacgggtaattatcttaataaaatatgaatgtctccgctaataaaaaagattgccggctaaattgcaaattaaggcattttgcgacgcctctgcccccgttagtttcatcattcgtttgtctttgagcagttttgctggtatgtggcattttaaaaatttctagtatttaagacccccaaacatttgttgttttctgtgcaggtgaacagtttgaattgcgcaatgatcggaccggggaaatg

SEQ ID NO: 100736 - DNA, 295 bp, Heterodera glycines
  Promoter: Source sequence=SeqID_3827; Location=3171..3465; Strand=-; Gene=SeqID_52024
tttcccattatccaagcatttgttacttgcctccaggcaagtttcagtatggcatttcataattagtcaatcatcctattaattagctcagttcagacatttaactaattggtcatttaaactttcaaaaaataagaaatttatttcaaataagccaaaatggaaaattttgacttttacttggttttcttcaaagttaatactttatttaacgatttttaagaaaattttgcgccgaatttggaattttaattatgtacatatgcaaaaaatccaatcaacagaatccggcatg

SEQ ID NO: 100737 - DNA, 491 bp, Heterodera glycines
  Promoter: Source sequence=SeqID_6008; Location=609..1099; Strand=+; Gene=SeqID_60004
attaaggatttaatttcctaaaagattggcacatctcatttttgatagagaatttgcaaatttttgaaaaataaaaaaatttaaataataaatccaacaaaattttaaacataaaaatattcgattatggcctaattacaaaaaattaaatccaatttttcgaaattttttggccctgtagaactaaatttaaaattattcttgccgaaatcggttgggcttaaccatggaaatgcaacaataaataataatagttttttgcatgttttttatttcaattagaagtgaaattttcaattttttgctctaaatttatcatttttggtcaatattttcttaaattttttggcatgctttttcataaacatttatttaaatagttcagaattttttttttttgtaataattcctcctcatccttttcataaatgagaccagtaccagcaggagggttttaaaattttaagcacaaaagcgccgttggaataatg

SEQ ID NO: 100738 - DNA, 260 bp, Heterodera glycines
  misc_feature (117)..(117): n is a, c, g, or t
  misc_feature (130)..(130): n is a, c, g, or t
  misc_feature (153)..(153): n is a, c, g, or t
  Promoter: Source sequence=SeqID_12378; Location=1315..1574; Strand=-; Gene=SeqID_75985
atttggatgggaagaaatgttcttaccgaattttggagtgactcaccgagactttagggaatacggggacgaaagcgtcgaattaattgtatttgtttgaaagcacggaggaaatcncaagaaatgcgcntatttttcataacaattcattanaatgctacaattcacaattttctatgcataatacattattttcaccatattattcgtctaaaaactccaaaaatttacagccagaaaaattaatcctgcaaaaaatg

SEQ ID NO: 100739 - DNA, 137 bp, Heterodera glycines
  Promoter: Source sequence=SeqID_2592; Location=7616..7752; Strand=+; Gene=SeqID_80607
aaatggcaacgaatgccaaacatgcgactacgagaaggcggaagccatcaacggaaaattcactgcggcctacggagaatcaatggccacttggatctccgaagatcaccaaaaggcattaactttcgccaaaaatg

SEQ ID NO: 100740 - DNA, 910 bp, Heterodera glycines
  misc_feature (47)..(47): n is a, c, g, or t
  Promoter: Source sequence=SeqID_1705; Location=4520..5429; Strand=-; Gene=SeqID_75419
aaagactcgcgagaaaaatgtaaaaaaaggattaaaatgtgttaccncaaataaataattccggattgacagacaatataaaaacggattaaaaactattgttttatattatgttttcattaaaatatttggggacaacgatagcccttttatatttttaaattgactttggcgaaagcagacaaaaattttggtgaaaaatttttttttatttattttttatttagaaagggattttttttattattatttttaaaaatacaaatgaggggggggggggcatcaaactttgcgtgttccgcgactacgggcggtattttggggacaaacatttggcatgtacatttgtgaagaaaatttatttaactatacgattaatttaatgatgtcaaaaaacgaaattttctcaaaatttctccacatgcggcgcctgaactgctggggtcgcaggaaaactgcaaaatgaaatggaatttttaagcattggcattgtgtgggcgttgctgcaatttattaacggatattttgtataatttatacattttcatctaaaaataatttgaattgtcaacaaattaaaatcaatgcttttttccaattggcaaattttcgcttggaaacgtggccaattttataaaaaatttcaacaaatttggccatttcttaaagaaagcaatttattagtgactttacttccgtccattcttcactcataagggtttttgaaaaaatgaaatattttaatttcttttttaattttctaataattttttccttcatttacggccgattatgtcggtccaacaacagtaagtgcaataaaagctttcaaaaaatggttaacatttttaattccgtttaattagataagcaacgcgaaatccctcctgagacttttgggaaaattatg

SEQ ID NO: 100741 - DNA, 719 bp, Heterodera glycines
  misc_feature (67)..(67): n is a, c, g, or t
  Promoter: Source sequence=SeqID_36243; Location=339..1057; Strand=-; Gene=SeqID_65615
tccttggtatcaattgagagcttaaagtctcgggaatttacaaatacaagaaaagagcaaatattancaataagaaaaaaattgcaatgaaaaaaacctgaaattcattatttttcgcgtatattcgaaatatttgtctgttgcatttatccaataattttcctaacaaacttctttggactttaagctctagattgataccaagaatgtaagttttaagcaagaaagaaaaaaatgatgcctaagaaaccgaggatagtcattgattggacgctaaaagtcgattggacgcgtaaactgcattagagccgaaaaaaattgtttattcctataaaaaatcgtaagaaaatgttttatgcgggttttggggcttcgctgatcacaaacaaatatggcttttatgtagtttattttttaaatgagttttggtggagtgaattttcgactttttgttcgaattcgggtccgggttcgcaattggtcggatgtcatatttatcagcggctctcaaaaccctcataaaacatgtttcacgactctttagaaaaattttttctacgaagggggagggggacaccagctttactattaccgtgttttgctataataaaaattgtatttgcctatttttatgcctattagaagatttttgtgcctttttaggtgcctatttctcgatttttgtgcctaaaaaaggaagccctactcattgccaaatg

SEQ ID NO: 100742 - DNA, 434 bp, Heterodera glycines
  Promoter: Source sequence=SeqID_1259; Location=1..434; Strand=+; Gene= SeqID_70944
gttttcacatttttaccttaaggatcaatcttgaatttttttcgacatttacagcaagtttttggcatcttttcgacaaccgttggaagtcttcacaaaattaaaccacaggtaaaaaatgacatgcccagaaataaattattaatatttttgctttttaaatttgttgtttatgtgcattaccctcggcttcattagcatcaattccaaaaactctcacataattccataacggctcattaaacagttccatctcaattcgtgggttcaattcccaccacaggctgaccttttacacctccgccatccaccaaattcctacatgaggaacaaataaaattacaataatgagactgaatttttgaaaaaacccggagcctgaaccaggcccaagactatcgggatggtcaaggacagataggtctaaaataatg

SEQ ID NO: 100743 - DNA, 376 bp, Heterodera glycines
  Promoter: Source sequence=SeqID_45400; Location=711..1086; Strand=-; Gene=SeqID_72695
ggggatctctagagtcataattaaacttgataaagtaaaatgcttttgttatttaagcaaataacaaaaaactatgtaaagcattgctaatgaacaaatgactgattcttccgttttccaaatttcaaaatccattggacggaatttgtttcttccgagccgatcttaaagctgtagttgcgtacagacaattctaagaaaattaagacactttttcctaatgtttttaaaaacttttgtgttctcccagcagatcgaatttgattgtattgttttttaattgcactgaaataacgtttttttaatttctcaggatatgactcataaatgccaaaaacaaaaaaatagccctcatttttgagtttctcttataatg

SEQ ID NO: 100744 - DNA, 210 bp, Heterodera glycines
  Promoter: Source sequence=SeqID_12247; Location=2652..2861; Strand=-; Gene=SeqID_75818
aatacggctctattgcactttacacgaccataaaaaagggactataaaatatttacccccaccccaagggtttaaaattaaggcaaaaaccctgcaacgggggaagggccacttacaatttgcatgtttctcttttttgccatttatcatttgttgtcaatttttgttttttttgttgtgttagatgcatgccataaaacaacgaaaatg

SEQ ID NO: 100745 - DNA, 206 bp, Heterodera glycines
  Promoter: Source sequence=SeqID_26189; Location=1..206; Strand=+; Gene=SeqID_56934
acaaaacctatgtccaattttataacagaaaatttttttttatttggctcaaatattgccttttcaaggccattcgctgtgcattttggcaagcctacaacagcatcgtgcaagtgatcgcttattgcgctgggcttgacgagcagttgaagcgctgctactgtggtccgctgttgtcgctgatcctccactttgacgtcgcaatg

SEQ ID NO: 100746 - DNA, 70 bp, Heterodera glycines
  Promoter: Source sequence=SeqID_37525; Location=868..937; Strand=-; Gene=SeqID_66573
ctttccgcagtgcgggaagtgttggatttgcgggacaaaacatttactctccttggaggcgtcgacgatg

SEQ ID NO: 100747 - DNA, 76 bp, Heterodera glycines
  Promoter: Source sequence=SeqID_14076; Location=1204..1279; Strand=-; Gene=SeqID_78050
ataaagggtgtcgacaaagaattggtctgcgtaattgcaattgtttctgcaacacgaagcaccattcaccaaaatg

SEQ ID NO: 100748 - DNA, 83 bp, Heterodera glycines
  Promoter: Source sequence=SeqID_43223; Location=1..83; Strand=+; Gene= SeqID_70951
ttgattatgccggaccatttttcgggaaagatttcctgattgtcgtcgactcattttcgaaataccccgagtttttcgaaatg

SEQ ID NO: 100749 - DNA, 216 bp, Heterodera glycines
  misc_feature (30)..(30): n is a, c, g, or t
  Promoter: Source sequence=SeqID_23960; Location=856..1071; Strand=-; Gene=SeqID_54661
tattctaaataaaaaaaattagaatttatntttattttttacaaatttgaacaatttcttccaaatttatacaatattttgtccaagacattgttaattacattggcacgtttttaagaggattttgcggcacaaaaaaaaaaagttttttttttgctggatttttgaaaactcagttcaactttttcagattttaaataattttgcaggaaaatg

SEQ ID NO: 100750 - DNA, 427 bp, Heterodera glycines
  Promoter: Source sequence=SeqID_34553; Location=490..916; Strand=-; Gene=SeqID_64315
caggaggggttaggcgggaaaatttttggaaatttttaccatttaacaggttttcaccaataattgcgatttttgtggatttttggaaacattaagcaaaatttgtggaaaatttgaatgagggaggtcttggagggtggggggtatcaattcccttaaaatttcgacgggaccgtccctggcaccgggggacaataatctcgtcccgggccatgtctaagtcttgagaaattttcggtcttgagcagcaccggctgtggaaaagcctaggctaggccatattttgacaaaacgcgtgctaattatctatccaattaagggtcgcgctcgaaagcgtcgccttggcccttccggctcattagccgaagaagggacggacgattttcgactgttcaaagcgccatgctcatatacgctgaccgaaatg

SEQ ID NO: 100751 - DNA, 1003 bp, Heterodera glycines
  Promoter: Source sequence=SeqID_5283; Location=556..1558; Strand=+; Gene=SeqID_57554
atggggtggggcaattcaagatatacctagcggcacaatgtcggctactgtataaattgggcaagaaattcaaccgctcgaattccgaatatatctgctgtgcattttaatgaagtcagtatttgatcaaaatagtagttgacttatttaatttccaagaataatgattttaaaaattttattctatttcctaactatttgacccaaaattttctagattttcccggcaacgcctaacagcaccgccgaataaattttggatctttttttttgttgcaaaatttgatcataaaatggccaaatctggcaaaaaaaaataaaaagctcttcggtgcccctcccgaaatttttctggattcgaaatgcgactttaagtggaattagatccaagcgcgagcattagtttttattggacccattctcgacaccgacgagtgtccacgataatgctgccctttatgatcgagaaattgagaaaaatttaatttattcctaataaaatttgaaaaatttataaataaaacatttgcagaataataattctcttttcaataaaaaatgttaaacaatttttttgatgcataagaaatgataaggaaatagcaaaaacacttaagaattttgatgatgttcaactgaacattaattaatttaaaaaatgaatatgtatatcgtaataatttaatagattatgaaataaaatcttttaaatttagtgtagttaaaattgtttaaaaattcatacccaaaaatttaacaaattagttgaaaagtttttaaatttaatggggccaaatgatatcaaacaaatttaaaaaacaaaaatgaattttcaaacatttaatgaatgtttcatattattcgccaatcaaacacaaaaatttatggaatgttttaccgttttgaatgtagatgtgtgtttgtgtgttgtatgtgcaattttcatcaaaatatgtaatggttgggggcacccaccggtgggcggatgggaggaacaaggatg

SEQ ID NO: 100752 - DNA, 220 bp, Heterodera glycines
  Promoter: Source sequence=SeqID_12630; Location=1741..1960; Strand=-; Gene=SeqID_76298
gggaagggcaggcgaacgaaattggagaagaggtggcgaaattggggggggggggggagggaagtgccaaagtcagagggatgccgaaacaaaaaagaatgaatgacaagcgaaaagggaagagaaatatttaaaaatgaaaggctcaaattcggtgggccgaagggtccattcgccacggcacgacttcgaagacagcgacaaatacaaagggagaatg

SEQ ID NO: 100753 - DNA, 1003 bp, Heterodera glycines
  Promoter: Source sequence=SeqID_11004; Location=367..1369; Strand=+; Gene=SeqID_74323
aaaatagtgattcatagccatttcaatcatttgaaatgattttaggacaataaaggttgatttttatgaaaatctaatcaaacattttgccatacttttttttgcctagaagtaacgtcaaaccaaacccaaactaaaaccttcacaaagaatgtcatccaagagaaagtatcgagaaatggcattacatacctatgtattcttatgatagtcttttttagagtttttatgtggcataaagccactcattgattaatccgttaactaaccttacatattaacggctaaatactcgacattttacccggaccacccctcagctcatctctgattcatcacacttccgttttcacatacaatttcatattcatcccaaaactgctgaaatggacactgcgggtattttttttatacacatgtgctaattttcacaaattaatcacttctctgtttaggacaattcagctaatttttgaagttaatgtctttttaagaaaattgttcaaaatccaaaaaattatatgtcaaagttccttcaaatatgttacttgaataactgaaattaagtgcaacattactgtttagagcaactcagagacaaagtggacgacccgtccacctcaatgcccccctcccttcacaacccagacaatttgcagggcatttacgtttatcaacttccctttcccggttggcatgaaaaaacaataaatggaaagcaaaagtaaatttagggacattgccggaaaaagctcagcgcgagcaacttgctgctgttgtgcggaaatactcgaaaatcgttgaaattcgtatgcattaatccacctgtcttatgtgaaatcaataaatgcttgttagggttcgatgctgttcccaataatccggatgtaacatctgtacaagccggcagaaggtaccaattgccacctctgagccgcagggcactgattgttttccaaaagtataaattaggttaggtaaaaactaacaaatttcgaaaatg

SEQ ID NO: 100754 - DNA, 81 bp, Heterodera glycines
  Promoter: Source sequence=SeqID_18824; Location=544..624; Strand=-; Gene=SeqID_83513
agtatttttttttatgaaaaaagtttataaataaaactatattagtaaaaaaataaaataaattttcaggaaggacaaatg

SEQ ID NO: 100755 - DNA, 192 bp, Heterodera glycines
  Promoter: Source sequence=SeqID_20571; Location=1..192; Strand=+; Gene=SeqID_51129
ctaccttattttttctgtgggtctttaccgtattttcgattgccattattttacgaattcgattgtttagtaatttaaaattgttttgctgccaaatgcttgacaaaatattgctgcattcacaaatatttttgaataattcttatccaatgcttaaattgaatttgagttaagccaaatgctaccgtaatg

SEQ ID NO: 100756 - DNA, 103 bp, Heterodera glycines
  Promoter: Source sequence=SeqID_13970; Location=1164..1266; Strand=+; Gene=SeqID_77930
ttctcatgggaaaggtggccttggcaaattggccactaccattcccattcaaccaattgaatttggtgccaattgtgattttgggctaacattgattgagatg

SEQ ID NO: 100757 - DNA, 52 bp, Heterodera glycines
  Promoter: Source sequence=SeqID_19069; Location=1547..1598; Strand=+; Gene=SeqID_83813
atttttacacaaataaatatataatattttttaatttaaggggaataaaatg

SEQ ID NO: 100758 - DNA, 181 bp, Heterodera glycines
  Promoter: Source sequence=SeqID_24136; Location=1107..1287; Strand=+; Gene=SeqID_54835
tctgtgaacaaataatgagtatgaaaatgaaattggaattgcacacttcctattttcggttcttcgttttttttttgaatttgccattaccattggcacgcgaagttggagcaggttgcgcatgaattggtggtattggcgaagtgtccgtccgtattgtctccaccggtccctgccaatg

SEQ ID NO: 100759 - DNA, 147 bp, Heterodera glycines
  Promoter: Source sequence=SeqID_5346; Location=1509..1655; Strand=-; Gene=SeqID_57751
gtgctgctcgagagttgaaatgaagagtcgagaccgaaacccaaaaaaatcaaggaaaacaaatcgttctattactccccccccgtctggtcagagtatgaaattgcatctgcaccggtctcgtcctgttcctccttcactgggatg

SEQ ID NO: 100760 - DNA, 121 bp, Heterodera glycines
  Promoter: Source sequence=SeqID_1670; Location=725..845; Strand=-; Gene=SeqID_75210
ttttcattggaaggtgggaatgaatgaatgatatgacgtatttgtgaattagtagccaagaaaaacagcggaaagcaatcaaaaatgaccccaaaagaaagaagacgatgagagaacgatg

SEQ ID NO: 100761 - DNA, 669 bp, Heterodera glycines
  Promoter: Source sequence=SeqID_7890; Location=3518..4186; Strand=+; Gene=SeqID_66302
agttgattcaaatgcgtcccgatttttgttgttgtttgagttctctatcgcttttcttcaaataaactttttgttgaattcttcatttccttttttggggtcatgtaaatcccttctaaatttcaattttcatgctaggaatagattacctatgtgagtattcaggagtgaattcatatttatattatggatcgtttctgttcttttgcttttgtttcactctgtcggccccatacagctttttgttgtcgtttttccacttctcagcttcggtcaaattttttaaaatgggacttgcacaaccaatcccaccggaaatggatgaaatggttcaacatcgacacttatcttcaacctagaagaaaatttatccgtctaattgctaatcggtgactcgtcagtttcatttaacttttccgttgtctctgtttattttccctggttaatcctgtttagatttcacccggagcgaattttccaaatggggccggattttgcgtgtttggaatggttagttactctataggagttgcttaaatgtttttttgtttaggctgatgaatgcgggttccacttctgttctaatgtcggatggcacattgttaaaaagcaaaaagtatgtttttttatcatataataatgaactttttggcatcatttagagaaatg

SEQ ID NO: 100762 - DNA, 449 bp, Heterodera glycines
  Promoter: Source sequence=SeqID_179; Location=1609..2057; Strand=-; Gene=SeqID_76515
ttgttggttatcattaggaaaaaaagctgttttagactgtttggccgtcctgtttcgtccagcaaacgttgggacattccacctgaaacaacggcagaaccaaatttcggacattttccaatgctagaaaagcactggtacgacgagaagctaaataggcggacatatatttccaacatcacacgacgagtgagcagagggatatagccccccccccccgaacatgtcgcggattattcgatttttaagacccgaatgccttcagaatcagataaaagaattgcgcatgaaatgagcatgattttggtaaaaaggtcaacacctaatgcaatgattagaaattttaaatttagatttatgtgttcgatgtattaaaaaagcaaaaatgggcatatgacgcaaatcagcccacctctgattttttgcctaaatccaacaaaacattaatg

SEQ ID NO: 100763 - DNA, 403 bp, Heterodera glycines
  Promoter: Source sequence=SeqID_3760; Location=2497..2899; Strand=-; Gene=SeqID_51761
aaataaaataaataatgacggcgccaccgaactggggcctattcaaattagcatcgatacgatgcgagcaatttgaataggcccctgctgaccgcaccggaaaacgccgcaccgaagtaactccgaccctggattatctacccccctcccccaaaaataaatcaatattgctatgcatttatgctaactgatttttaaaaggaaaacaaagagattaagcaagaataattttttccccctcttttcgttaaatattggcatttacatcattcgcttttcgtcatcatttgccaccctcctcccccccccctctaagaattggcatttgacagatttaatatcattaataataattattattattctatcaaatttttcatccccttccctccccatcacaatg

SEQ ID NO: 100764 - DNA, 1003 bp, Heterodera glycines
  Promoter: Source sequence=SeqID_8504; Location=4025..5027; Strand=-; Gene=SeqID_68323
tattggaatagttaaattcgtttgaacaattaataaaatatttttataaaaattattttaatttcataaaacagattaaaatttattattttaagaagtgataacactgacaattggagttaaaatgaaaaggctataactaatctttttataattaaattttaaaattaaaataatcaagaatttgaataaacaaaagatttattgattatcaaataattatttaaatgtaaaaagaaaaaaatatttttcaaaaacaactttaaatcctttttaattcaattttaaatctttattaaaattgttttccgaatgtttttattacaaataatactaatattgaaataagaaaaatcttaattaaaactttgttaattaaatttaaagcacaatttttaactgcttgaatgataataataaaggatgaaactaaatgccacagccacaaaaatgaagagcattgtcttgctagatttaaattaaaaagatttggatttaaataataaattctaagcagctgtactaaaatctgattcccgacatttttgggcatcagatttccgatttccttttttgaaaatttttggggcctcaaatgctttccctgctgatgaaaagtagagcaagacttatgtgtcttgggttcttctccatcccgaacaaaaggaaaagaaaattcagggggcgagtagcaaattccccaacaagatttgtctgtatgtctagagaaatttaaaaaatgtcggtggaaaaatttcacatccccgatcttggggaccaattttacttttttaatcacttaaaataccagtagtgaaattaatttcttagaaatgtaaaaataaaatattaggcctaaaagcccaaaaacaaagttttatttagttttcagtcccattccatattttcagaaatttttaaaaatttctttacgaaatttttttattttttcccgaaattgtccgcaaatgtccgtccgcaagtgtcccactgcgaaaagatg

SEQ ID NO: 100765 - DNA, 92 bp, Heterodera glycines
  Promoter: Source sequence=SeqID_25125; Location=927..1018; Strand=-; Gene=SeqID_55854
tttcgacccattccgaacccctgatacgaattcgcacaagaagtcgaaaactcaacttcgaatttcatatttggtctaaaatagttaaaatg

SEQ ID NO: 100766 - DNA, 344 bp, Heterodera glycines
  Promoter: Source sequence=SeqID_7054; Location=2767..3110; Strand=+; Gene=SeqID_63678
cctattacagacaaaatgtaaattttcgacaaaaaaaaaacaaatgattttcgtttagaagttgtacaaaaaaaagtgcaaaaaaaataaattcgggtacgaaaatatgtcacgaatcagacaaatcaacctcaaccaatcccggtcactcaaaccaaactctaacaaaaggtcgaaaattagtttttttttttcaaatttagggaaaggattcggaaattggttgcaggtcaaaagggtcaccttgctggcttttaataattttcttaatttacgatttcgaaactagcggcaaaatttggaaaattccaaacaatttcagttttcatggaacatgacaaatg

SEQ ID NO: 100767 - DNA, 229 bp, Heterodera glycines
  Promoter: Source sequence=SeqID_35692; Location=586..814; Strand=-; Gene=SeqID_65185
ttttcttgacaaactctttactctcctacgttcatatattacccctcacattgcaatgctcaaacctcttgataattacgtcactacttgtactattaccatcactaatatggtgacaagttttgtgccctaatggacacccaaaggacgatgctccaactcaaacgcccagcaaaggacgaagacggggacggcaccaccgcagacgaatttgacgaaagtgccaatg

SEQ ID NO: 100768 - DNA, 463 bp, Heterodera glycines
  Promoter: Source sequence=SeqID_4803; Location=1312..1774; Strand=-; Gene=SeqID_45907
aaaggaggtaaaattgaaaaaaatcatcatttgttttccggatgtcagataaacaattgtatatcccaccaattgcggtttatgtttatttttgaaaaaagggatttgaaacttcaaaattggccaattttaaataaagcgccatatttttagagcgttagatttatttatttttgttatattcaagccgaaataggacaaaacagacgacatatttgtggtcagagacctcaaaatgtcctgaatttcttttttgaccaaaaatagtgatggttgtacaaattttgaaaaaccaatttgcactcaaatggccaacaattggatcacacttttgagatggtttattacatttataccaaagccaggaaatatttttatggaaattaattattatttacaaatcatttaattaattagatacaaattaattattgtgcaaatcccaaattccgtgacaaaaatg

SEQ ID NO: 100769 - DNA, 501 bp, Heterodera glycines
  Promoter: Source sequence=SeqID_13488; Location=264..764; Strand=-; Gene=SeqID_77376
tcgtgacactggttttggcgttggttggcgttttgctctgtttgccattctccgccccttttggccctccgatctcttctttctcttctctctctctctctctgccgctgtcgcccaaaaattgcgattataccaaaaaaatggaagacaaaaataaaaatgaaattaaattaatcagtggcagtccgacgccggggagaaagtgtggaaagtgcgcagccggcggaactgtgcgcacattttgacggaattgggggacggcaatcttttaagacattgtgcagttttttttttgcccgacatttgcagccgcagatagaaggggtcacttttttgccaatttaatcagttcagtggcccggggagtcggccgggcaaatcaaatgccccccctggcgaagttgccctatttaaagggacatccaccgaaagtgagcatcagtcagtgagtgatccatccgaccgaaggaagacaaaccaaccaaatcaaccagcagcatg

SEQ ID NO: 100770 - DNA, 77 bp, Heterodera glycines
  Promoter: Source sequence=SeqID_4188; Location=1..77; Strand=+; Gene =SeqID_53522
aagagtaagcataattaaattatgaaaattatttttaaattggagcaattaattaaagttttaataatacccaaatg

SEQ ID NO: 100771 - DNA, 1003 bp, Heterodera glycines
  Promoter: Source sequence=SeqID_13118; Location=978..1980; Strand=+; Gene=SeqID_76915
tccgtgtgcaacatgagtatttttatttattttttgtccaaaaaaatttaaaaatgacgctttgtgaaactcgtttttgaaggttttccaatcaaattgggtaattttggtatcattcgaaagctcatggagagctgaagctttttctaagaaatgttaaacagttggacgtgttagaaaaaagataaaggcgttttaaaatttgtcttttgattaacttttgaatttaatcacagataacagatactaactagagattaaggtgtattaaaaaaagaattggagaatattgaactatgagaagcttaaacaatatttcaacttcgacaaaagaccgaaacgccttaagtttttagatattttaaatccttttttctttttatttgattaaaattaatttttgttttgcaattattgtaaaaaattagtccaagattttggtgcctgttggcaaatgaattttaatttgtggacaacatcataaattttcaattgtgctttattatattagttaggtttattttgaatattactggataaatatttcaaaataaaattgttaaaaatgtcgcccatgaatttggtcagtcacatcgcaatttttatagccaaaaaatcattaaaatgtaaaattgtccatctcattttaagccccaatcgtagcttatgctttacctttttctcaacttagataaaaaatcgttcttcactcatttttaagttatcattttgctcaacaaaaaagccaaaaaaggattaatttattcatttgaaagtgaatatttaattgattgataggtcacaaataaatttgcctaattactttttgtctaccaatgccgccttataaaaggcgaacagattcagcgcaaaacagcaaatgttcattcatttatttggcagtgatgaattttattttccaaatttacatttctttttaatatgaatgttaatttataattttctagatagcacaatacactttctttaatttgaaaaaatg

SEQ ID NO: 100772 - DNA, 133 bp, Heterodera glycines
  Promoter: Source sequence=SeqID_8928; Location=2037..2169; Strand=-; Gene=SeqID_69675
ggtataatattttaatttatcagttacaaatcattatttaatacaaggttttaatctcgattgtccaaattggtctctatgtttatcatgagttccattattgcggaaacgaccgctttttgcctaccaaatg

SEQ ID NO: 100773 - DNA, 1003 bp, Heterodera glycines
  Promoter: Source sequence=SeqID_430; Location=1272..2274; Strand=-; Gene=SeqID_52502
ggagtattgaaaatttattgaaaaaagattcttggctattttttttctgcttttcgtcatatatttaaagaagagtctttcaacgagaattatggattttatcttactgatgagctcaatatgagagaaatttttaaaaaatttagataagtaaaatgaaaattatttaaatatttggttttattcttataattagggcttccaattatatggaaatccatatttttttcctggactgtgggaggtctgaaacgcacgaaaaacatgtttttaacttggtttaaagcttctaggatgggtttccatatccatttttcccatatttttccatatttcgcgatttatgtccatatttccatatttttccttattttggcatttttatccatattttatgtccatattctgggatttttccaaaaaacctctattagaaaggcccccatcagctaaattgggattttgaccccaaatcggaaaatttttgcgaaaaagacattttttatcaaaattttgtcgaaaattttgattaatgtatcgtgtttttttcttcaaagatgatttttaatacatatctagccattcttgaaagttttactttgcatttagtgaatttgaagaaattttgagaaattatagcctaaatttggaaaaatttatgtccatattttgcaattttatgtctatattttgatattttggctattttatgtccatatttttggacgccctacttataatatataattgccttatgtgcataaaatgaaattttaaaatgttcttatgctgatatcttaaatattaaaacccaaaatttaaataaaaagtttaaaaagaaaaaatattgcaagaaaaacagctgatgtttttaaaaagaattattttttattatttactaaagttgttgataataattaaaaaatacaagcattattataacatttagtatatctccacaaaatgtgcccacttaaaagtggtcttcatgtcggccactatg

SEQ ID NO: 100774 - DNA, 194 bp, Heterodera glycines
  Promoter: Source sequence=SeqID_9520; Location=608..801; Strand=+; Gene=SeqID_71727
ttttcgtaccgccgttttcgtacgagtggatatgcaaaaaaaattgcattcaaataatttgtttattttttaaattacttttaatgttttgacagttaagcttttattaactacaaaatgaaccagcagcaagtaattaaaacaaaacgaaataatgataaattggtgcatgatggtgcacttcagtaacgatg

SEQ ID NO: 100775 - DNA, 87 bp, Heterodera glycines
  Promoter: Source sequence=SeqID_20968; Location=589..675; Strand=-; Gene=SeqID_51546
gctgtattcgtgatcagcgaccctaaaaaccccctaaaacttattttcattaatttctaaaacaacatttataggcatttgaaaatg

SEQ ID NO: 100776 - DNA, 222 bp, Heterodera glycines
  misc_feature (123)..(123): n is a, c, g, or t
  Promoter: Source sequence=SeqID_7453; Location=1010..1231; Strand=+; Gene=SeqID_64862
ttctgactcggtggctgttgaacaggtgttaattgacattcatttattttataatatgaattttttaagtttgtagaagcctttttttacttagtattgatgcaaatttataacaaaaaattntaattttaattaatgtcaaaaaaataaaaataaatttgacgttttgccggtttttagtcaaaggtggatgccgtcgatgttggagacgcgccgcacatg

SEQ ID NO: 100777 - DNA, 462 bp, Heterodera glycines
  Promoter: Source sequence=SeqID_19165; Location=2087..2548; Strand=-; Gene=SeqID_83912
tgaggaccgcagacagctacatactcatcacaatttgcgtgacagtgcaaggcgtcgtgagaagtgcaatgcacatgaatgggaaatgacgcgcgataggcgtttttatagcgacgctgatgcatgacgctgctgatgaacaacgcatttaaaacatctcttggcacattcaccaacatgcgaatcaatcaacacttaattcaagggaaaggatgatctgtattctgcgaaaccgagaaatcctatatgattcatctaccggattaagatttaaaaaattggatatttcgtgtctcagcgaaaaaaggggccgcttaaaaaaggcgtcaaaaatttatgcgcaaaattctctccccttataagggggtttctgtgttcactttcgtcattttggtttttgtttcaacttcaactacaacaacaaatgatgccgtcgcgttcatttttcatcaaattcaaatg

SEQ ID NO: 100778 - DNA, 151 bp, Heterodera glycines
  Promoter: Source sequence=SeqID_43710; Location=1093..1243; Strand=-; Gene=SeqID_71316
attaaaaatttggttgcatttgagcaaagttatttcaaaaaatattttcattgatggtttttgactaacgtcatagcaccgtctggtttaagatactatccaattagtttattaaataaaaagcacaaaaatcatttcacatcgagaaatg

SEQ ID NO: 100779 - DNA, 106 bp, Heterodera glycines
  misc_feature (27)..(27): n is a, c, g, or t
  Promoter: Source sequence=SeqID_4686; Location=1..106; Strand=+; Gene= SeqID_55378
tcactccttctacaccccgaccccgancctgtcaaactggaaaaatgccgtcaactggagggctcaatttgatcgcgtcgtcaaggaaattcgctcgatggaaatg

SEQ ID NO: 100780 - DNA, 79 bp, Heterodera glycines
  Promoter: Source sequence=SeqID_39803; Location=1..79; Strand=+; Gene= SeqID_68286
cagacgacggacttttcgtcggagattcgtggcggacgaatgcggcgcgtgggaagagacgtcgtgcggaggagcgatg

SEQ ID NO: 100781 - DNA, 1003 bp, Heterodera glycines
  Promoter: Source sequence=SeqID_2490; Location=1825..2827; Strand=-; Gene=SeqID_80029
tttattgttaatatcataaaaataaaggtcaagatcgattttcaaagttgcaagtactgttttactctaatttacaagcaaaatctaacaaatattatttcaaataactcttcttaattttttatagtttgatattttcgtcatcttcgtgttttgtctccgttcattttcttctattataaattgagagcgaaattatctttatatttctttattttttatccttaataagtgtgaatatgagttttcaattaatgctctttggaaggctcaattaagtggtgcaatcctatgatatctccatattttatcactttctctaattatacttgttccacaaaaattcccaattaatcactgattaatataagattctgtggcctaaattaatacatttttaaaatttgactataaagtacaattttactttgacgattatgcttttttcgattcaataaaccttacaatacatataagaaattaacaaaaatacacatccgaattattatgtttatattcttcttatttgggaaaagatcggagacgaaggggcaatagagagagaggcgtcttcgtaaggcaaaataattaaacaatttctaagattttttcaaattaaagattaatgttaaattttcgcccattccttttatttcgtgaatttatgaacaaaaattcataaaaaatttactagataaaattttggaaatctaaggttaaaaaatttcctcagagggtgccaaaaaccttcattttcattaaaaaaaatggatcaacatcgcaaaattagatcattttaacgaaaatttttaagaaatcacattaaaatatatgggaaaattttatgaactaagaataaagttgacttcataatctttcgtctccgaccccccccccccttaattatatttactcacaatggccaattgtgtctctaacattattgctttgattttaaacattaatttgtaattcggctgtatctgttatgttgctaaatatg

SEQ ID NO: 100782 - DNA, 223 bp, Heterodera glycines
  Promoter: Source sequence=SeqID_11508; Location=1..223; Strand=+; Gene=SeqID_74935
gtaaacaatttttgccaaatatttcctcaaatacatttggacatttaaatttctaattgtaagggaaataaaaatggtaaaatggatacagatcctgtgtccgtctcgggcctgttttcaatttccgtcatttcactgattgaccgattttggcttttaacagtgtctattttttcaaaatccactaaattggaactttgacattatttgatatccccaaatg

SEQ ID NO: 100783 - DNA, 71 bp, Heterodera glycines
  Promoter: Source sequence=SeqID_36010; Location=1..71; Strand=+; Gene= SeqID_65450
gggggggctcccccgaaaacaaaaaaaaacgattttttcaaaggcccgttggggggtctcaaacatttatg

SEQ ID NO: 100784 - DNA, 120 bp, Heterodera glycines
  Promoter: Source sequence=SeqID_15852; Location=1..120; Strand=+; Gene=SeqID_80182
gcatggggggaaattgggtgggaatgagcagaggtaattggaagttgtggtggcaaattttgtaaatggggcgcataaactgtaataattttgttggtttaatcataagcatgccaaatg

SEQ ID NO: 100785 - DNA, 407 bp, Heterodera glycines
  Promoter: Source sequence=SeqID_4530; Location=312..718; Strand=+; Gene=SeqID_54789
cctgaaaaacgaaaactggtaaaagggcggcacttttgacgttgggaacccccgaaaaaaattccttaatagaggacacttttgtgggaattggaattggatgaaataggtgtcaaattcgagattaacaaccccgaaaaccacgtgtaaacaagttttcactaactatgacagaaaaatttataaaacaaaagggacctctgccccctttgaaattttttcatggacccccatcaaaatgccggtaaaagcaacgcattgatgaaagataacacacaccaatgcgcaagaaatgaagaggtctttggccgacactcggagcaaaatggcttcaatgtcagtgtcggaagcacaggacaaatccataataatattattgcttttgttgtcgctggtatttgcaaatg

SEQ ID NO: 100786 - DNA, 273 bp, Heterodera glycines
  Promoter: Source sequence=SeqID_44858; Location=1455..1727; Strand=-; Gene=SeqID_72271
ccgaaagggaggggaaacggagcaaaccgagcgaagccttctaatgtgagtttgaaaaggaaaagcaaatcgggattttgtttgaccaatgtcgagaccaacggacggcacagtcccacagggaccgaggggggggggggcaggccaataaatttggaaagatttttgaaaaaatgcaaccaaatttaaatttttggcactcaatataacggaccaagaaattgttattttcaaagcaaaatttccaacatttttttcagatttttaccgatg

SEQ ID NO: 100787 - DNA, 280 bp, Heterodera glycines
  Promoter: Source sequence=SeqID_39949; Location=866..1145; Strand=-; Gene=SeqID_68399
ctcaaatttttttttttttaaatttgtcgaggaccaataatctataccattgccgaaatcctcgccctaattatcagagtcattccttacaaattgcccctttccctctcttccctttcatcattcatatttttccctcctcctctctcaattttgtttacctatttattcgtaagagaggcaaacacatatcgattgacttattttaccgctttaacatttcccttttaaattctgcaacacatatacctaaacatttttgcatttgaccataataatg

SEQ ID NO: 100788 - DNA, 178 bp, Heterodera glycines
  misc_feature (78)..(78): n is a, c, g, or t
  Promoter: Source sequence=SeqID_3967; Location=1..178; Strand=+; Gene= SeqID_52609
aaaaggagagacatttaaaacgggtgcacttttgacggtctgtttttgattttaaatatgcattattaaaacgaaacncaatcaattcgttattagttatataaaatcacgatgtttacaaaagttaaatttcacaaaagaatgtttttacaaatatgggactcatataaaaaaaatg

SEQ ID NO: 100789 - DNA, 498 bp, Heterodera glycines
  Promoter: Source sequence=SeqID_1299; Location=5074..5571; Strand=+; Gene=SeqID_72003
tctcattgtttgtgtttgcatatgtatttacgtctatcctgcctttttgattgtttttggtgcacttcataaataaagagaatcagagcctaccattcactttgacgggcaaaacagaatatcgaattttctaaagaaatcacccaaactttgagtattgtcaaggggtagtgtttatcttccgggtatttaactcgacttattcattcagcacatgtacattggtttaccaatcgagtagtgtgtagtaaaattaacgaaggggtagagagaaatgaagtcacatagaaaattttcattccgtcttcaaatccgctcatttatttgttgctcattaacattttcgcgatctcgcagcctaatacacttacaactggatggacaacttgacttcgtataaattcataacgttttacattcctctcccgcactttatcagttatttttttcaattagacattaatatacatcttctaggtagcgctaattgcaggcatg

SEQ ID NO: 100790 - DNA, 51 bp, Heterodera glycines
  Promoter: Source sequence=SeqID_30413; Location=1189..1239; Strand=-; Gene=SeqID_60823
aagcatatgccattgttcattcaatgccatttgcccgtctttcacatcatg

SEQ ID NO: 100791 - DNA, 347 bp, Heterodera glycines
  Promoter: Source sequence=SeqID_2072; Location=3853..4199; Strand=-; Gene=SeqID_77670
ttccaaaagcagcgtccgattttcttctgtttcctttcttccgtcatgattcaaatatttttttacgcagttaattctttgattcggcaaataaaggcatcgctgtttcatatcgaactgagagaaaaaataaatgaaaatggaaaaaaaaagaaaaagaaaagagggatcttaaacatttgcataaatcacatcaaattaatacacaatgaacaaaaagaaaaaatatttatacagccaccggtacgaaaaaggatactgaaatttgacacctttatataattctctccaaaataaatatgtatgtatttttaattgaaaataaaaaattaagcttaaataaaatg

SEQ ID NO: 100792 - DNA, 156 bp, Heterodera glycines
  Promoter: Source sequence=SeqID_13811; Location=1696..1851; Strand=-; Gene=SeqID_77747
ggtgggcaattaattggccaaaaccaataatagcagggtcattaagtgggtggtttcattgattaggccaagtcagtcttttggattggcttttcattttatttattcattttatgcttaatccgtctttttctgttcagttacgtccccgcaatg

SEQ ID NO: 100793 - DNA, 219 bp, Heterodera glycines
  misc_feature (74)..(74): n is a, c, g, or t
  Promoter: Source sequence=SeqID_23379; Location=1126..1344; Strand=-; Gene=SeqID_54089
aaaaaaattttcaatttaacaattttgaaatatttttcaccccattgttttcatttgcaaaaacagtcgcctcnatctgtgcatgttgaggtgggtgttgctaaaaattgaatgcattttaacaaatttgaattaaaatttttttattttaaatcagacgaatctaaaaaaatatattttatggaatcaatttttggaaattttttaaatttagggatg

SEQ ID NO: 100794 - DNA, 191 bp, Heterodera glycines
  misc_feature (53)..(53): n is a, c, g, or t
  misc_feature (106)..(106): n is a, c, g, or t
  Promoter: Source sequence=SeqID_35287; Location=862..1052; Strand=-; Gene=SeqID_64871
tttgagactctgagtgaggaggcgggctaccaagaggaggacaacgagcaaanctccgacgccctaataacaacagagtgattgctgtcacagcaaattccatctntacggtcaacaaaatattcgaaaacggaggtgtcactgccatcggtgcttcaccgccaaaaaagaaatcaatgcgggaacgaatg

SEQ ID NO: 100795 - DNA, 354 bp, Heterodera glycines
  Promoter: Source sequence=SeqID_2697; Location=1..354; Strand=+; Gene= SeqID_81147
tattgatatttgtgccaaaaaatgaaatgggacaacacttttgatcactatattttgatccaattgtggatatggtaaaataaatcaaataaatggtttagtcaaaatgcaaaatatgggtatcctttgagaagccccataaaaaaatgctatttccattgtatgcttcttttttttttttttgaatggaaaatgacaattttatacgcaattatttttttcaaagcatgatgggacaacacttatgaccatgactgtatttttttttttgtgaattttaatatgccgccttcaactattttgcgagataataaattagaagaaattttagaattttgcttttcgtttataatg

SEQ ID NO: 100796 - DNA, 271 bp, Heterodera glycines
  misc_feature (14)..(14): n is a, c, g, or t
  misc_feature (23)..(23): n is a, c, g, or t
  misc_feature (74)..(75): n is a, c, g, or t
  misc_feature (100)..(101): n is a, c, g, or t
  Promoter: Source sequence=SeqID_7515; Location=1..271; Strand=+; Gene= SeqID_65085
taaaaattcgactntaatttttnccggtctattttacaggaatgaaatagttttagttttatttttaaatgatnntaatgagttatttcaataaagcttnntatcgagttggttccaaattttagttactcgccctgcaacaggtataaattttttgcctagtttatatttcgaattaagtctataaaagggaatgttaaagcgttcagaaggtttgaatatttcaaagggattcagatctgttcggccataaattattttatgagccatg

SEQ ID NO: 100797 - DNA, 682 bp, Heterodera glycines
  Promoter: Source sequence=SeqID_3300; Location=4340..5021; Strand=-; Gene=SeqID_84128
actactaattctataaatgaccaattaattatcttagggaccggaatttgtaaaaaaaaaattcggagcaggaaaagatttaaaaattaaatgtaattagtaattacttacttaaactgatttttacttagcaatttagtcatttcgttgcccaattaagaaacagagcaacacattggcttattttattcaattaatcctctgctgctgatcgcccatttaaaagtgccattttcttccgctttttctctttttcctaatttcctttttccatttcattttcattggcactcccttttttgatttgttaaatttagtgtcccaatttaatttgctttccgttggcatattaatcaaatcattcgcctgtcaatttgtcatttttgacgcactccttcgcccacttccgtcccatttgtcccccgtttgatcaaatttcacctgccctttttttgcccaattggcgaataaattaagtgccaacgcgagaattgccaccaccaccacccatttatctatttaattaattgcttttcagaacgccgccagcgattgttttgcttttgtcactctcattttcattcagtcatttgtccctttccgcgccattcatttgccattcgcggccaaattttacgagcattacgcttttccaaatttgggcattcctgctgctgaaatg

SEQ ID NO: 100798 - DNA, 603 bp, Heterodera glycines
  Promoter: Source sequence=SeqID_39226; Location=740..1342; Strand=-; Gene=SeqID_67846
tttctttaaaattaccttttttcgccccccccctcccctctttttacaaaatgccaacctcttttaattttcccttttttagttcattggtccaaacaaaagtccggcaatcatttcgcgatgaggtggcacaaaatcagaagcgctgggccgagcaaatggacatgtctgagggttggcaaattttcttttaatttggcattttgttgaaccaagtttactataaattcccatttctccccccccccccctcgctcgacatattcaaaacaccaccaaaaaaaagtgggttagtagttttgaaaaagtcggttaggataggaaattaggccgggataagattttacgtgatgactcaaatttggcatgaaattttgccgacgatatttagttcgggatcagaatcccggggttggctcttctactaaatgccccacaaattgggccattttgaacacatactgttaaaacagaccaaaatgttattgccccattgctacgattgatgcctccgaattgatccagtccattcatttacaaataaaattcatcgtccccgcaggcgagtccgctctgttcctcaacggcattccgattgcgatg

SEQ ID NO: 100799 - DNA, 1003 bp, Heterodera glycines
  Promoter: Source sequence=SeqID_22662; Location=1253..2255; Strand=-; Gene=SeqID_53344
aatatttatgggaagaaatttccaataattttttttaaatagtcaaaatgtttttatttcaaattttgaaccagacataaggatatgaagaatatatttaatttcctaaacaatttgcaaaagaatgatttactgacagtagttagtgcacacaaatccgtccgggttacggtagcctcccatacctatgggaggggtgcacggccaactgagcgccagccaggtgagctccgccaagtgagcgcgggccaactgagcgccaaaattttcagtactgaaaccaaaacctattgcgcgacttttttttgaaacccaaagctattgcaggggtgcgcgacttttttttctgcaagcctaaacctattgcaggggtgcgcgactttttttgaaacccaaacctattgcaggggtgcgcgacttttttttgaaacacaaacctattgcaggggtgcgcgactttttttattcgaaaaattacgccgcagactagtggactcgaacttttgctctgccaccaaacctgacacactaccaatctgccacgagaccagttgccagaaaaaggataattgtccactataagctgcaaagatgatgacgtcaccactgcgaggggtactgtagtccagggaaaattgcaataaataagtcgcaggcaaaaggattcgaacttttggtctgccaccaaacctaacacactaccactctcccacgcaaccacttgccagaaaaaggataaatgtctactatatgctacaaggatgatgacgtcaccactgcgaggggtactgtagtccggtgaaaaatttaaaaatacgcaaaatagaacaaaacgccacaatatatacataacgccataatttactgaaacgaaaacctttggcgttaaattcaaattcaaaaaattagcgggaaaagtggcttggcgtcgtttttttgtattatccttaatcctaccctttttcaaaatcattcttatcttctttcattatttattaacatg

SEQ ID NO: 100800 - DNA, 1003 bp, Heterodera glycines
  Promoter: Source sequence=SeqID_7978; Location=1088..2090; Strand=+; Gene=SeqID_66564
tttcagtcttgtttcatataagttttacaataatatttttattatctgtttcaagatgcaattgtcttagttatcaacccaatccaagagtgtacattagcaaagaatattttaaattttcaattattcaaaaagaaaatataacaattaagaacattattagtgaaattattttttaaatttatttttaattgtcttttaaatgaattataaaaattcatgtgtgcgacttcatgtgccgctgttagtgcagttagtgtacctgttattcttcaaaccaaaatattgattagaataattgatagaataagataaaaaaatttatttatttatttattttcaataatttaatcgttgctaaattatatgattaagtttcaaagtgtatatgtaaagttcctattttaatttttaaatttctttaaataattttatatcaaaagaacttttctttcatcatcaatttttttttaaacaatctgctgtagtaatcaaattatatttgaattgttctcattgttatatgttttaacattgttaacaatattttgattattttacatttaattggtcaaatttaataagataagtgaatgaatgaattaatatttgctttaatttaatcaatttttgatttttattttgttattatttgtgtataaactgttattttttaatttcatggtgtgtttcccactcgaattgaattcatatgtctttgtgtcgaattgtattgataaaattaattatatatttttttatttcattttattttaattaataaacaactcactcaatattttggattttaatttattgtattctttcttatatcttgcattaattaaaaattattattttttataagttttacaatttagaattttaattataaaaaaaaattaatttttactttaaaacgagtttttgtaatctattagataatttaattttattatataaaaaacctaaacattaatttattttatttttaggaaaaatg

SEQ ID NO: 100801 - DNA, 551 bp, Heterodera glycines
  Promoter: Source sequence=SeqID_13308; Location=1799..2349; Strand=+; Gene=SeqID_77156
ttttcttgctaattattgaagaaataatacataaaactagagttgtacgggaccgggacctggtactgaaaaaaacgtacaactgagtacctaagtcccggttttgaccagttttgaccgggaccgggaaaagccccggttttttcccggttttcccagccaaaaagtcccggtttttcaacccgaaaagtcacggtcccagtttatctcaaaattcccggtcccgtacaactctacccataactcgtcaaaattgttcaaaacaacaacaaacttgaaatgggataaatatgacgttaaaaagattaagctattctgaaaaaggagaagctgtgaattttttttaacttgatacgctcagataagcacgaaaaacacaatttcagcttgatttggattgtctagggatgacttttataatgcctatttttgtggctattttctggattttcggaaaaatccttaataaaaatttaaaaaaaatgaaaagtacacccctaataaatgacccaaaaaaattttcagaaaaagattgattaaaatattcaatg

SEQ ID NO: 100802 - DNA, 1003 bp, Heterodera glycines
  Promoter: Source sequence=SeqID_13366; Location=403..1405; Strand=+; Gene=SeqID_77240
tttgcagaataataattgagcatttgaattaataaatggaaaataaattagacatataaacactttaaattgcgcgacctttgctctccaaaaatgaccgaattggcgacaaaacatggcaatgcatcattagcaggcttttcagttgctaatccgtcctttcccatataagccgcccccttttaacagtaattccccgtcccctttttttgcctcccctttgaatgtctgtccattttttgacccttttgctaattgccatttgcttccttgttttgtcactcatttgttgctttgttttgttgttgttccattatttggccaaacaatgctttgttttgttttgcttttctttccgttgctttgcttttgtctcgcattacaccaattgtctcgtcttccgatttatcgccacggctttttctgttgacttttgcgcgttaatctttccctgggttaattccgaagctttttcggtgtttgcggaaaatggaaggcggggaattcggagaggtcgcgagaagctcgagctttttccgtcatttcctcgaccaccgcccctcggcttttcttcttctccgaatgaccgtccaattcgccctttttgtttttggtcctttgcccctcccctcacactttggggcagtgactttttcacctttccccttttagctaattaatctcccgacacaaagtgggcagaatattgagaagggggggggcattaagcacctgagcataaatccgatttgggctctctctccgaccatttaatgaaattaaatgccgccacaataaattgcaatgaaaagggcgcatttgctcattggtcattttattttggcacttttgggcgcattgaccagcagcagacgggcgggagagaaaggctaagattaattagcaaattattcggatgggcacatttcgttgctccctataaattctctccactttttcagccctttccattgccccctccccttaattttgctccaaaatg

SEQ ID NO: 100803 - DNA, 845 bp, Heterodera glycines
  misc_feature (194)..(194): n is a, c, g, or t
  Promoter: Source sequence=SeqID_31491; Location=1..845; Strand=+; Gene=SeqID_61822
tttttgagtcatccatttgctggttttttgagtattacatcatagcatctttttgagtatgaattttaaaaatgaaaaagtaaagtccaattggacagttttgttgctcacatcatctcacgtataaatgttttgtatttgtaaagcactatcgtacaaagtgattcacattttttaaatattttatttggatntatttcttaatttccttttcaattccaaaaataaaataataaaactaattatttatttaattgacatcatttaggtataattttcggattaaatttacattaatcaccacaatttccgctctccctaacggtggtcctaaattgcgtccatttccgccattttcccgatgcccaataaagccttcttggccaaccacccaacccccacatttccgatgggaaattgagccaataatgaaagtgcaaactcatcccaaccaacatacattgagaaggaattaatttgaataaaaagcgaaaaattattttaagaaaatccattggcgtgttcaattagcagagaaacaatttttaattaaattacgtttaattggtctaaacattctttataataaaaagattcctataacaaaaagcagaaaaagtattattattttttgttaatttacgcaaaaatcaacgaatacgtgcccagccaaaacttggtaaaattggcaaattagtgacaaaaaggtgaatttttggtattttattttatctgaatcctgcaaaatgagtttatttaaaatttgtcacgctatttaaaaaaaaatgtaaatagattctttacagtatctgttcatcagtgagtgtcaatcgacggtaataatg

SEQ ID NO: 100804 - DNA, 495 bp, Heterodera glycines
  Promoter: Source sequence=SeqID_6830; Location=438..932; Strand=+; Gene=SeqID_63018
tttttttttctttaaatataattcatttttccatttttatattaatttttcaacaaaaaaggctggtttttgggattaataggctcaacaatttgtaaattctgtatttttttaaaataaatttacaatcttttaaattttttgcttttaaatcgctgtttttgtggcaatgttttttcaaaaaacttttttggaacagtgggagggggcggggtccggcggtgccgataggcgcccccgggggggggaaattgaaatttgagtgcgatttgaataccgagctttattaatattaatcctatttacgacaatctttttataaaaagcttagtgaaaaatcgatttaatgctatgaaatacgtgacaattttactgttggcaaagatgtttagagaaaaaagaataataataaaaaaagattaaaaacaaaaagatattaaataaattcatttaatgcattttgattttttattaatattctaactattaagaatg

SEQ ID NO: 100805 - DNA, 193 bp, Heterodera glycines
  Promoter: Source sequence=SeqID_41952; Location=806..998; Strand=-; Gene=SeqID_69987
taatttttttattaaaatctaaaaattttcttttttaattaaaattcttaaaaaaagcatttttattttgaattttttaatttggttagctgcaaaaactgagcacataactacaaattttataaaatcacagaattcttatttcaaatatttactggtaattaaaatatattttaattattttgtcaagatg

SEQ ID NO: 100806 - DNA, 387 bp, Heterodera glycines
  Promoter: Source sequence=SeqID_1531; Location=8174..8560; Strand=+; Gene=SeqID_74286
agaagtaacgtaggaaatctgagttcatcaaaataaatgtggactgccttttgaggattgtggttcaatggccagtcccttaaaggattgtagttcgcactatgctgatctttcccctactggggaaagattcggcaaaagatgcataatttttatctgcattcttaatgggatgtgtgagcgatcaatttctgcattcaatgacctttgtgcgaaattggacatgtttgattcgcagcggcatcactgtggcaaacaaggaagatgcaccttaatttttcacatttcaatgtttttgataaatatttgattaatgtggtttaatggttgttttcccaaatattttgccgcatgtacacatcattgcttcatttttgttttcagatg

SEQ ID NO: 100807 - DNA, 304 bp, Heterodera glycines
  Promoter: Source sequence=SeqID_3911; Location=1..304; Strand=+; Gene= SeqID_52395
tctctctctctctcttctctctctctctctctttttattttctctatgccttgcgttgcgttcgtccttcacaacgattcggtcgcttttcgtcgtaccccgaggggttttgcgtagaactgtctcgcttttctgcttccacttctaacgtgcacacttttgtctttgcttctctgttctcgctttttctctcctgtggcaacactctctgcgttctctcgcctttccttccgttgtctatctctgcgttctctatctctctcgctctctttcacttctctgtttagaatagggcagagaaatg

SEQ ID NO: 100808 - DNA, 624 bp, Heterodera glycines
  Promoter: Source sequence=SeqID_39398; Location=646..1269; Strand=-; Gene=SeqID_67971
ttaatgaaattgaaaaattgagagcattgagagaaggctttcgaagtgctttaagtgttccaaattgaaactcatttcaaaaattaattaaaatagataacaatttaagaaacaaattaaatattttttttattctcattaattaaattttcagaggtgacacggctgaaattgtcgcattttctcttttcccgtcgcctttcccgcgccaactttttgaacaagcgaaaaatgtgcagatggtatttgattttgaattttgtttagacaacaatttataaataaatatttttgaaataatttaaaagaaaagttaaattttaaaaaatatgtgatattaaacaataatttattaaaaaatattttttaataatgaatttaacaaaaaattttttgttaaggattttaatttgttatattttcgcatatcaaatgactacgaatttttggtagaaacctatgtagaactggcaaaaacgaacgaacaaatccgaatgcatttgcaaattttgaagaaaacgcacgaagaaggcatcaaacaaacaaaatccattatgttggcacgttcggtatggcataaaaatgtgaaaaaaattaaaaattaattaatttaaggattatatg

SEQ ID NO: 100809 - DNA, 751 bp, Heterodera glycines
  misc_feature (29)..(30): n is a, c, g, or t
  misc_feature (101)..(101): n is a, c, g, or t
  Promoter: Source sequence=SeqID_21824; Location=1..751; Strand=+; Gene=SeqID_45675
tttaatcctcgattatttccaaatcaatnnttcatcaattcttcatcatcttcatcaggttctgtcgatggtgccaaagtcaaacgaccccaaatttcctnttataagcaaaaatttttttgccatttcaccactcagactaaaataaaaaaggctggttttagggattaataggcgcaacaatttgtatggattttcatttaaaaaaaatgataaaaatgtgtcaattaaaataaaactatgagtaaccatattttggtcaaggagactagccactaggcaatccgccccaattgtcgtcgttacttttaaagaatatattaatatatttttaaaattttttccttttaactccaattttcttcactaatttttcactcagacccccattcttaccagtgcttgtttttcccggttgccctaccgggaccgggacctgagcttttcaaaatccgggacctcggaggaccgggaattcccggcccattcccggcccgctcaactctaatttttaaaaaatgcaaactttggccccaatacggaaaaataccaccgaattttatggagagcttaagttttaaattttataataaatttaatttggcgttatgttgttaataatatatttttttgtttgtttttcttatcctccgttccttattttgatgtttttttgtacacctctaccatttgataatcatcattttagggtattcttttaacatcaattttggattccaacaataaaatg

SEQ ID NO: 100810 - DNA, 954 bp, Heterodera glycines
  Promoter: Source sequence=SeqID_12958; Location=1..954; Strand=+; Gene=SeqID_76715
aatatagatattttttcttttccaagtattttatttgctaaaaattattttcaataaataaaattttcaaattcctaaactttcattttaatatttttgttaaacattgcccattcgtatagttgtagttctgaagttgttcaatttttgcataataattttattattttttcttgtttatttcttttttatgaaaatttttgagaatattgacttataaagtttttgtaataattgggtgatttaattattgttataataataaattttaactctatttaaaattattataaattgcttcttatttttcctaatcgtaaaattaaatttatttcagtcaggaaaattccaagatctttgaattacttttgcactttgatgcaaaagcataataatcaagtgtaaaatttatatttaaaattattgtttaaaaatgttttttgtatattgaaaaaaagtccaaaaagcaacttagatgcttccagtttccattaggttaattatttctattgtttcatgatgattttatttatattattgcaaagtaaatgatttagtaatttggtgcgatttattcattttaatcattttgttaattttgacataattactctttgttcaatattttttgcttattaattagactgtagaaaattacttttgagaatgttatttctttgtttcttagatatttttatttttaatttttgtaacccagagtctctatggtcgggacatcaaaacggcaagagcgaacgcccattatctggttttaatgcgtaacccttccggacaattacaagtgaggacactggggtcacaactgttcccaaaaagactgaattatttcatggatgcatatcatgatgcgaccaataatcaatttagttatctcatgattaacatgcacccaaattctgaggaggaatatgaatttaaattaaattaaaaatg

SEQ ID NO: 100811 - DNA, 1003 bp, Heterodera glycines
  Promoter: Source sequence=SeqID_10177; Location=511..1513; Strand=-; Gene=SeqID_73281
gtcatttttttgtgcctctggctctgttttttccgccggttttccggcgccaagccttggccatccactgctcggcatgctgcggcttcattatccgccaacaacattcgcgcatctttctcacggcacaaagtcaattaataaatgtgtggcacaaccaacaacaacggcacaccgctcacaccacaagaaaatgatgagagaaatacatcggcggaggtgaaaagaaaaatttaaatggaaaagaaaaaaagaaaagatgtaagtttagcccccgaggggaaatgggtcgagaaattctcggcaagaaattggcgcaatggttatgaattattcaaatattggagcattggcacatcgcgcgcatagaatgtggtggctgatgagcgatgatgtgttgtgccgaaatgcaccatttgtgccagcaatagtgaaaaaaaaaattgcgtgacagcccccggggcggcaaaaatttacaccaccccaggtaatgcccggaaaaaacttttctgtttttatatgcgttcggcacgcgagcaacaaatgttggaccaatgattttggcacggctaacaaattttggaacaaaaaaaccgtgccattttcgtgagcgcaataaaaatgttgccatttctcattcaacaaattttatttaaacaaaggcagacccaaaaatgctgtttccatcaagcattttcattcaattaacagtaaattcctaattaatttattgaatttttgaaatttgaaattttaattctttttgcaatttttatgctaatttgaaaatgatttcagggttttttagaattactattttttgttataatcgaagatttggctaaaaaatgttaattaaagctaagcggcagatgaattttatttctcttaacaaaaaaataataattttatcataaatttcatttattctcttaaaaatttaattgatttaacataaaagcatttagttttttttttggaaaatttttttaataccaaaatg

SEQ ID NO: 100812 - DNA, 133 bp, Heterodera glycines
  misc_feature (121)..(121): n is a, c, g, or t
  Promoter: Source sequence=SeqID_1038; Location=4347..4479; Strand=+; Gene=SeqID_66721
tttcctaatttttgcatatcgatagagaaaaaaattctgaatttttctatactgattttattttggtttatactcccattccaaaattattaaataataattttaaaaaataatatttttnaaagattaaatg

SEQ ID NO: 100813 - DNA, 1003 bp, Heterodera glycines
  Promoter: Source sequence=SeqID_8704; Location=680..1682; Strand=+; Gene=SeqID_68900
gagatggggagagagagagataaagagagatggagagagagagagggaaaggagaaaaaagagagagagagagagaagttggagagaaaggaagaaagagatggagagagtgagagagagagagagggaaatgggagagaattgagaaagagagagcgagagatagaagagtgatagagagagaaacgtggagggttgagagaggggcaatgacaggtaatgatagagagagtgagggagaaagggagacagagggagggaaaggagaagagagagagagagaagttggagagaaaggattgaagagatggggagagagaaacagagagtgagagagggaaacgggagagagttgagaaagagacagaagagtgatagcgagagaaaattggaggcttgagagagggcgcatcacagatcatcatcgagagagagtgagggagaactatatacagagagatgcatatacagcaatatggatagcatatcggaaagctttattcaagctatattaacaagcagaatgtcaaaacaaatttatggtcaaaaagttggaaaatttggttttttgaactcttctgatcataacttttttaagccttaataaaatttttcagaattttgcaggctaatagaggacacttagagctttcgaatgatacaaacaaagttgaatttagttgacaaagaaaaaagttatagccaaaaatatgctggggccgaatcgtgccggggcgaactgaggtagaccgtgttttacggctattctctacgtgtcttatttgtttttattaaatcatattcgttatctttttcggtacaataataaaattgaaaaatattaatatttgtcctttagaaatggaacataaaattcgatgtataaattttttatttcttaatgataatcatttctttgtcgctgcctctaccgtcattatattatttttttgttaattatatttactaatttattatttacagccattttctttaattaatg

SEQ ID NO: 100814 - DNA, 107 bp, Heterodera glycines
  Promoter: Source sequence=SeqID_11434; Location=816..922; Strand=+; Gene=SeqID_74829
ggtttcgggtcgtctattctagccaacattataaagtagcacggatttaggcctgtcctttgaagaattttggcacattttgtaagaaaaagcttgacgaggagatg

SEQ ID NO: 100815 - DNA, 165 bp, Heterodera glycines
  Promoter: Source sequence=SeqID_23715; Location=1..165; Strand=+; Gene=SeqID_54410
taatttagacattatttcattgaaaaatgttcggcgctttagctgtggggcgcgcgaatattgtcaaaaatcaggcccgaccaatgcccgaaattggcacaaccgtcgcactgtttttggcaccaaatttggcacccaaaaaattcggacaaacttttacggatg

SEQ ID NO: 100816 - DNA, 274 bp, Heterodera glycines
  Promoter: Source sequence=SeqID_13987; Location=610..883; Strand=+; Gene=SeqID_77950
aaattagttttgaaatttttcaattttattacgatattcagatgggtttactgtaacagtgggctttattcggatgttctgaactccgtccccgcttttgtcgtcctttcactgtgctctttaaattacgcggcaatttttggcctaattttgtggcgcaattttcaaacaaaaagaaagaatcaaacgaattcacaaagtttggcaatttttttaatttcaattttactctcattttgaacatttagctgctgatcagtcagtgcgcaggatg

SEQ ID NO: 100817 - DNA, 223 bp, Heterodera glycines
  Promoter: Source sequence=SeqID_16009; Location=1..223; Strand=+; Gene=SeqID_80362
cctttttagtcagggaaattctgtgaattaatgctctttttttcctaaaaggcttatcgccctatttaattaatggatggaaaattatggactaaaataagttagggtctacaaaattccaaaaattttcttcaccatgcatgcgttttaaaaatttacttatttataatttttccgtttttgctctcctattttataattcctattacagtatatataaatg

SEQ ID NO: 100818 - DNA, 339 bp, Heterodera glycines
  Promoter: Source sequence=SeqID_40365; Location=1..339; Strand=+; Gene=SeqID_68726
ttatggcttgatttaataatcattaaaaaattatggggctattttatatcaaatacattaaataaaacgaaaagattattaatcagtttaaaattgaaaaccattaaattcatatttgaataagagttaaagaaaataaaatttcatttagaaaacttaattgtaattcattaataaaatagataaatttttgtttaatatttatcatttttaaatgtctatattatttatttgctaccaaaatgtataattaatttgtcaatattttaaagcgattaaaaaaattttaatatctatctccacttatttatatatatttttagaattttgacattaatg

SEQ ID NO: 100819 - DNA, 647 bp, Heterodera glycines
  Promoter: Source sequence=SeqID_41300; Location=381..1027; Strand=-; Gene=SeqID_69459
acaatcaccgacttcaatccgagtgaaaatgatcacgaattcaacaaagtgtttgccgaacgaaatttcaaacaagttggaaaaatattttttaatttacggacgaattccaaattattattaataaaaaaccaaaagataaataataaaatagatatttaaagcttaagaaaacaaattttgtagtacaaaattttatcggtaaatatttctggacggcaattaaattaatttgtggtaattcttgtaaatttttcgcacttttagcttcggctcaccttcgatttttataaacaaatcgctcaatttgacatcgaaaaaggcatcaagaaagaattcggcgatgccaacaaagcggggtaatggcagaagcagggacgggggggggattaattagccttaattagtatgacaaattgagatgggctggagatgtgaacaattagccttaattagtatagcaaattgatgaactcgttcatcctcattaactgctcaagacacactaaggaaaacaaaattttaatccattaatttaaatccattttctcgaggtttttatttgtggcattttgtcaatttttggcccattaattttaacattaagttatttggcgctcatcaaataccttcgaaaccgccctatg

SEQ ID NO: 100820 - DNA, 381 bp, Heterodera glycines
  Promoter: Source sequence=SeqID_27727; Location=1..381; Strand=+; Gene=SeqID_58397
agtacacgtgaacgtgtgattcagtccattacgttccttgtacatggtagtgagaagtttgtgattacacaacactaaagccttgttcgctcagcatcactaagcagtctgttactaacgtcataagcagaacagttaaacaaattcgtgaattgatcaagcaaactcatctgagcaggagttagttacacgaaaagtgaatgcgtgctttttgaaagaatgaatggtcgaatcactcactacacaccctcaaaatttgtattcaaattttgcgctaaaaaattcgcttcaaaaaatcgtacatagcagcctatttaagtgcagattgtatgcttaagtatacactttaatccttcattaaaactaattttttgaaaaatg

SEQ ID NO: 100821 - DNA, 59 bp, Heterodera glycines
  Promoter: Source sequence=SeqID_18434; Location=1..59; Strand=+; Gene= SeqID_83032
gtgaaaatgaaaatgctaaagttcacagtttttaaacataggatgaacaaaaatcaatg

SEQ ID NO: 100822 - DNA, 675 bp, Heterodera glycines
  Promoter: Source sequence=SeqID_5523; Location=2224..2898; Strand=-; Gene=SeqID_58331
gaatgccattgtttttcgattgacgtaaaaggtgcacttttatggaaattggaactcacttacctatgtttgtttgttggtcatgagacaatgtgtaaaaagagtacgaataaatgggaaattcaaattaattttatttccttcgacggcaccggcaaaaagcgtttcgtcgcatttggccatttttaccttttttaaaaagtgccaatttaagttgcgtctaaataaatgtttgttcgtctcgtctcgtctctcaatttaataataacaattttttcaaaatttaatcgcatttttatttttctcatttttgaaactttgttatgaaaaaggggtaatgcggtgccaatggtgggaaagtgtgagaaaaggcgacaaaattacacaaatataataataatttgcctggcgggaaacttccccttttggccttataattttggagcaattggccagccgacgagtacaacaattgccatttgtataattgtcatttattataattattattggtataattaccatttctattattatcatttattataattattattggtataattaccatttgtattattatcattttagtattcccttaattatttcattaattgaagtgttaatttagtgactaattaatttctccttttaattttcccattcttcaaaatg

SEQ ID NO: 100823 - DNA, 1003 bp, Heterodera glycines
  Promoter: Source sequence=SeqID_2169; Location=1432..2434; Strand=+; Gene=SeqID_78230
tttccttgatgaccattgtgcgtggcgtgcacttggcggccaaaaaacagaaatgcaatttgtgaaacttttatatatatataaaaatttttttctttatttttaacaatttttagcaacaaaatttattaaaagctattcgaaacttttgtaaattaaaaattttccggagtttttattttaaaacttaaaacgctaaaaatattttagattttgacaaaaaaataaacaaaaaaattttcataccttttttatattacggaaatctccatattcatcgtgaatttttattatttttacataatatattttataaaacatttatgcgtgagaaataaaataaggcttatatctcattaaaacattgattatcttagtgtatggcatgcgtttcatcttctagaagagattgccaatatttacaatgacttcaccctactattcataaaaatgcatttttaaatattataaaaccataaatattatataatttaaagttaaaataataataataatcatttttattgttttaaattacctatttttaacgttgtaattacttatttttgatgtgtcttcaaccgcattgcctcatttacactattatcttcttcctccaaatagaaatatcaaatgcatatccaggcgaagaaattgctcatggtaaaagattagtttgtggggactgctggatggaaattctcaatatttcaagctcagcttccagatcaatttaatccttcatgcattttttcgctaaattttctaatttatttattttggtcttgctttttttgatgtcaaataagcgagatatctcaggttaatcctatctgctgaaggattaaatgattttttacttaaaaaagctttttctgtcgggaaattctcgactttcccgcgtcatattcctcggcccctttttcttcatgcctctcaggccattaaagtgccgatcccgtcaactttagtaaaaattaccaatttaggatttcattttatg

SEQ ID NO: 100824 - DNA, 873 bp, Heterodera glycines
  Promoter: Source sequence=SeqID_19841; Location=589..1461; Strand=+; Gene=SeqID_84596
gtggaagtgcacagtccactttggagcgatcggtgtgaacatgagcaatgcattgtttgtgccgccgttggtcaaaagtgtgtaaacagtagaggtgtgccgtgactgaaaaaacccgtgaaccgtgaccgtaaattggtcccgtaaatcatgaccgtgaccgtgatccaaaaaacccgtgaattcacggtaaccgtgaccgtgaccgtgaattttttgagtttattttttctcggtcggtaaattttttgctttttacaccgtctttttttctggtatgattttacaaaaaaaaaatttaaaaaagggggtccaggggagctgatagacgctgccgcaaaaaattttgaaaattagactctaattgtgcgcaatttttgtccaaaaaatgaccaaattttgcgaatttgagccaattttttatgaaataatatgttttgggggcccggcggtgccgatatgcgccgccgggggtaaaatttaaaatttgagtgcggcacacctctagtaaacagcgtggaaaattataaaattaaataaattatttaattaattgtctaatgagcttttaattggataaatctgacaaggatgagtctattttaaaaaatgtgcgagagtttagcataattttgaaactcaatttaagcatttttggaggaaaatgggcccctttttaagcagtttttttaacctttttagatgtttttttgtgcaaaaacctaaaaaaaaattttctgaaggaattgaatttgttgaaactgtaaaaaaataacaaaaaagaattttaggggttttttctataaaaccctataataaagtgagaaactaaaaaatttcagttttaaaaaaatatttcgggggaaaacaatg

SEQ ID NO: 100825 - DNA, 233 bp, Heterodera glycines
  Promoter: Source sequence=SeqID_39541; Location=208..440; Strand=-; Gene=SeqID_68091
attttgcaaaaaataaataaaaccgaatgactcagatttcggaaaatttttttatctctatctttctctgtctacgctctcactccaataaatgcagagacgcaaaataaatttttatttttttaatgcctattgttatttcattgcttttttcttcttcgcgttttcttattatcctacatttctaattacttattcttttatttaaaataaactttttagcgggagcaatg

SEQ ID NO: 100826 - DNA, 174 bp, Heterodera glycines
  Promoter: Source sequence=SeqID_37393; Location=1..174; Strand=+; Gene=SeqID_66477
tttataatttaaattaaaatgatataatcattcaaggattttcatctaaactttggtcaacacgaggaacaccagcagcccgtgctcggatcaaatttaacacaaaggaagcccaatccggttaagagtgaaatttaaaggaaaataaattttaatttagccaaaaaaccgatg

SEQ ID NO: 100827 - DNA, 553 bp, Heterodera glycines
  Promoter: Source sequence=SeqID_3506; Location=776..1328; Strand=+; Gene=SeqID_47635
ttgtgtgtgaattaaacaaaaaaaaaagataggtagataaactaaaaaaataagcgataagctatgcatatgcatacataacagaacagagaaaaaaagatactctaaaatagtacgagttgggtttttaccataacaatcacatattgtgtgttaaatgtaaaaaaaaagaaagcgaaaataattttcctttttgttttagcacataaaaaatgcataaacatctggtctgtacacatttgcttttatcttatcttcaccacgcaaggaattgaattgatttttctttctttttcggctaacattaacgtgtttgggtggacagggaaaaatgttagctcggccaaagggaagtgaaaagaaaacccaacaaaatatgtaggtgcatgtactgagctcattcattattttgaaatgataaatctcaagttgaaacaaattgccttactttaaatgtaattctgcgaggatctaatagcttcaaaaacgagtaatctacataatatttacaaagacaaaacattttgcaagtattcagtaaactaataaaatg

SEQ ID NO: 100828 - DNA, 56 bp, Heterodera glycines
  Promoter: Source sequence=SeqID_5381; Location=2542..2597; Strand=-; Gene=SeqID_57835
tccgtgaacgtccgattcaaagaaggccactacaccaatctgacacggaagaaatg

SEQ ID NO: 100829 - DNA, 315 bp, Heterodera glycines
  Promoter: Source sequence=SeqID_45239; Location=1..315; Strand=+; Gene=SeqID_72575
aaaaattatcatggttttttatcttaaaaaattttgcatacaaaagggtcctccccccttttgtttcaaaaactgtcactttccatatagtgccatgttttttgtttctgcttattttcaggcgggaaaattttttttaatttgaaagctatttgttaacagatgattaaattttaatgctttttgggcgaatttttgaccaaattaaaaaacagaaagagaggttccggcggcgccgataggcgcctgaaaatatgtgtcaaaaaagcggataattctagccatactgatcagaatccaagctcagatattatg

SEQ ID NO: 100830 - DNA, 102 bp, Heterodera glycines
  Promoter: Source sequence=SeqID_6402; Location=3956..4057; Strand=-; Gene=SeqID_61427
tttcgaaccttttttcaaatgttaaatgccacctcaaaatcagtggaatggtagcaccgaattaacaaacattttactgcgacaataattaggcaaaaaatg

SEQ ID NO: 100831 - DNA, 145 bp, Heterodera glycines
  Promoter: Source sequence=SeqID_1064; Location=1..145; Strand=+; Gene= SeqID_67036
gcgcatttttctatcctagaaaaaatgcttcttaaatttttaaattaattttacgcagaaaccacaaaactgcaccattgcccggaaatccaatatttattcaaaaaaataatcgttttcaatttgattttaccaattttcaatg

SEQ ID NO: 100832 - DNA, 82 bp, Heterodera glycines
  Promoter: Source sequence=SeqID_30008; Location=1..82; Strand=+; Gene= SeqID_60463
tctagagtccgacttcctgaaactgctccaagcccaagggttcgacgtgtacgagaaatgcgtggagaatccgtccacaatg

SEQ ID NO: 100833 - DNA, 984 bp, Heterodera glycines
  Promoter: Source sequence=SeqID_5186; Location=692..1675; Strand=+; Gene=SeqID_57204
taatggactggggagcacaattggaaggggaaaatagggctaaaaaaagaaaacggaaaatgcggaggaattggaaggggataggcaaaagagaagaaatttgtagaaatgaagtgatgcctaaaatttgtctatttatatattgctgaaatcacatttttgatgaagttggtttgatattcaatttgcatttgcatctctcaaaagctataaaaggttgaatattctacagtttccaacattcaaaattggtgaatataagcagcaatcgttggatttgcgaatgaaatttaatgattaaatttttttcggttttcagatgggtttgcaacgacctttggattggaaggacattttcccattttttggtcgtcctcaactcggcctcaaattgttcgacccgtttcaattattttgtccgtgaaatttgtcccattatttgtttaggcatttctgcgtgccaccatttctccttcctctgtcagttacaatattaaattcgttcgtttttcgtcttccaacagtgattggctgtgaagcgatgcccaattggagagacggcggcggcggttcagcggaaacccaaaaattcggcggacgatttgaacaaatgtcatcttttatttgtgtgatgccaataattaattgacttggcggtaatactgccgatggtgccccccttttttgaaaaaaaattttcaaaaatttttcagagataaaattgtctttagggtttttagggccgtagaattcgaatctgacatccgttttgacccatttcgaacctcgaacccggattcgaacaaaaattcgaaaatacaatttcctaataattcacatttattcactaaaatcggttcaattgcattaaaatagttgttttgcattgatttgtgtgttattagcatttaatataatatggctgcgttggaagaccttagaaattttacattgaaaaaactgcacgataattggcgttgaatg

SEQ ID NO: 100834 - DNA, 231 bp, Heterodera glycines
  Promoter: Source sequence=SeqID_41163; Location=871..1101; Strand=-; Gene=SeqID_69353
tttgcacatggcagagatgcggtatgtgaaaaacagataacaaaaatatttaaatatttaccgaagtaaataatatttataattaaatattttacgcaaaatgttgagaaattttttaaaataaaactaaaaataaaatttgcttatttaaattttttattcaatatttaaattattcttaaaaatataattataattaaatcatatttttcttttcttttatacagaatg

SEQ ID NO: 100835 - DNA, 82 bp, Heterodera glycines
  Promoter: Source sequence=SeqID_4831; Location=408..489; Strand=+; Gene=SeqID_55880
ggtatttgccttttttcaaaaaaaatatattcaattttaatattaaaaattccaatttttttttcaaggcatcgaatgcatg

SEQ ID NO: 100836 - DNA, 447 bp, Heterodera glycines
  Promoter: Source sequence=SeqID_38609; Location=359..805; Strand=+; Gene=SeqID_67376
tgtttatcgtttactatggaagttatcagcactgggacaagtaatttttttgttgttgtttttatttcattgatcaaagatttacgaaattttactgcgattttgatcattgtacctttacaattttttaataaatggttttaaattgcctaattaagcaaccaattaacaaaaaaaaaacctaaaaactccgcctaccaaatgactttttatattacagtatttcctaaaatacagtctccggcgggcggtttattttccaaccccctcagcagaagggtggctttatttcagagggaaggctctaatttagtgggagattttttttcagcccccctaaaaaggacggttttattttacgggggggggggctctattttaaggatacggtatttaactttttttaattttaacgataaaaatgataatttttattaggccagtatg

SEQ ID NO: 100837 - DNA, 411 bp, Heterodera glycines
  Promoter: Source sequence=SeqID_6506; Location=1872..2282; Strand=-; Gene=SeqID_61823
agtgcgttttaccaattaatttaaaaaaatacttttaactaattgtagtttccccgcgacctatgaaattaaaaaaaaaaattcattggtattttctttccactctttgctcggaataggccgtttcacctccgagggttttgttttaaatttttcaaaaataaattttcaaaacaaaaatctttgggaatatttttaaataaagaaaaaaaaatttgtgggccacaatgccttaccattgccaaaattgtaaataaaaaagtttgttttttttgaaaatttctgtttgaacgtttttcaaaaaaaaaatttctgggggaaatgaagcgcaccattatttgctaaccctattcctctttccttgattttccagaaaaaaataattgcaccttcctttttcaacaaaaaatg

SEQ ID NO: 100838 - DNA, 394 bp, Heterodera glycines
  Promoter: Source sequence=SeqID_40680; Location=237..630; Strand=-; Gene=SeqID_68933
tttcttttccttttcttttctctcaattttgtcactaaatttcacgtgcctttttccttttcttttcctctctttttacttttctcttgtccttttaaatcctttcacttttgtatgtcgttttttgtcgttacttaaagtctttttttttgccaattttgtggactttgtttttattacatatacctaggtatgtacctacaaaaaaaacgagaagcgatgaaaacgcatctacagtcatctacctatttcggttcatattttaagatttgtctgtatagtaacaagtaaagccaaaattaatttgttctattttagctccagtgatatttattttttggtgtgatttaaaagtttatttgagtaaaaaaaaagtgaaaaataaatgaaaatg

SEQ ID NO: 100839 - DNA, 801 bp, Heterodera glycines
  Promoter: Source sequence=SeqID_5587; Location=1508..2308; Strand=+; Gene=SeqID_46075
attgttttcggatgttcgatttttcggaagaccctttggtcctctcttttttgtcctctgcgcaaacgaataaaggaacgggttcagttggtatgtctctgtaatgaactttgatctttttttgttgtcttaaattccagggagtggatgttctccatcgtgttcagtgtacgacgaaaccacatcagtttccaagccagtggatgtgttaattacagcagacaataataacgttggcattctgccgggtgaagcggaagaaacggaaggcgggagcaatgaaacgccgtgcacttccacggaacaaaaggtcaatgaaaaaacaggcgctacttgcaaagcggtcctttttgaaattttttttcactttttttggtcacatttttttttttacacataatgatgaatattaagaattaatagcacaattatggtgaataaaaagtatattcacgatttttaaccaaaaaaatttttacaaaacaaaagggtcccccctatggttttttataaaattcaaaatctatcactttataactagtgccaaatttgcttaacaggcccaaataattgtcatattcatgatcagcgacctctaaaacccccgggtacttggtttcaggactttttaaacaaaaaaaaaatgtgaccaaaaaaagtgaaaaaaaattttttgcaagtagcgccaaaaaacatttaaataccgtatggctcttctgcagttaattctttttattaaaagttaaattattacccacatcttattagtccgtctcaaatcgtcaaaatttgtccaaaatg

SEQ ID NO: 100840 - DNA, 86 bp, Heterodera glycines
  Promoter: Source sequence=SeqID_8832; Location=1510..1595; Strand=-; Gene=SeqID_69350
ggtcgcgctgctgctgaacccgccttttaatttgcaattgttaaggcattctgagcggtgaactgaagcacgggccgctggcgatg

SEQ ID NO: 100841 - DNA, 502 bp, Heterodera glycines
  misc_feature (76)..(76): n is a, c, g, or t
  misc_feature (92)..(92): n is a, c, g, or t
  misc_feature (111)..(111): n is a, c, g, or t
  Promoter: Source sequence=SeqID_31592; Location=1..502; Strand=+; Gene=SeqID_61918
taaaatataagcgtattgtatgtgcttatttgagggtggctaataatttcgatgcagagaaatttcgacaaactantagaatgagatggctntatttaaaataaagaattngatgaaattaccgttggtaaaaatgaaatgaaagacaaaagattggcaatatttaaattcgatagaaaatgcagaagtgtcgatttttgaggaaaaaccatacatataaaaggcagagaaaaatgacagaaagtgtctttttttttgcaatcataatttacgactaattaattataagtgtgttcagcgctaattgccacaaaatgaagcgaccttcaaggaaaatgtaaagaatttttaacaaaaaatttcataattacctattttttacgcatttcagctggatttgtcttgacgtttggatggacattcttcggcgcgccaacgattcgtcaactcgacgattcgtcaactcagccaaaatgcgacgattcgtcaactcagccaaatg

SEQ ID NO: 100842 - DNA, 68 bp, Heterodera glycines
  Promoter: Source sequence=SeqID_33740; Location=1..68; Strand=+; Gene= SeqID_63712
aagcgaagagagatgccgaagaaaaggccaaaaaagacgcagaagcaaagaaaaaggaggaagaaatg

SEQ ID NO: 100843 - DNA, 259 bp, Heterodera glycines
  misc_feature (16)..(16): n is a, c, g, or t
  misc_feature (95)..(95): n is a, c, g, or t
  Promoter: Source sequence=SeqID_6203; Location=1..259; Strand=+; Gene= SeqID_60699
atcgcgtagcaatttntttgaaaaaaatgaattttcaaccatttataattattttttcaagaaatcagaaagacgaattttccgaaatttaaagntgtttagtacatctgggattgaaaaaatgtaattttgaacccaattttgggcataagcgctaatgtctcagacgcaattgtccccccccccctcccttattttttatgctggtgtttattaattttttaaatttaataatataaataaattttagccaggaatg

SEQ ID NO: 100844 - DNA, 201 bp, Heterodera glycines
  Promoter: Source sequence=SeqID_3029; Location=1..201; Strand=+; Gene= SeqID_82850
gtggtccttctaattaagcctcggcaaaacttttaaaaaattttagtttagctttcaaaaaagttacggccagaagaaattcaaaaaaccaaatttttccaacttttttcggccatcaaattggttcaaaattaacaaaattttttggaattttgcaggctagtagatcatctgaagagctttcgaatgataccaacaatg

SEQ ID NO: 100845 - DNA, 1003 bp, Heterodera glycines
  Promoter: Source sequence=SeqID_207; Location=8162..9164; Strand=-; Gene=SeqID_77582
taaattcactgccaccgtttacggaaaaatttttatgacttaattggaacgtacggcggaattcggactgaaaatggcttgcatttaaaggctctaagaccaatgaaaaatcttcatttaaaaaataaaatacaataatttaatattaaaaatatttaaacaatttaaaatgcaacatataatgttgagaccgattgatttccgtcttttggtaccaccgataatggcacaccttgtaatttttaattaaaatatttaaatgtataagcttaagggcccaattgtttaccaaataattcaaccgctgcgcgactcaattaccaatttggaagcaagcacagtatgttttatacaataatattaaaaataaattattttgaattcaagcgtccattaattgcgaacgcagaggcgatcggcaatttgttaacgaattttgtaagaaaattttaatgtaaactttttcttttattatgtattaacagcctcaacatgttagagatgctgtcaatcgagtatttgcgcaaaaagtgcaggaagcaattgcagaaattcaggctgatttgaaaattaaaatttgagatttaaataatttaatttaatgatttaactaattaaatgtaattcagcaagcggtaggcgccagaaacatggaaccccaaatagcggcacaggagcctcagccaataccgaatcagcggattgcaggcaattctaatgactaagaccttggcctgtgataggcattcaaatttaaaaaatatgtggatttttattttctatttaataatttaaattcttttaatcagaaactacatgtatagtgataattaacaaacttaagcacataacgctttttacccatttcaaagttttgagaggcaattacgaccattttcctctgacattagttactcaaactacattttacgaaatcgtggacttttgccaacttttttttttcttttcaaaatttataattaaaatatttctagatgaaatg

SEQ ID NO: 100846 - DNA, 1003 bp, Heterodera glycines
  Promoter: Source sequence=SeqID_24147; Location=764..1766; Strand=-; Gene=SeqID_54846
tgagataaagcacattagattgggcttaaaattctctacaaaaaagctcgtagacgattttttgataaaatcaactcctgacgagttattgcgccagaactgaaattgaggcctagcaaccaaaaattttctatttccaaaaaaaattttaaaaatttttctgaaaatgacaccaatcgatagagcatgaaaaacggttgcttgaaagtggtctccgttttccccggaaaaatctgtaaaaaattataaaattcaaaaacggaaaatttttgagggggcctagctcgaaaatttctgaaaatttctgaaatctaaaagcatggttggatagagctcgtcaagctgtacaaaaaagccgcttacaccgacctcctccggtcaaaccccggcgagttattcagccggcgctgaaatggcccaaaaaagtatgcaatttttagccagtttttcggaaaaactgacaagaccttggggttcggtcaagaaacaaaaaaaatccaaaaaagtccaacttaaaatcctatcgaggccgatttttcatttaagcctttaaaaaatttttgaatcccaaaaactgcaaaaactgcttcgaaaaaagtgacttttcggcgcctggcgctcagttggccctcggatcggaaaatctatagttttcctgaatgcgccgtcaaaagttacccccaaggtcgaaatttcgaatccctcccggcaaaccgtaaggagattttgtttttggaaacgaaactccttgtttctttagtagtatataactagggtgaccagttggctttaaagtagaaaaaatacttctggaaccccaatataatcggtattgacataagcgcttcgcgcaaaggacttcgttgctagttcttgcgcggacatgaggccagtttattaaccgtcattagcggttggacaatttttttttgtaaatgtaaactgtccaacccccagggtccaccacgcggaggagcacggtgggaaactggcaaaaaccatg

SEQ ID NO: 100847 - DNA, 543 bp, Heterodera glycines
  Promoter: Source sequence=SeqID_16064; Location=1412..1954; Strand=+; Gene=SeqID_80421
ggttaaaagaacgtttaaaattttctcaaaaaggtattttcgtggcaagaattttaatttaaaaaattatttttttatgtacctattttgtttttttgcccttaaaattcccagccctactcatttgcaatgcaataagtgaataaaaattatttttacttaatttttgtctgaaaattatgtcactattcgtcactatttcggactttttgtcactatttcttcactattttggcatttttactcactattttagttaactattttgggatttttcgtcactaaaattcacagccctaataatcaatatatttaaacttaacctattttaagaataattccttatattatcattattttagaaattttataaccatttatttaaatattattacatacttcttttgttatgaattaaataaaatttgacagattatgtttaaatatttcaaatataatttttaacgtcatttactatttttgtaatttttgctgtttgaaaacaaattaaattattttttttccagctttgtagtgcaaatg

SEQ ID NO: 100848 - DNA, 400 bp, Heterodera glycines
  Promoter: Source sequence=SeqID_6667; Location=925..1324; Strand=+; Gene=SeqID_62406
ttttggcacttttaattactcttccaatgccttttattctcccgaccgatgaaaaatgagaatttaataacaattatattttctatatgttttattttgtaatcaaataataatgcacatttaatgaatgtttcgttcgtttatttgccaatgcaaaccaaaaaatggcctattttgggctacccgaattgccctggcaaatgccccccccccctctcagcaaaggacgatgctttccgccacgcccatcccttctccgtcccctcgggcatcgttgtccgccgatttcttcgcccccagccgaagtgccgttgttttgtcctttcgtttcttttttattcttttctcgtttcccggtgtttgaagacattgggctggcgaactccgttcttcccaaatg

SEQ ID NO: 100849 - DNA, 173 bp, Heterodera glycines
  Promoter: Source sequence=SeqID_4931; Location=1659..1831; Strand=+; Gene=SeqID_56257
tggcaggagaatgaaattggaatgaggttaataaattttacttttatattcgcaaaagtgtggccacgcctacactatttgaaaagagtcacggttttagacacgcccactaaaagccaaaacattttgcctgccaaaaacccagaatcattttaccaatttttgtcaaaatg

SEQ ID NO: 100850 - DNA, 622 bp, Heterodera glycines
  Promoter: Source sequence=SeqID_233; Location=186..807; Strand=+; Gene=SeqID_78833
ttttggggtatgaatgtgctaattgaaatgtttgagcttttatagctttgaaataagctccgcctacttaaagccaattaaattcacccgctcaaagctcaaattcattttataaaatgtcatcattatctcccgaaagaattatgtctcaagctccgtcccctagaaaggcaaaagttgacgagcgagctctctggaaaatcttcaagggcaagtaaatgctggcaatttatctctgcgacgatgactggcgaaaactgtacgagaacaaagagaaagtcagacgactagaggacgacgacgacaatgtggcccttagtttccaaatgtgtgaggattgcgcgcgcgtgaattgcaatgcaactgacataatggcaccaccgaagaaacgaaagatcgagaaagcttaaggacttcataatttattgttttttttcatgcttatctcttaaataaatcgttgtaattcttttgcgcaatgattgggtgtgaaagatggtagcggagtgggttgggtttggttgttttggtgtttttgtttcaatctcgactcattcacccatccgcatcccttctcgtccaattttcaccgaagaacaattcaactgctgccatcaacatg

SEQ ID NO: 100851 - DNA, 140 bp, Heterodera glycines
  Promoter: Source sequence=SeqID_8526; Location=3293..3432; Strand=-; Gene=SeqID_68402
tttcaactgcttttggcatttttgttccattttttttaagaaaaatgaattggacctgaaaattgcttaatttttaagctattaaatacccgaatattggtttgaaacctgttcaatttattttttagcatttaaaaatg

SEQ ID NO: 100852 - DNA, 1003 bp, Heterodera glycines
  Promoter: Source sequence=SeqID_54; Location=5611..6613; Strand=-; Gene=SeqID_56538
aaataaataattaaacgagtttttttattatgttgcttattgcgctgtttgttgattaagcattgtcctgttttatcagtttttgtttttttttgcttttgcgcagaatgctgaacgattattcgatcttagcgggggaaggtggaaggtaattagggtaattacggggggtggggaatgatgggacgaagattatggaataattgcaaaaaagacaaatattcggctgatttggagcaatgaacgaatatcaatgatttttgatcagaaaataaacgaaaacttaaaaaaaggcattggaagacacagagattaaaaaacaaaaacgaaaattaatgggtaattaaaaaataaaacgaaaaataaataaataataaataaaatggacgaattaaaaacgaaagaataaaataagcggcgaatgattagtgaatcgaaatgaatgagaatgaatttgccattttgttgatcatttttcatatcacaactcttttttttatctccacgtggtcaatttggacaataataaactcattttgacattaatttgtgaaaataaaccataaaatattattattattaataaatgtaaattaattaattatcagtgatttttaattaaaattactgacacaatgaaagaaaataaattattataaaagagaaaaatatttctcttaaaagaatggtaattataattcaaaaattattttaaaaaatctcccgaaattgcaatgttttgtcctgaagaaaaaaaaagaattatttgtttgaatatatgctaatttattaaatttctcaacaaaaaccaacaaatattaagcaaacatttgaatataaaattgtgggttttattgattccacgcaaaaaaattttattttttaattttttcatttatttattttattttttaatgggcataaatttattaaaaaagaaaaagaaagggattttcgttagaattatttataatttatttttgaaatattaaattcagaaatg

SEQ ID NO: 100853 - DNA, 279 bp, Heterodera glycines
  Promoter: Source sequence=SeqID_16217; Location=2483..2761; Strand=-; Gene=SeqID_80590
ggtaaataaatttaatactttttttaattatttaaattgattaaattaatttttgtgtgtgtttagatttacgaacattggacaacccaagcatttgcctctgttctgtcagtatttttgcaagaaaagttcgtttctgttatttgtgctctttaaatggaatttaattagtaaatctttaaaaatatattttaaaggcattccaacaaagaccaattagacgtggtgccggacaaattcaacgaatgttattttggcgcacagacagtgccacggatg

SEQ ID NO: 100854 - DNA, 698 bp, Heterodera glycines
  Promoter: Source sequence=SeqID_30872; Location=1..698; Strand=+; Gene=SeqID_61261
atttatttgatatctttcaaatattttatgggattttcttttaatttcgtataaaggtttatttggaaatgattacattgaaataagaaataattgcataacaaatatttgaataaattgtgatataatcaaaaattaatgaatgaataaatgaatattttagtggtttaaaaattatacaaatttgcttctttttccgtgaaccaaaaatgtaggaaaagaatcccactgaatatggggaagaagcaaaattaaaaattgaacaaaaaataattggcaaaaacattggaaattttgtcaaaaaagagacgaaaagtgaaaatattcaggaaaataacaggaaaaagataaaaatggaagaaaaagatgaagaaatgtcgcaaaaatttggtcagccacaaataaaatgggaggaaaaattttttaaataaactgaaatgcaaattaattattattaaataaaatttgaatttttcgttttaaaattaaaatttagagaaagattttggaggcgaaacaaataaaataagaagaataaccaatcgaaatgatggccaaaaaaagcaattagttgagcaatttgaggaaatgagaatgccttttcagcgcgcgggtgcccattcaacgagggaatggatgaaaattgagagagaaattgccgaaaagattggcacttcccttacatcaatttacagatg

SEQ ID NO: 100855 - DNA, 242 bp, Heterodera glycines
  Promoter: Source sequence=SeqID_4217; Location=1..242; Strand=+; Gene= SeqID_53644
actgaaggcattggtcgattttttatacatttattaaaagagagaaagagcaaagatttaaggaattttatttctctgttttcaattttttaatttcccccctttttttactataaaaatgtttgctttttccatttgcctctcattatttaaaaatatttctaacataattattattgtgcccttttgacgtccttcttcgcaattctaatacggcaaattgtgctaattgccacaaaatg

SEQ ID NO: 100856 - DNA, 985 bp, Heterodera glycines
  Promoter: Source sequence=SeqID_18618; Location=1787..2771; Strand=-; Gene=SeqID_83271
tttgtagaccctacgcttgcgattccggccttcggggaccatacagttggagataccgaaacttggagacccgagagtcgcagatacctatatggctgtactatagtctaccagccacaaaaactcgcctttaaaatggtcaaacccggacaaatttggtttcattcgaaagctcttaacgaattttccgttcaaaaatcaaagaataaagtaaaaaaaggcgccatctaagaactacgacaaatgagtccaagtgaagatagatatttcagtaccaaagaaattattgaaggcaatgttttagccattttttgttttcaatttacaaaataaaatttctatttttttttgtctttttcagtttccataacaacccctccgggcgtttcattgttaatttgtccaacctcatcttatagatttaaaaccaatgtgtgagcactttatggggcctctgtttgtttgtcctacaattttgggcagactctgtgccatctttgtcagtgccatcttttgagaccggacccaatttgccgattttcttcatcattttcgtggctttttcattcttttttttagtagttgggcattattgaagaatctatctttgtggcaaaacaaattgtttgctcacatgctcttaaaaaggggcaagctcaaatttctttttgtaaaaatattctttttttattttaaattgatttttttgttggaagggatggacttgggaataaaatatttttatttatttgaaattaataaaatagtccaaacattggattataatttagttaccgaagcattttaatttttttttcctcatcctgttttgtatttctctaatttattctcatccaacattaaatttttatgtctataattagggctgggatttttatgtttttacatattttttctgccgcttagttatggcgagagaaaatagcatttttttagaaaccggaaaaatttgacgccgaagatg

SEQ ID NO: 100857 - DNA, 75 bp, Heterodera glycines
  Promoter: Source sequence=SeqID_24298; Location=1..75; Strand=+; Gene= SeqID_55018
cctattaatctctttggtttttgaaaaagcattcatttattatacaatatttcttcaatcctgtgttgtcaaatg

SEQ ID NO: 100858 - DNA, 276 bp, Heterodera glycines
  Promoter: Source sequence=SeqID_475; Location=1177..1452; Strand=+; Gene=SeqID_53800
ttctcaattactggtgttaatccgagttggataacagccagacgtcaatcgccgaatttggagaatttctacattcaattgttaatccgagacggataacaattgcgaatcactgttaattcgagttgaataacagtgaccgtccatcatcaatttcattgttaatccggttcggataacaattgacaatcactgttaatcccagttggataacagttgaccatccatcatctttaatttgatcctagtttggacaaattataaaacgcaacaatg

SEQ ID NO: 100859 - DNA, 403 bp, Heterodera glycines
  Promoter: Source sequence=SeqID_12712; Location=1664..2066; Strand=+; Gene=SeqID_76403
atgtatttaaagtgatttattatttatattttataattttttaaaatgtttattttgtttgttttatttttgataaatttttcttcgagttataatagccctattctctaccctgaacgatccagggacaccgaaatgactgacatttattataaaatagcctcctttgaccattcctacttgaataaaatgaatcaatctgaattattctcaatgattgatgaaattgttgaaaagtttcaactttgtaatgttgaagaaacgaggtcattatcgagatgggtatactgtatgcttttggttttgttgtggatagctattgttatgacaggaattttcctctattttaattcattaattagaaatttatgtaagcttatgcatatatgtagagacgaaaatg

SEQ ID NO: 100860 - DNA, 212 bp, Heterodera glycines
  Promoter: Source sequence=SeqID_39642; Location=225..436; Strand=+; Gene=SeqID_68160
tttggtcttggtttaattttaaacattcgtccaaaatttgacacttacattaattaagcaaaagtgaaaccattagatgggattgacaaccgacaaattttatttttacattcttaaattttttaaaaattttattaagccggtcaaagacatgggcagcaccaagttgggaacaatgaacggcacaaatattatgagaagcgcaccgaatg

SEQ ID NO: 100861 - DNA, 79 bp, Heterodera glycines
  Promoter: Source sequence=SeqID_15633; Location=742..820; Strand=+; Gene=SeqID_79926
ggcggcacaattttgtgccttcctgaagaaatgggcgctgaagccgtacaacgacagcatggaggcgtacatcaacatg

SEQ ID NO: 100862 - DNA, 476 bp, Heterodera glycines
  Promoter: Source sequence=SeqID_3417; Location=1244..1719; Strand=-; Gene=SeqID_84601
tttttggtggttgtaatgatggagatggtgtttgtggttaggattttggatttttggaaaatttctttacaaaaaatagacctataaaaatttacaaaaaaaaaaaaaattgtcgcatgtgaatagaaagaagttttttaaaaaatattcatctcaattaattcttatgtattttcatttaaaaaaaaacttccctcattttcagagaaaaaaaacgaaatttatttcagcttctttgtcattttgactaaaaaaattattccatgaaaaaattctgccgattttcaattttgtgcctttttttttgcctaaaaaatccaatccctataaatacagttattattattcaaaacagaaaatgggaaatggttgcatgaattggtgctgctcactggccaagctgttctcttttatagccacagattttgcttaaaatttacaagcaaatttcatcagatgattatgatgacgtaatg

SEQ ID NO: 100863 - DNA, 1003 bp, Heterodera glycines
  Promoter: Source sequence=SeqID_18837; Location=1213..2215; Strand=-; Gene=SeqID_83532
aggaaagcagttcgtaaatttttcatacttaaagtaaaccgtaccttctaggacttttagatttataaaatgctttataacggcggcaaatttttaaataagaaaaattatacaattacctttgaattagcaggaagttttgtggtaagttgaaaataatcagttggagcatccatccttaaaatagtttctagccgaagtctttaggagaatcatcgtggcactgtttattccgtgtctttcaatccttttactcactcggaagcgcccatttattttgccactgtagggaaaaatagggtgagcaaattggaatgggaagtaattggttatgcaaattcatacgtaatgagtgttgttttattcaggtgtctgtgtacctttgtccacccgaaaagggctttcaattggtgcggcaattcgaagaccaagacgcggtcggttggactttcttttgttttggagttttgctttgtttcacacattttctcagaaggacgagttttattacacggtcacttgggcttataaccttgaaaaagcacaacatgtgttggtcgtcggcggatttcgcggaatcatccgtgtgattagcccactcaatgggcgacttcattgcgtaattcaaaatttgttgcatatttattaattatgtttgtgtcggctgttaattaggcattaatcggtcacggcgactccatcaacgaattgtgcacttcgcccgtctctccgatgattgtcgcttcagcgagtaaggatctgacagtgcgaatttggttcgtttggttacgagtggtgagcagtaaattgatttgaggaacgtcacttactcgcaatgtttggccatcctcggggggaccaacggacaccgtgaccaagtgatttctctggtagtcgtccatcaatttttcctaatgacttattttgttgcaattcacaaggatttcgattcgtccggcgcttttttggccactgcgagtatggaccacgcggttaaactatg

SEQ ID NO: 100864 - DNA, 846 bp, Heterodera glycines
  Promoter: Source sequence=SeqID_18061; Location=1..846; Strand=+; Gene=SeqID_82651
taaaaatgtatacaaaaataataaaatttaatgtacacattttcgttttgttttttcattgctccctttggcatcatcagccgatcgatcaacagtcaattcgcaattttgctgtttttgttgtcactgatcagcggcagccagcagagtttaatgttgtcgtccttttttatttgctggttaaattggcgcttttggcattttatcgcagcggcgggaaaagtccaatgatggcagcctcagcttcatcagcggaagttgtacaatttggcacaaaatgttgttgaccattcattttggatggcatttgatttggtggatttaaatatggcaaaagtttcaaatttttgccatttttcacatttttccctcttttatagttaaattttgttgtcattttgtccaaaatttggcaaatgttctcactccttttactaattgcacgtgcgttcagcgatcagtcagcctttttcgcccattttcacggaaaaaacagatgaaaacattcgcgcacccaaatttactcaatttcatttattttattgcacatattttgagtaaatatgttcattaaataaagccaaaaaacattgcaattagtaattctttttccttttatttttttcggctttttgacatatgaaaaaattatgaataaaatacctaacaaataagcttctttggcggaaatttatgtaaaaatgacacgaaacaaaaaatattttcatcaaaatattattattattattataaaagctgattttttaatgaatttttgttaatgattattttaattgtttttattcatttaatttcatcatctgttcagttgaatctccaccgatg

SEQ ID NO: 100865 - DNA, 149 bp, Heterodera glycines
  Promoter: Source sequence=SeqID_1149; Location=1..149; Strand=+; Gene= SeqID_68759
aattgattggaattgaattgctaaaataattaaacttaagtattttataaataaattttgaaatggtgcggccaacgaaaggcactattcaaaaacgcaatgccgcggcggcgggacgcgccgttatagaggcgcaaaaggcaaggatg

SEQ ID NO: 100866 - DNA, 967 bp, Heterodera glycines
  Promoter: Source sequence=SeqID_8832; Location=136..1102; Strand=-; Gene=SeqID_69351
agacgaaggaatcccgcaaatcgtgatgccaaaactacccatggacttaattttcgactttgattataattaattaatttattttgttaggattgttcttccgactttgacattgcaattttatccattttacttgtaattaaataaatttgcttcctagccaaacacgcaaatatttagtacaatgactcattttttataagtcaacgttctttctgttttcattcttttcttttccatataatctttctgtgcgttctttcatcatttttcgctcccttcacttcctttattttagcattcgttcatttttcttcctccacactttgcgaaagtgcattctattgattgttttttacggaaatcttttaaatttccctttaaattttctgttttaattttatttttaaaaattttccgagcggcgcctgtcggcaccattaggccacaacagcatccttatttttttaaaatcagctcaaaacatctaaacttggccatttttggaaaaattctgttaacaaatttgttaaccattatttccggcagagtttatcggcaccgtcggcccgcccccccatacattggatttagaaaaataccgcataaataatccattcatgatcagcgaaacctcataaagacttttgttatttattccctttctcctccaatgttcagtttgggcatgtgcattattgggttgttattatttttacaacatttgtttatcaattggttgtgtccctgacctttctttccacgcctccccactgctcttcttccccactcatttcgtcctccattcattcacttattcatatcatcttctttcgcccaccccattaccattctttttgtcttcgatttcattctttttgtcttcgatttattttgtgtttattactgattacatttcagtatcgtttaatccacataaatcaattgcgcaaacgaagtccaaatg

SEQ ID NO: 100867 - DNA, 271 bp, Heterodera glycines
  Promoter: Source sequence=SeqID_29285; Location=769..1039; Strand=-; Gene=SeqID_59805
ggcccatttcaactacccgaactcggacaaaaagaagaaaatttgaatttttcaggattcgtttttttcaaaaaaattggatcgtaaatggaaatgtgccattttcgaatggaaaagtgccattttgaaatgaaaagtgccattttgaatggaaaagtgccattttgaaatgaaaagtgccattttgaatggaaaagtgccattttgaaatgaaaagtgccattttcgaatgccatcccctctccatttttcagattgttgcctcagaatg

SEQ ID NO: 100868 - DNA, 271 bp, Heterodera glycines
  Promoter: Source sequence=SeqID_39814; Location=1450..1720; Strand=-; Gene=SeqID_68290
tcattattaatgctaaataaaatgttgaacagttaaaattatattttcaaatttcttaatttttcaaaattgtgtcttccacctactaattatgcattattctacttaaaagttacatcttccaacgtttaattattttcgtactttattttccattcattaattatgcatacgataaaataaaaaggggcggagcttatccatttgagttggaacaccggtataaaagccgctcgaatttcttcattcagacattaaaaaatctgaaatg

SEQ ID NO: 100869 - DNA, 392 bp, Heterodera glycines
  Promoter: Source sequence=SeqID_37131; Location=404..795; Strand=-; Gene=SeqID_66281
ttttccgtgctgagtcgatccacaaaaaactcagtgaataataataattttgtattatattatgcgcttcacaaaattcatgtgtcaaatcaataacactcaatattaaataattttcgctgcctgtaactgcaaaattaatatacatatgaattttatttaaaaaatatatatttataatattattctaacctagaaaaatgtataaaatttttatttttttcttatctctatttgagtattcggttactactaattctggtaatatatcaatgaaatttaatcggaattccaaggaatgttcttttttttgcaaacggaaaaccgatcgaattctgatcatttttaattaattatacgcaaatagtaaaacaacaccgtgcaggcaaatg

SEQ ID NO: 100870 - DNA, 179 bp, Heterodera glycines
  Promoter: Source sequence=SeqID_34983; Location=639..817; Strand=-; Gene=SeqID_64660
acattgtctttttttaaaaaatcaattattcaaataattgtgcatttttctcatatatttttcatgaccaattgtgtttttgatgagtattgctcatataaatactccttttcgctgcatatttatcattaaaataatatttaaaaaatatttatggatttttattagatttaaaaatg

SEQ ID NO: 100871 - DNA, 1003 bp, Heterodera glycines
  Promoter: Source sequence=SeqID_2534; Location=2831..3833; Strand=+; Gene=SeqID_80246
acaacgaaatttatagttaaaaactttattgaatacctaacaaaaaaaagtttttctcttagttattaggacaactataataccatgagaccagggatggcacggaatttcgatttccgaaaatttttggggcctcggaatgccatccctgccatggacacaaaatgccatgggacgcgtaaagtgttgttgggacgcgtaaaatgtcatgggacgcgtaaaatgtcatgggacgcgtaaaatgtcatgggacgcgtaaaatgtcatgggacgcgtaaaatgtcatgggacgcgtaaaatgtcatgggacgcgtaaaatgtcatgggacgcgtagtgttgttggggctcgtaaaatgtgatgggacgcgtaaaatgttatgggacgcgtaaaaccgactagaaccaattttaattattttttccgtttgacgcacatccgaccaaactgacaaattattgtagaagatactagccgcaagaaataaaaaagttaagaaatttgtccgaattcgggttcgggattcgaaacatggatgttttgcacaaatccgaccaatttcagtcctaaacaggtactcacgcgaaaacgtaccccacgcgaaaacggccacgcgaaaacgtaccccagccacgcgaaaacgtccccacgcgaaaacggccacgcaaaatggccacgcgaaaacgaccccgaccgacaattatttatgaagttcattttacaaaatttctttttttttatttttggcttaatgtcctttcggcgctttaattcaaattaatagttgctaggcgtgccaatgtgtggcctaaaccattttgttgtcttatcatctcaaacagccaaaatgaataagcttattcagaaatacaaatgaataaatacccaatttagcagcagcggcagcagcagtagcaacaaatcacctcccccccccccccttcctattttcaaaataatcccaaaaaggcagcgccataacaattactcaaattcagaaaatg

SEQ ID NO: 100872 - DNA, 175 bp, Heterodera glycines
  Promoter: Source sequence=SeqID_16064; Location=1181..1355; Strand=+; Gene=SeqID_80422
tttctgttgtcgggcagaccaattcttaagggataaaaaattcatattattttaatgacctaaattaataataattcaaccaactttcttttgcaaattcaactaattgcttttcaacaaccctccaatttcaaagtcgttaatttccaaatttggcaaattttctgggacaatg

SEQ ID NO: 100873 - DNA, 1003 bp, Heterodera glycines
  Promoter: Source sequence=SeqID_6667; Location=2816..3818; Strand=-; Gene=SeqID_62407
cgtcttttttcgctgcccaacatctccgtcttctgaatttgtctcataatcgactccacaaattcgactatgactccttttctccacttttccaagtaattaaattattcagttattttttaaaattaaatttagttggaatctctcgacctttcctggaataatttcaccgcaactccgccggacatccgccaatttgtggccctgcgaatgctaaatttcagcggaaatcccatcgagaaaattgccgaaggggaattggcccagccaatgcttcaggcaataaaaatacattaaccaattaatccgcttcacttttcgcctaaagacgcttcaaatttgcgactgtcattttctgcgtttggtcgaaaggcgggcgttcgccgcattgccaaatttgcaattcgtccgattggccaacaatccaaagctccaatttgtgtccccgggcgccttctccaacaactcacttctttttgagtcagtcctttcccccgtcctcggaccactgatcagtattgtccaattaccctctaatgccttctctgatcaattctttctctcgatcactgatcagtatgttccaattgctcctacaattccgtctctgatcagtcctttcatccttccctatcactgatcagtctcctctcaataattactctttagggtcgacttctccaacaattcgctgtccaccctctcgcccaaccttctgcttctccccgtccgtcttcatctcagttccaatccctttttctgcgcttgcgtttctgcttggatgccaaatattttccaaaaaataactgaccttaatgaggctatttgcgtgtcatcagctgagggggaaaatcagcggcgaatttcaatggcaaaaattgcggagagacaaaacaccgaccaaagaacgggagagtgtccgcgcgagccgattttgccgatgggcaaagaatttagagcaaaagttggccagtttttttcgttgtattgtgcgccgagaatg

SEQ ID NO: 100874 - DNA, 256 bp, Heterodera glycines
  misc_feature (14)..(14): n is a, c, g, or t
  Promoter: Source sequence=SeqID_7249; Location=1..256; Strand=+; Gene= SeqID_64253
agggtttacccccntttcctcacccattttttcgaaaaaataatccctagaaaacattacttttggaagcagaaattttttttcgataaatgaggtgggaaacataaattttactattaccaaaaaatttctaacaaaaaatttaaaatttttttttatataagaaaattacaacggaaaataataaaaatttcagcgactttttgcgttgagtgatgcctctcctaatcagaacattttgatttaggccgcgatg

SEQ ID NO: 100875 - DNA, 214 bp, Heterodera glycines
  Promoter: Source sequence=SeqID_38922; Location=1..214; Strand=+; Gene=SeqID_67616
ttcgtctgacaatgagcaattcactgaaactttgctgctttttccgcttccgaatggcgaccttttcacgctgttcaatttcactgtttttgcacaccaagaacatgaaaattcaggtttttgaattcaagaatttatacattttccgggggacttttttgtttacgtcgaatcaaaatttctagagctcgacattttaaaaagaaacaaaatg

SEQ ID NO: 100876 - DNA, 330 bp, Heterodera glycines
  Promoter: Source sequence=SeqID_12835; Location=1096..1425; Strand=-; Gene=SeqID_76561
atttacctaaaaatgttattcaaaacttggattttttaaagaaattggtaaaaacaaagtcttttaaaaagagacaacaaatatttaaagaagcgactagtgaacaaattgcattattaattgaaattagttataatatattaaaggggtactttccgctcacgaagagacaaaaatatagacttttaccatacgcaaattttgtgagaaaattaggaagagttagaactgagaaaggtgtaaataaaattattcaacaaaacggaggcggtggtttccttaatttgactcctttattattaccagtacttattgccgcgttaaaatatg

SEQ ID NO: 100877 - DNA, 372 bp, Heterodera glycines
  Promoter: Source sequence=SeqID_25458; Location=567..938; Strand=-; Gene=SeqID_56188
cttcgcggcctcagacgggcgcttcgcgcccgttcttcaatttttgttgaccttgaacgggcgctacgcgcccattttttaaatccgttgaactcatacgggcgcttcgcgcctgttttttagcttgttaggccgctttgtagcctcagtcgggcgcttcgccggtttttcaatttttgttggccttggacgggcgcttcgcgcccgttcttcaatttttgttgaccttgaacgggcgcttcgcgcccattttttaaattcgttgaactcatacgggcgcttcgcgcccgttttttagcttgttaggccgcttcgcggccttggacgggcgcttagcgcccgttatttaaattttgaggtacaaaagtgatg

SEQ ID NO: 100878 - DNA, 96 bp, Heterodera glycines
  Promoter: Source sequence=SeqID_43001; Location=940..1035; Strand=-; Gene=SeqID_70778
tatgcaactgcacagatgcagggacagatgttgtggtcctagcgacccaatttacgggcggtgcaatattgggttcccatctccttactcgaaatg

SEQ ID NO: 100879 - DNA, 945 bp, Heterodera glycines
  Promoter: Source sequence=SeqID_17865; Location=1..945; Strand=+; Gene=SeqID_82408
atttgacaattttgaacaaaaatggtcttacatttatgatggaactcaaaaacaacaagctgaccgggtgcgcaaaggtgagatgagaatttgggagagggacaaaaatttagccaaatttttgaaatttgtgaaaatatggggacagaagggaaaatttaacaaaaatcttgaaatttaatgaaaatatgggcatgaaaattagccaaattttttgaaatttgtgaaaaatatgggcacacacccatatacggtaaccacttcaaacgtgcacaggcattacggtagtagtacagtagaaaaacggaaaatttagtaaattaatgctcagaagggggtttaagtttattaattagacaatttttattttttatttttaagatataaaacatcttttctgtttacatagaaatttctatacaaaaaaatatatggcagttctaaagagcaaaaaagcgggattttacaaaaagaaatttttttaaatttttgcataactttttttttgttgtcctataaaatgatttgaaaatatgcattgaaataaaaaaaagatgcccgaagaacaatttatatgtttataaaaaaaacagttccaccaaaaataacgtatgaccctacgtactgtaccttacagaatcgggtttaaaaattagggtgtggaaaaattgaaatttccatgaaaatccatggcatattttaaacacacaaattccacgtttagttggaggccatcctgctgcatttgagggtcgcccagcacaaaattggctgcttcagcataccgatttgagaggagctttgtttattacaaaaaaacagtacaaaaaagaataccgtatgccacccagctgataatacagtatggaatccaaaatacaaatagcactcttaacgtattgattcttctgtgatctttttaagcccccatcaattcgacatatg

SEQ ID NO: 100880 - DNA, 660 bp, Heterodera glycines
  Promoter: Source sequence=SeqID_9506; Location=1372..2031; Strand=-; Gene=SeqID_71671
aacaaaacatagaagaaagtggaggaaaaagaaagaaattcacaaattgaacatagaatgggaatagttttatttacatattttaaatggtataataaaataacatttttaattgtcttaattggttagtagaatatgtatttgttaataacacaataaataaattaataattttcttttttcaaatttaatattaaattattattaatataattaaagattttctttcaagattaattaacgataaaaaaaagaaaataaattgtcctcacaattgagttttttaaaatgagtgtaatttgaaaattcagccaaatgttcaaaattctcgatttacactgggaaatggtattaaatttgaatggccacaaattcatattgctaacttcaactttaaaaaatggcttaaaaattttaaatttattttaattttgagataaaataacagataatgcgaaaccgatgggaggagaaggaccatcgattgaacacagcacaattattcatctgctttgtgttgagagaatgcatgtgttcgttcatcaaccaatttctctttatctctcaattttcctcttcggcgctttagtcatccattcatatattattttaaaaaactcatatattttatttaaacattaaatttgcctcttaaatatg

SEQ ID NO: 100881 - DNA, 118 bp, Heterodera glycines
  Promoter: Source sequence=SeqID_2976; Location=3751..3868; Strand=-; Gene=SeqID_82601
ttgcgatttttctcgttttccatcaaccaaataagtgaaagcaaaatcatttcattatttttacggattccaaagcgtaaaaattttccaattttttttattatttgtattaaaaatg

SEQ ID NO: 100882 - DNA, 471 bp, Heterodera glycines
  Promoter: Source sequence=SeqID_14368; Location=1734..2204; Strand=+; Gene=SeqID_78399
tttgtgttatttttccttcttgttatttaaaaattcctccccatttattttgtgtctttttcccctctgctccaaataaatattgattatttgtttgccatcggccggcataacaattggcgacgcccttacgtattgcactgtgggcttatttattggaaatgtggaagcagttttggatttgttggtttgcttgaagcaaccaacaaactttttccaaactttggactcttaattggagggagaggtcaacagcaatcgaaagtcatcgctgctggactacatttgtttattatctaggcgataataaacaacatttttgttggacctgctaaagttaggtactgttagtagttgaaaatttgcgctgctgattttgtgtcttggcgacacttttcagttcatccacgcgcacccactctgttaacaagctaggcgctgttagcaatagagtggtgaacggcaaaaatg

SEQ ID NO: 100883 - DNA, 127 bp, Heterodera glycines
  Promoter: Source sequence=SeqID_26452; Location=295..421; Strand=+; Gene=SeqID_57185
ggtaattttaatttgttttttggattttgcaaatatctatcttggcaggaaatcgtccacaggatgaaaattgtttgggtttccacaaatatcttgtctgattttttctattttagggcggcagatg

SEQ ID NO: 100884 - DNA, 228 bp, Heterodera glycines
  Promoter: Source sequence=SeqID_10352; Location=492..719; Strand=+; Gene=SeqID_73533
ttttttaggacaattattacttatagtaatttcctttgaaatttaaaattaaatcaattgaaacaaatccctttaaaaacagcaaaatgatgacaaatcagcagaaagagaggtagagaatgtgagagaaacgaggagagagggaaatagagagaaagagaaacaggagagagagagagaggtgagggagagagaaagagagagagggagggagagagagaaaatatg

SEQ ID NO: 100885 - DNA, 117 bp, Heterodera glycines
  Promoter: Source sequence=SeqID_7599; Location=2859..2975; Strand=-; Gene=SeqID_65352
ttccgtccgccctttctttttatgagtcttaatcattcctcgcttccgcgttgtaaccgcccagcagcttgttccctgcaattatttatttttaatttaatttattaaagggaaatg

SEQ ID NO: 100886 - DNA, 405 bp, Heterodera glycines
  Promoter: Source sequence=SeqID_20983; Location=246..650; Strand=-; Gene=SeqID_51556
aaaaggggaccaaacaatggcatcacttgtcggacattgcctatttttaaggactatttctgatttgaattcggacgactttgatcatttccgcgcgtgttgtttttctaaagtatttcggtttactttaaaacataaggaaaattcagaaaacagaaataataagttaattaatagaaggacaacaagtgtattccctgtccgaaatgtatctcaaaatcagttaatgaaaacgacaattaccgtatttggcgactcattatttatttgtgtgctccaataaataatattcactttaatttagagaccattattttaaaagctaattaaatgataattgcgttttcaatatttatgttttatgagtgtgtttgtaatttgcacattttaagctttgacaaaatg

SEQ ID NO: 100887 - DNA, 454 bp, Heterodera glycines
  Promoter: Source sequence=SeqID_15306; Location=188..641; Strand=+; Gene=SeqID_79540
ggtgggcattcttagcaaaaaattggcatttttatatggggaaatgaatctcattggcatcgggggatggtgggcattcttagcaaaaaattggcatttttatatggggaaatgaaaatggcattttcttttttaaattttattttcaaaccaattaatttgttgcaaatcgtgaaagttaaggaaattgaacttttttatttttattcaaataaaagccttaaattaaaaaaggaaagggaaattgttaggtgaaatctaaatttagcgacctttttgaaattttttgttgttactcatttttctttttgattatgcctaatttaaattctaatttactaaaggaatttggcaaaaacacattttctgttaaggcactttgatgaacaattcggcagcgatgtcctcggcactgttgggtgccgtgaacacgaccagcggcggcaccaaaatg

SEQ ID NO: 100888 - DNA, 90 bp, Heterodera glycines
  Promoter: Source sequence=SeqID_4650; Location=4348..4437; Strand=+; Gene=SeqID_55235
aagtttttttttttattgcagcattcgccggctgagttcaaaattcaaaaatttccgaatgatgccgatgaaagggtcggcgacagaatg

SEQ ID NO: 100889 - DNA, 127 bp, Heterodera glycines
  Promoter: Source sequence=SeqID_29600; Location=1..127; Strand=+; Gene=SeqID_60074
ttattcatcattcatttaagcaaaaataataataatttttttttttttttgttatttttttagcaaaaaagaaaactgaagtgcaaaagtgccaaaaactgtcttataatttgccctcaacaaaatg

SEQ ID NO: 100890 - DNA, 190 bp, Heterodera glycines
  Promoter: Source sequence=SeqID_5967; Location=1991..2180; Strand=-; Gene=SeqID_59857
aaaaaagggaaaatatcccaaaaatttggaagcaattaaaaaaaaaaacggaaaccaaaaagggaaaattccaagggaaaaaaaagtttcaaaattgggcttaaaattggaaaattttttggggcaaaccgcggccaaaatatataaaggaaaaaagaattaattttaatataaagcaaataaaataatg

SEQ ID NO: 100891 - DNA, 377 bp, Heterodera glycines
  Promoter: Source sequence=SeqID_40996; Location=1..377; Strand=+; Gene=SeqID_69213
ttggttttttgaacatttgcatatttataaaaaaataacccccataaattaaaagaaatgaaatgttttaaatctaaacatctaaattattttgtttaatttattaagcaattaatctaaaaatcaaaaatgtcttgaattttgcataaagtgtcctggttttgaaataatgaataaacaggcgaaaattttctaattaacgtcatcaaatttatagattaatattatttcaataatatatattcgatattaaacaaattctgccaaactgagtaatttttttttgataaaattattataattcaaaaagaattcatttaattgtataaattttgaaaatattttaaaaccatttagactgtcattgcataaaaatg

SEQ ID NO: 100892 - DNA, 274 bp, Heterodera glycines
  Promoter: Source sequence=SeqID_27423; Location=1..274; Strand=+; Gene=SeqID_58119
agtgcggaaaaacggagaggggggcattttgcatttggtaccaaggtctgcggttgttttttttaggaaaatcactgtcattttagggttccgattcactcgcagaaagggaaggtggttccgctgctccaaccgggactgtgaggcaactgcagcattgagtaaagaaggcggaactaatggtgtgctcggaagaaaagagcacaaccatctgccggacccagcgtgcttccacgcggaggtaaaacgcaacggaattaagacgacaacgatg

SEQ ID NO: 100893 - DNA, 417 bp, Heterodera glycines
  Promoter: Source sequence=SeqID_39237; Location=1..417; Strand=+; Gene=SeqID_67853
tctcactttgggcgtactatctctttatttttaacaatcctcctaagaacttttacttttctccgtctaactttttttctctacgttaaacctacaccaaaatttgcatatcgatagagaaaaaaataaagaatttttcaatcgctttttaaaagaaaataatcgcttttatttcaactaaaattttaatttaacggcgaatttaattagatggcaaaaataaaaattgtgtgtaagcttaacgcaattaaatcggcacaaaagcgggtgataaagcgggatgagagacgcgcgcgaacggccaaagcgacagaagcccgttgggccacgaaattgagtttttacattcatttttcataaaatatgcaattttcccaaatttaagccgctccccagcccaacaccgatgcagaaatg

SEQ ID NO: 100894 - DNA, 227 bp, Heterodera glycines
  Promoter: Source sequence=SeqID_16812; Location=106..332; Strand=+; Gene=SeqID_47396
aaaaagcaattgcgacaataaaaaagaaaaaaaaattttgaaaaaatttgaccccaaaaaggggggtacacacgcaaaagagggaacccccccaaaaggtaagataccacttgcttataaaacatctcttattaaaggttcaatgcaaagtgcccgttttgttgtgttcagcgacaggctatgacgtctctaatcgcgtggaggaccttgcattcgaactgaaaatg

SEQ ID NO: 100895 - DNA, 170 bp, Heterodera glycines
  Promoter: Source sequence=SeqID_416; Location=569..738; Strand=+; Gene=SeqID_51899
tttaattcttgcaattatataaatttgacctttttaatctatttaaattttaatgttttatctattttttcaaagttttgcttcccttttcaaggtcgaccttctgtccatcaattgtcatgagcgtatgattcgtcgttcggcagcgtttggctcattggtgcggaatg

SEQ ID NO: 100896 - DNA, 244 bp, Heterodera glycines
  Promoter: Source sequence=SeqID_1781; Location=6996..7239; Strand=-; Gene=SeqID_75927
ggtgggtgaagaaattatcatttttataataaaatttttatgggcctggaataaatttccatagcaaaaattcacaagattttttatttaattcactctgcacattgttttattttcaaaaaataaatactctaattattgtcgcatcagtatactgtaaagggagtgtacggtaaagggcataatcatgctttatgaaaattgatatttttaaatatatttatttaaataagttttaaaaatg

SEQ ID NO: 100897 - DNA, 400 bp, Heterodera glycines
  Promoter: Source sequence=SeqID_36265; Location=811..1210; Strand=-; Gene=SeqID_65629
tttgagtcgtcagatgaaaaacctgcaaaatttggggctcccgtaatttacaattatcaaagtgtattttttataacacattcatcataattagggccaggattatatgtgctaaaaacgccaaatacatatttattcaccaaaaaatcaaaaaatgtaatttcgggccctgataataatgctttatgtgtatgtatcttcaaaaaatttgaaaaaacttaggttttttataattacctccgctaatgaaaaatggaaaaaagctaaacaacacgagagagagaagcaaattgtttttaaaagtcttcatttaaaatatttttttttgtaagtataaaaatgctaaaatcgcggtgcatttatatatgcctttttcaggcaaagaagccttgcccgcatg

SEQ ID NO: 100898 - DNA, 153 bp, Heterodera glycines
  Promoter: Source sequence=SeqID_11121; Location=1522..1674; Strand=-; Gene=SeqID_74461
aataataggtgatggaaactgtgggtggcgtagcatctctctcgctttaactggaagtgaatggaatcactctgatattcgaagagatgttattgaatatttggaagaatctatatatcaacacacgcatataaatcataatgaaaatgaatg

SEQ ID NO: 100899 - DNA, 198 bp, Heterodera glycines
  Promoter: Source sequence=SeqID_41963; Location=1435..1632; Strand=-; Gene=SeqID_46689
acatttaatttaatttctagtttactaggacctgatcactttttctcgaaatctatttttgacataataataataattttgagattgatacacacgtattacattaaatgattttttacattaaatgattttcaatttcaattctcatttcatttttttgctagtgttgatttggttttcactaattggttgttgatg

SEQ ID NO: 100900 - DNA, 168 bp, Heterodera glycines
  Promoter: Source sequence=SeqID_11815; Location=2485..2652; Strand=-; Gene=SeqID_75318
ttcattgtaagaactggcccatcttatatcccattttcaacgaatctctgacccgagttctctactcaaatttcagtgcaaccatttgttgtcgattggtcgtcatctgtggccccgtccaccgtcagttcggctggcacaacttccaccggctgagcgtcgacaatg

SEQ ID NO: 100901 - DNA, 262 bp, Heterodera glycines
  Promoter: Source sequence=SeqID_5049; Location=6342..6603; Strand=-; Gene=SeqID_56719
ctaataaatgatgcaattgagcatttattatcaggcacatgcgaaaaagaagtatattttgaattaaagaaataataataataaaaattacaattaaatttcctaatcactcattttttgggattttccttttttttcatgcaagtactactgacccgttttttcttgagtatataaaattttctgactgtcctgatttgttacgaaaaaagcgaatttttttctttttatatttgactatgcgtttagggaatatatgatg

SEQ ID NO: 100902 - DNA, 356 bp, Heterodera glycines
  Promoter: Source sequence=SeqID_33293; Location=419..774; Strand=-; Gene=SeqID_63400
tgaagaatgatgacgaagtgcgacggatcaatacagtcttagacttcacgttgccaagaagatatgaaatagttcttggccttttgtatttaatgaaaaagaattggaattgtgccaaaattgttgcggcaagaaatgaggagcggaaattatgtgaaaaagttggcaattatttgaacattttgtatgagtatttgttcacagtatacgcaaaaagtagggaattgattttattaattaccattctgttatagtaaataaaaattaatattattatttttttgcttggaatttttctctatatacaattttttttcaattttaaagctgaaaacccgaaattggcaaaagaaatg

SEQ ID NO: 100903 - DNA, 812 bp, Heterodera glycines
  Promoter: Source sequence=SeqID_3942; Location=1191..2002; Strand=-; Gene=SeqID_52541
aagaagaaaagggatcggcggacggacggaggcggacagaaaattaacccatcgaatgtcccttctgtcccccgccccccgcctcccgctcttcggcttttttcacgaaaatggacagagacacagaaacaccctcttctcttgctgctctcacttttcctcgtttttcttccgatctctctctctctctctctctctcgctctctctctctcgctctctctctctctctctctctctctttctctctctctctctttccctccactcgtcactctcaaaaggaagtgggcgtgtccctccctcccctcccccttccccctctcctcccctcccattcactcccctcccctccctccttccgtctgccccctcccccgagaggtattttaaaaagccgcgcaaaaacagcggcggcacatttctcctcaaacgttacgcaaaaggcaatcgccgccaaacctcaacaagcccggccaacagctcactcaaattatcagcattcacagagaaaagacaaaggaaaggacgaacgacgacaattaattcatttggccaagcgaaagaacaaacgaacggattcaaaaaacgaacggacggacaaaagtgactaatttatcgcaaattcaaaggtgcaattttatatttcttcctattgcagacaatgtttgaccacttcgcttcgtcctcaagctccgtcgacttcgattcgaatttggcactgttccaaccgctcttcccgtgcccctcgtgtcaatgccgtcgactaccgtcgctcgcccgcactctgtcctccctgaacttgctgcccatg

SEQ ID NO: 100904 - DNA, 187 bp, Heterodera glycines
  Promoter: Source sequence=SeqID_39409; Location=1..187; Strand=+; Gene=SeqID_67977
cgtgcagccccggacatctaagggcatcacagacctgttattgctcaatttcgtgcggctgaacaccgaaaatccctctatgaagttgtgcccacagaagcaatgagccaactatttagtaggctagagtctcgctcgttatcggaataaaccagacaaatcgctccacgaactaagaacggccatg

SEQ ID NO: 100905 - DNA, 302 bp, Heterodera glycines
  misc_feature (53)..(53): n is a, c, g, or t
  Promoter: Source sequence=SeqID_41139; Location=1235..1536; Strand=-; Gene=SeqID_69331
attttataattttttaaattcttttttaacacaaactgtatcattaatcaccngctttttaaaaatgcataacggcaaaaacaatagtggccacaaaaatagggcagtcatcagcaaatcactggttcatatcaataacaatccccggcgctgtccaaaatatgccattgttcgtttgaccgaagggaccaatgtgcttcagttttaccaattattggttcgttcgttaaatttttttaaatttttccggaaaaattcagcttgataatggtcaagaagaagtgtcttttgtcaacgaaatg

SEQ ID NO: 100906 - DNA, 76 bp, Heterodera glycines
  Promoter: Source sequence=SeqID_22306; Location=1974..2049; Strand=-; Gene=SeqID_52981
attattattctaattattcgacatgaagcgaaccaacgcaacaaacatcactccgcctcccgccaaacgttcaatg

SEQ ID NO: 100907 - DNA, 89 bp, Heterodera glycines
  Promoter: Source sequence=SeqID_14782; Location=1659..1747; Strand=+; Gene=SeqID_78924
ttccgtggtcccgagaagaacatataatattttttcaaaatttaattattaattagcggtgaagcaaaaactgattattatttggcatg

SEQ ID NO: 100908 - DNA, 231 bp, Heterodera glycines
  misc_feature (28)..(28): n is a, c, g, or t
  Promoter: Source sequence=SeqID_26771; Location=1..231; Strand=+; Gene=SeqID_57528
ttgtgataatctgggaacggatttatantgtgctaaaaaatgccaaatatgtacatattatgtagcaaaatcccccaaaatatgtaccaaaaaaaattcaaaaaaagagcaaaatacatgccaatatatgccaaaaattgaaacaaaactgcttaaaaatatttgagtttcccaaaaattcaattattttatcagtttcggtagcataattgaaaatcaaaatcataaatg

SEQ ID NO: 100909 - DNA, 639 bp, Heterodera glycines
  Promoter: Source sequence=SeqID_3673; Location=8716..9354; Strand=-; Gene=SeqID_51389
attaaaaattaatcattgcaattaaagttacggacggctttatttacataaattaatctctttttcagagtctgatcaattacttcgttgcatttttggcccatcgttttggcaagattggccttttccttcccatttacctcaaatttccgcggcttttgctggcatttctgttttttattggttattacgtttttcatgtggagaatttgttgaccgcttttttgctgttaaatcgattaagcgccattcttttcccgttgaaatatgaaaaggtgttaacctattttaaatttgttttaaattcccatttaattaaagttgtggcgtgtcggcttgccctttgttgtcgctttctctttcatctttccgctgcctttcaccgccccaatttttgggttggacatgtacatccatgttcaaaatgacaatgccacctttactctggacgaccataagacggaaaatgtattattttaattaatagttttaattatattttactaaaattgtccttttaggagttgaacagcagcgaaatcgccgcttggtctgccgttctttttggcatcgtttgcctttttctgaatgtggccacacttttggcctacaaattgcgcagcaattaccaacaaaatg

SEQ ID NO: 100910 - DNA, 266 bp, Heterodera glycines
  Promoter: Source sequence=SeqID_21672; Location=1..266; Strand=+; Gene=SeqID_52278
ataaaactgcactcaccaggatcgatctcttgaacctttttttcaaaaggcttggaaaaaataacaaaaacttttgaaggttttggaccaaaaacaagtaaaaatttctttttaaatatttacctaactatgaaaaaaataattcgaaaaatcgaatttgctgtatgaaaaacgttttatccttacttagacctctatatttgaatttttaaccccaagaaaccctcgccctattcattatgcaaaaataatagactttccaaatg

SEQ ID NO: 100911 - DNA, 80 bp, Heterodera glycines
  Promoter: Source sequence=SeqID_1889; Location=1..80; Strand=+; Gene =SeqID_76577
acctgtcaaactgggaaaatgccgtcaacttggaggctcaatttgatcgcgtcgtcaaggaaattcgctcgatggaaatg

SEQ ID NO: 100912 - DNA, 674 bp, Heterodera glycines
  Promoter: Source sequence=SeqID_167; Location=2061..2734; Strand=-; Gene=SeqID_75820
aaaaaaacaagaaattttttaatgtaaattcacaaaaaggaccgcatctatactggaatgtaccgcattgtactcttcacggaccagcctgaggagcttccaagaccaatttggaagggtccgatgggacgccgcttctgtgtgtcgctgtttctgtcggatgggcactatcacggcatcaaaaaaattcactgcttcttcaaacttgggataaaatattgcgttgattgcgagtgtttctatggtagagacgctaaacatacgatgtcctgtaagagccgttgtcaccaatgtggaaaaggttactaatttaatccaacaattaatttgatatttcctacagttggaccgcaatatccttgcataagagtgcaaggtgtctgtctacactgtcaacaatgcaaacgatttttcttctctcaaagctgctttgatggtcatcgtccgcagatgtgcaacttgattaaacgttgcgatgaatgtaacagaacttttcaagtggatagaaaaaatccccacaaatgttacagcaactattgtgcgcgatgtaaggtattttttctctatttatttattaataactcctccaaaaaacacaggtataccatgagaaggaaggcgcgtgcttcatcaaacccattgtggtgcctgacgagaaacccaaataccgaatg

SEQ ID NO: 100913 - DNA, 676 bp, Heterodera glycines
  Promoter: Source sequence=SeqID_37232; Location=895..1570; Strand=-; Gene=SeqID_66352
ccttgaatgaatttttttgatgtacaagaccatcaatgttttgtcggtgtcagtttgtgattagcgatgaccagaaatgatgaatttgtaatgagtttttttcaattaacaaaaaagagaaaataaatttatttggtatttgggtaaattattattatattttcaattagtgataatattttgtgttgatgaatttgattaatgagaaatttgatgatataatatgttgaggaaaatacaaaattatccaaataattgactaaattcatattttttgcatttatttaatttctgtaattgatcagaacattgatcctagtggcaattggtgtgaactattccacggtacgaatattcttcactagaagcaacattttttgtgaaaatttaaaattaactaatcaaaagcataataaagcataagaaaatgaaaattataaatataataaaaaaataaaagcggcatttctaagcaatatgttctatagacaacagcggttcattttctcacgtttttcggattggaagccttttaattccttaagttcgaagtgtgatctttaacattttgtagcaaattttttactttctttccgtcatgttcgacttcaatgaaaaattttttccaccccctagaaatttttttctaaaaatttcatcgatttcaatcaccatg

SEQ ID NO: 100914 - DNA, 478 bp, Heterodera glycines
  Promoter: Source sequence=SeqID_11456; Location=939..1416; Strand=-; Gene=SeqID_74854
ttccggaaaagggaaccgaagacctttattcttcagcccttattttttttctccacttttatttaaaaatttaatcgccataaaaaaaaaaattgtgctttttagtaattttgcgccaaaaatgtcaatgaaattttgggctaaaattaaaaaaaactttttgaagattttaatgtaatatgatatgtaaattgtgcaaaaatttttaaaaaatctgccattatctaattcagtcgctgattccgtagcagggttttgctaagagaaaataaattatcttcgaacaaaagatattttttgaaactgaatattccgtctacaattgaacaaaaaaaaaaatattaaatatttttgcttactaaaaataattatttatttcaattttttaaatctcatccctatttttttattcaaataagatgaataattaaaaaattgttaaaaataaatgcctcaaagatagtcggattatataatg

SEQ ID NO: 100915 - DNA, 386 bp, Heterodera glycines
  Promoter: Source sequence=SeqID_37481; Location=258..643; Strand=+; Gene=SeqID_46517
ttttagctgattggggatgagtgaagcgaattcaaatgagcaaaagaagaagagtgaggaagagaatgaccgtgggcgctatttatgctaagaaaaatggcggctaaattgttgaggcgcgcggagactcctttcgtgccaaaaaaaaaatccatttaaaattggacgccgttttactctctcactcacactctctcacgtccatttttctctgctcccaccggggatttgcattgtctgtcaatgggatgggcgttccctccactttagcgacataaaaggggctcactgtgccccattcgccactttcattagaaagcaaacgaatcgattcaccagctctcttcggcaaaaccttcgcctctccacatttcgacgacaaaatg

SEQ ID NO: 100916 - DNA, 101 bp, Heterodera glycines
  Promoter: Source sequence=SeqID_22104; Location=255..355; Strand=+; Gene=SeqID_52752
aacgaaatttggcacaaaactcaaatatttccgctttaaaatgcatccaaaatcaaatgaataaaggcaattaaatttgaaataattgcacaaataaaatg

SEQ ID NO: 100917 - DNA, 294 bp, Heterodera glycines
  Promoter: Source sequence=SeqID_6730; Location=2038..2331; Strand=-; Gene=SeqID_62657
tcttggcttagctcaggcaagcagcaaacatatttattaaatgatgatgaaaacgcaataataaattttggaattaaattttattacattttttcctttagtaagttattattttgtcgaaaaaataaaatcttacctttttaaatttttattagatcttctaaaaattatttacatctccctaaaatatcacttaatttaaataaaattttgataaaaattttcataaataaattttccgaaaaacgcgtcgcgtgatcagagtttactgaccaattaattttaaatagaatg

SEQ ID NO: 100918 - DNA, 412 bp, Heterodera glycines
  Promoter: Source sequence=SeqID_14002; Location=895..1306; Strand=+; Gene=SeqID_77970
acaaaaatcacatttttgagtgtcgcaattgcccattttaacatttttgacaaaataaattttcggatatttttgatgaattttattggctaacaggaggcatttcataacaaagcccatgaggggccggggcatttaaaaaaggacgtggcggcagacaccgtttactgtgctaatttccatttatccttggtgtcttttttcgttgatttttttctgtccatcgttttccgttatttttctttgttttgcgaacactccacacattcactgctttgactcttatcactccctccccatattttatcagcagaattgactaatcaccgaaaaattttttggggggggggttaccccgccaagattttttttttattttttatttttcagtcccgtcatttgagtccttatg

SEQ ID NO: 100919 - DNA, 62 bp, Heterodera glycines
  Promoter: Source sequence=SeqID_25316; Location=959..1020; Strand=+; Gene=SeqID_56068
tttggtgttaaacgattcacacttttcagatagttgtcaaagtttcagcggagtagaaaatg

SEQ ID NO: 100920 - DNA, 52 bp, Heterodera glycines
  Promoter: Source sequence=SeqID_40376; Location=1..52; Strand=+; Gene= SeqID_68731
gggatggtaccaggattttggaggggggtggggtgattagctttccgggatg

SEQ ID NO: 100921 - DNA, 1003 bp, Heterodera glycines
  Promoter: Source sequence=SeqID_21307; Location=355..1357; Strand=+; Gene=SeqID_51907
ataataagcaaaaaattattatttaaattatttagtttatgctcaattcctatcgttcatataagttggcagctacctaaaaatttttggaaatttttgattaaattttatgttttttcgaaaaaattcaaaaatctcgcaatctagcgcgggacccgaaaattttaaaagtgtgattgcataaataaccccccgcgggatcccgtcctgcaagagttccaatcccgaagctggatcagcaaatttgaatttttgattcaattagtgaaccaagacataaccgtaccgatgagtcacaagcccgcgaaaagcggtccgcaattttgcggtccgcataagtatcatgccgaaaataaaaaaaatctatggaccgcttaaaaacccatcggataccgtgtcatttgctagagcaaacattggcccccgcgtgtgctccgacaaccgcccatcaatgacaaatcgtgcggtttttcgagctgtttcatcccaccaaaaatgccagaagatcaacatgacaattaagaaaaagatggatgaaatttacaaaaaaaaagagaattttgctagcatattctttgaatcaaattatacaaattgtcatttgttgcatcattaaaatttttaattcattcatttaacaaaatttattctatagaaaaattagacaacaaaaaattcattccatatatgcaatcaaatatttattaaaaaatgcaaaaatatatttaaatttttattacattgcgtaagtatttttttatgtttcactaacttcaaacctttaatttaaaatagtaaattataaacaagaaaaaaacatagaattttatttgttttttataacttacttctttttattaattaccttaaaacattaattaattctatcaaatcaataattgtcgtttattttacttgtatgcgtttttataaacaaatatttttcataaaatttattattttatgattttgtttattaaaaatgcttatccccacaaaaatg

SEQ ID NO: 100922 - DNA, 172 bp, Heterodera glycines
  Promoter: Source sequence=SeqID_8273; Location=114..285; Strand=+; Gene=SeqID_67518
tttgctgccgctctgttccacctctattcgtcctcctcctcctcgtcctcctcttccaactgctggtccctccctcgctcccccccccccactttgtgccaccctttcccctcccctcaggcaatgtcttggcctttccctatcctcccaactcggcattttcgctctgatg

SEQ ID NO: 100923 - DNA, 198 bp, Heterodera glycines
  Promoter: Source sequence=SeqID_26875; Location=730..927; Strand=-; Gene=SeqID_57620
aaaatcaacttggctttaaatgcacaaatgtttcaaattcgcaaaattatggctgttctgcggagggaaatgttttgcgcttttttgtcatcggtgacatcggtggggaggagtatacggtagagggcaaacagcagcagtgtacggtggaaggacacggtaagttgaagagggagaacaaaataacattttaaaatg

SEQ ID NO: 100924 - DNA, 134 bp, Heterodera glycines
  Promoter: Source sequence=SeqID_37404; Location=230..363; Strand=+; Gene=SeqID_66484
cgtaattaagcattgttaattggttgatgattaattggtaattgcattcacagctaatcaattgcccataacggaactgccgccgacatacgcacaagtgatcggacaaaacgcagaacagcagcaaaggaatg

SEQ ID NO: 100925 - DNA, 633 bp, Heterodera glycines
  Promoter: Source sequence=SeqID_17272; Location=1..633; Strand=+; Gene=SeqID_81736
tgataaaaaagacatctttcacatttactaattcagagtataatcaggaaaaaattgtgagcagaagaaaatccgaccgggagattccgattctaaaccttaccaatgttgtatattatctacagtagttttacccaggttatcgtatttaattgttaaataaacacgataataggatttaattctgagtttattataatacaaatttttctaaatataattttattttaataatgtttgattgtttgtttataatatcactcaactatggtcaggaccatacccgctcttagacttaagcctagcttcggcatagttttaatttaaagcctaggccgagtacggtacttccaatttttaaattttgtgtataatcatagatatacccatattaaaaaatgctttctcgtttccaaataaaatccacatataaacgcgattctgctggccaatttgctaacccaaaaaacgtctcagacgttaaggcattcaacggggcaggtgcatttattgtacatgcgcttataatcgacctacagtataaactgtatgaagtgagttttatctctgtaatgctacatgcatacagtctgtattgtaacccttaggcttgcccaaccgtagctaaaaatg

SEQ ID NO: 100926 - DNA, 244 bp, Heterodera glycines
  Promoter: Source sequence=SeqID_11188; Location=3058..3301; Strand=-; Gene=SeqID_46934
tttgtcggacaaagaaaatttgagggcatattaataaggcaacgctttttcaaatttggcttttcgttgtgatgaactttcgtttagtcctgacaaaattattgttgtgtattttgttgtcacagaaatatcctacagaatttctttttccccttttttgtcattcgtttcatcgtattactttcgttgttttctgtttattcacaattttcctttgataataccttttaaattgtaggaaatg

SEQ ID NO: 100927 - DNA, 73 bp, Heterodera glycines
  Promoter: Source sequence=SeqID_11964; Location=821..893; Strand=+; Gene=SeqID_47000
attgtactattgccatcattgatttgtgtttgcccaaaaccagtaaattgtttacgttttatttttagcaatg

SEQ ID NO: 100928 - DNA, 442 bp, Heterodera glycines
  Promoter: Source sequence=SeqID_26037; Location=1039..1480; Strand=-; Gene=SeqID_56786
aaaaatttttgaaaaagcgcgcgaaaaaaatggatgggaaaagcaactattaattataataatattcaatcatttaatcccagaaatgattaattgtttgaaataattaaagaaatttgtttgaaaattttcattaatttaatttagcttaacttttggatttttattaaataaaaaacaaaatgaaaatttaattttgtattattttcagttgaaaaacaaattaaaatttgaatttttttttaatttttgatttttttgaatttttaaaaattcccggttggtcccggttcccggtcccgaaaaaaaatcgaggtcccggcccggtcccggcttctcaggtcccggcaagtccccgtccctgttttggcaaaaattcccggtcccgtggcactctagttaatttatcatgatattttaaaatttttaggaaagaaaaatg

SEQ ID NO: 100929 - DNA, 403 bp, Heterodera glycines
  Promoter: Source sequence=SeqID_7016; Location=1191..1593; Strand=-; Gene=SeqID_63575
ggagttcggcggtgccgataggcgccaccggaaaaaaattaaaattttgagtgagctttgttaacagaatttgtcaaaaaatgacccaatctttggttaatttttgggttttagactgcaaaaaattaaaaaataataattttaagttgaaatattttttattaattaatttcaattaaaataatgtaaagaaattataaaaaagtgttcctttggggaattgaacccaagagagaaaattgaaggtcagagaaagtttagccacacattacatatgcattaagatataaagttatatttagttgtttttgagtaaagttatgggcattttttgttcaaaatattcattttattgttttttatatacaactaagcaaatttggaaaagttttaaataaaaatg

SEQ ID NO: 100930 - DNA, 930 bp, Heterodera glycines
  Promoter: Source sequence=SeqID_12416; Location=1..930; Strand=+; Gene=SeqID_76023
catccagcagactgctgctgcacagccgcacgcgtctgttcactgtatgccctcccacccgccgctgccccgcgtagacagacagtcagacagcgcactactatttgccacctttccctccctctaaccaccacagcacggaaagataaatcttttccctttcaactatttctttcgctttttcttttcctatactatttcttttgccttcttctttttctaaactatttcttttcatctctttttcttttctaatctctcctcacagcaaataacataaatacaaaacgccacattcaaaccatgttacaaacagacaaacactcaactttattatataggattatacataaaaatagattatacaacaagtgaatctttgaatttaataatcttaaataataaaataattattaaaatggtaactaattgatttttttatttgtttaaaaggcaaacaaaatgataaaaatttcattttaatattttttttacaaaaactacaattaattgctaggaatatttgtaggaattttacatttatttgttgctcaaaaatagttatttttaaaaatatagaaaaaatgaaaatgccaaatctctcaaaattattttgtgttttatttgttttttcaacatttattgaaaagacaattggtacccccaaaaaaggaactgcttctccactggaaaagcagagcaaaaaggcgatgaaccaaaactgggaaaagaagacaaaaaattggtgaacaacaaaaaagaattgctaaaaaaagaggtgaattaaaaatatattttaattgaaattgaaatttaattttaatatttttgattgaaaaattgcaaatgcaaatgggccaacagttgaacacaattttggaagaaaaaattcctacttttgtacttgaagtgaattaaattgccgaaatg

SEQ ID NO: 100931 - DNA, 720 bp, Heterodera glycines
  Promoter: Source sequence=SeqID_21510; Location=1055..1774; Strand=+; Gene=SeqID_52120
ttgagtttttttttggatcgacctagcacccaaaaaggaagcgaaaagtgacggaagagaacacaaaagtgaaagtgatcagagaattttataaatgataaattgaaaagaacgctttaaaagcgaaacagaaacaaaagttcaaagaatggaggagaaattgaaaatttagggatatatttgatttggataaattttaaaataaccgaattttgcaaaatttctgatatttttgacctattttcaaatattcaattttcacgtgaaggttttcagtttttggcacatttatttgtgcctttatatacttcgtggtgaacaaaaattttcgttttcatacttttcgttcataattagtggcttaatgccgggatatttaatgccattaattgacagctgctgaactgcagtgccatgataagcactaaattatgcggttttaattattttttgcataattattttttacccaaaaaatgattcaccaaaattcaaaagaatttaactgttaactgcccagcccaacaaattattctgtgaatcattctgagaaaccacacaaaaattgtcactgctgttaaaccaatccaaatgcttttggttaaccataattttaagccatttaatccaatcattctcattttaactgtggtaaattgtaaaaatatttaattaatttatttatttattttttaatacagcatacactgaaaaaaaatg

SEQ ID NO: 100932 - DNA, 1003 bp, Heterodera glycines
  Promoter: Source sequence=SeqID_1518; Location=2596..3598; Strand=-; Gene=SeqID_74150
tttatgatgtttaaaaaaatgaggatttttcattccaaatgaggattttttgaggtattttagttgcaaatgaggattttttatggctgaaatgaagattttcaaaattttgagatcgcagctctgggctaacataatttaaaaaaaattattttatttctaataaaattagaaaacaaccaaaaactcgaattcatggtaaagtctgccatgtcaccaaatatgatgaaaaacggagaaaaagacgaagggcaaaaaatcaaaataattttaaatgttatcggacggtttgcttgctttaatgaattgtcaatttgctctttcagtttttaagccaattgctgaaatattgggtgactaattttcctctgtcaataaagctaatagcaacattccaattttttgtcgaaaaagtggtggctgtctgtgttattgtcgaaaattggagagaaaaagtggcggcggccgtctcgtgactcaatgccgactaatggaaaaaggcagtggctgcccataaaaagtatggcaaactttttgactcacgaaagcataaaacctttattttggcaaaaaaacataatttgatacataaaaaatgattggacgcataaactgaagtagagccgaagttttttcaatacatgttactgctcctaataaactaaaagactgagtttttcatttcaattctgtttcggctatcagggcttgaaaaaacaagttggaatccgattttgtgcataggcgcaaatgtccggggcgcaaatgttcggagcgcaaaggcctgctggacatgaataaagtaaagcatttctgaacgctttcgccttaccactcacagtcactgccgctccaatgccgtctcctgcctcctctctctctctcctttggccatctcgccgctctctcattgcttatttcactcgagcccccctcttcccccttctggtcagaggaccgtccctttgtgcgatagtgccataaaataaggtgcgccgaaatg

SEQ ID NO: 100933 - DNA, 453 bp, Heterodera glycines
  Promoter: Source sequence=SeqID_33608; Location=470..922; Strand=+; Gene=SeqID_63621
atttgattcatttgttacaaagtgtttatgttgagaaaatgtgtaagaaaatgccaaaatactggtcatgtttaattgtaatattattccatgttatatgtttttttatgtatgttgtagatcggacttttattgtatatatatacataattttacgcatattcccattttcgaaaatgttaaatatttgttaggaaagcatcgaaattttttggaaaaaaagaaagaaaaaaattaccatagaaccgaatttagcgatgggagcaacggtatttcgagcagttataaaaattccctgaacactttgttaaatttgtaagttaaaatttaatattttattaggaaaattaacagcctttttttgtaaaagaaaaatatttccaattcgctgaaaaaattaaattaaaaaaaaaattatgtatctatttcagttctcgtcatgtctcacaaatg

SEQ ID NO: 100934 - DNA, 366 bp, Heterodera glycines
  Promoter: Source sequence=SeqID_4869; Location=3669..4034; Strand=-; Gene=SeqID_56015
attttatgatgctaccacaataatgtcacgcttaaaaaaaccaggcacgctttcattctttctcactttcacaaccaatccgcgttggcgtgaaatttctcgtaatttcctccataaaggtcagaaaactgtagatcgacccgatttaatatgtcgtatatatgaggataaacttcgccatttgcattatttgattgacaaaaaaaatattttgggtaaaatgattggacaagaatgtcgtgagttccaaaagaaatacggcggtccacatgcccatcgtgtttatcacacaagtttgcttgccatcccagagaatgttgataatataatatgggcgcatatacctgaagaactcagcgaaaaatg

SEQ ID NO: 100935 - DNA, 313 bp, Heterodera glycines
  Promoter: Source sequence=SeqID_14897; Location=2013..2325; Strand=-; Gene=SeqID_79060
catacacacaccatcccaaaaaacgagatgtgtaccaataaatagagaatgccagagaaaaacattatctttttttctctaattttttgtctccttttggcgtactatctaatattttcattattaggaaaaacaacattcacttcgtgatgtttaactttttttctggatgttaaatctataccaaattttgcatatcgatagagaaaaaaatttggaacaaaatgtaagggtttttaagagcaaaaaaagggttaactaaaaagttataacggcttttcttttaaaattcttattttttaaattttagatg

SEQ ID NO: 100936 - DNA, 1003 bp, Heterodera glycines
  Promoter: Source sequence=SeqID_1329; Location=23..1025; Strand=+; Gene=SeqID_72717
actcaagttttctctgcctctgtatctattttcattttctttaaatcagccttcaaaaatacctaccccgaaaatgagcatttttacttaatcaactctagctcctaattaacttttccatttctattgatcttttgcctgaaaaatggcaactcattattgataataaggggattatttcgaatcatgattgtgttttgttcaattaaaaaaataataaaatctcgaaaataatttcgagggtcaaaacttagttgacaccctaagtaaaaatgacgaaaagtagcaaaaaaaaagagctaaagtgataaactgtttaaatagtgtcaaaaatagttgcaaaacaacaccatttgcgtcattattttggtggtcgataaatccataattataatatacaatgacaattaatggacttaaaataaattccggctaaaaatgtttttttttaggtttttttcatttacttgagatgagtatcgttttttcaaatgactctaaattctaacaacattatttcattttttactcttcctttaggtgaatgtcactctcacagatggaatcagctcgtacattgtcacagtgtttgagtgaaatggcgcgacacgcgaacaatgaaacggaaccacaacgaaatgtcattaaaaggaaaaccagctgttcgtctggtgatctacaacagaatcagccaagctttgcgtcagaacaaatggatgacaatgacacggcctaacacaactttcatggatcatttgatctattgttaattcgttccttctccgttgcgaatttgagcaattcgaatttctaatctaatttgaacaaaaaatcattaatcggaaattcaaatttcttcacttttacactagcgccaaagattttccgatgaatgaccgtattccctccatttccaatttgtttattgtttgtgatttgtttaaacatgcagtcaatatttaaaattaatgcatatttttacagattcatttcattttacatg

SEQ ID NO: 100937 - DNA, 99 bp, Heterodera glycines
  Promoter: Source sequence=SeqID_6536; Location=1345..1443; Strand=-; Gene=SeqID_61927
tccgcctcagcaacagaaaacgaagaaaggcactctgtcgcgaggcgaaaatgccgacggagacgacgaaaacggaggaggagggggaaggcaccaatg

SEQ ID NO: 100938 - DNA, 568 bp, Heterodera glycines
  Promoter: Source sequence=SeqID_10144; Location=3856..4423; Strand=+; Gene=SeqID_73243
agaagacttaaaaggggaggtgttcgggtggtaacacctaaggaccaaaaggaagacattttttgttcttttgttattttcttttgatgtctcactctctctctgttccatagtctctaatcgctgtctctgttcttctcgtactctgacctattgattaaatgtccatccttccccatgatgcattcattcatggtctgattatatttgttgttctctcttctccaaatattgtgcttctccgtccaatttaatttatttatttgttatttaattttcttcaaataaatttgtttgttaaattgtttttgcttcggtgtcaagaccgaacattggcgacgcccgtgattaaccaaactgtggactgccgacaattctgatctgtcgatcatacgattttgaaatcagagatattttgcgctgctgtcttagtaccttggcgatactaattcagctcatccacgcgcacccacttgtttagcatcttggcgctgttaaacaataagtggtgaacgacaatttcggcacttcaaaaaccccgaacagtgtggtttgatcattcacaatg

SEQ ID NO: 100939 - DNA, 337 bp, Heterodera glycines
  Promoter: Source sequence=SeqID_2939; Location=1..337; Strand=+; Gene= SeqID_82434
gggaggagagagtttaagagagagtggaggagaggggaagagagggcgccgagccaaatttggaattcattcatccactcatttaacctttgatcaggcgctttgactgggctgcccatcggaggaatacaacaacaacaaaaacaacggtggaggtgatcaaaaaacaataggccaaattaaaagagaattaaaaaggtgctcaacagcagcagcagcagccgaattttggcggaatgggcgcaatgaatggggcgagcggagcggcgcaaagttgacttgacacccacattttttggcatttcaaacaatttaaaaatgagctaaccaaggaatg

SEQ ID NO: 100940 - DNA, 205 bp, Heterodera glycines
  Promoter: Source sequence=SeqID_8411; Location=5320..5524; Strand=-; Gene=SeqID_67972
ttcaaccttgatttgtgtgaagcctttgtctcagctaacattcctttccacaaattggagaatgaaaaatttaaaatttttttggaaaaatattgtaagcgtgaaatgccccatcgaaccactcttcaaaaaaattacttgcggttaacttgtgaccaggtcactccaaaaacaaaccaataacaaaaattaattttagacaatg

SEQ ID NO: 100941 - DNA, 262 bp, Heterodera glycines
  Promoter: Source sequence=SeqID_2419; Location=5406..5667; Strand=-; Gene=SeqID_79626
cctgaaaagtgaaaaaacacggaaatagaatgggatttccacgaaataggaaaatgtacaaaaagaaagtttgggaacaattttaggtaaaagcaaaaaaatgaattcttcaaaaatctaaacattccgtaaaatgcattcttacgccaaatgacaagaacagctcccacctcaacaaattcagtaaaggacaaattcgaattgaccccctcgcccctctctttttgagctgaccgtcgtttcgcccattgtggcgaccatg

SEQ ID NO: 100942 - DNA, 568 bp, Heterodera glycines
  Promoter: Source sequence=SeqID_12669; Location=1..568; Strand=+; Gene=SeqID_76343
ttattaagaaaaaacttcaaatttcgacttccttcaattttcatgtataacttttttggtaattgtctaatcccgaagcaataccttacaaaaagcttctaaacgtgttaatatttcgaatgaatgcactaaaatatgctttaaaaattaaccaaaatgtcttttaaccctcaaaaaaatgccaaaattgtgtaaaaatacagaattgactttaaaaacatcaaaacaatggctaaggagcgtttttatataattgcaaaaaattttgattttctaaatttatatatgaaatttcgagtttttaaaacttttataatatgctaaaacaaatttacatttttcttatatcaacaattttttttcaaaagttctaaaaattcaaaatattttccgattttcaagggtatatttttatccaaaaaagtcgatctttgggggtgtatttttcactttttttttgcatttttcttgtgaaaatttaccaaaataggccaaaatatggattaaaaacgcaaaatggcaaaatatttcaaatttttattttaagctcctttcttcatagcatatg

SEQ ID NO: 100943 - DNA, 360 bp, Heterodera glycines
  misc_feature (82)..(82): n is a, c, g, or t
  Promoter: Source sequence=SeqID_8858; Location=23..382; Strand=+; Gene=SeqID_69437
aaattcatggcattcatattggttcgatctgtcatgaaaatgaaatgaaaacatgaacttgcttgtatccaagcaaacattnttcttcaattttccacccattttcaacaattttgggtctcaggcctcccttcaaaaaaaaaaaatttttttttacccttgtccctcttcccccaaaaatttgtttcccgtccctcgtccagggcttttggcaaggagtgcgccaagtggaacccgtgctccgccgtcgcatttgagtacgacccggacaacgcgttgcgccacacggtgttggccaagccggaggagtggccccggtccgccttctccgacccggccgagtatgaaggggacaaaatg

SEQ ID NO: 100944 - DNA, 1003 bp, Heterodera glycines
  Promoter: Source sequence=SeqID_13787; Location=993..1995; Strand=-; Gene=SeqID_77711
atctatatttttaatctgtttttacagtagtaaagtattgatgataacagtacagaaaacgtgttttctaagcaccttttcggtttgagcgtattttgcagttatttacaatttttacaattttcaatcactatttcccgatttttagcaaataataatctgttcattaatcaccgccgattatttttgcccttttttacaatggtaaataattatttctgtgcaaatctgtttcgcaaccgcgaccggagtttttgaatacttatattttatttgtcgaatatatggttttatccaataaattagttaatattctttaaatttgcggtatatttttaccgtagtacttgatgagaaaaaacacaaaaaaacacattttctaaggactattttcggtttgagcgatttttagcagttattttcggctatttttacaattttttaaccacaatttctcgattttttagcagataataatccgttcattaatcacacagctaattacttttcccttttttaacaatggtacataattatttccatgcgactcccgcgaccagaatgtttaggttttatttgggattaaattactgtaataatatattttcattcggatacgtaattttttatccttaaatcgtattttaaatagaatttcttcggaaattgaaagtattatttaaaatatctttgatcaattattttttttcgtttatgtttataaaattcgttgttcgtccattctttatctacgattagatcgcttcggttggttcgcacatttcttttttcgtgttattttaaaatcgttaatttgagttgtctttcttattcctgcacggctctatcattattttaccagtattaatatttttcataaaattcaaatttaatttaaaaatttgtaccccttgtttatacttagaatatgtattttatttgaccttttaaatttttgacttatttttcatatcgttttttacaaataccttttttacaaatg

SEQ ID NO: 100945 - DNA, 117 bp, Heterodera glycines
  Promoter: Source sequence=SeqID_43417; Location=1066..1182; Strand=-; Gene=SeqID_71084
ttattcaagttgaaaatttattttagggaattccatttcgaccaattccactacatcaaattcaaaaccacccacctcgtcaccccgatttggcggatgcttttgtggctccaaatg

SEQ ID NO: 100946 - DNA, 92 bp, Heterodera glycines
  Promoter: Source sequence=SeqID_3058; Location=2189..2280; Strand=-; Gene=SeqID_83004
ctcaaagtttggcttgggtgtacccggtcctggggttcgtttaattgtaagtataaagaatagtcacagtgaaaacaaaacaaaaaaaaatg

SEQ ID NO: 100947 - DNA, 164 bp, Heterodera glycines
  Promoter: Source sequence=SeqID_18447; Location=1508..1671; Strand=-; Gene=SeqID_47517
ttttttgccatttttattttcagcgttttgtcctgctgaccacaggcgacttttttctttcattctgcggcctttcattcccgaagcccaacggtggctttcgctgttgatgaactgagtcggccaaaaggcgcgaagcagtgcaagcgaagtgagcgaaaatg

SEQ ID NO: 100948 - DNA, 1003 bp, Heterodera glycines
  Promoter: Source sequence=SeqID_17627; Location=73..1075; Strand=+; Gene=SeqID_82152
gacaaaaaaagcaattaaaaggcaaaaggaagtgaaatatgccaaaggcgactcggtctttgtacgattcggtgccaattcctaaataaaagcgactgctctttccatgcttatttccctcacatcaaaggaaaggataggaaaagcaaagaatggacaatcatcggctgctcacccaccgaaggcacttacgcacttattagcattgctttttgtccctttactactaaaattcgccctttccctccaatggacgccttttcccccgcgtaattcacaaccaattagcgggcaagggaacctccgatggccgaccaacggatgcgcaaattgcgcaattcccgccccctcccccgcccaattgagtcccctggggcatcgcccgcacagacgcttaaggagcaaattggccaacagctgattgaggaagaaaccaagccaatgccaaggaatagctgtttttagatggagaaacaatgctttaggggagggaatttaatttaaatggaatcaaaatatttgaggaacaaatttaaaatagaaatggtgaaaagttgatgggaaatttctacataaaaatagaaatgtccaaaaaggctaaaatgcattttgagttcttaaaaatttatttaaggaggcgtgagatttgttcacaaccaatttaacgtttttgtattcagtggaatttactaaagaaaaaaaaagaaagcccttttaaaccaaatggccacttttattcggagttttagatttttggtaattgccaagtttaacatcggattggtaaaatatggaattgcaaataatttttattttgataaaatgagaaaaacaattgaaaatttacgaatgcaaaaaaactaaagcccgttttgaacaaattggccactaaagtcgcgcatcacagtcggtcagttcgttgtcagtctaaaagtcaaatcccttttttccattcactctcattctctcccccccccttttttaccccaacgcctccaaaatg

SEQ ID NO: 100949 - DNA, 721 bp, Heterodera glycines
  Promoter: Source sequence=SeqID_24160; Location=554..1274; Strand=+; Gene=SeqID_54866
ttcttaacaattacgaaggaccaaagtccaactccaattctcgtaattgtccccaattaattgcccaaaaacttatgttctctaatttcatcatttgtacatctttctaacttatttttgtccatttctttaatttaatgtgtgttggtccccaacattaatttctgcctttcgccaatcggctttccacttggcccggcgatcgccactcctttcatcacttttggctcttttgttcagtactcagcagacggaggcggggaataatgaggccaacaaatgagagagagagagagagagagagagggaacagaaagtgaacgaacgatttgtgagaatttaatgaaaagaaatggtcgaaatgttgtgaactgtgaagtgactgttgggacagggaaaacgggctgaaggggcagtccattttccttttctttcaaactttattcatttttgaacaaagttcattttcattttccacttttctcaaaaatttatattcctcatttttgttcgcatttcggttcagagaacgtaaaaaattcttcaattgtcaatgtccaccacttgggaaattagtcaaaactgtcccatcagctgccctgagtcttaccattgctttgaacccactgagtttaccgcgcctcacctctgcttgccgccaggcgtaactcccaattcgtttcggcactacatttcatttcgtgaggaaaatgccgtgatg

SEQ ID NO: 100950 - DNA, 443 bp, Heterodera glycines
  Promoter: Source sequence=SeqID_19855; Location=492..934; Strand=+; Gene=SeqID_84610
ttttctgatcatacagaactcgcaaatttgggtcagaaagtgacaaactgaaaaaaaaccatagttttttggttccgatcaaatccaacaccacgtaaatgtttggttctgatcattctctgatcaaataaattagccaatcaaattttgttcttattagataataaatttattgcttctgaaaactttctgatcagtgaaatcccaaaattttttttactctgatcactttttgatcagaataaacttccaagctgatccgagaaccattacattcccaatttatagctccaatcattttataattagcaatcctccatcgatcagagaaccccccccccccaattccccactttacttttttaaaattctcatcatttttctgatcactttttcccaaccattttctgatcactgttttgccgcctttccctttgaagatg

SEQ ID NO: 100951 - DNA, 80 bp, Heterodera glycines
  Promoter: Source sequence=SeqID_5191; Location=1303..1382; Strand=-; Gene=SeqID_57218
acgaagcatattaaagtttatttcaatttatttgtaaactttttttaaatagataaaagacaataattttcagtttaatg

SEQ ID NO: 100952 - DNA, 726 bp, Heterodera glycines
  Promoter: Source sequence=SeqID_20140; Location=1129..1854; Strand=-; Gene=SeqID_84927
tttcaaattttttgtttaattacccaagtttgaggcttttccccggaataaatttttgcttaatcaattctcggcatttgatttggccggtcctcgtccctgcctgcccctgacccccgcaccgtggaattcatttggcccgaccccagagcaagtcgggacaaattggcgctcctgggtggattgctgtgaaccacggactgaaatcgacgaatcccggtgacaaagggggaaaggaaaaagcaaattagagagcctagacaagaccctccaaggcttgtctagtgttcatagtttcgtgtagttacggtcctccgaggcctaacttcacgagggacatagcagacttagtacttaccctccgaggaagtgcttcgtcttagcaaagggtagaggtgtgaaagtgttagtgcacgtagtacttgcccttcgaggaagtacttcgtgcaaaaagggtgttttcgcgcactaggccattgacaaataaggaaaaaaggcaaactaacagtcctccgaggctttagtttagccataaggcaaaaggcaaactaacagtcctccgaggctttagtttagccataaggcaaaaggcaaacaccttgtcctccgaggcaggtgtttagtcacaaaaggtccaggaccaaggccagactgatcccggaaaaagacacaaaacaacaagtgcaccacaacacacacacacgcacaaccaaactgcacgcaatg

SEQ ID NO: 100953 - DNA, 320 bp, Heterodera glycines
  Promoter: Source sequence=SeqID_12855; Location=961..1280; Strand=-; Gene=SeqID_76584
tctaaagaaaataaaaaatgtatttgaagaggagaaaagaaatcatttaaaataaatatataatttcacaaattccttacattaaatatcaaaatttttaaatactttgaaatttttgaaatcaattttaatcgtatttaattttatttacgttggtttgaccttacattttgattaattattatttgatttcacatttcactattttaaaattgattctgattaatggattgtgtttgcactcacttttatctcatgggaaaatcagtttacatatttttattttccaataaaacccataatttgtcaatttaaaaatg

SEQ ID NO: 100954 - DNA, 138 bp, Heterodera glycines
  misc_feature (35)..(35): n is a, c, g, or t
  misc_feature (89)..(89): n is a, c, g, or t
  Promoter: Source sequence=SeqID_28157; Location=1234..1371; Strand=-; Gene=SeqID_58807
atattagtgaatttaatatgaatatttatttttanatattaagatttagaagaaaaaataaataaataagttaatgtgataaaaatttnaaaaataaataaaaatgaaagtatataaaagaaatatgttaagtttatg

SEQ ID NO: 100955 - DNA, 63 bp, Heterodera glycines
  misc_feature (29)..(29): n is a, c, g, or t
  Promoter: Source sequence=SeqID_38686; Location=1195..1257; Strand=-; Gene=SeqID_67424
gcagaatttcatgaatttcggtatttttntggctacttatcacatgatctctaatagataatg

SEQ ID NO: 100956 - DNA, 393 bp, Heterodera glycines
  Promoter: Source sequence=SeqID_1535; Location=3482..3874; Strand=+; Gene=SeqID_74313
acaattcagtcccgtcgtttcagtcccaggctagtcagtaccggagcaattaaatactattttacaaaaataaataataaaattgatttaaaaataatcaaaattaatttattaaaacccagaggaggtaaaataaaaaatcaaataaaattattaaaaacctgataaaaataaatagcctaatatttttaaaaattgttcacggcaaatgccctcaaaaattgaaataattgaagttgcgcttaacagcgctaaaaattctccacctgaatgaattaacatgaaaataaggtcatcaaccgcttcgcaaaaaattgcgcatgtccacattttgccccggtcatttgaaatttaccaaaaaatttgcctttccaaaaactctatcctaaaatg

SEQ ID NO: 100957 - DNA, 165 bp, Heterodera glycines
  Promoter: Source sequence=SeqID_7464; Location=2915..3079; Strand=-; Gene=SeqID_64902
tttttggtacaaaccagggattgcaagcactcagtggcacaaaaatttttctgaaaagggaaatcagaattccgagtcctaaaaattttctgaaagtcggaattccggtcacaaaaatgtagcaactcggaattccgtgcgaatccatagtataaacaaggaatg

SEQ ID NO: 100958 - DNA, 550 bp, Heterodera glycines
  Promoter: Source sequence=SeqID_8411; Location=2021..2570; Strand=-; Gene=SeqID_67973
acaggcggcggaatgtcgcgcagaaagcccattcgtattttaggtgtgccatttttaatttttaagtgccgagggggagagggattagcatagcatagctaattgtaagccatcatttgatgctgctctttattttgatggttcggcagaacgcgatgggatttttttgaggacctgaaaaacaaaaaaaaaccaaatgctatgaaagcatatgaatatttttacaattttttgtcgcaacgagcgaataatctcgaaaaggggaaaacgaagattttttgctcttcgaattcttacagatttttttcaaaattataggcgcaaattttcaaaaaatgcaccgttttccttgagaaataaatgtttcccggatctgggcctacttctctatcaccagacttatctttgcccagaccggcgccgggcaatgctaacaataaattagtgtttttttaaattaaaaatgattttgtgaattttgcttttttcaatttgccatcctttcccccctcccctttttagccgctgttccattgccatcccttcgatg

SEQ ID NO: 100959 - DNA, 595 bp, Heterodera glycines
  Promoter: Source sequence=SeqID_24309; Location=246..840; Strand=-; Gene=SeqID_55029
tgtgacagatatatatcctttttaattataacgtgcacgggcttggacaaagttgtcaataaaggctttgatttttcagatttgaaaatttaatttttacaattttagcaaatattggtaaaataaaaaactttttaagttcattgattttctattcaccatattatagctatattgttacattatgttctttaaattatcactttactttttaaaaagtccctgcaaagtaaaaaatgtctaaaaatgtcaatggcttatcattatatcatagaatgtttattttctaataattattaaaccaatcataatataaaaaattatattctcgttgcataaatgaaataaaaaattaagccttggtgatattttaaatatagcgtaacaattcaatgtaaagtaaattatttttattcgaaattattattttaactattattagttgctgacggaagagaagcacacacactttgaggttaaaattactatgtggcaatttttagatatttttaatcatttaatacaatttcttaaatgacatttggaagcgcagtgcaaccaacaccaaacgtggctgacaaggcaagggaaaatg

SEQ ID NO: 100960 - DNA, 53 bp, Heterodera glycines
  Promoter: Source sequence=SeqID_23138; Location=605..657; Strand=+; Gene=SeqID_53843
aaataaattaatcaaattcaagaaagtgctttactaataaattattcataatg

SEQ ID NO: 100961 - DNA, 920 bp, Heterodera glycines
  Promoter: Source sequence=SeqID_3455; Location=1..920; Strand=+; Gene= SeqID_84743
aaatttgcaccaaattattatattttttcctttcaaccattcaattcaaatgatatgtttttgcccctctcaaaagagagagacgacaaaagaccaacgccggagagcaatgatcaggcaaattttggtgaattgtcctagcctaaagcgctaaggcagggactttagggctgattggttaataagctgaacagaaagtgattaatgagaaaatgtaaacgaataattagtggccagtcacaaggtcacacggttggccaacccaaaaataaaaataaatgcaagctaattaagctaattaagaaacaatgtgatgtgcacaaaataaaaaaggatgattaataaatgtgacaaaaaatgtgattaacaaaaggatgactaaaataaaaggggttcagcttaacctagtcagatcattttcttcgactccaatcgtcagcaaaaatcattctaattaaaaattaataataattataaatcacgttttcgcacaaaatcaaatcaaattaaaataaattaaattaattaagcaaatccaaaaacaaacaaattgcactcagcacttattaaagcactttctacaattgtcgacaaatcaagcagtttcaaacagaagtgggccgaacagaagtgtgccgttgtgtcaaacagaagtgtgccgttgtgtcgaacagcagtggccgttgaaaacgttggtgggcgaagacatttgaataattatcaaaataaatacataaaaattgtcaaaactgagtcactcatcagtccctgaatatttggaaagcaaatttaaaaataaagatcaaagcaaagccgaaagggaaaaaaggacaaaagaaagagggttaaaaaggagagaaaaagagactttggaaagtgaaaaagataaagttcacatcggaagaaaaaaacaaaaaatg

SEQ ID NO: 100962 - DNA, 220 bp, Heterodera glycines
  Promoter: Source sequence=SeqID_19197; Location=1..220; Strand=+; Gene=SeqID_83942
cactgccacactcgaagagcaagaacgccaacgcaccctggtcttcattggcctcccggaaagcaatgccatccgcccatcggagcgtgttcaggaagacagggaagccatcacaaaaatactggaccatcttgaagttgaggcccaaccaacggccgtctttcgactcggacgatacgacccgcagcgaacaacaccacgcccgctcaaggtggtcatg

SEQ ID NO: 100963 - DNA, 189 bp, Heterodera glycines
  Promoter: Source sequence=SeqID_37966; Location=1..189; Strand=+; Gene=SeqID_66929
ttctttagtgaaaataagcacttcccagtcaattttaatgggtggagaattaatagaaagttgacaaagttggaaatgggctctttggccaaaatttcgatttttgaggcctcataactttttgggaccttgctatatgctcgtaatattaaaaattcacactagaagtcgacctttctctatccaatg

SEQ ID NO: 100964 - DNA, 53 bp, Heterodera glycines
  Promoter: Source sequence=SeqID_44527; Location=1..53; Strand=+; Gene= SeqID_72012
tttgaatcttgttatttcgattccccacagtgccttcctacgttctgacaatg

SEQ ID NO: 100965 - DNA, 889 bp, Heterodera glycines
  Promoter: Source sequence=SeqID_6851; Location=550..1438; Strand=+; Gene=SeqID_63100
tctcaatttctgaatttaattgccaaaatcaagtttcatcaagcatatcccatcgaacatttgatttagagattaatttaaagtttagcaaaatgatttaagataaaatttttaaaatttaaagaactgctggaaagtgatcgaccgaaccctttcaagaaaaacacatttttatgaccaggaaaaacccgtcccagtttagtttctctctctgttcccccccccccccaccttcccacacagttcaagtgtcctaggcatttaataaaatgaatcaatgtgaaagattaattgtgtcactttttttccgctgatcgtttatcattgggttggtaattaggtaggtataattttattcgcaactccatttcccccccccccccccgcctttttttatttgctcccaccacacattcattcatttctcattatttattgccttttaacattttcttcgttgcacatagacatttaagaaaatggtattacacatcattaatgtaagaaattaattcttttgagtcgatgcatcaacatttcttccattcattctccgcgttcagcaggccgtcatcattttagttcaattataatgtgaatgagaatatacatttgtttcaaaatcatttttatccttaaatgctgctattaaggaaaaatattcagacgaaccaacatattcgtttatttttaactgtttttagattcatataaaaataaaaaaggcaatttcgccttatataattaattttctcccaatcaaattcatttcgtctctatgctacataaataaaaccaacacaaagaccaaacgacaaaataaattagaagaaaaaattgctattgcaattcaaaaggacatatattttacaacgacaaagcaaaaatg

SEQ ID NO: 100966 - DNA, 477 bp, Heterodera glycines
  Promoter: Source sequence=SeqID_13064; Location=136..612; Strand=+; Gene=SeqID_76850
ttacagaaaacgtggttcggaattacagtttacttccccaattattttaacacacaaaaatcggataaatttgcgcccatttttaaccaaaatacgtcagcatcaaaaaatcgcgtcagtgaaacagaatttttttgaatttacaagatacggtatcgtatcgtatagtgtgatggtttgaaattaataaacttgaaagcaataataatccaattcgcaaaaaaaaacatttttaattacaaaattgttaattaataattcaaattcattaaagtttttacatcaatggctacagactttattttagaaatacagtatcactcgacccattttacggtagccgcgggggaaaattgggggaaccataaaaaccccaattttttttttttaatttttctatttttttaactttttaccctacaaaattcgttttttcagtgccttcatggtgtgtcgagaggacagcgcaaaaaaatg

SEQ ID NO: 100967 - DNA, 204 bp, Heterodera glycines
  Promoter: Source sequence=SeqID_25292; Location=909..1112; Strand=-; Gene=SeqID_56041
actgaaaataattcggcagatgggcaactcgacagaaaaataaataaaatattgttttttcagaagtaaatttttttaatatattgcaagaaaaatattggcaaaatttttatgagtataaatgtgtatatattaataaaatttaataaattatactaaattttactaataaaattgtcacagaaaatatataccaattaaatg

SEQ ID NO: 100968 - DNA, 1003 bp, Heterodera glycines
  Promoter: Source sequence=SeqID_3853; Location=5777..6779; Strand=-; Gene=SeqID_52154
aaacactttcttttttgtgtttgcgaacaaaagttgggacttttatttgcatatttcgggatttttgtgcatatttgcatatttagggtttttttgcatatttcatgcatattttgacattttttgtacatattttcagattttttgcatattttggaaaatttgttaaaaaaaattcaataaaacggaaacccctaagaatcggccctaaaattcagaaaaatacacccctaagaatcgaccgaaaatttttaaaaacaccactaagcattggaaattttctcaaaaattcttcccccaaatttttttttcatgagaaaatttttgatttaaaaaatgtcaatatttgctaaagagaattttataaaagaaatgtagcagctcattggcaagtgcactatttcaagtttttttgtgcatatttgatccatatttcacgattttatttgcatatttatgcgcatattttggccatttttcgtgcatattttttgcagccctgccaattatcaattatgtagcttttctcatttttttctcgccaaattattggcattttcattttcaccaccggtactcaaacatacgctaatgttttcatataaaaatataaaactgcccttttttctcctctttctcacaaaaagattatgcacatataattttttggtaatttcaaatttttaatgagaaattgctgttttcaatttaccttctctaaaataagcaaattttttgctctctcattttttctaattgttctctctgttttaagttaacaacaaattttttgccttttgtgacacacaaattaattaattggaaaaagggaaaagcgtgctaattgaaccaccaaaatgaatcgacggtcagcaatttcttttgaaaaattacaaattttcattttccttgctattttttcccatgtttcagttggatttgtggtgacgtgtggatggacattctcccatcttttgaccatgcccaactcggactcaaaatg

SEQ ID NO: 100969 - DNA, 1003 bp, Heterodera glycines
  misc_feature (14)..(14): n is a, c, g, or t
  Promoter: Source sequence=SeqID_6228; Location=148..1150; Strand=+; Gene=SeqID_60805
aacatataaccatntacaaataaaatcacaaatcaaattcaaagtcgatctttttcatattacaaagtgaaaacaaattaaaaatcctttgcttcttcaattttttactaaacaaaatcaaaaaaacacgtctctttaactatcaaattcttttctctttaacaataacaaattcttttatagaattaacaaattcaataatgaaaaacgcgggaaaaaacgattaaataatgtagaaaagtaaaagcaaaaactttctcacaaacaaaaacgggaatcagaacgctcgttttcctctttctatttattaaatatttgatataataaaagatgggatacaaataaggaagggatgcgagacaaattttctattatctctcgctttcatttcttttctcttatttcttttacttttccacttactctctctttttcctcactccctccctcttccacacacacgcacgcctccaacagactgctgctgcacaacagcacgcgcctgttcactgtctacccctcccacccgccgctgcccgcatcaacagacagtcagacagtgcactatctccctcctccctctacctaaccacaacagcctgggaagagaaatctttttgctttaactatttcttttgcttttttcttttcctatactatttcttttaccttcttctttttcaaaactatttcttttcatctctttttcttttcaatctctcctcacagcaaatacaaaacgccacattcaaaccatgtcacaaacagacaaacactcaactttattatataggattgtgtattctttaagtttgtttaagcaaatattgaatatttttggaattttagtaaattaatttttgtcagtttttagtccatattttggttaatatttggccatttctgagctttttagtccatataatttcgagccctactgatggcactatttagtcatttttaattttattatttgtgaatggcctgctactaatacaccatg

SEQ ID NO: 100970 - DNA, 644 bp, Heterodera glycines
  misc_feature (15)..(15): n is a, c, g, or t
  misc_feature (29)..(29): n is a, c, g, or t
  Promoter: Source sequence=SeqID_22137; Location=1..644; Strand=+; Gene=SeqID_52786
tttcctaacataaantttgaacaaaaaantcggaaaatcctaattttaaatttttgttcgagttcgggattagaaattggtcaaaatagatgtcaaattcgtgatcagcgacctttaaaacccccgggaccaaattttcacggttttctatcacaaaaattttttgcaaaacaaaagggtccccctattgtttttgataaaattcgaaatggacctctttttaaatagcgccgtgatgctcgagacccaaaaaacgacagaaaattaaataaagttcgatttttttttgtcgagcagcactttccccccccccccccccccctcgccgtgtgaatgccatgcgattttcttttattgggtaagaagaaaatgttcattggtgcactcattttgtcaattttggcaaattattacgttggctaatcaaaagaaattcgaaaaccaaatgaaaatttcggttgtactgccgcacacacaaagtaaaaaaatgtgccaatgatggcgtgcgaaataaaaatcgcatttgggcctaaatttcagcggattgatcatcgccgaagggcatgttcgaattgcaaatttatgcgttgggaacgtaaaacatgcgtttttttcttttttaaaattgggtgtgcggcagaatg

SEQ ID NO: 100971 - DNA, 168 bp, Heterodera glycines
  Promoter: Source sequence=SeqID_42522; Location=786..953; Strand=-; Gene=SeqID_70396
ttaagtcttggatttgtcaaataattcaagactcaaattaataatcaaaattctcttaaaattttttgaacccaattcaaaaaaggaaaaaaatttgcagtcaaaaaattattcgaatttctccaattttgtttccataatttccgaaagttattcggtatcataatg

SEQ ID NO: 100972 - DNA, 1003 bp, Heterodera glycines
  Promoter: Source sequence=SeqID_17877; Location=199..1201; Strand=+; Gene=SeqID_47484
aaaaaaagatatagaaagaatagaaaaagtccagaaatttttcacgagaaaagcctttaaaaaatgcggacttttacatagatcatattcagaaagacttgaaatttgtcagcttatagaattagccaagcgaagaaatattgctgacttaactaccgcttttaaaattatgaagggttttacgagtcttgatgctagtaaactttttactttttctgatcgaccccattcgtaggccattacttttgagaatgcggcgcacaaccacaaaaagtaagaataatttttttaaccgtatagccaagaattggaacaaattaccaattgttccaattcaggcagataaggcaaatcaattcagggcattgctaaaagctatgtatgagttctaagggatttattgacatttgcattgacattcattccattttattttattttactttacatttcatattgttgtattttttgacattattcattttgattttttttatgcgccacataagagcactaatgtgcctgtggtttgctcaataaatatatatatttaatttcgtattaaatgaatttggcaaaagatggatgaaatgtcgcggatgactgtgtataaaagggacggacattcgcattttcatttttggggagtttggcgtattgatgattccaattcaaatttcattccaatttttttgcctctgttttcggctttgaatttcttcttaaggaaaaggtgaaatctagagatccgcctggacctggatccaggcttggatttttcctggatccaggttcaggtccaagccatttttcggcaacctggatttatcctggacctggatttatgtccaggaaatccatgtccagcaggtccaggttttttccaaaataccgatctctagtgaaatctaataaattaatgccttctcattttattttatccatttgttatttaaaaaaaacaatttttaacttttaatttagacacttaaagcgaaaaatg

SEQ ID NO: 100973 - DNA, 210 bp, Heterodera glycines
  Promoter: Source sequence=SeqID_23210; Location=1702..1911; Strand=-; Gene=SeqID_53931
attcctttgtgtggttaggcgcactgggtcggatcaaagacgtagcatctacatcgttttttgatctcgcggaagatgttgagctggcgaaagaactcgttgaagtaacttttattggttggtgccttaaatgtttcgcacccacagggactccaaaaacaagaccaagaagtgccggattggcttaagctggtggctgaggggaaaatg

SEQ ID NO: 100974 - DNA, 622 bp, Heterodera glycines
  Promoter: Source sequence=SeqID_29439; Location=378..999; Strand=-; Gene=SeqID_59938
ttctcatttttttaccgcaaaattggtaccaacagttgccttcttttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaatggttatctcttttttctcatttttttaccgcaaaatttgtaccaacagttgccttctcttgtctggccctatcaaacaatcttacgatatttgaaacgcaaacaaaaaaaattcttgaccaaaaaatggctatctcttttttctcatttttttaccgcaaacttggtaccaacagttgccttctcttgtctggccctatcaaacaatcttacgatatttgaaacgcaaacaaaaaaaattcttgaccaaaaaatggctatctcttttttctcatttttttaccgcaaaattggtaccaacagttgccttcttttgtctggccctatcaaacaatcttacgatatttgaaacgcaaacaaaaaaaattcttgaccaaaaaatg

SEQ ID NO: 100975 - DNA, 289 bp, Heterodera glycines
  misc_feature (21)..(21): n is a, c, g, or t
  Promoter: Source sequence=SeqID_35137; Location=636..924; Strand=-; Gene=SeqID_64769
gggataaaggacctgagagancctctaaaagaagcgcccgtagctcagtggttagagcacggcacggattgctggggtcgtgggttcgagtcccaccgggcgagttaccttttatgttctacatcacatcaattagtcaaaattatactgcatcttgttttttctcataactcgtggagcattttttcttcacattatttatctttttctatcaatttaataatttattctgccgatgctgccaaatttatattcctattaatttaatactttaattttgtcagaaatg

SEQ ID NO: 100976 - DNA, 507 bp, Heterodera glycines
  Promoter: Source sequence=SeqID_219; Location=1098..1604; Strand=-; Gene=SeqID_78207
caaaatatcattcaaggtactcctatttaacttcggagaaaaggacttcaaggtgtttagagtgacagaaacaataatttcccctataatccctatccaggtgaatgtcggagatagaattgcccagttgatctgcgagttttacacacggcctaagttcatagaggttgacaatttggaagtgacagaacgtggggcaaacggttttgggtcaacaggcggatttggaaatggaaaatgatcgatgaatgaggggtggggggaggagaatgacaatttaatttcataattatcttattttgaataaatcggtttcataaatcaatccaacaagaaaggaatcgtggtgggcaccttcgctttccttcctctcaaatgcgttctttgtcgcatggcattgccaaagagagtaaacaatttcccatcgaccacaaattgaaatatggcattctccttggcgattactaaatggacagcgtaaaataatcaattttatcttaaaaaatg

SEQ ID NO: 100977 - DNA, 244 bp, Heterodera glycines
  Promoter: Source sequence=SeqID_40835; Location=1..244; Strand=+; Gene=SeqID_69081
ttaagcatttcaacatatatagaaatccgaattataatatttgttctcgaaattttataaatagatgcaacttgagaccaaaagtgataagaaacatcgtggccttggaatcgctttcgctacaaaaattcttccacatacgaattcaataagcttctgtgtgttccatatctttttttgtgttcttaattccatgcttaagaaatcaatgtaaaacgaatacatttataggcatttaaaaatg

SEQ ID NO: 100978 - DNA, 344 bp, Heterodera glycines
  Promoter: Source sequence=SeqID_3785; Location=1148..1491; Strand=+; Gene=SeqID_51870
tcatggcaagttagtggtgattggtgatgacgaaacggtgccaatgccattgttctccgtctcatgaagcatccattcctcgggcagcccgctgttggacatgggccaagcgctgccagacgccccgacaatttgcccgtactgcaacaaaaatcccaaaggttggcatcgctcacaaaaaaggcaaaataattcacaagaattagttaactatttgcccactgcgtaggtatagtaatttaaaatggtttataatgccgcggtcgcgttcatcttcgcctttgtcatctccaggcgacttaatgccaaacaccgacatcacttcagagttcaatccgaccatg

SEQ ID NO: 100979 - DNA, 292 bp, Heterodera glycines
  Promoter: Source sequence=SeqID_9528; Location=1..292; Strand=+; Gene= SeqID_71758
catgtaattggacgaacggagatcgtaattaaataatgaaaaattcggtaaaattaaaacgttgaaaatatcagatcgaatctaaagaaatctttctccgactgaatgtagtatcgaagttccaattaattaatctttgaaattggtattattggagcccttagatattaaaaactgtttttgatatgattgataaatttaaaaataacctcttttcatttcaattttgtagccaaacagtcaattatttttcgtttgattataattataatttaaattttgtaacccaatg

SEQ ID NO: 100980 - DNA, 167 bp, Heterodera glycines
  Promoter: Source sequence=SeqID_26463; Location=1679..1845; Strand=-; Gene=SeqID_57195
gctggaggatccagccaaaatcaatggaattgcttcgcttggggacgcaatcccaaaaaacaaagccaattattcatttcaaaaaatactatcgctacgaaaaaatgttaaaattttaatacagattaatgcttaaaatagagcagggttaaagttcagcaccaatg

SEQ ID NO: 100981 - DNA, 634 bp, Heterodera glycines
  Promoter: Source sequence=SeqID_10374; Location=1794..2427; Strand=-; Gene=SeqID_73562
tttctaaatggccattttcggacatttgcggccacagtcaaaattgttctcccatcgaaaatcctttttctcttcaaatttttgccaaaatttactcaatcgagtaattctttttcaaaattgggcttgttcaaaaactcttcagagcttgaaagcttacatcggccagttgatactgtagagagagtagagatctgagatttcctaatactgttcatacttatttcttcatcatttcgtagcgcaaaacattttgttgctcgatctaacacattttccacagtttttctattgttcagttcgatacttatttgaacccagtttcaaatggacgggatgatttttttcctccccttttaatttttctagaaagtttgaatcggcatattagaagagcataaaaattcatttaaattggatggaaaataatttcttatttagtttgtgtggaaaaggttgggccgcaaaagtcgttttggctgggggacgcaattgtcggaccgctaatgtccgagcgcaaatgtcggtccgcaaatgacgtttttggctggggccgcaaatgtcgggctctctctattttgattggcctatttttgaaaatcattccgttttctcttggccagacccggaaatg

SEQ ID NO: 100982 - DNA, 157 bp, Heterodera glycines
  Promoter: Source sequence=SeqID_7626; Location=1..157; Strand=+; Gene= SeqID_65452
aattccaatgcccgcagcaattgaagcggcagaagaagccattgctgctgctgaagagcgaaaaatttcgacaatgagtggtcgaatgaaaacaattcaggtgacaaattggtgagaattacaataaaaataaaattgatcagcccattagacaatg

SEQ ID NO: 100983 - DNA, 1003 bp, Heterodera glycines
  Promoter: Source sequence=SeqID_4773; Location=1132..2134; Strand=+; Gene=SeqID_55671
cgggattttttgggattaccggtaatgaagaatttgaagttccatcgcgcagggagcccgcaaattctaattcaaagaaatcagagagaagcgaaacagtggtgcagcagagaaaacatagaaaaggggaaaagggcaatatttcctcactttctcttccacatttttaaccccatcaaacaacttataacacttaatgaattttcatatataagtaaaaagcaatgcaacaaatgttcgcgagctcagtgagaatcgtttggtgtgagattcggtaaaaacccaactcgtactgtttttcgacaaaaaaatggtcataacttttgtcaaagtcgaccaaattaaacattcttggtaccattcaatagcccttaatgttctccatctatctgcaaaatacaagaaaattttattgcttttcaaaaaagttatggccaaaaattgtaaaaaaaaaattttcgtccataacttttttcaaactttatcaaattttttgaaacttggtggttagatagagaacattaagggctatcgaatggtaccaagaatatttaatttggtcgactttgacaaaagttatgaccatttatttgtcaaaaaacagtacgagttggggcagtacgagttgggtgtcgtccgattttgtcgtcccttctttaggtgaaatgttcgaggaattgcgaggcgaccccgagtcgagagtggacaccggtaattaattggccagagggggagggggggggtgtcaagactgccttctgatcaattcaatcactccctcccccgaaaggcactctgtcgctggtgattgcggtgggtgtcgcctgtctgctcacttctctgatcactggtcatccctttttttctctgccttcttttcccctttatctctcctttcccctctttctctgctgattaggctgtgtttgtgcctttcgctgctgtggcaatttgtctcccgccgaagagaaatcgctaagtgcgctaattgactcgggcaatg

SEQ ID NO: 100984 - DNA, 61 bp, Heterodera glycines
  Promoter: Source sequence=SeqID_1091; Location=7670..7730; Strand=+; Gene=SeqID_67690
ggtttatcagctgacaattttcatttattatgacttatttacaatgtttttaggtaacatg

SEQ ID NO: 100985 - DNA, 152 bp, Heterodera glycines
  Promoter: Source sequence=SeqID_212; Location=2371..2522; Strand=-; Gene=SeqID_77794
aacatttataggattttagcattgtcgttttacacaattttgtcgttattttcgatatcaatttgaagttttcaaatgttagaattggcaaagttaaaattttgttcattgtcgaaatcggtcactgtcgtaatcagccactgtcggaaatg

SEQ ID NO: 100986 - DNA, 327 bp, Heterodera glycines
  Promoter: Source sequence=SeqID_9096; Location=176..502; Strand=+; Gene=SeqID_70230
atcagcgacctcggaaacccccggcggatacttgttttctgaactttttaaaccaaaaaaagaatttgaaaaaatgttgaccaaaaatgtggatacaaactcctgtagtaccatttttataattagagaacaaagcggaaaacaatgaaaacaaaatttgagaagctcgaaaaacacagaaaaagggaacgcaacagaagaggagaggaggaccaccaaagagaatattttgcaaaatgatgaccatttgccgggcgttttaccttatccccccacccacaaatcaatcgatcaaataatcaattggacggatagaggaaaaggatg

SEQ ID NO: 100987 - DNA, 88 bp, Heterodera glycines
  Promoter: Source sequence=SeqID_1218; Location=360..447; Strand=+; Gene=SeqID_70089
attgttagtccttttgttgaatttttagaaattctatccgtccaatcggcttttggaattttaatgagtaaatcagtaaccgtaaatg

SEQ ID NO: 100988 - DNA, 69 bp, Heterodera glycines
  Promoter: Source sequence=SeqID_24491; Location=1620..1688; Strand=+; Gene=SeqID_55220
aatgcgatttcggatgaggcggctcagccttcggtatccaactctcgaaggtccctgaccccgacaatg

SEQ ID NO: 100989 - DNA, 889 bp, Heterodera glycines
  Promoter: Source sequence=SeqID_6851; Location=548..1436; Strand=-; Gene=SeqID_46315
tttttgctttgtcgttgtaaaatatatgtccttttgaattgcaatagcaattttttcttctaatttattttgtcgtttggtctttgtgttggttttatttatgtagcatagagacgaaatgaatttgattgggagaaaattaattatataaggcgaaattgccttttttatttttatatgaatctaaaaacagttaaaaataaacgaatatgttggttcgtctgaatatttttccttaatagcagcatttaaggataaaaatgattttgaaacaaatgtatattctcattcacattataattgaactaaaatgatgacggcctgctgaacgcggagaatgaatggaagaaatgttgatgcatcgactcaaaagaattaatttcttacattaatgatgtgtaataccattttcttaaatgtctatgtgcaacgaagaaaatgttaaaaggcaataaataatgagaaatgaatgaatgtgtggtgggagcaaataaaaaaaggcgggggggggggggggaaatggagttgcgaataaaattatacctacctaattaccaacccaatgataaacgatcagcggaaaaaaagtgacacaattaatctttcacattgattcattttattaaatgcctaggacacttgaactgtgtgggaaggtgggggggggggggaacagagagagaaactaaactgggacgggtttttcctggtcataaaaatgtgtttttcttgaaagggttcggtcgatcactttccagcagttctttaaattttaaaaattttatcttaaatcattttgctaaactttaaattaatctctaaatcaaatgttcgatgggatatgcttgatgaaacttgattttggcaattaaattcagaaattgagatg

SEQ ID NO: 100990 - DNA, 284 bp, Heterodera glycines
  Promoter: Source sequence=SeqID_41007; Location=189..472; Strand=+; Gene=SeqID_69222
ggtatggaaagaaaaaatagttatttctgggactttttcagaaatcagaattaattctccaatgtggcccaaattttaggcccccagccacagccctttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 100991 - DNA, 512 bp, Heterodera glycines
  Promoter: Source sequence=SeqID_22481; Location=1..512; Strand=+; Gene=SeqID_53152
aaaacaattctgtccttaaaatattgatcacaaaggtcgcagcatttgcattttctaaaatgttttccacaattttgaaagtttctccatttttaattataaaaaatcttttttgaaaatttatattgtctttttacaatttttttcccaaatacatactaaatatatctccgatggttccattaactgaaaatttcataattaaaagcatttataaaatggaaatctttgacgaatttattgttgttgacgaaaaagcgatcagccaattaactgttgcccattttaattccagctccaactgtacttttcgtgatgtgacccaatttgccgcactgtaatttcacttttttaaatttgatttacatggtgccgccggggaaaaaattgaatttttttttgcatttttaataaattttttcgaaaattgtgaaattggttctaaaaggcagaaataggtttctagtgccaaatgcctttttaaatcacttacatattttagtaaatttatg

SEQ ID NO: 100992 - DNA, 376 bp, Heterodera glycines
  Promoter: Source sequence=SeqID_11518; Location=2602..2977; Strand=-; Gene=SeqID_74944
ttgtcgatattcgattttatagagaatgtttttaattgttcttaattggactatcactagtcttatatattctatatattctatataaattgtctaaaaataattatttcatatttataaaacagtacctaatattattcaagttataccaaagcgaaacattgttattacatttaaaattcaaggatatgcatggttgtgaaaatattcattcgccttaattattcaatgacgaaaagaccctgtcccgaaaccgaatattctccaatttcccaaaaaacggtcttcaccagttaattgactctcaaatgacttttgtcaagactacagtggagcattgaaacaactccaaacctctttcacctctaaccaaatg

SEQ ID NO: 100993 - DNA, 1003 bp, Heterodera glycines
  Promoter: Source sequence=SeqID_1431; Location=4518..5520; Strand=+; Gene=SeqID_73512
cttacaagaaatcgtctcgaaaaatattctaaaaaagccagttacggatcaaaattacggaaaaatccgtaatccgtaactccaagaaggccgtaatttccataatacgtaatccgtaattacgtccagccctgctgggaaggaaatcctgagcttataaggaggggccccaggagtgtcgggaggggcggttcttccatctgattggctgatcccttgggcgccttacataagtgaccagcgagattgatcaacgtgtaagtgatcgattagactgatcagcgagtgcgtgatcaaagcccgttttacgttaggaacagcggcacggatcttcgtaaagaatgaaatggacggaatgttgcgcttttgctgaaatttatcaattaatggaaaaaagcattgcgtttattttatttcgttcgttatttaaaaagacttttgaatattatttaataaatattctaattgcgataaatgacgtggaaattgctcatagaaatgggagattattttatgttttgaaaagggcggcgacaaacaaaagacaaaaggggggcaattggggggggggggggggacgaaagtcgagcaaaaccgggaaaagaaaaacgaatattatcgggcgggggggcggcattttctccgataagggaaccgagtttaagaacagattgctgaaggacttttttgagcagcgagaaattgagaagcatgaacccgtgcattcatcggtcaaggcgtcggtcgccgagcgggccatccgcaatgtaaaacagcggctgtaccggtattttgcggaaacggagacgctgaactgggtggatgcagcacagaaaattgtggacgggattaaccgctccccgtcacgtgcccacggaatgcgtccgattgatgtgggcttttccaatgctcagagggtgtggaagcgattatatgatgatggacaccgtgcgccccaaaacgacgaccgacacgcttccgcaaagacgattttgtgcgcatg

SEQ ID NO: 100994 - DNA, 55 bp, Heterodera glycines
  Promoter: Source sequence=SeqID_34145; Location=841..895; Strand=-; Gene=SeqID_64018
tgcccattttatttttcaaataatttttatattttatagatatcccagaaaaatg

SEQ ID NO: 100995 - DNA, 55 bp, Heterodera glycines; identical to SEQ ID NO: 99576
  Promoter: Source sequence=SeqID_16829; Location=176..230; Strand=-; Gene=SeqID_81245

SEQ ID NO: 100996 - DNA, 876 bp, Heterodera glycines
  Promoter: Source sequence=SeqID_457; Location=4146..5021; Strand=-; Gene=SeqID_53203
gccagcgatgagaacgacgacggtgcacgacctcacccttcacgatcagtcccccctactgcttgctgttgtttgtgtgaagtccgttccccatattttgtacatattccatgtgatcagcgaccttcctaatgtgatcaaaatatgtatgtatgtgtaatatccattaatgtgctgcttcatattcgttatttgtgtgtttgtacagtgtttgtattcattgttcaatgtgtgtaataaacctgataataaatgtgcaaaaattgaatacaggcaaccacaatatagggtcggggtcattttggcgcaggccattttggcgcagacaagtttaaagattcataacttttttttaattcgaccaaataaaataatgttgatattaatcaataggtctaaatgttctttattagcctgcaaaatttcaaaaaattatattaggttttaaaaaagatatggcgcgctgcgccaaaatggccaggaaaatgcaattttttgagttcttttggccataacttttttgtttctcagctaaattttttgaaactttgcaggttaataggcagggaccagagcgtttgggcccccgtttttgggcccccgcgtttgggcccccgtttttgggccccggggtcgtttgggcccccgtttttgggccccggggtcgtttgggccccaacccaaaaatcggaaaatgtgctttttttaaaattaagattctaaaaactaagcctgagggatgcctcgccacttggcataagttaggtttaattaacactcgctcattttttacaattttacttattccaaatcctattattttttaatagttaaccaatttgatgtacattctgatttggacatttttcagaaatg

SEQ ID NO: 100997 - DNA, 130 bp, Heterodera glycines
  Promoter: Source sequence=SeqID_8352; Location=1..130; Strand=+; Gene= SeqID_67775
ggggggggggggtggcaacggcgggtggggggaaaatgaaaggtgcaccatttctaacactgataataattttaattaaaaaatttcaatgattcccattttttttaaaacaggcgctctttcgtcaatg

SEQ ID NO: 100998 - DNA, 85 bp, Heterodera glycines
  Promoter: Source sequence=SeqID_1210; Location=4386..4470; Strand=+; Gene=SeqID_69952
cctaaagaaaaatcgaaatgaaaaacgcatcccatataagtaagtccttcacaagggttcccgggcaaatgatgacacgaaaatg

SEQ ID NO: 100999 - DNA, 137 bp, Heterodera glycines
  Promoter: Source sequence=SeqID_2632; Location=1818..1954; Strand=-; Gene=SeqID_80812
aaaaatttccgtaaaattttatatttagattctctggcctttgctcatcggaaggggcggtgtccgttgaaggaggggaaatttttggggtaaaataaaaatttttgaaactctttaaattggttttaagggagatg

SEQ ID NO: 101000 - DNA, 631 bp, Heterodera glycines
  Promoter: Source sequence=SeqID_18917; Location=555..1185; Strand=-; Gene=SeqID_83634
atgacggcggatacacacatctaattaagccataattcattgatggaagaaatgtgtcgtcaccaccccgaaatgatgggggattaattaataattgattcggagatgttgcaaaaacgtgactatttcatttcttatcaattaatcaaatccaataaaacaataaggcagcagcttgctatttccatcatatttcaatttaatttcttcgtttttcaaaaaaaaaaaacaatgcaattcaatgtggcaaaaaaccatgtcttcgtgagaacttttggattgccattaatacataatatgtatataaaacttgtttggctaattaataattgggcagcaaaattcaatgtgccttttttatgggtagtgacgaattgtggcggctgattaatcccccccccccgttgacccgcttgctgatcagatattgcaagggcttagccagcaaaagggggggggggggaggcagaaggggcaaaagccctccaaagccaagggtctgttgctggctacgcccttgtcaaattgaatgttttatgcaataattcaaacaaatgaaatgaatggacgacgaagacaaacgaataaaaaaagatggtacatttctttaaattaaaaaaatcaaataatg

SEQ ID NO: 101001 - DNA, 327 bp, Heterodera glycines
  Promoter: Source sequence=SeqID_36276; Location=421..747; Strand=-; Gene=SeqID_65634
cctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatg

SEQ ID NO: 101002 - DNA, 647 bp, Heterodera glycines
  Promoter: Source sequence=SeqID_11840; Location=2141..2787; Strand=-; Gene=SeqID_75343
gaatttacatgaattttgttagaactttgccaaatttttcagaaattttcctcttttagaagaaaataaggcattacccacaaatcaaaatatttttagaaataagaacataaagaaaccctgtattaatcaaaaaaaaagttaaaggaaaactttagccgaagtcgaactcatgacaaaagtactgttattgttgaagcactatccaccaatccacaaataaaataaaaaacacaagtaaaatttactttatttcaaaaaaatttctcaaaatggttaaaaaattcaaaattgtataaattttttgccttatatcccacgaatatgccattcttaggggtgtatttcactcccgcgcccccgcgggggtgaaggtcatgggggcgggggttgtggaggtctgagtcgcgggggcgggggtgaggccaaaaacctgtcccgcccccggcgggggcgggaacccaagtttcatccataatagcacttttgaattttgtccatacataacatatttattttaaatatttcttaatgaatttggcttttaatttaaatttcaaaatagaagatttcggtttcgattcgcgtaaattgttcatggatttaaccgaaagaaaagttgaaagcggaggcatggactcaatatg

SEQ ID NO: 101003 - DNA, 174 bp, Heterodera glycines
  Promoter: Source sequence=SeqID_23559; Location=345..518; Strand=-; Gene=SeqID_54246
tcttttctatggtttctctgagaattaagtcaaacggttggcttaagaattgtgtacgtattattttttgtatttggccattccatccgcacaatcacaaaatacttagactggataaaattttaattatttttgattataaattttaaattgttttcttcatttcagaaaatg

SEQ ID NO: 101004 - DNA, 769 bp, Heterodera glycines
  Promoter: Source sequence=SeqID_694; Location=883..1651; Strand=-; Gene=SeqID_46110
tctgaagggaaatatttgatcagggagggcactggagcagggcaaattttgaaatagcaaaacaaaaagcttttggaattgttggccagaaaagtttaaaaaaaatcatcgagtttcccgctttttttctggtgtcgggcctaccatgaatatgcaccgggtttgaacaaactgattctctaaaaatcattttcgaattaaaccaattaaaatgctcattctttttcaaaaatttgtagaattttaacaggacatccattttttaatctcatcgtagttgcttaaaagcatcatttgcaaagaaaagcataacgatgccataagacagaattccgatgcaaaaaattggtcaatttactgttgcatgcatcgcgggtggtcgggcccgtaagtgaggtaaatgctggcatggtttaaggcggtaacgaagaccagcgccgtcgaaagctgatacaaccaattcgaccggacgcgacgcaaatggcagttcaaattgatgcgaaacttttgaaaagcactgagtctgttgtaaatttttgttgcttccgtcattaaaaaaaagataaattggaaaacatttaggctaaaggaaatgatttaactaatttttttaataacgaaaaaaacagattctctggacatagtcaatatttgaattttactcaacacaatgcctcttaaaaactgcaaaataactttttaatattttttaataaaaaatctgtttaagcactttttcttagttttatcattgccgctttattaaatg

SEQ ID NO: 101005 - DNA, 222 bp, Heterodera glycines
  Promoter: Source sequence=SeqID_3230; Location=561..782; Strand=-; Gene=SeqID_83801
ccttaaaaggggggggggagaaaatagaatgccaaaataatgaaaaaggaatgccaaaaaggaatgccaatggaagcgccaaattcaaaaaagataggagtgccaaatggaaaaatgccaaaaaaatcgcatgccaaagtggatttgcaaaatcatatgggaattaatcgttggctaacagaaaaattaaatttaataattgtttaatattttagaaaaatg

SEQ ID NO: 101006 - DNA, 87 bp, Heterodera glycines
  Promoter: Source sequence=SeqID_18231; Location=1..87; Strand=+; Gene= SeqID_82830
gtagtgtaattgtaaatttgacgctaatttagcaaatttgtttttcgcttaggactgatcactccgtggaattacccactaatgatg

SEQ ID NO: 101007 - DNA, 91 bp, Heterodera glycines
  Promoter: Source sequence=SeqID_21683; Location=2492..2582; Strand=-; Gene=SeqID_52296
agatgaattcaaagaagtggaaaagccaccaatcgctgagattcatgagcaaccaattcaagcagtgcacagcttcatcgcatcggtcatg

SEQ ID NO: 101008 - DNA, 110 bp, Heterodera glycines
  Promoter: Source sequence=SeqID_25896; Location=1623..1732; Strand=-; Gene=SeqID_56667
accaattacaaaaatgtgtagcaaaattaatgcttatttcttatagaatgccaaaaattttaaactttttttcataaaattgttattttttaagatcatgtgccaaaatg

SEQ ID NO: 101009 - DNA, 109 bp, Heterodera glycines
  Promoter: Source sequence=SeqID_11356; Location=2829..2937; Strand=-; Gene=SeqID_74742
cctgaaataggtaaaaaccaattgcttattacccatttgatctgtccacggggatcgcggggattcgtcgcaacaaaaattgtcccaattcattggttttgatcacatg

SEQ ID NO: 101010 - DNA, 117 bp, Heterodera glycines
  Promoter: Source sequence=SeqID_27749; Location=1779..1895; Strand=-; Gene=SeqID_58418
ttcacctatggcattttgttgtccattgcttttttaaattttgcggtgatttgtcccaccaaaattttacacattaacctgaaaagcattctgatcactcaaactggtgctgagatg

SEQ ID NO: 101011 - DNA, 451 bp, Heterodera glycines
  Promoter: Source sequence=SeqID_4308; Location=5166..5616; Strand=-; Gene=SeqID_53985
attaaaaaatatttttataaatatggattatcacaatccgtcataataatttccacttttttaaattttttatatattatttaaaataagagaatttttaagagaaaatacaaaaattatgagatgtatccattttttaaattaatttccgacttgaaaccctgactgtaatcttttttttcgtttaattctttttaaattaaaattattagttgtagatacttttgcctctgtgggtcttttgtcgtatgtccttttgtccgtggatcctttgtgcatgcaccatttgagccgtaaagccacaaaaataaattttaagttcaatcaaagggcttgcaaacaaaatgtttcaaactatcatttgaaaagaaaataatataatatttttttgtgtggtaaaataatttttatataaaaaataataataattttgttaatttagttcacaatg

SEQ ID NO: 101012 - DNA, 295 bp, Heterodera glycines
  misc_feature (53)..(53): n is a, c, g, or t
  misc_feature (105)..(105): n is a, c, g, or t
  Promoter: Source sequence=SeqID_619; Location=1..295; Strand=+; Gene =SeqID_57576
ttttctttagaccatacccgaaaaacttttgatagagattttggatccaatancaatgattgtcaaagaaaatagtaaaatccaaacatgcactgagggacaatntaaaacaattttactgaacaataagctcataaaaataaaccaattaacaggcaaatatacttttattggagaaccaactatttataacatcaatcaaaaaatatggggtgaggaaaatttacctatttttccggtacaaattttcaaacaattaattttaactaatttaacaaacaaacaaattgacatg

SEQ ID NO: 101013 - DNA, 116 bp, Heterodera glycines
  Promoter: Source sequence=SeqID_19775; Location=1..116; Strand=+; Gene=SeqID_84515
tttttataacagagaagaggcaaagtgacattggccattgatgtcacagtgaaagatgataaaaaggagaaatcgcatttctcgatcccgacaaatccaacggaataatttcgatg

SEQ ID NO: 101014 - DNA, 953 bp, Heterodera glycines
  Promoter: Source sequence=SeqID_22953; Location=856..1808; Strand=-; Gene=SeqID_53649
tttctaaaaattgatgggttttcatacccaaaaaaaatccatgtttgttttagaacccagacttttaaaaatgccgggactgggaattaggctgggatataattaccgggattcaaattccaattttttggaagtcttggtctcttggttcatattttagggtcgggatccagtctgggctctagctggtttccgaaaatggtgaattatcgccaccttacacatcggctcttccaatggactggtgcattcgtcctctaaatccaacaaatttgcagattgagacgtgccaccagccgacttcaagtcaacccacccccccccccccctccccctcccatacacacaaacagtgtgcccgggggtggaaaacactaaatgatggtgatggtgatgataatttagcttttcatttgagcatgaacatcgttttgcttgttatagaagggatgaatgaagtcattttttcggcacgcccccggggaggggagggtgtgtgttgtgtaattttaaataaacccattgttgttgcccaatttatattttcattcctcataaaaaacttcttaggaaatttcttattaagaaaatttcaagaaaaacaaattttttaaaaggcttttcagcgattttttcgaaatttcatgatgaactactaagttttttcaaaaattttccaaaaaatcgctgaaatttttttataaaactttttttcttgaaattttctgactaaaaaatttcctaagaatttttttatgaaaaatttctaggtttgaaaattaaaaaaaaaaaatttttcgggggcgggggggaaacgacgggggggggaatgaagtgcacccgtccaatattccggccccctaccatgggttggtgctttctttcagaagttcatcaatttattaactatacaaatattgtttcaaattttcagctacatagatttgtgcatg

SEQ ID NO: 101015 - DNA, 521 bp, Heterodera glycines
  Promoter: Source sequence=SeqID_4895; Location=497..1017; Strand=+; Gene=SeqID_56122
aacttggccccactccttttgtaaaattgctgcctcgaaatttgtggtcaaacttttgctgcaatcagcaataaaagatattagcggcccaattttttcgacaccaatcaaaatataaacctcaaaatttttgtccaattcaatataagcgaattttatgttttttttttgataagcggattcaaattacaatactttctcgaatccattttaactggatctaccaagtataaaaactgaaaaaaggaaagtataattgtggagaaatgtcagatcgatcagatcaaaaatctattgtcttgaacaaactcagtttttgaaaacaatactaagttgaaaaagtccggcgtaatttgaagaaaaaaaagtatttttaatgttctattttgattggggtagaaaaaatcgggccgtcaatgctcaaaaatggccttagaaatggccgcaaatgtgaagcaaaagtcggaccgcaaaattagtgacacgataaaattaagggaaccaaaaggcgcgaacgaatg

SEQ ID NO: 101016 - DNA, 209 bp, Heterodera glycines
  misc_feature (27)..(27): n is a, c, g, or t
  misc_feature (196)..(196): n is a, c, g, or t
  Promoter: Source sequence=SeqID_27853; Location=1..209; Strand=+; Gene=SeqID_58531
ctagtgggagaattggcactgatcagngaaagtgatcaatggaaggactgaatgatcagattgaggactgatcagggagaggactgatcaacgggggactgattactcgagggacagatcagtgggggaaaactcaggtggtaagagtgatcaggcagagacactttgcagatggctccgaagtgcctgcggtgcntccgtcgggaatg

SEQ ID NO: 101017 - DNA, 78 bp, Heterodera glycines
  Promoter: Source sequence=SeqID_7861; Location=1..78; Strand=+; Gene =SeqID_66210
aattggtttgagatttattgcttgaagaaaattgctgtggtcaatgatgatttggtcaaaagaattcggaacacaatg

SEQ ID NO: 101018 - DNA, 689 bp, Heterodera glycines
  Promoter: Source sequence=SeqID_18644; Location=1541..2229; Strand=-; Gene=SeqID_83297
ttggacggagagggaaatggcacgcgaaaggccgtcaatttgggaggcaaacgaatcggcaaaccatggcataatcgcaataaaaaaaatttatattagaaattaatttaaataaatttagtaataaaaaaggaaaatccaattttatgatggattgtcctaaaagatattcatatgagaatggagtacaaattgatggaaaagaaaaatttctttggctgataaatcaatgcataaatttcgctgataaaataatgagcaaaaagtcaggtaatctaatctgaataaatggtgataaagtaataatgcaaaattttaatcatatggtaaggagagatccaccaattaaccgaactaaaggaagtcgaatttttgggaaaaacccgaaaagtcgaaaaaccggcctaaccgaacaaggaggactttagtttaaaaacaaacagttaaagtgcgataaataattttgtttgttttttgttttaatgttattacaaacaaaaaaatattttcgccatatgcaaatttcggcgtgttgtccatgtttttctgtgcaattaatacgattatttttgtttttttattattttcggcgcatgttcaatacataattctttcaaagtgtttgtttttatagaaataaaaatagtaataaatttgcttgaaatatattttattttagacaccaaatg

SEQ ID NO: 101019 - DNA, 268 bp, Heterodera glycines
  Promoter: Source sequence=SeqID_2982; Location=373..640; Strand=+; Gene=SeqID_82620
cctacgaataattgcagagtttgtcgaagcataaaaaaagatagagataaaaaacttcgaaaattttgcggtttcatgtgacaaccttttagtgagctgcttaatcacttagaaatagcttagaaataccatctaaacatttaaagttggccagaagaagttgacccctgccgcgttttagagtgtggggtgatcggaagaggcggcgggtcatttcagtacggtatttaattattttaatttattattagctttgatgttcagtatg

SEQ ID NO: 101020 - DNA, 180 bp, Heterodera glycines
  Promoter: Source sequence=SeqID_6564; Location=1..180; Strand=+; Gene= SeqID_62015
tctcagtgtcaataaaatatttaaatttaattattttaaagcaatttttttaattgaatattaaataatattaaaaattttaaaataaaacaataatgtaatttcaaggttcaactttcttcaatatgttttttcttcaaagattctgctaaaaaaaatctttctttcgtaccagggatg

SEQ ID NO: 101021 - DNA, 137 bp, Heterodera glycines
  Promoter: Source sequence=SeqID_29712; Location=858..994; Strand=-; Gene=SeqID_60184
ctcagcaagaagcaattaagaaattccgtgccaacaacagtcagtcccatcacaacggagggaatcacagggccaaattggtgaatttttatttattttttattacattttaaaattggaatgattttcagactatg

SEQ ID NO: 101022 - DNA, 272 bp, Heterodera glycines
  Promoter: Source sequence=SeqID_3230; Location=149..420; Strand=+; Gene=SeqID_47561
agtgagttttttggttcttgttttgccccttgccctaccgtatccgggttccctttcctacctcatacagtagtacatccgcccattttatttacatacaatactgtactattacagctctctccttcattcatcattccgccgctctttcctatcgtagtcttttttcttttgtctgtctgtcccactttcttttcctttcctatagtattcttctctaccatttccctccctacccctacagtaatcattatcccccaccctacagtatg

SEQ ID NO: 101023 - DNA, 345 bp, Heterodera glycines
  Promoter: Source sequence=SeqID_9332; Location=1..345; Strand=+; Gene= SeqID_71024
aaaattcggtgcttatgggttttgccaaccctctagaaatatatttatagaatattttatggtataattttaagcgcggatcacgaacgtcacgtttatttttaaccatgatatgtttccagtgagttaagtgaaattttagtttttttttgatgagattttacgaaatttgttgcctttatgtaaaaaaaattcagaaggggtggcaaaacccataagtaccgaaaactcttctatagttttttggtatgccatttctgtgtctaggcctcgcatagtactctaatcaaataacgcgatattggaattccattgatttatttgaaattttcaggcggcttaatg

SEQ ID NO: 101024 - DNA, 1003 bp, Heterodera glycines
  Promoter: Source sequence=SeqID_2721; Location=3247..4249; Strand=+; Gene=SeqID_81262
aacgactcgccctatctgttctgatcagtgccctcgcccgatctgttctaaactttgttccaaactggttttctgatttgtaaaagtataaagaaaaatatttattcaaatgtccaattcgaaaaaatatgttaaattgtcaccactgatcacttctgccagctaaccttttttaagaaattctttcaaaagttatttcagattttcatcttttcgtgaagattagccaatgtattgttcaggggtggaatgctagcgcgatcaacaattcgtggcatatttttcgcaactgcgacaatttaaactcgcgatttgagtccgcaatccgcggcttttttggaaccaaattatttataaagaaaatttatctaaatgaaaaaatgggttcaaaatcgcaaattggtaatttttgataaaatctattaataaattgtctcaaatttttaaaaattttccggcggcgcctgtcggactgtcggtcaccttatgaaaatgaaaaaaggcttaaagatataaatgtttgaaaagatggaaaactgagcttttaaggcaatttgaatccgcgaccgctgggtttttctgtccgcgtctcgccactgttatttattggtcgtcatccggacgaattatcactttttgctggacggacgaatcgaccgacacccgacggacgaattgtcatagcacctcgacgaaattataattatttataaatatcattcatattcatttcctttttaatttattgaataataaattttaaattaaaaatattttttataattcaatcaatttaattcaatgctaatacaatataaaattgcatatcatagaaacaccatatttgattgtcgtgtgaaaacgtgcaaaaatgtgactctttcaattgcctttgtcaggagaaatgccacattcgaatgccaacgaaacattacacttttttttttattaatttgtgaattattttcttactattcacatctcattctgctctttcggaatg

SEQ ID NO: 101025 - DNA, 74 bp, Heterodera glycines
  Promoter: Source sequence=SeqID_6739; Location=4957..5030; Strand=+; Gene=SeqID_62703
ggtaccgtctctttttatgtgtccctcttgcattttccctgttcttctgtaagggcatcgtattcgcgttcatg

SEQ ID NO: 101026 - DNA, 803 bp, Heterodera glycines
  misc_feature (13)..(13): n is a, c, g, or t
  misc_feature (53)..(53): n is a, c, g, or t
  Promoter: Source sequence=SeqID_22597; Location=1156..1958; Strand=-; Gene=SeqID_53264
ggggggggatganaaaaaattagtgtatttatcacaagggaaccacacgaacntgtgtaccaggggtgcgatctgtcctggtttggaggtagcgaccaaaacttgttctgatttttaaaataaactcataattttgaaaaatttatggcagaatggcactattttatcaagaatacataagatttgtgcaagtcctaattttcgaccccaaaatctgattttttgggcccgatgtcctgattttgaaaaattttcgatcgcacccctgactgtaactaactgagtttcggtcggctgaatttcggcggctgagttttgtcctgctccgcatgaccccctccccaaatgatcagaaaaatcggtcaacgtttcaaaaaacgtgagaaaatatttaggttttaaagatttataaaaaaaaattctaaactcatactaaacaccgtactggacaatccgacagtaaactaaaacttaaaaaaatattttcgacatatacggactatttcctaaaaatatattcgagtcaaaacactttcgcaaacttaacaaatttgaaaaattaaaaaacatgttaagaaacaaaaaattagagcttaccaattagcaaaatttaaaaaggataactaccgtattaaaggcccgcatcgatccttaattagccaattccgctttatttaccgattattaagttgttttatcaaaattaaaagcagaagacagatattagaatttgttgtgcaagactttaaatgaatcagcaaaaaattctctatcaaaagtcatagttttaaatgcaaataatg

SEQ ID NO: 101027 - DNA, 76 bp, Heterodera glycines
  Promoter: Source sequence=SeqID_14590; Location=215..290; Strand=+; Gene=SeqID_78661
ggtctgtcgattctgggtacaactgccctcactttgaggacgctgagaggggtaaagttgactgtatttgccaatg

SEQ ID NO: 101028 - DNA, 510 bp, Heterodera glycines
  Promoter: Source sequence=SeqID_32480; Location=1..510; Strand=+; Gene=SeqID_62784
ccaatgcaaaagtccggtccgcgtaatgttttaatttggttttatttacttgctggtggttttggtagttattccatagaacctaaatttgtccaaaccattaaaaaccatattttaacattattaatatgtatgatttaaattgggttgcgtccccgaccgtcggggttgaaaaagtgggggttcgggtggggtcgaccaaatcgttcggggtcgggttttttcaatttttgccttatgccatataatcaaaaaaccttatattatttttgcttaaaattttttataattcataatattaattttgttttttaaatttcataaatatttttgtatagaattaattaaaaacgcataaggcatttagtcgccttttatacacttttttttgccccactaaatttttccattttcgggaattttcattttttgttactaattgtaagtgtctataaaagggaaggcattggaaaatttgctctcattcgttgcgcctgtctggttttaatg

SEQ ID NO: 101029 - DNA, 583 bp, Heterodera glycines
  misc_feature (24)..(24): n is a, c, g, or t
  misc_feature (200)..(200): n is a, c, g, or t
  Promoter: Source sequence=SeqID_15183; Location=1..583; Strand=+; Gene=SeqID_79381
aactttataataatgttaaatacntacatgcatacctcacgaaagataactcttgaaaacaaagcgattcagttttgggctcagaagaaaacgaattgaaagttcgtcctttcaaaaaaaagaaaaagcggcgctactgtaaaagttaccgattttgaaacaaaaggggggagggacccttttgttttgcaaaatttttntaagataaaaaaccatgataatttgttatccggggttttaaaggtcgctaatcacgaatctgacatgtatttttactaatttctaatccctaacccgaactcgaataaaaatcgaaattttgaatttttcaaattatgattttttgttcaaatttagattaggaaatcggaattgatcaaaataattgaaagattcgtgatcggggaccccaaaaacataaatgttgtttttcctaataataaaaatattagatagtacgccaaaaggagacaaaaaattagagaaaaaaagataatgtttttctctagcattctctatttattggtacacatctcgttttttcggacggtgtgtacagtagcgccgaaaaagcgccgaaatg

SEQ ID NO: 101030 - DNA, 119 bp, Heterodera glycines
  Promoter: Source sequence=SeqID_8255; Location=1339..1457; Strand=-; Gene=SeqID_67468
tgcttaaaaaatcatgtataattaattgtacctttattggcatttaaaaatgtatgttaaaagtatcaggtaaactggacaagtaccgtttttattttgtgtaaaaaattgtggcaatg

SEQ ID NO: 101031 - DNA, 103 bp, Heterodera glycines
  Promoter: Source sequence=SeqID_33482; Location=804..906; Strand=-; Gene=SeqID_63536
gcaagagtacaagaatacagaagagagggcaaatatggtttgaaatttgatccttcaatctgggaatattgagcgatcatgctgtgattactttcaaaaaatg

SEQ ID NO: 101032 - DNA, 382 bp, Heterodera glycines
  Promoter: Source sequence=SeqID_19946; Location=1..382; Strand=+; Gene=SeqID_84712
ccaaattaattcggttcattttttaaaattaatttttatattaatgaaatattctaatcttcaataattctattcaattaaatcgtttcttttggtaaatttttgttcgctgttttatctcaaattcaaaataacttcattttccaatgttaatgtaaatcataaatttaatttattgtaactaaatttcaggaaaaaaaactaaatgaggataaataatgtccaaaacaatatttatttttaacataaaagcatgtttttttaggctagccacattcaacacagctgaatttaaaaccttaaaaataaaattcgactgaataaaaaatattgatatgataattatttaaagaaatcattttttatttaaaaataaaaaatg

SEQ ID NO: 101033 - DNA, 599 bp, Heterodera glycines
  Promoter: Source sequence=SeqID_11064; Location=2438..3036; Strand=-; Gene=SeqID_74398
tatcattaattagcgccaaaaacttcaactttttaaatagataaaaatgtgataatttgtttttttttgtccaaaaatcttgaaaatttttattactttccagattttttaaaaattttcgaagtccattcctgatgagtgcattttgtatagcatttttgataagtttctcaaaaatgccgaaataggaccgaaatgccaaaatagggacgcccctgtttaagaatcagcttcctaatcataagcatacaaattatacccctaattattataaattttaataaagattttgaattagaaatagtggggtttcagtgcttattgctctttatttatgtgaattcttatttaaggaaaataacatcaatattttacctgatatgcaatcacaaatgtgtatatgaatcaattttgtacctgcatagcgtcatcattttatgcatattactctcattgtttatattcatcaatatttcactgatcaataatttactttgtgggtggataaaaccgtgatgcgacacttgcgccgctccatttgcgccgcgacatttgctccgcctagcaaaaatggacatttgcgccgctcagcaaaaatg

SEQ ID NO: 101034 - DNA, 52 bp, Heterodera glycines
  Promoter: Source sequence=SeqID_8309; Location=1374..1425; Strand=+; Gene=SeqID_67650
ggtgagagtaatgacaattttattagccaattaaattatatttccagaaatg

SEQ ID NO: 101035 - DNA, 141 bp, Heterodera glycines
  Promoter: Source sequence=SeqID_29858; Location=288..428; Strand=-; Gene=SeqID_60323
gtttctttcatcaagtgcaatccgtaaaaataggaaaactctaaaaatccaggctttacccaacgcaattaattattctgttatatatttgtgtgacatcattcggaactcggccaaattgtgctaattgccacaaaaatg

SEQ ID NO: 101036 - DNA, 273 bp, Heterodera glycines
  Promoter: Source sequence=SeqID_44223; Location=539..811; Strand=-; Gene=SeqID_71740
cctgcaaaatctaataagtggaaaatacatgagtatagaatttattttcaaaaagtgtcaacagacttttggaatatatatttgcaatttatcaacaattttgagaagtgagttagaaaacttcacgattcaaaccagttttcgttgctctaattaaccgcgataaaaacattcgaatcaattaaatagcttctgagataataaggtttatcataaaatttcatttaaaaataaaccctcaattattggtatgaacgatactttccaaacatg

SEQ ID NO: 101037 - DNA, 467 bp, Heterodera glycines
  Promoter: Source sequence=SeqID_3095; Location=1..467; Strand=+; Gene= SeqID_83176
caattcaataaaatttaccagagaagaagtatttggtaagaaagtaataaaaaaattagttatactattatctatcgagatataattcaaatgaataaaaaacagaaaaatttgaacaatttgtaaatttccacgccaataataaccaagtcttaaaacttatgacggtatttagttttttggagttaggtatattattctacaacatttataaaagagaaagggaaattaacaatcatttttgaatttaaatcaattattcactcattaaaagttaataattatttaataattttcgcgtaaaaattataagcaacatgttaatataaaaaatcaattactgatgcaattattggtgggggaaaatgaaaaaaatatttttaaaataatttttgtcaaatcataaaattaatatatgcagaaattctaaataatttaattttgaaaatactttgactcaaaaaatg

SEQ ID NO: 101038 - DNA, 1003 bp, Heterodera glycines
  Promoter: Source sequence=SeqID_17642; Location=1352..2354; Strand=-; Gene=SeqID_47463
tgaaattatcttcaaaattcgattaagatcggcactctcaagtttcaatccaatttgaaatcagacaaatctaaaaagaaaagagttctaatgggacaaattattactcagatgactgtgaaatggctaactttgacggtttaaaaaagattttgggtactttcctgttttgaggccacacccaattttaaaaagtcaacaaaagggcgcgcaaaataaacaagtcgcgcgtaacactagtgaggaggcaaatttcaataattgcagatcaaaatttctcaaattgatcagcttctctgtgtttgcagtcttcacgacagagaaattcacataagaatagaattttgggtgtggcctcaaaacaggaaagtacgagattttgcacacaataagcagattcaggaatttgtaaatttgctttggcgcatttatttatttttattttttgttttttgattatttgtttgtgtttgttgtgcttcacagccgttctcgggatgtatgccgaggacaatcagaaattaatcccgagtccaaaaatcgaaatcggcatcccgcgcatccctggagcggacccatattgatgcttgtgcttattccggcaattgtgtagatttacaaaagccatcatttgtctatgatttatggtttttcatcaagtatcacaaaaattccgattttagagaattaaaaaattaagatttttataaatacctaatcattatcatctcacgtaaattcaaatttagattaaaagaataaggacggaattggaaatttttggaaaacattgaactccgaagtgtgctgtccacatggaccaacaacaagccgctgccgctgctgctgctgctgctgctagcgggatttcctctggttttttgcgcactaaaatttcgctcaaaggcagtcagtctcaactttcgctggtgtctcctttttatggaatgaagcccgaacttccccgtaactttgggataaaaaattataaatttgcattatg

SEQ ID NO: 101039 - DNA, 1003 bp, Heterodera glycines
  Promoter: Source sequence=SeqID_9926; Location=2113..3115; Strand=+; Gene=SeqID_72959
taaacaatggctttttctcatgtttttttacattttctgttatgtccaactctttgacgagagagacacaagaaaagagcatttccatttcatgcgccccaccataaaacaaagacgggagacatcgcctcgcgggcgtggggagggatggcggctgtttgccatcgccggctggcagagaattggacacaaaataagccgactccatctctttcatactctcattctctcttttttctttctctctctccttccctctcactctctctcttccttttgtgcccggaggcgatgtttggccaaaagcatttttcatttctctgccccatcaacagccatttgtccaacgagacagacaaatggacacaacacaacaaacgccgccgccgctgaagccgccattcccggaccattttactcgcccagccgctcctttctcccacaacggtcgcacctcgtccaagtcgagaatgcagtaaaggacagcaaatctatgatctaccccattaatagcatcattaccctcccgtcacacggatgaaaaagggcccacggcataaaataggaggaaaacgaaaatttcttctgattagggctaagagaaaagcggagtctttcaacccatttacaaattagctaatgtgatggcaaaaagtgagtgaatgtgaggtatttttgcgtataatttgtgcctctctctctcccccgcccaatttctttaaagggcaaaagtgaaagaaagcgctgtcgccgaacagaaacacaataaaagcactaacaataagaagcaggccagcacacatagactttgtggcagcacaaaactttttttaaattgaatttactcactgaaaaagtctctcattttgcaacattaaattaccaaaaaattattaatttaatgttttaaaacatttaaatttaatttttctgtttacgttttatagtgaaatactgtggtacatatattagaattttacggcatatgcaaaccgaacaaatg

SEQ ID NO: 101040 - DNA, 1003 bp, Heterodera glycines
  misc_feature (189)..(189): n is a, c, g, or t
  misc_feature (197)..(197): n is a, c, g, or t
  Promoter: Source sequence=SeqID_9571; Location=4339..5341; Strand=-; Gene=SeqID_71932
tggtaacgaaatgtttgtccccaaacatgaactgctagggcagccttcatcagctgatagagcatggaaagccagagatgccggctcaaagcggggacgggacaaaatctcgccgccgaaatttcaaaaaaaatttcaaacagaaatttctcaagaaaaaaccttaaaaaatattggcggcctatatgnaaaagtgnccctttttgaaaattttttaaaaaggggggacccttttgttttgcaaaatttttttgtgataaaaaaccatgataatttgttatccggggttttaaaggtcgctaatcacgaatctgacatgtattttgactaatttctaatccctaacccgaactcgaataaaaatcgaaattttgaattttttcaaattatgattttttgttcaaatttagattaggaaatcggaattgatcaaaataattgaagggttcgtgatcggggaccccaaaaaccccagagaataaatttttatgactatcacaaaaaaattttgcaaaacaaaagggtccccccttttaaaaaattttcaaaaagggccactttccatatagcgccgaaaattttttataagaaaatttcagaaagaaaaatattttaaaaatttacagcgattttttttgaacttttgtaataaattactgttttttttaaattttcaaaaaaactcaacaatttttttttcttgaaattttcttataaaaaattttctatgtttttttccttaaaaaatttctaaattttatatatttttttaaatttctgcggcgagatttggtcccggcgagatttcagggtgtaaccctcagagccgcccctcccccttattttccttcaaggcttcccagctctttcatagataattaattaattcctaatattggatcactcgcgcattttggcattgtttttcattatttttttattcgtagatgaatgcatgcatgcccaaatttaccatcccaatttcaatccgcccaaagaaatg

SEQ ID NO: 101041 - DNA, 145 bp, Heterodera glycines
  Promoter: Source sequence=SeqID_7807; Location=392..536; Strand=+; Gene=SeqID_66024
agtatgttggccagtgttctcttaccagtgttgatggacaaatttttgccaaaaaaaactaattgacggggaaataaataaatatataaaagcgaaacagcaggaacactcatatatttgagacatttgaggagagcgcaaaatg

SEQ ID NO: 101042 - DNA, 135 bp, Heterodera glycines
  Promoter: Source sequence=SeqID_35553; Location=878..1012; Strand=-; Gene=SeqID_65094
aacgcagtgatttgtgtaagtaatgtgtataaaacattggatgatttgatgtaatacgtaatcggcaaaccacggacgtctttgtttgacataattacgcatttgagtaaatgtttttaaattggaacagtaatg

SEQ ID NO: 101043 - DNA, 185 bp, Heterodera glycines
  Promoter: Source sequence=SeqID_422; Location=408..592; Strand=+; Gene=SeqID_52037
tttgtcttttatcgcgccacaaattacggtaattgtgttaaaaggccaaagattccattctaatgagtgattatctgtgctgattaaccgaattttctccgtaaaaaagtcctttaaatggcatgccaaaaatggaaattcattccaaataatgtaattttctctggtttccgaattacaaaatg

SEQ ID NO: 101044 - DNA, 106 bp, Heterodera glycines
  Promoter: Source sequence=SeqID_36838; Location=223..328; Strand=+; Gene=SeqID_66064
ttcaccgaaaagagtgggagaagctttaaatggaagaagtcaattgaaacgaaatgttgaagttgtttgtgcttcacagaattcggcggacaatgcgccgacaatg

SEQ ID NO: 101045 - DNA, 852 bp, Heterodera glycines
  Promoter: Source sequence=SeqID_21796; Location=565..1416; Strand=-; Gene=SeqID_52415
ttgtgcgaacatgttcaacttaggatcatttatatttaggcagattttgaataattttttagttatcattattttgaaacatactctcttgcgattcttcaacagaagaagtgatagcatttgtttgacttgctgtcaaagtttcttcagaattttttacttgtttgtttgcgcgaacacttatcatatcattctcctcgtgtctttatttcttttttgaaatattgatcaactaaatttttgacaaaataaatgcagataatttatttatttatgttgaaaaagaaaaatgttttaggttttcaatcatatttgtagtctttagcctcattttgcggtttttgagtagccaatgagtcaagtttttgtgctttttggaaaaaaacctctcaaaaaagcgggtattgcgggcccaggaaagccgggcgggtccaagttttacaaccgggtccgggtccaaacggcatgtgagtcagaaaaaataacaaattaaatatatttatttatttatcgaacaaaccacaaggtgctatgcactctaacagtggtgtaaaaagaaaaaaagtgagaataaaaataaaacataaatggcagtcaaaaatcacaaaaataagtgtcaaatcacagaataggtgtcaaattaaaaacaatagacataaatgaaacaaatcacacctctcaatggggaaaatatgcattattgcttaattatttcttttgcaatttctcggaattttttggggtcatttatttccatattcattctccaaaaaaaatattcattctccaaaaaatattcattctccaaaatattcattctccaaaatattcattctccaaaatattcaaatg

SEQ ID NO: 101046 - DNA, 508 bp, Heterodera glycines
  Promoter: Source sequence=SeqID_28168; Location=1610..2117; Strand=-; Gene=SeqID_58816
tttttttttttttaggaattaacaaattaaaaattttttttattattattttttcataaattacagttcattcggggtccattaatcagatttttaacttttttgcggcccatttccaaaaaacttggtgatgtgcgaggggagaggtccggtgggtcccgattggcgcggcaagcggaaatttttagaactatatgaattttgttagaaattagccaaatttcttagcaatttccctgttttagatgaaaataaggtactacccctaaaccagaacatttcttataataacaacatagaaaaaccctgtattatttggaaaaaaaaaatcaaaagaaaacgtcaaccgatgtcgaactaataacaaaaagtttgttaatgttgaagcactaaccactaaacaaaccacaaatattttaaaaatataaccaaatttactttatttcataaaaatttgtaaaagatggtcaaaactgtataaatttttgcctttaatttcacgaatatg

SEQ ID NO: 101047 - DNA, 126 bp, Heterodera glycines
  Promoter: Source sequence=SeqID_38697; Location=778..903; Strand=-; Gene=SeqID_67429
ggtttgatttcagtttatcatcaagatcaaaaagcaacagaaaattctattaaaactgtttacgaaagtagcatcctaaaaccaagatcaacaaatacagtaattgggcaggggtatggcaaaatg

SEQ ID NO: 101048 - DNA, 215 bp, Heterodera glycines
  Promoter: Source sequence=SeqID_15395; Location=406..620; Strand=-; Gene=SeqID_79655
ttattctgtttaataatgattataattgcctatcaattaacggactaattggtttttaaatgtttagtaactttgaagaagcattcctcggaaaagcacagaaagaagaaggaccaatcggaggaaactgtcaaaggcgtgccgcaatgtgtttgggatgaagaatttgacatttgcgcgatgcaattgtgcagctgtgacaggtggtcacaatg

SEQ ID NO: 101049 - DNA, 235 bp, Heterodera glycines
  Promoter: Source sequence=SeqID_14224; Location=4224..4458; Strand=+; Gene=SeqID_78242
aatacccccctcatcattgttgtaattttcatgcaccaatcattcattattcatggcaaataaatttctacttgttcctcaagaaatttaccggggtctcaccactgcgacggacacgggcgatttaaacttggatgctgttcgacacgatttgaatcgtgcccgggccgaacgagcacatccctctcgaaaaaatgtcaactacaaccagcagcttaggcgatatttaaaaatg

SEQ ID NO: 101050 - DNA, 525 bp, Heterodera glycines
  Promoter: Source sequence=SeqID_8577; Location=1..525; Strand=+; Gene= SeqID_46620
cccccccccccttttttcgttaaaaatttttttcttctaaaaagtcgtgaaaacacacattttatggggttttaagggtcgctgatcacgaatatgacattcatttcaatcaatttcgaaccgctgacccgaattcgaacgaaaaaaaaaattcaaatttttcaattttccatttttagtctaagaatggtttaaatgaccttttagtgaagcactaatgatattcagtgcgttttcgtgtatttaaacaaagtttgaacaaaaatctgaaaaatcgaaaaattttgaattttcgacttaaaaaaacactgaaaattatacgaaaatttaagagttttcagaaaattttcaaattcttaataaaaacttgctttttgaaaaatatacattattttttagattctcttatgtaaaaaacaaataaatttagaaactaaacatttttaatttttacgtggctcagcccctatttttttttatattcgaatttaaattaaacacatttttaaatcatttttagccatg

SEQ ID NO: 101051 - DNA, 930 bp, Heterodera glycines
  Promoter: Source sequence=SeqID_6119; Location=426..1355; Strand=-; Gene=SeqID_46185
aacttagatgagttacaaaaaacatttatccattaacgattcagtcccaaaattttttgaacggcaacatcaagtttgggcaccatatgccatatggaggaatttcaaaaaaataaataaagtatattgatcggtttcatcttttgagcattaaaagagcacacaatgggggtatttctgcagttgaacaatttgtctattttaatcccagacaaagtacgctccttttttttagaacattagtgactctcaaagacctttgcataagagccgacttgcacctgacgtatgacgatgacattaaaaataggcccaatcgcaaaaatttgtcatttttggtgaaaacatttaacaaattgcactcaaattttaaaatttttccattttttgaaaaaaaagctcgtcgtaatatttttcatctggcagccctggcatactgtacataaaaatggccacctttgagaattttttccaaaaatcggcaaacgcatatcaaataaaaaagcagcttttacccccttgaaatcagcaaaatgcttctacctaaatcagcagagttgggagccctgagtttatatatataactattctggatcaaagtcaacagacaaaaaattacacatttatgtatactcagaaaaagctgaatttttctcatttaatttttttttcttaatgtcaatatttgctcttcccttgtaattgtaaatttccgaggcttttaagctttcgtttgataccaaaattgtaggcattgaccaagtaagaaaattataacctaagaaactgagagtggtcattgattggatgcctaaagtaaaataaagccaaaatgagaattacattaatctaatttaatcttttctcgaaatttactatgtttatatatatatttttagtcgttacggatatattctctgatcaacaatg

SEQ ID NO: 101052 - DNA, 723 bp, Heterodera glycines
  Promoter: Source sequence=SeqID_6517; Location=1766..2488; Strand=-; Gene=SeqID_61874
accgagctacgccgccggtgcctcggcgtcctgctgcagcagttcggcatccctcagttgagagggcggttgcagataagttaggcgtcggtgctgttcgtgcccattttatcccttactttataggcactactcctgctaatgtgcgcaagccggtcattcgccgctcatccaccgtggagcgggcggttgccagcaaaggtttgccgttcatgtctatcccctgtcggatttaatccgaaaaaatacaaaactattaataaaaataaatctaaaataaaataataaaaatttgcctacaaaatgcaaaataatgaataaaataaatataataaaataataaaatctacctagaaaaatctgttctaaattaaataaattttttaaattaaataaagggttttttactataaattttaataaagataaatttaataaaaatgaaattcaacatataataaaatgggaaatgcagaatgagaaaatgagagatggaagaaggaaagcaataacaaataatgagaattgacgatcggcgacaaacaagccaaaaatatcatttgaaaccaattgtgtttggcgaagaaggcccaaaacataattggaacgatgggaaataatgggaaataaataaatattcaaataaaataaaatattaacgaaaagctaaattggaaaaaagataaaattgagaaaattcaaccgaccaaaacggcccaaatg

SEQ ID NO: 101053 - DNA, 139 bp, Heterodera glycines
  Promoter: Source sequence=SeqID_5918; Location=2832..2970; Strand=-; Gene=SeqID_59680
acaggtctccaggttctgtttctgttttttctaagcccgagactggcaatcgcggcacttgagaacaaaaaagtgccgaaaattccgagagcattaaaagaaaatgagaaaaaaaaatgccaaaagatgtaaaaaaatg

SEQ ID NO: 101054 - DNA, 1003 bp, Heterodera glycines
  Promoter: Source sequence=SeqID_20794; Location=550..1552; Strand=-; Gene=SeqID_51367
aaaaaaacgaaaaatacacccctaaagatcaactttttggaaatttttaaaaattacaccccacaaaacacgaaaaatttgagttttcgtcgtcattttggcattttcaataaatattttcgtcatttttttgcgaacatttcttttttttaatgagaattttttcgaaatttggcaaacttggaggtgtttttgatacaacgaacaacaataaaaaatatgcatttttaagttttaaaccccattttttggttgtttattgtacttttaaggtttatttaagcaaatattaaatatgcacacctttttttgggatttttgggggtttacaacatatattttggcattttttatccatattttggtccatatttggccatttttggcctttttagtccatatttcgggcttttttagtccatatttaatgtccatatttcgcgttttttagtccatataatttacaaccctaatcattatatttggaaaaatatttttttaaaaggacaataatattttggggatttacggacatatttaggaatgacttggaggaggaataaaaatttttgacccgatggaattgatttcaatggcgattaatttgcataaaaggcaaatataaaatgaggaaaataaaattacataagagggattcgaacctatgggggcaaaaacaaaagtccggagcacaacctccgcaccaccgaccaacacaaaacatgcaaatgtatatttaatttattgcaataaaaaaaagtttggcacgtcataactcggcactcagactcatttcgcagaaaataaaaacacttttcttaagaacccatgggtgctctatacacccaccaaatttcatttggaaatcccacggacacctggggaccttcctttgtgagttcagtcggattttctgtataaaagtgttgatttcttctctccacctccacaattcctcttcgtaaaatttttttctttttttagttgtttttgttcatatatg

SEQ ID NO: 101055 - DNA, 147 bp, Heterodera glycines
  Promoter: Source sequence=SeqID_31757; Location=1..147; Strand=+; Gene=SeqID_62063
ggaatggcaaagacgatggccagagagagggacggaggaaggcatcggatggcaatttggggacgaattgggccaaaaatgaggacgaaaatgccctgctttttggaggtaaagcattaggaaaagggcacattctctttgacaatg

SEQ ID NO: 101056 - DNA, 61 bp, Heterodera glycines
  Promoter: Source sequence=SeqID_17894; Location=2796..2856; Strand=-; Gene=SeqID_82444
ggtatataattttctattatatttcttataaagttaaatttcatgttttaaggaggttatg

SEQ ID NO: 101057 - DNA, 456 bp, Heterodera glycines
  Promoter: Source sequence=SeqID_25158; Location=851..1306; Strand=-; Gene=SeqID_55887
gtgattgattggtttcttatttaaatgtctccattatttttagttttctgttccaactatttcgcaatatggcccgtaattttgcaacctgtcaagaaaaatgattgatgactttcgaaataaagaatatccagacgatttttttttgcagttttgaataaaatgtgacagttgtctacggaaatgattgattaccctcaaaattaaggcaaccccagacagtcacgtgactagacccctccccctttttgcctatttcgcacacccggcccaaatcgcaaatcattcaactaaatagttggatttcattaaactctcttcacgctctaattttatttctctccgctctatttttatttgcattaattaaatctattactatttacttacgtcttttttcttttaaaatctctctaccctctttaattcttctgctgcaatttcttgtttaaaatg

SEQ ID NO: 101058 - DNA, 81 bp, Heterodera glycines
  Promoter: Source sequence=SeqID_7861; Location=3272..3352; Strand=-; Gene=SeqID_66211
tggactcttgtgtttctaaagtttggaattgttttccccccctgacaatctatgaatgtacaatgcaatttatgccacatg

SEQ ID NO: 101059 - DNA, 542 bp, Heterodera glycines
  Promoter: Source sequence=SeqID_779; Location=558..1099; Strand=+; Gene=SeqID_61022
tttaagctgggctagaaagaaaaattaataatttactttttttattttaaatttaataccatttgaacaaccaagtgcgtttatcataacaataaataagaaaatttgaagtaaattcattgctaaattatttctttaaattaagataaataaaaaaaattaaaaataatgcatttaattatcacaataagatttttattgaataaaattgattttttttaattttaaatcaaatgatgaaattaatgagagtgaaatataattgagaattaccaatacaactaatcaaacaaatttatgaatgtcatttatgctggattttaataaaatatttaaaaggcagaaaatggctgagtaaataaaatgaattcaaaattttcatattataaaaatttaaaataaaagacaaattatcacaaagtttgatgcaattaaagagaaattgaaggcaattggaaaatatgtttgggaaaacagaagcagaattgagacaaaaattggtaaattattaggcgcaaatcgcaaaaaaaaatatacaaatg

SEQ ID NO: 101060 - DNA, 94 bp, Heterodera glycines
  Promoter: Source sequence=SeqID_14559; Location=1704..1797; Strand=-; Gene=SeqID_78632
cgttagaccctcccaaaaaaaaaaaattttttttatgcaggtcaaggccataaatttttttccaacaaaatttcccataattttttttcagatg

SEQ ID NO: 101061 - DNA, 626 bp, Heterodera glycines
  Promoter: Source sequence=SeqID_31442; Location=474..1099; Strand=-; Gene=SeqID_61786
tcttgatggggggggggagtgcattttggacccccaaataataatgaaattttgtataattttcctacaaaagtagagcccaagcatcaattttaaagcattttgacattgtgacattttccttatgcccaaatgtgcctcaaaaattgttttgtttttttgtcaaaaaatagtcaagtgatgatgatgttgcccataaattctaagtgattggatgattcggattttaaatattgttttttaccatttttgtttgaaatctcataaatgaatgaaattgtaaatttattgtgtctattcttgtatttttcaaattactaaaaaaagacaatttgtgcatttttcgaataattttgagaatgcactcattgctttgtccacgtgcgtccagctcccaattatcggccctttttaaacgtttttccgtcgggaatggcaccgcttcgaccgattgtgccaccaaaaaagggcctgtcgatgtgctgcgtgcacggcttctctaccagagcagaaagcgtgggatacgcgagaacgacattttgatcaggtaaaatttggcaaaatattctttcttcacggcaattttgtgtgtaagtgggtttgctgaggaacacttggtcaaaatg

SEQ ID NO: 101062 - DNA, 92 bp, Heterodera glycines
  Promoter: Source sequence=SeqID_39664; Location=1026..1117; Strand=-; Gene=SeqID_68173
aaaaaaatggtaggacaattaaaaagggacaaacggagggagaaaatggacagagcggaagagtgaatttgatgaattcaaaccaaaaaatg

SEQ ID NO: 101063 - DNA, 1003 bp, Heterodera glycines
  Promoter: Source sequence=SeqID_17425; Location=609..1611; Strand=+; Gene=SeqID_81912
atgaaaaaatagaatataataataaataagagtaaatatcctttttggaaatatcctttttggaaacggaatttaataagttagtaaaaatgaaatattattattattttaaataagtaattcaaataaaaaattaaaaaaaaaacataaattatttatataataatccatagaaaagcttctaaacagataatgaaagtcccaattttgtcccaacgttaaagcaacaactgaaatggctttcactcggttttctgcaggctgaacgatattcataaaaaaatatctatgaaaagaaacattagacttacattatattataaaaaacaatttattaaataattttaaaaaacatttgtacaaacttagtcgagaagaaataattaatgtcaatagattatttcattaaaacaagcaaaagaattaaaattcaaaaaattgaaaggcaataaaatcaaaaaataatataattaaaattaaatttaaagacaaaaaaagacttgtttttttagtatttaagagcacttagaatccaggaaataaaagtatgtatttgccaataatttctagtcctaattataagttatcaataatttaaagatgccaattagtattatgcatacaataaaattataatataggaaaattttttcgtgtttcacacctactagaaatagccaatgaattaatctgatttatcaaagagactataaaattattaagctgaatgcataagtaattttgatcactccttgatgatgaaatcaaaacgaaaatttcaatttttttgaaaaaaagtaaacaatatttcccgaaatgacaaacattaattatattaacaatataaattatgaattcatttaaatataaaaaatagattaagaaaaaataaatcgactaattaataatatatgaaatttatttaaaatattataaagaatattaaaaattccatttaattaataagaaatattaaatttaattaatagaaataaggaaaatg

SEQ ID NO: 101064 - DNA, 88 bp, Heterodera glycines
  Promoter: Source sequence=SeqID_34586; Location=1..88; Strand=+; Gene= SeqID_46395
gttagttcggatgttacgatgtccaattctctccatcattcattatgctgtgactacgttacaccatcttttattgtacgtggaaatg

SEQ ID NO: 101065 - DNA, 803 bp, Heterodera glycines
  Promoter: Source sequence=SeqID_11021; Location=2446..3248; Strand=-; Gene=SeqID_74349
tattattttatttttttgatttttttaaagaaaaaatattattttatgaattttgttattgcgattaaaggcgtggagaaatgaataaataatatttaataatgtttcgaaaatgaggagatcaaataatgaccgaccgaaaagagaaccatccatcggcagtgacgtgtaattacatacaattaatcatttttttctaatgacaatttaaaggtaaggtcatttttcgtcagatgttatttatttgttccgctatttcggccagcaaaattaacaaaaaagtttatgaaataatttgtgcaaaatttcaagaatggaagcgattttttatttcattagaatttaaaagagaaggatagtgatgagattagtgatgaagacgagaggttaatgcgagaagggggtgccaagggattttgcgggaatcccagtaagtaagccctcattttttgaaaattgcttggtacgggattctcgcgggattttgcggatttttagtccacaatcctgcatttttgaaaattgcaagatgcgggttcccgcgggattttgcgagacgccaggccgcaatcctgctttttttgaaaattgctggtgcgggattaatccctctgggttccgtcccgcaaaatttctgtgtcccaatcccgaacaatcctgcagcaggaaccgcaatggattttttgaacagtggacatatgctaatttctgaataatttataataaatttttaattatccatttttcaacacagaaaatctcttccctatttatgacttttttggggcagtctaattaaaatg

SEQ ID NO: 101066 - DNA, 271 bp, Heterodera glycines
  Promoter: Source sequence=SeqID_4500; Location=1584..1854; Strand=+; Gene=SeqID_54678
ggttattattagtttaaatttggtaaataaaattattataaaaattaatcaaaataattaaaattgtattcaaaaaaaacaaatattaatttaaattggattcataaatcaaaaaatatattttaaaatatcttttttttaatcaaaatcccccccccccaaaaattaattaaattaaatatttaggcattattttataatcgttaatttaatttttacataaataattaatttttaattatttagtgaaatggacggattattaaaaatg

SEQ ID NO: 101067 - DNA, 617 bp, Heterodera glycines
  Promoter: Source sequence=SeqID_6876; Location=2043..2659; Strand=-; Gene=SeqID_63177
ttattgccgctaaataaaaggattattatacaagccaattttagacaatgctttggtttcaatgaaaaataaatatgagaaaactaacaacagggatattgagaaaagaaaaagaaaatacaagacaagagaaaatgtagaaaaaaacgagaacgagacgcgctaaaagtcaagaaaagagacgagaattctcttttaacgaacacctaattattaattaatcagaaatttttggttcgtatttttacggaacataatcgggccgggcggaatttgtatttcaaactgccggaataaaacggggcgggaataaaattgtttgccttcaatttagaaaacaaaaatcatctcaaaatttaaccaatcaaccttttttttaaaactatcaaaaattctaaatttaaaattttctaaaactccttaatttgtgagatctactaacaaattttcaattttttttaccgcattacatatttttccaaaattttttggtggaggatggaccgactgtaccgccggaaacttttcccgccggtgccggcggtggcgggtgtttgttcgcctttctgaagccgggtgagtgatttggtgagggaaagggagtcaataaaaggatg

SEQ ID NO: 101068 - DNA, 561 bp, Heterodera glycines
  Promoter: Source sequence=SeqID_874; Location=2894..3454; Strand=-; Gene=SeqID_63064
ttctgatctctttttgtgtgtgtattttaaatgtacaatttttgagcaggatatacataatcggaggatgaacaatcaaacatttacattaattttatcggttttgataaataaatacccaagtgcggggggcgaacattatgggaaagaaaccttttctcgtcacttttttcttccattcttttgctggcagctaatttattcatgggcccaactgctccatatttgtatggcccgtggactctcgaaagcggagagtgtccacaaattggagatggagggggggggggcgagtgccgtgccaatttccccctccgcccaatgctttcaattcgatactcccgccgtcttgttttcttctttcctttcttcacgtcacttgcttttcctccctctgtccgttctttcgtcttttcctcattttcgtccttcaaaaaccccattcttcccccaattttcctttgtttttttagtgtttttatgtccttttcctcctcctccgttccgttctttcgtcccctttcgccttcccataattcggacaaaaccaatgccaaaatg

SEQ ID NO: 101069 - DNA, 221 bp, Heterodera glycines
  Promoter: Source sequence=SeqID_10248; Location=2991..3211; Strand=-; Gene=SeqID_73401
aaaaaaatcgctaaataggcacaaaaatcctcgaataggcactaaaataggcaaaaaaaattttattaatgctttttaggaagcaaaacacgtaaaaattattttttacaattttattttcaaaattacaaaatgcgttagccattttttaaaagtaatttccgaattttgtttttttaagatttgcgatttcaagaatcaaacagaaatatttggaaatg

SEQ ID NO: 101070 - DNA, 1003 bp, Heterodera glycines
  Promoter: Source sequence=SeqID_14447; Location=869..1871; Strand=+; Gene=SeqID_78490
attagcgcctccatttttgcgcctttcacatttgcgcccagaatatttagcaatgacgaaatgacactttttaccaaatactcgaaactttttgcaaaaagtttttttacaaattataactaaattttaatcctttcaccgaccggcgggcctattggcaccgccgaaaaccgcgaaagcgttaaaaattgacaaaatttttataaattacgtatattgtaaggattttatctctttttttccccttttaattattgtgtctccgagtgttttttgacaacatattgcctggcgggctaataaattgggttctaagtaatactgggaggtgcaaaagtggacttaccataattaatacaatttatcgaaagtattcaactttgccaacagttttttacagtatattttaaatagtcgacattcaaaaatttattgttgtcatttgataaatttttaggtttatttcctttttttgtaaacatttccaattttccattttttcaaatttatttttttttctattttttcaaataataatttggggttacatttttgtatgattttgagaatttctcagactttttttatattttgtctaaaaatagaacgaataaattgaaaatttattttacattggaatgcaattaaaaggagatgatgaatgaatgaatgacatgcttgttaaatgtattcaatccacacatttttttcatcttaaagacatgcattaaaagaaatttcattgaattaaattcaattaatttattcctgtaatgttcgggcgttaaacacggcgcatttttaaacgttcgttttttcggcgtattgtaacgaataaattttgtacattaattgagctgcttataaaagagtgcccgatgctgtagcttctacagttctcctcatttcatttcatttgaacaaaaatgtattttttatattaaatttaattaataaataatttatttaataaataataataaattttagaaagggtaaaatg

SEQ ID NO: 101071 - DNA, 1003 bp, Heterodera glycines
  Promoter: Source sequence=SeqID_3880; Location=2163..3165; Strand=-; Gene=SeqID_52269
gatagagggggagcgagagacggcgggaagggggagaaacagaagggagaaaagaaagtcgatagagaaggggagggaaaagggggggggggagagagagagagaacccggagaaagaagagagagagaagggagagagagaggggagaaaagagagagggggaagaggggcagagagagagaaggttgatagagcgaaagggggagagagagagagagcggaggagagaaagcgagagagaagggagagagagagaggggagaaatgagaaaagagcggttggcgcgcgaagcggcgccaaagcgctcgttcagtcggtgctgggcgttagtcaaaaaccatcaaatggaaaatttttgacagaaaattattcataatttcgtctaaaatggatcaaattttataatattgatatttttcgatagccctaagtgttttctagtatcctgcaaaatttctaaaaattctttaagtttaaaaaaaaattatgacctgagaagctcaaaaaaccaagtttttttgaacatttttagtcataactttcttaaaacttaaagaaactttttgaaattttgtaggctaatagaaagcacttaggcctatctaatgatatcaagaattaaaaatttagttgcttttgagcaaagttatatcaaaaaataacatttcgttgctggttattagggctgggatttttatgtgtctaaaaatttcaaaataaaatgacgaattaagaactcaatttggctactttcagcattcggataaaaaaataatttttgtaaattctgtaagaaatgacaagaaagtcgatttttagcggtgttatttttcaattttcttttatttttcttacaaatttttctcaaaagtgccaaaatatgtgtaaaatatgtgccaaccccaaaatatgtgtttttatgttgttataaatcgctctaaaaaagaataattaagtgaaaaagtgccaaaaactgttaataatttaccatcaacaaaatg

SEQ ID NO: 101072 - DNA, 730 bp, Heterodera glycines
  Promoter: Source sequence=SeqID_188; Location=8380..9109; Strand=+; Gene=SeqID_76956
atccccctacgccctcctcgattttggcgtcttcagtgcagaatctgatcagaaagaattctttaattgctttgtttaaattttgagcaatttccagtcgcggcgttactttttctaatgacatttaacaaatattacattgccgaaggcatttaattattgtttaatgcacatttgaatgccaatgttgacgtaaacacataataattatgttttcagctgatttaataagtacccaggggaattgtttggtaggaattttgtccaaataaaaataaaatgaacagaattcataaaagacgagacgacaatttttccatttggagttggttggttggcattttgtcactccgatggaactgttgctgtttcgtcatgatgaatttgacaaattgtacggctgtgagggatttaatgccgacaaaatcccacttgagcaacggacaaacattgtgaacggatgcattttaatcacactttttttcatttttgaggtcactttttctagggcagcgttttctagaacaatttaaaataattaaaaaatcgataatatttaagatactgtacgttccgtgtatggtatcaatattcaaaaaaatgtacgacaacccatgctacaaaatgctgtttttcattggcatattggacatggttataaaaaaaatgttttaaaataattaaaatataaaatttacttaattactatgcctagttggccttgctaatg

SEQ ID NO: 101073 - DNA, 584 bp, Heterodera glycines
  Promoter: Source sequence=SeqID_17159; Location=1430..2013; Strand=-; Gene=SeqID_81598
gaaagcaatacgccatgaatcagaagtgacaaaaattgttctgcgcgagaaaactgtgcatataattagggaacaatattggtttgaaaagcaagtctcttaagtcagccctgagcatcagcttgtcatgctccgatttcatcaacaaaacaattagtgccaatcatgaaattgttttcaagattgcttttactaaattcgctgttggcattgcgataaacgaccacttgccgacgccgtcgagctgcaaccgcgaatatgtgccactaaagtggtggcaaggattgccactcgaaaaaatgacgacacttaaggtcagaagcacattgacgagagagtcccagcactgattatcattatgaacagtcgaaattttaagaaaagctggactttgaccgggattccattttggacctggatctgggtaaaaatcaggtccatgtaaaatacaggctcaccgaggcccaaaagggtctatgaaaattataatatttaataaataaaaatactaagttaatttcaccaattaattgtttaagttggaaggcaaatttttgttgctgaacgatccgccgccagtgatg

SEQ ID NO: 101074 - DNA, 1003 bp, Heterodera glycines
  Promoter: Source sequence=SeqID_11807; Location=568..1570; Strand=+; Gene=SeqID_75309
gataaaaataataatttattcattattacatattagcattttattataatgcatttgctgacagaaccgatgaaaacaccaaccgtcgatgctataggagatttgatctaataaaatataaaaatacataaataaatgctaaatcaatgcagcacaaataaaagaagaaattaaaatcagaaaaaatattttttatttaattttaacataaatttccgtactatattttttgcaaagaaatttttttttctacatccaacagaaaataatgtctcaaaatcaagtggaaaagaaaatgtaattaaaataaagcaaagttaggaactattgtaaaaataaactaagaaaaaatttaaaaaaatcaatttttttaacatagtcggatcttgtccaattaatatgtaaatattttaatttcattaaacaaaacaataggcatataatgactgataatttcttctttttttattttctaatgctgcctatgtaatatttctataaattatgaattgcaattacttaattgtcttgtaatgacataacttttgctttccaaatcacattcatcatcattagcatcattcatgaacgcacaaatgagttgtttttttaagaaagttttttttttgtttggaaatcggagcgagtaactgatcggacaaatgtcatttcgcgcacccaaataagcgttaaaaaacggttccacatcgactttttatacacagaaaaacggtttatgctttaatgagagcaaattaaatttaaaaaataaatatatggcaataattagcaaattttttttcatcattttgttccatataaaagcggagtaatcacaacgaaacaccataactctacatattttcctcattaacgtcaataaattttccacaaaatgtacatttcgatttttttattcaaaattgtatccaaccaaaaagcattttaaatttgaaaattttaattctaaattgaaaatccgcaaaatttagcgcttaatatg

SEQ ID NO: 101075 - DNA, 131 bp, Heterodera glycines
  misc_feature (20)..(20): n is a, c, g, or t
  Promoter: Source sequence=SeqID_22148; Location=1718..1848; Strand=-; Gene=SeqID_52803
gtagaaaaagtataccaagncactgtacgtctagaggatgccgctaaccgaagtctaagagtaataatcgcagagctgtacaaaatacagatgccattaaccaagtatctgtaacggttaatgctaacatg

SEQ ID NO: 101076 - DNA, 547 bp, Heterodera glycines
  Promoter: Source sequence=SeqID_8674; Location=1692..2238; Strand=-; Gene=SeqID_68827
ccccccccaccaaagaaagccattttggcaccttcgaaccgagtcattgcgctgggggcaaaagcaaaaggcagcaacgggagggaaaaggacgaccgcgacgaagaagccgaggaaggtgatcagagaacaaggagttggccagaagggtcctccattcaatttcagccttcgcattgcccccgtcccccgcttctcccacttcccccgccgcttctgctccgtccccgccgcttctgtgcctttcgcgtccctccgcccttttggccgttctttcgctcgtcactttggccatcattcaactcgtccatcttggcacttttttgcataaaaggcacgcaaaaaagtgcataaacgtcagcaaaagtgacaaaacagcagcagacgaagaaaggcatccgacgccaccgaacgcagcggcggagaacgccgaaagaaatttggaaaaggaattccgaaacggtaaagcacagggaaataaagaaatacggtacttacggaaacagcggcggaaggaagtcaaaattggcacaaaatcagcgcaatg

SEQ ID NO: 101077 - DNA, 75 bp, Heterodera glycines
  Promoter: Source sequence=SeqID_24983; Location=1..75; Strand=+; Gene= SeqID_55719
cgcctctaagtcagaatcccgcctaggcaagatagcaatattcttgctccccggtgtcgggaggcactacttatg

SEQ ID NO: 101078 - DNA, 1003 bp, Heterodera glycines
  Promoter: Source sequence=SeqID_4633; Location=991..1993; Strand=+; Gene=SeqID_55168
ggaagctgtcaaagttttctgacttgttttattttttattttaaattgttaattaatatccagagaattgcattttggtggagccgaggacagatttgggcataacggtcgaccacttccaatttctgcatttgaacaatttgctgacggaagtgagctctctgatggatcagatcaattcgggttgggattctcttggaatggcattttgtttctacttttatagaccgcactttcttccggaccaaattgccgaatctctcttccgacattcccttggccatttattgtcaatgtcaaaaggtgcttttttgggttagccgacatttgcggaccgacttttgcggaccactatttctcgatagaactgtctaaataaagaaaaaaataataagaaattttaataaattcaatattcccaaattgaaattagtgaaggtaagctgatgcaaagcgatctgtctcaattggagacaagtcttatttgacataacttttttctttcttttttatagaatttctaacttataattaaactgtgaaattggcgaaaaaattagctaaattaaatataaaagtcagttcaagaattttataccaagaaaattttttatcttgtttcacttccacgctttagttaaccgagagcttaattttttccggcatgtcaaaccaattaaattaacaaacaaaaactaaaatagtttatatttttctcaaaaattgtccgtaatttgctgttattaaaactatgggtccaaaattaaaaatgtgcaactacataatatatttatctatggaaactaaacttctttaaaaaatgggttctttcgatgttgattgcaaaaagttgatcgattactcttgaagggcgatgttcaacttggtaaaaatcacaaataaaactacttagtcactcaatttttgaaaaaattatttttttttgtttttttttgacagttcaacccagaaatagtggtccgcaaaagtcggtccgcaaatg

SEQ ID NO: 101079 - DNA, 356 bp, Heterodera glycines
  misc_feature (30)..(30): n is a, c, g, or t
  misc_feature (144)..(144): n is a, c, g, or t
  Promoter: Source sequence=SeqID_16348; Location=1..356; Strand=+; Gene=SeqID_80740
cattagcaattcgtttgtgcttactaatgnacgaaaaagaaaaattggcagaaaaatatttgccaaaattcgtattcgcattgaaaatgtgcacaacaaacactgggtaaaaaggcgtgtttcattttttattcattaagaatntaatctaatatataatatatatttatacaaggaaattaaaacaaaaagaaatatttggataaatatttgtaaaatgcacttaattaagttttaccaaattctatttcatcgaatacaaaatcaaaattgcacaacaatctgttaagattaatttaccaaattggaatttgccttataatgtttatatgaaaaatgaaaaggaattaaaaatg

SEQ ID NO: 101080 - DNA, 85 bp, Heterodera glycines
  Promoter: Source sequence=SeqID_15395; Location=1..85; Strand=+; Gene= SeqID_79656
tcatcctcatcaattttgccaatgttcctttattcccggaattaacttactaagtgaccggaatttataccccaattggcaaatg

SEQ ID NO: 101081 - DNA, 184 bp, Heterodera glycines
  Promoter: Source sequence=SeqID_2424; Location=3891..4074; Strand=-; Gene=SeqID_79645
aaggcccatcttctactctccactttgtgccatttgcactataacatcaattcattggccttttggatgagcagggggaaaaacaaattgcttaattagcacaaatttttaatattttcattttcaaggtgatgaggcgcttcattcggtgtggcgaagactcgaacaatggtggaaatgtatg

SEQ ID NO: 101082 - DNA, 66 bp, Heterodera glycines
  Promoter: Source sequence=SeqID_5573; Location=1..66; Strand=+; Gene =SeqID_58527
tttttagaaaaatgggaatcgggaagtgaaaacgaggcgttattggaacagaaaatttcggaaatg

SEQ ID NO: 101083 - DNA, 497 bp, Heterodera glycines
  Promoter: Source sequence=SeqID_29450; Location=1..497; Strand=+; Gene=SeqID_59948
aaataacttttgagataataaggtttatcataaaattcaattaaaaataaaccctcaaatattggtatgaacgatactttccaaacatgcacgcgtttgcgctcgagctatttatcatcgggctgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtccacagacttttggaaaaatatatttgcaatttatcaacaattttgagaagtgagttagaaatgataaacttcacgattcaaaccaattttcgttgctctaattaaccgcgataaaaacattcgaatcaattaaatagcttctgagataataaggtttatcataaaatttcatttaaaaataaaccctcaattattggtatgaacgatactttccaaacatg

SEQ ID NO: 101084 - DNA, 104 bp, Heterodera glycines
  Promoter: Source sequence=SeqID_262; Location=1..104; Strand=+; Gene =SeqID_80327
ttttaaaagaaaacccaaagtaaatcgaattagaatcccccccaggaaagttaaaaagaccattgatttatttaatcacttctagtttaattttattcaaaatg

SEQ ID NO: 101085 - DNA, 172 bp, Heterodera glycines
  Promoter: Source sequence=SeqID_10550; Location=558..729; Strand=-; Gene=SeqID_73786
tttctgattctcatcaatcacagcaaatggatttaatattattatttttaaatgtatattttctttttaatgaagaaaatgcggttataaacgcattgttttttcttttcttaatttaagcattctcaaacacattcctaatctgatcattttttctgcttgccaaaaaatg

SEQ ID NO: 101086 - DNA, 216 bp, Heterodera glycines
  Promoter: Source sequence=SeqID_20501; Location=1934..2149; Strand=-; Gene=SeqID_51041
gatcgttccaaagatttcgatcaggtcaccaaactagaggaaaaggtacttaagggattgagtgaagcgagaaaactacatttagaatctcgccggtttcacaccaaaattttggagttggaaaacagaattcaatttgtagtgtgggattttattgggcttcacgaataaaagagaatttgagtaccaaaaaaataaaaattaaatcagaaaatg

SEQ ID NO: 101087 - DNA, 1003 bp, Heterodera glycines
  Promoter: Source sequence=SeqID_5036; Location=1651..2653; Strand=-; Gene=SeqID_56663
agtcaaaaaattatcaaatggaaaatatatgacaaaaaatttttcataacttttacaggctaacataaaatatttagcgctaccgaaggatataaagaatttaaaatttaattgcttttgagcaaagttatagcaaaaaaaaaaaaaatttcatttgatgttttttgattaacgccctttttgatggtttttgactaacaaggggaaccacccgaactgtaagtcggaaaatgcatatgtgttatataccattggatagagcaatgtcgacttctattgtgaatttttaatattacgggtccatagcaagaaataaaaaagttatggggcctcaaaaatcaaaattttggctgtgtttccacttaaaattggtggctcagttggttaaattcgtgtttttgaagctcgggttcaaatcaaacataaaaaaatatatattttaattaatgtattatataacaaaacaacttaaaaaatcattttttagacttaaaaattttatgatagttttctttagtaaaaataagcaaaaaataataataaatgtaaagtttggaattaataaaaagtgaacaaaactgtaaaagtgcccttaggcgtaaatttcgatttttgaggcccaataattaaaaaagatcttaaaaatattaaacattaattatttaaagaaataaaatgcatgccaataggcccgcctagaaaattttgattattgtagtgcaattttaagattttatcaaaaaatttaaatttgaaaatttagcctcattagccaattaaaaccacaacaaaaaaagggttgcaaacaaactcaaatagatactgtgttgtgggaagtttcggggtcacagataaagaatatctctcatccatttctaaaattccaaatccctgactcgattttgaacaaaaaattcgaaaagtcggaattttcatatagttatattatttttagtttattaaataaaattaaaacttcccaaaaagtgtgtctactaaaatg

SEQ ID NO: 101088 - DNA, 778 bp, Heterodera glycines
  Promoter: Source sequence=SeqID_15337; Location=1064..1841; Strand=-; Gene=SeqID_79580
tgctaaaatttgattaaaaaatatagtaatttttcaaacaaaatattatcttcataattaaatcaataaattcatacaaatatttacaatgattcggtttttaaacatttaacaatcacttagctttcatgtggtgatcagcgtattccaggcggttgattttgatgtgctgtagtacgagttgatttacagctgtgtagcgatgattccataagaaaatgcgcatccaattagtgaccagctaggacggatattatttaaatccaaatacaactaaaaaacaatttaatttaagcaaattccgacaatttaaccgctataaaatttagatttttaaagccaaattgagaagcaaaaaattaaaatttggttgtttatgaacaaagttttaagagtagaacgggactgggacctggtactgaaaaaaatgggacaactgagtacctaagtcccggttttgatcgggaccgggacttccattttttaaaactgatttaaaaatatttaaaatcatataaatttataataaaattgttcatttatttagttgttaaattaacatattattttctatttattggaatatttatgcattaattaatccgttttcgcattgaatcatcacaaaaatgcatcccatcccattctcattttcaatcatttattcagcaaatcataaatatgtccatcaaatgattttatcgtattattccaatgaaaaaaaggaaaaatttttattagttaaaaaataataaatttttgtaattaagcaaaaatg

SEQ ID NO: 101089 - DNA, 1003 bp, Heterodera glycines
  Promoter: Source sequence=SeqID_23417; Location=815..1817; Strand=+; Gene=SeqID_54123
ttttatgttttttaaaattttatacaaaaatcgttggggaaaatatgaaattgtatttgaagtattttaagatatttagttttcggcatcaaacaatggcacttcatgcgctgaacgaagcgatgataaagttcgatttgcaattgtgctggcgaaaaagataaagaatgagatttttatgaataaataaatttgatttttccaattttaagcaaatattttattagttattacatgtttcagtttagcacataaaaatcccagctgaattttgataacaaaatgcaataaaaacgaaaaatatacctctataaaattgcataaatttaatataggaaactttgatataataaaatttcttattaaaaacggtagcatcttcgcggtataccaaattttagaaataaatttaaataattaaatttttatttttattgagcaaattaggatataattttttatttgccaattgatattttcttaaatttagatattttaattatttgaaaaactttttcaatacaaaaagggttaaagtttctttaatgttataacggaaatataattttttttaattgcaattttgttagtcattcatttgttttataaaggttaaaattgcctttcataaatgaggtgtccacaaaaattcaaaaatgtcctactaatattttgatgaataagcattatgaaaatggttgctgcttaatgtgacaatctttgctcgacttattacatttgtaatttgttaaattcattcattccgtccatttgcggtgtcgttgttaattcactgtgattagacaaattgaaattgctaaaattaaattaaattatttaatttaaatacatttttaaaggatttaaaaatggattggaaatttaattttcaacttttattacgggctttgttttttctaagtttcacagtcgttttcggattagaagacactttttctgtaaaatcagacagtgcagaaggggaaaattataaaaaaaaatg

SEQ ID NO: 101090 - DNA, 104 bp, Heterodera glycines
  Promoter: Source sequence=SeqID_26151; Location=1..104; Strand=+; Gene=SeqID_56901
tttgtttaaactcggcatcatttatatacctgagaattaggactccgcccactttaagcagattaaatttacccgctcaaacccaaaatcatttttacaaaatg

SEQ ID NO: 101091 - DNA, 491 bp, Heterodera glycines
  Promoter: Source sequence=SeqID_4802; Location=2464..2954; Strand=-; Gene=SeqID_55774
ggtaggagtcccgttttgacttgccgcaacactccgcaaatgcccaggcaaaggggccggagaaatgattcgctaatagggagacggctccctgttgatcgctgacccgcccgaaaatgccgaacacaaaatgacaaaaatagtttattgaagaagcgctcaaacttgggtaattaaacctcgtgagaggggggggggcaaatgtgacaaacggcaaaaatggggattaacagtgaatgcgtgattgagtggtgtggtgagagattaaggcaaaaagaacaactttttctccctagaggggagtgaggaagaaaagtgaacgaatgaatgatgtgacggacaaattagtgatgaaaaaagggggggggaggggcgattggtaaatattttccccccggggttaggcccagataaatgcaaattggacaaatgagcgaaaatgaacgatgcgataagaaaaaaggggagagtcaaaggccggggagaggatg

SEQ ID NO: 101092 - DNA, 422 bp, Heterodera glycines
  Promoter: Source sequence=SeqID_1549; Location=944..1365; Strand=-; Gene=SeqID_74386
atttgaaacagataaaatgttatttaattttcttgcttgttttaatcgtactgtttattaatattcatactttggtagggaaatggcccaaatgccttagtagggaaatggcggtagggaaatggctggtagggaagtggccggtagggaaatggctggtagggaattggcggtagggacatggcggtagggaagtggcggtagggaaatcaccccaacccccctagtgacgtattaagcaagagaaaagtttagaaaaatgtaaaatttactgcaaaagaaaaaaaacagattgataaaatgattagtgacagcgcgctagtttatttttatttctctcttttattttttattatttattcaacataaacatatttcttataaaaagataaaatataagcttgttttatcaaacaaaaatg

SEQ ID NO: 101093 - DNA, 330 bp, Heterodera glycines
  Promoter: Source sequence=SeqID_6025; Location=313..642; Strand=+; Gene=SeqID_60051
tgtttgcgcatctgtctcgcccccacaatgctttagtccagtccgattcatccatcgacaaaccaatcaatccaccgccccctcccattgctcaattcgtcttcctcccccgcccattcattagccgcttcatccctctctttccaaattcaaagttgaattcgtcctcccctccccctcatttgctgctgttctgcacctcttcccctcgggtaaagatgtgatgagttccttcctgctcatctcttccttccgatgaggtcattccccaaccccccccccttccccaatctcttcagcccctcctcagaatcccttctcctatcgatg

SEQ ID NO: 101094 - DNA, 328 bp, Heterodera glycines
  misc_feature (30)..(30): n is a, c, g, or t
  Promoter: Source sequence=SeqID_35320; Location=1..328; Strand=+; Gene=SeqID_64896
ttctctaattgcatgctaaaatgtcaatancgcttgtactcttcttaggtgaaatgcataaaccccgcgcgaatttccttttcccgcaataaacaaaaatattttcgtttttggatttattaataattttgtttataaattgtggcacttcgtgtcatttgcctcctccgctttctccgtttgtttaattaacccctaattgattcgcatttcttaatttgggcatgcccttttaaatgtttcattttttgtgaaatcaaagacattcgcaatagcattttttctaatcgctcactaaattcgcaatttttgccattttccgcaaatg

SEQ ID NO: 101095 - DNA, 413 bp, Heterodera glycines
  Promoter: Source sequence=SeqID_2805; Location=27..439; Strand=+; Gene=SeqID_81696
gctgttcgtaagagcgaaagtgcaacgctcggcagcgtaatgtccatacgatgcctgttcgtaagagcaaatggacaacgctcggaagcgtaagtccatacgatgcctgttcctaagagcagcagcgtaatgtctatgcgatgactgctcgtaagagcaaaaggacaacgctcggcactcggcagcgtaagtccatacgatagctgttcgtaagagcgaaagtgcaacgctcggcagcgtaatgtctatgttatgcctgttcgtaagagaaaaaggacaacgctcggaagcgtaagtccatacgatagctgttcgtaagagcgaaagtacaacactcggaatctcaatgtccatacgatgcctgttcgtaagagcaaaaggacaacgctcggcagcgtaatgtctatacgatg

SEQ ID NO: 101096 - DNA, 73 bp, Heterodera glycines
  Promoter: Source sequence=SeqID_40083; Location=1..73; Strand=+; Gene= SeqID_68519
attgcttattcatattatttctttacatttaaaaaatatatttttcactctctaaacaaatccggataaaatg

SEQ ID NO: 101097 - DNA, 341 bp, Heterodera glycines
  Promoter: Source sequence=SeqID_27445; Location=1..341; Strand=+; Gene=SeqID_58142
cgacagaaacaaatggagagacggacacctgctgagaatggacggagaaaggacaaaattatgaaaaaaaacttcataaaaaacgccaatttattaagtaagaaaaatgttttgtactaagaaaccgtggatggtcattaattggacttaacattaattgttggacgcataaaaatcgattagacgcataaattaataatagaattattgatccattccactgttcagagaaaagtaccatctctttttacaaacatttttcggttttttattctcctcatttatagatacataatattcccttttagttaatctaatttaatcctaattggcaacaaatg

SEQ ID NO: 101098 - DNA, 92 bp, Heterodera glycines
  Promoter: Source sequence=SeqID_9283; Location=4633..4724; Strand=+; Gene=SeqID_46724
agttaagtaagcgatttttttataaatttccccttgaaataggcacttttccggacgcttcgcgtgacccgatcatccaaatcgccaacatg

SEQ ID NO: 101099 - DNA, 1003 bp, Heterodera glycines
  Promoter: Source sequence=SeqID_19463; Location=1071..2073; Strand=+; Gene=SeqID_84182
ttctatatttatatttcctatacaattaattaataccgaaaaaacatatttccttaagtgactcacggtccatataagaagcgatttttttgaacaaattttcaacgcgaaattcgtcttggcttacaaaaaattctgtatccattacagagaatttgagtgggaaaacgtggcagttatagatgattcataaggcgaaatgtatttctttttaataaaaaataaaaccttcgtttaaaacgtcaaataaatcgtccactattaaaccgactaatgccccagctccgccaattaagtgctcagatttttttaatagccgaacttcacggaagagtcttcccaaatttaaatttggccgtgggatatgaactctagcaatgatttcaacagaaagaaaaataattaaaattagtatggttattagcttcatcttaaagactacatattgtataggcttaaataaacgaactttaaaatgaaaatgaaaaaagatatgattctaataatagtttaagtaaaaatatgtttttatcaaaaattgtttttgcttttatatactctaaacgcggttccgccgaaagataattcgctgatcagctgtcagataaaggaaatgcggttccgccgaaagataattcgctgatcagctgtcagataaaggaaatgcggttccgccgaaagataattcgctgatcagctgtcagataaaggaaatgcggttccgccgaaagataattcgctgatcagctgtcagataaaggaaatgcggttccgccgaaagataattcgctgatcagctgtcagataaaggaaatgcggttccgccgaaagataattcgctgatcagctgtcagataattaatgataagcacaaaaattactataaaaaccaaagataaaagctaattattcaactccctagttcttcttactctcaatcgtcacatttgcacaatgtattcaatttaacggctaaaatattttatctttttttaagataatg

SEQ ID NO: 101100 - DNA, 493 bp, Heterodera glycines
  Promoter: Source sequence=SeqID_33143; Location=248..740; Strand=-; Gene=SeqID_63298
ttgtgtattttatgaaaaataattggcaatgtgacaaaattgtggatgtatttgacgaattttaacgggcagaatgccaaaaatatcgccaatttttagacattttgtacgaatatttgtttagagagtacgttggaattcctacagtgaatccaaaatttgtatttaaaaacaaaattgaaattaatgggccaataatttatgcggtgatttgtctggccaaatttcgcaattttagtttaaaccaaattatagtaaacatattgaatagaaattaaagaaacttttcatttattatttcgaaccaaaattgttaaatgaggagagattgaaatttggaataaaattggaaaatgaacaaatattgccaattaatgaattcattttgcaattggcaattgacacagcgaatgaatgccaaacaaatgaaagtttagagggaataattcgagaaaattgtggagaaaaatttgacaaaaagttagagaaaatg

SEQ ID NO: 101101 - DNA, 67 bp, Heterodera glycines
  misc_feature (13)..(13): n is a, c, g, or t
  Promoter: Source sequence=SeqID_18214; Location=2395..2461; Strand=-; Gene=SeqID_82814
tttaaaaaaaatntttttttgaatataaaagtcacggaatgatttgttgaatgttcgctcacacatg

SEQ ID NO: 101102 - DNA, 1003 bp, Heterodera glycines
  Promoter: Source sequence=SeqID_13423; Location=224..1226; Strand=+; Gene=SeqID_77307
cattttttggcgtttcgcatttcgcttttcgcatttcgctttttggcgcgaaaagcgacttttacacccctaagaattggattaaattcccataaaatttttcaaaattttacctataaattggctaattttcagtgaaaaactgtttataaatgatcaaaatttccaatttttttccccagcggcgcctatcggcaccgccgcgcccccaaaactcctatttttcttagaaaatggcccaaaatcgcaaaatttggtaatttgatgaaaaactgttctcagcggcgcgccaaaactcttatttctcattagaaaaatgatacaaaaatcacaaaatttgatgattttttggtgaaaatctgtcaacaaattttaatcaaattttcaaaaattttcccggcggcgcctgccggcgccgcctgccggcgccgcctgccccctcttcccaaaaagtttttttggaaaaagcgcgcctcaaaaaagcgttttattgatttttaaatttttataaaattttaaaaaatgatttttgctttatgattttaactattaaaaatttgtagaaaaaatttcgcttttcgcatttcgcttttcgcattttcgcatattttggcttttcgcatttcgctttttttttcatttcgcatttttcagtttcgcaaatttcgcttttcgcatttcgctttttatttttcaatttggcccatccctggtgcaagcattctctgatctaaaccattcattcattctacatacaaagcaaaattccatggcaacaattattggttcagatcgtgctcatctacatcatttgtgcacttaccctcctctattgcattgtttcggtacgtttgctaattttagacggcactcaaaaaaacactcgttttgatgcactttttgagctactttaaaaagatgatcaaaatttggcaaaaaggtgcaaattttcaaaaacccaaactaaggggggaggcaatgggaaaatgccttttgaaatatg

SEQ ID NO: 101103 - DNA, 332 bp, Heterodera glycines
  Promoter: Source sequence=SeqID_24423; Location=342..673; Strand=-; Gene=SeqID_55156
tgctaaaaatggaacacgtttagcgggaacagttcgtttcctgcccccgcccgtaccccctcccccctgttgatgcctttctactgattgaaaaacagcaattgaacactgttttattaacaaatgacacagtgtttacgtataccggcacattacataatgaatgtatagatttttactactcatctcatagagccattcaagaagctgaaaaagttaagataagaaatctcgaagcctcaggggtaaatatatggtttggacgacttttagaaggggtaagaaaagtacagagcatttcggttaatattaatgaagattatcagaaaatg

SEQ ID NO: 101104 - DNA, 53 bp, Heterodera glycines
  Promoter: Source sequence=SeqID_5896; Location=2714..2766; Strand=-; Gene=SeqID_59604
ttcatgttctcaactaattcaattttaattattttttagcaaatttaaaaatg

SEQ ID NO: 101105 - DNA, 279 bp, Heterodera glycines
  Promoter: Source sequence=SeqID_7308; Location=1848..2126; Strand=-; Gene=SeqID_64417
tcctgattttttgtctgtgttcacggcacagcaatcagcgaccaacaggaagaagatcacgaaaaccggtaaccatttttttacattcctatttttcctgaaaatttttcgcggctctgtatagccaacaagtttttggtttttgacccattttttaaaaattccaccaactttgggtgtgttttgttattttcagccaagtttcatcccatttatgagaacttctcgtctccaaatagttactcagtttttgtttgttctttagccctttaattcatg

SEQ ID NO: 101106 - DNA, 76 bp, Heterodera glycines
  Promoter: Source sequence=SeqID_41985; Location=1..76; Strand=+; Gene= SeqID_70005
gtctctcaggaatacatatggggcgcacattccatctttgcctgataaagatgacgacacgcccattgcaaaaatg

SEQ ID NO: 101107 - DNA, 586 bp, Heterodera glycines
  Promoter: Source sequence=SeqID_23570; Location=310..895; Strand=-; Gene=SeqID_54259
tttgaccctttttttaacggggcgttcactacagtttatccaaaaaagctgttgttgacaatttaagtataaaatgaaaaataaaataaattttatttttctctgaaaattaggctcactcagaccataattttttctgtttgtttttcaaattaagcaatgtgaggatttcatcatttggagatttcggctcttgaatttatacaaccggctttaccccattcttcgaaatatgtttgtaatgtaaacaatcagcgaatagaaagtaggcaaatattgacaacagaagaggcttgcttaagttcttttttcctactcatttgcccggaaattttctcgcgacaatgggagttatcgggcagtttttgggtatttattagcgcactaattaatgtatcttttggcgtaataaaaccattttcgcatcattcatttttgagaaactggttttttcaaaaaaaaaaaatggtttgatgcattacttttgcacctgactgtactaaaatacgcactccctaattgttaaaattccaatcataatatttagaaaagaattttatatacataccaccaaaaatgaatgatg

SEQ ID NO: 101108 - DNA, 125 bp, Heterodera glycines
  Promoter: Source sequence=SeqID_4013; Location=906..1030; Strand=+; Gene=SeqID_52808
ggtacaaacaacattggcaaattggcggttttggcaaaaaatgatttaggcatttcaaaacttaaacatcaatatctttttttgaatcatttattttaaattttactttcagcagtcacaatatg

SEQ ID NO: 101109 - DNA, 338 bp, Heterodera glycines
  misc_feature (16)..(16): n is a, c, g, or t
  misc_feature (56)..(56): n is a, c, g, or t
  misc_feature (86)..(86): n is a, c, g, or t
  Promoter: Source sequence=SeqID_24222; Location=1..338; Strand=+; Gene=SeqID_54936
tttgcaaaaaggacgnagtatattaaggagcataaatgctcaaaacgttatgatantcaatatggtaataaaataaaaatttatgngagaataaataattatttaggaccaccgcacccagcgcggcttaaattactcatacatggaacaaataaacaattcagaaaattgtaaattaatttacaaggatacaggtggaccaaaaaaataaaacatttttaaacataatttttagacagtgtgttttttatacatcccaaaggatcaggtccattaaggaactttttagggtatgaaaacaacccaaaatccttttaatttccaattttagtgaaatg

SEQ ID NO: 101110 - DNA, 67 bp, Heterodera glycines
  Promoter: Source sequence=SeqID_41161; Location=1183..1249; Strand=-; Gene=SeqID_69348
ccctagcattcaatcggaaaattagttcatgcatatatgattatgtcatttttaggctggtgccatg

SEQ ID NO: 101111 - DNA, 1003 bp, Heterodera glycines
  Promoter: Source sequence=SeqID_10234; Location=2341..3343; Strand=-; Gene=SeqID_73378
ttatttttttggtacttttcaaagtataagaaaattgcttaaaatttcaaaaaaaatactgaaaatattttacttttttgggtttcggggggggggggggggttagcctcctcaggagggtaggcggtcgacggtcccttggttttcacacctcgtcataccccgttttttcctttttacccgcaaaacccaagggttcgggtctttttttcttgttaaattaaataaaattagataatttggatttggtttaggatctaatgtttaactattcttttcataagtaattttagtaaggcaaaaaatgtttttcaaaattattcaattttaattaataatggctagggaacgtctttttttctgcggctttgtttcgacgagatatgcatgaaaaacacatttttagctaggaaattcttcgttttaacgccactattcatcactaggaatcactattttggagctttgcaactaaaaaaaattatttgaacactaaaatagttttttgcaactattctggcgtttcgccactatttttggcactattttggttttttggaaaatttcccaaaaaatgcaataaaagcgaaaaatacattcctaagaaccaaactaaaaatttcaaaaatacaccccctaagcattggaaaattttctcaaaaattcttccccaaatttttttttctagctcaatattcgctaagaaaatattggaatagaaatgtaccacatttgcactgctaccagttaaaatgcttaattttttgctgaaaattatgtcactattcgttactatttcggactttttcgccactatttttgccactattttggcatttttttgtcactatttagttaattattttgggatttttttgccactaaaaatacgatccctaataatggcatttgtgcccaattgcagcagaatgcttccctcccccaattgaccccagcagacaaaatcaatttctgacggataaagggaggggagggaggaatg

SEQ ID NO: 101112 - DNA, 154 bp, Heterodera glycines
  Promoter: Source sequence=SeqID_6764; Location=4383..4536; Strand=-; Gene=SeqID_62809
gcaaagacaaaaatgggggaagaatgccgacatttttcaatttttgttacctaattgtgggctttttaattttacttttttttttcccccaccaatatctgggtcagaaatttcttgcccactattttcgctttcaccgcccgacgccaaaatg

SEQ ID NO: 101113 - DNA, 211 bp, Heterodera glycines
  misc_feature (7)..(7): n is a, c, g, or t
  Promoter: Source sequence=SeqID_1327; Location=8420..8630; Strand=-; Gene=SeqID_72642
tataaantccttgttttaatgaaaaaataattaattatagtatgcttcgaaatacaaatggagctctaaaaatacatggttttgatgagaccacaaattgctgtgtcaacattgtaaggacatatatgtcttaaccctttttgtaacttgttttttattttatgatgacatttttcccttggcgcctattgcaaaacgcaaaaagacaatg

SEQ ID NO: 101114 - DNA, 72 bp, Heterodera glycines
  Promoter: Source sequence=SeqID_11496; Location=1168..1239; Strand=-; Gene=SeqID_74912
atgggttgttttaagataaacaatcctgatgagcgcagctactgtttattttatgccttacaagcaacaatg

SEQ ID NO: 101115 - DNA, 112 bp, Heterodera glycines
  Promoter: Source sequence=SeqID_13603; Location=1876..1987; Strand=-; Gene=SeqID_77507
catacttttaacaaggaagagaacgactggggattcaaatatttcattacttttacggtgagtggcagaaaagaaattttttcaaatttgctaaatgttttgtcaaaaaatg

SEQ ID NO: 101116 - DNA, 1003 bp, Heterodera glycines
  Promoter: Source sequence=SeqID_9551; Location=814..1816; Strand=-; Gene=SeqID_71860
aaccaaaaaatgccgataggcgccgccgccgggaattttcaagcacttttcttttttccacttcgaaatcggcaccggtaccgctcttttcaactattggcattaagattcgaattggagttgcaattgttcggcaacctttcgaattgtcgcgcaaaacaaaggggcggagaattgcacagggaaacgcattgacaatgtgtttgacagcaaatcaaacagctggggattccccactttcattgctttttgggtgagggctgattatatataccgtacttactgaattagaacccccctttcgagggggctgaaaaatagaacccccgggggtattaattcagtaagtacggtattctaatgaaaatattctaatcttctgaacgatatcaaagttcatcgactttaagtaattttgtcattatttttcatttcccctggaaaatttaagaaaggccaataatggcagaattggagaaacggccaaataaattcaaaaaagctaccaatcgattcgtctcggggagttaatttgtaaacacgaaaacatacataggtctccagttgcggaaatgccaaaaaacctgttttgaaccggtttaaaactctaaaattgagcaaatttggcacttccaacttttttttaaaataaatgatcgaattatgacaaattggtatcatcgaatcagccattttcgttttttgaaccaggttcaaaaatttctctcattctctgacggcaggacgtcatccactgatttttagatttagctcgtcaaggttttcgattgataccaaatttgtcttggttcgatcatttagaaaaaaagttgtaagtgccaaatttgctcaattttcgagttttcaggttccgtttttggcatttccgcgactggatacctttgttttcgggctttgcttctcgagatgaatcgattgatatataatttgcgccattttttcaagggctcactatgatatatccaaaattaagcaattgatg

SEQ ID NO: 101117 - DNA, 240 bp, Heterodera glycines
  Promoter: Source sequence=SeqID_42952; Location=930..1169; Strand=-; Gene=SeqID_70743
ctgaagttccagacgaaggacagaaagcttgtcaaacttctcccgctggcatggacaacggactcccccgtcacggcaaccctggaatttgatgctaaggcatttgcatacgggcaagttgttctgattaagaagtcgtcggaaaagactgaagaaggcagtgacacattttttgttagtgttaaagttcgccttggacaccatgaaagtgatggtcaaataagcaacttcagaaagatg

SEQ ID NO: 101118 - DNA, 181 bp, Heterodera glycines
  Promoter: Source sequence=SeqID_6963; Location=5685..5865; Strand=-; Gene=SeqID_63421
tcgttttccccaattaattaagtctgatgatgctggtcctcccgctccttccggttccgtcgatgactttgcgcagcgcaccagccaattcttcgacttcatccgtcagggaaacatcgaccgattgcgtgcactgatcgactcgctgagcgccgatgagctgaacaccttgctgcagatg

SEQ ID NO: 101119 - DNA, 209 bp, Heterodera glycines
  Promoter: Source sequence=SeqID_6658; Location=2428..2636; Strand=+; Gene=SeqID_62353
gaggaccaaatgtttgctggacgaatgggattattgttgatcgaattatttgattttgtttgatgtcgtgagaagacaattttatgttgacgacttattcattacttctgaatatgcaattgctattttgttttagcaactttatcttcgtattttccatcaaatttttcatctttttaagatattattgtaaagcaaacatcaaaatg

SEQ ID NO: 101120 - DNA, 410 bp, Heterodera glycines
  Promoter: Source sequence=SeqID_12121; Location=1..410; Strand=+; Gene=SeqID_75690
aaattttgcgagacatttcatctaaaaccgatactcttcgtgacatatttctcacaattaaaatcgcgcggagtctgtcgagcgcaaattttaaattgttcaagcaattattgtaagcaataattcttagttcattaaggcaattatcgtgccacattttgtcacgaaataaaatgcgggagaattgtcctgtccaagtttatcccttcagtaaatgcttggcaacactttttattttaacaacattctctttttcttagcaaggtatttcattaaatgtaatatttatttattttaatcttcaattttatcataacgagtaaaattaataattaaatgtactaacttaattataaataaaaaaatgcttttacaaggctttaaaaaatttatcgggattttcaattatg

SEQ ID NO: 101121 - DNA, 138 bp, Heterodera glycines
  Promoter: Source sequence=SeqID_26897; Location=1..138; Strand=+; Gene=SeqID_57636
aaaaatttaataattttgggggggaaaatttttttatttcaaagtttaaagaaagaactggagaaaaaattcagaattttgattcaatcattccattattttttatttttgaaatcttaaaaaagtattttagaaatg

SEQ ID NO: 101122 - DNA, 657 bp, Heterodera glycines
  Promoter: Source sequence=SeqID_22043; Location=809..1465; Strand=-; Gene=SeqID_52682
aatttgaaacatgtaagcattaaagaaattgaacatcttttgacattcaaatttgtactcattatttctgatttattcattccctggttttacattaattgtccgttttaatgaattgtcattgccattcctcagaattgtatttgacgtgattatcttaaattacaagaacattgtttaagagacatgattttaaattttgctttttactttgggtatagagcaattgaattaaacaaattgcaaaaaatggtacttttccattgtgctgtacctttccaataaaatttcgcttttcagtaatctttggttctaaaggtcaaagtctaaatctaaaattttctattgtctgtgatgatatgaatctgttccgatcaattaaaatgagtccgtctgccttggcatagaccccgcttagctccaatattggcacggttccattcttcacaaaatttcgccaaatgaaatttctattaaaaatgaaaaactattttaaaaagccgggatttccaggaaatttctttaacaaaatggaaaaatgaaaaacaacctttaaaaataaattttataaaaatttgaaaataacttcacgaagaaaggaaaaatttttaaaattgcaaaatataaaatctcagtttttggattaaaatttcaatg

SEQ ID NO: 101123 - DNA, 119 bp, Heterodera glycines
  Promoter: Source sequence=SeqID_9519; Location=408..526; Strand=+; Gene=SeqID_71726
aaattggaaatgttaaacaaaacctttctttcgaaagacaataaggcattattaaatttgcttaatatatctgcgtgtaatgaataatatatttttttgctccaaacagcttcagaatg

SEQ ID NO: 101124 - DNA, 240 bp, Heterodera glycines
  Promoter: Source sequence=SeqID_44957; Location=1..240; Strand=+; Gene=SeqID_72361
ttttgttgttgtttgttaacttcgttggtattataattttttttgttcaacttcgtttgtattaatatttaattaatttatttaatttaacatatacgaattaaaagcatggaataaaaattccacaatatgcgatactaattcatactgtatcctttttttttgtttttgtttccgtccaaggtcaggcttttcccgttttcttttttgtgcaaacaaaaatgagtgcgtttggagatg

SEQ ID NO: 101125 - DNA, 158 bp, Heterodera glycines
  Promoter: Source sequence=SeqID_21970; Location=384..541; Strand=+; Gene=SeqID_52602
ttcattcggcggcccattccgtcgtcagaacagcgcgtcggctgcttcaaggcaatgggagacagcaaccatctcgaaatatcaccgagacatttgatcaatgtttagaaatgaattgtcgaataaccaccgaacttcactttaccaactccaaaatg

SEQ ID NO: 101126 - DNA, 685 bp, Heterodera glycines
  Promoter: Source sequence=SeqID_22965; Location=321..1005; Strand=+; Gene=SeqID_53664
tttgaagaaatggacgggccaccggtggaattgggggactcgatcaaaccccgggagcaatcgcccaaatcggactcaacggacacaaaagccgggactcgcccgaacggacccgacccgggggcctagggggaacggtgactcgaattggggccccctctcgtccctctccctcaaatcgtcgaggtcaaatgggagcgttcgccgaagggagtgcctcctccctacaagaacagtgggcaatggctgataacggatgggaaagcaattcaaattttggcgaaatccgatgggaaccgaaaaggaggaagaaaacaatttgcagaacgataacgccgacgaggggacagagggagaggggggaaagacgaaaaaaggagacaaaacaaacaaagatgagtccaaaagtgcaaaaagacagatgtctccctcctcgtttgcaaacgggggattcgatcaaagggagggggaaaacgacgataaacagcataattttgggcgtcattttcaattgacccgcccctccccccaaggaaagggggcattccaccttcattcatctccgcacagcattcagtggccgcacaattcgccaccatcaattgggagattctcccatcttttctcatccactttttcttctagcacatccccaactgatttgtcttcccaatcttcaggaatg

SEQ ID NO: 101127 - DNA, 59 bp, Heterodera glycines
  Promoter: Source sequence=SeqID_7886; Location=798..856; Strand=-; Gene=SeqID_66282
ttttcaaggccgaaaacaaatttaaattttcatttccatccttcaaaaaaattaaaatg

SEQ ID NO: 101128 - DNA, 433 bp, Heterodera glycines
  Promoter: Source sequence=SeqID_18656; Location=642..1074; Strand=-; Gene=SeqID_83314
attgaaagaagagccccttttttgtttttcaatgagaaatttttacgtaataaatttatcattaaattccttaaaaatgcgcgaattatgtagtaatttaaatggtaggcattttggcgttttgttttttacgccagccaattcctttggaaagacattttaatgcatgtgcataacgcacgacaatttcaacacccatcagaagtttcttgttttaatttaaaatttttgtttgttaaaattcgatgaaaaagtgcgaaaaatataggaggaattaaaataagaatttttttattagatgtgtaaagtaaaattaatatgaattggtttatcgtacagcaggtgcggtgccattgtttttattaacacatctaaaagccgattttttcgtccattttcgcataaatgccgcccgatactgaccaaggcaatg

SEQ ID NO: 101129 - DNA, 1003 bp, Heterodera glycines
  Promoter: Source sequence=SeqID_31453; Location=453..1455; Strand=-; Gene=SeqID_61795
tagtgatcggctgacgtctacgatacaatttgaaggcagaaaactgactaagagcatcaacatactcaaaatgcagcaattctattagtaagaaacaggggtggagcggacagaaatacccctcggtcgtggaacacgcactcaaattgccgcgtttacggatcgagctccaaccctagtaagaaatttaaaacgaaatgccgagattaatgcagaatgaatgtcttacgaccacctagaaatgcacacataggagataaaagtagcaaagacgaggcacaaatataaatcattttatgatacatatgtaagttaccacaacaaatataggttgacaattgagaaaataaatttattttcacttctgacgaaatcacatgttacccataaaaccgacaagaaacatttatttattcggcgcccgttattttaaatgaatatcaaaaatatctacctaatccacaagaaacccaacttttagagcttcagaaaaaaaattttagctcctcaaaagatcgccaagaaacgtatgtattattctattaatcttcgtccttgttagagtttttcctgactaggtatatataacgacactggaaaattttaaacctaaattatttatcaagaaaaaaaaaattaaattttggcgatctttttttgagaaatttcatcaattcttaggggagtagtttccgatttttatttcatttttaatgggcttttttggaaaaaaacgccaaaaaggcgatgaaaatcccaaaaaaggcataataatgtcaacgtagaagcttcaaaccgatttgattaatatattggaactaatgcgcagaaaaaaggcatatgcctcaaaatacgttctctaatgattaggtataccttttccattccatttaaagttttaagtcaacggttttcgttttgcatttattaaatccctaatagcttgagacatctctaaataaatcgaaaatcttcattcaatttagatttgtaaattcgaatg

SEQ ID NO: 101130 - DNA, 1003 bp, Heterodera glycines
  Promoter: Source sequence=SeqID_3792; Location=2866..3868; Strand=-; Gene=SeqID_51888
caaaaaagtcgaaattttataaatttcttctcaaatgttttttccaggcttaaaaaccttttcgctttttggtaaggttctaatagaacatgttaagagctttctgataccaagattgatgtatttggataacaaataaaaaagctatattggaaaaacatgctgggccgaaccgtgagggccgaactgagcggcaccgtttggcatataatatatataataaatttaaataaaaaagcatttttcgcaagttttttaatttttttaaattgccaaaaattaaaaacattacttaagtaatttataaaggaattattaaattttaaaatttgttctcaaaatttttaaaaatcggatccaataaagaaaaacgaaatatatatttaagagatgaccaaaatttttaaaaaccaacgctaaaatggaaaatttccacaaaaattcatcgcccctatttacataaaattatttttgagttttcggtttttaatagaaatagtttattacttttttggaaaaaataaacaaattcaaaaaaccgaaaaatcgaaataaaccgaaaatttttcttctgttttttcgggtttttaaccgaaaccgttcggccgagaatgttttgagtttttcggtttttatccgaaaccgttcgaccgaccctcttgtccggtctctactaaaaactcatattgactgtacaacaaacaaatttataaatagaggattttatagcatgtagtttaaataaaaaaatttttctttcttacagcatagagcaatgattttatgcaagcagattatgaatattctaatgcttgcttttaagttttttttttatcaaaaatagtaatagatttataaattatttacttaaaagttttattttaatttaaaataaaaaaaacaaacaacaaaggtatttatccatccttatgttgacggaaatggacgcttggggcgccttgtgatgaactggattctcgttcgcggtgggcttccaaagatg

SEQ ID NO: 101131 - DNA, 188 bp, Heterodera glycines
  misc_feature (40)..(40): n is a, c, g, or t
  misc_feature (73)..(74): n is a, c, g, or t
  Promoter: Source sequence=SeqID_43267; Location=1084..1271; Strand=-; Gene=SeqID_70982
aatgccatcatcgtccaaatggcgtctggaacaatgcganagagtgccgttttgatgtcaaagtgccaatctnntcttaaggtcaatgggttctgtcgggccgtgtccaattgatactttgcaaattaagagttcatcttcgcccaattaatgctgccccttccactgcaatttcgaaaaatgaaatg

SEQ ID NO: 101132 - DNA, 801 bp, Heterodera glycines
  Promoter: Source sequence=SeqID_2586; Location=33..833; Strand=+; Gene=SeqID_80564
tgtaacctttttttgtctattcggataagtaagaaattgaaatattcgtattacttttcctcccttaaagctttataatgaaagcgtcgttgtctattttggatttgccgttgcaattctgtaattccactttggaatccaaaggaatttgattcgcttttacaaaatagacagtgccgaaatttgtagatcggctaaaccttaactgaaacataccatatcagcgagacgccatgctgatttgttgtaatcataataaaaaggcccttattgtttaattcggcctttcctataagcacaatgtgtttgatgggctctacaaaatattgcttctgcaaagcaattattttcttggaggctttaattttctgtagtcatttgatatgcatctgctatttttctagtcacaaacaccaatatttttcggcccgaattttataggcgtgaaaagtactgatttccaacttctttctattcggatacacccaaaatttgaaaagcatctttaatttagcctcttttaaatcttaattttctgaaacccgaatttagaaaatatgaatgtatttctgcgacgccttctatacttaattcatccataatgggccaaaaatcataagttaagaccaaaagagggatgttagtttcagccggaatttctataaaaatgttcgtgtgtaacctatctttgtctattcggataagtaagaaattgaaatattcgtccgagtagccagtccactatttttggccataattgccttccttgccctatttggaagcaacggagcatccgaaatg

SEQ ID NO: 101133 - DNA, 165 bp, Heterodera glycines
  Promoter: Source sequence=SeqID_29904; Location=1020..1184; Strand=-; Gene=SeqID_60363
ccttaaaaagtcatcagcaagatcagattcattataaatttatgtgccattcgggagagaaattggaaacaaaattttacagaaaaccatggcactaattattggcataaaaattaatcaccggaaacatgcgcatagtctcgcgaaggcaccggtccaagtatg

SEQ ID NO: 101134 - DNA, 1003 bp, Heterodera glycines
  Promoter: Source sequence=SeqID_12192; Location=2667..3669; Strand=-; Gene=SeqID_75767
cccccccccctcctcatttcccctaaaaaatttttccaccatccctccccctcattcctcagttttctgcaatttttcccctcctgcattttccccaatttttcattgaatttcccctttttttacccccccccccccctcccgcctcagttttccgcactttctccctctccatttcccccactatttacgcctttttcacccattacccccgtttaccctctccccccattttccccgagttttcatttttttccatcatccttgccccacccccagctcagttttccccacatttcccctcctccatttcctcaattttttgttgtattttccaatttttaccccctcccattgcactcattcattcattcattctctcattttgtcagcagtcagttgtccaaccaacagcagcaaccaccgccacactaaaaccatcacgagtagcaaacattcattattttccccgctcattttctccatctcttaactctcatctgctgctgctgctgtttgtgtgtgtgtgtgtacgaaaaagtagtgatatttatttatctttttaatgggcaccttctgctgatgttaggctttttgatataccgcgggcatagccatggccaattaaattgtgtgatatttttgggagttaattaattaattaattaattaaattttaatacaaattttagttgcgaaaaattaccgtcaattaaattttaatatttttgaaaagaattttttttttttaataggcattttcaatttcacaaatatatttttctggcaaattaacattttaaacccatccaaaatacctatttttgttttgttttttcaaattacttttttttcattaatatatgtacaataaatatattttgaaatattttgtttcatttttcgtcattttctaatgtgtacataatcaatcacttctaccgtttttaaaagatcacacaaaatattattattatattattattgtttttaaccggtaatg

SEQ ID NO: 101135 - DNA, 533 bp, Heterodera glycines
  Promoter: Source sequence=SeqID_18014; Location=522..1054; Strand=+; Gene=SeqID_82589
ttcaattttgaaggcagaacaggcagaaagagattaattgcaattgattagttttaatgaatagtttattgagtttctgttaaaaaaataaaaaagattaaaaatttggttggaaaaacaatttatacaatttaaatataaaattgtcaaattaagaataaaattttaaaaatatgactattttttgttttaataataaacaatgagaaaaaataattgaattcaaacatttgtccagtaaaatattccaacaaaatttcggtcaggaatttaagtagttaattaaattaatgatggcaaccattggtaattaaacgatgcctaattaccggctaattagtgaatgttgctgttctatatatttttttttgaatgtgcatttgtgcattggaccgtcaacacatattcacacatattgttgtctgtttgtttgcacatccatcggcgggcgaggcgagaaatttggggctcaaatttggatgaaacattttcccgtccgcgcggctaatggatcaaagcggaaaagggacatg

SEQ ID NO: 101136 - DNA, 1003 bp, Heterodera glycines
  Promoter: Source sequence=SeqID_1669; Location=3224..4226; Strand=-; Gene=SeqID_46979
attcgcgcagagagttcggatggcagacgaagaaactgcagaaaattctgcatcagctgaggacgggcggacaaagaggcgaaggcattttggaggggacactgcacaaattgttcagaaggattttccggaaatgaacaatttccattttcaatcattcattaaataaaggaaaatgattaaataaatattcactcattatattttttgaattcattaattgtcttttcttcaattaattcattttccaatctaaaattgaaaatgttttgcttttctcttaaaaagagttaatttataattttttttacaattaatttcatttattcatttgcttattccctcccgtcttttcattcccttctcctatttgtctttgcgttttttcatttgttttaaaccattgacaaagaataaatgagtcatccgtccgtcccgcaaatttttccaattccttccaatttcgtcatatttcacaaaaatggtcgattttgacaggaaattcccccccccccccccccttattcacaatgacaatgacatgctaatatgtagaatacaagccttttatttttttttatttagtcgatatacataaattagtgtgtgtaaaataacggtaataaattaaatttttaatatttttaatttggcgttatgccataattaattataaaaaaaatttattttatttctctctaatgttttaattgtcacccctttaatcagtagaataatgtggtgatatttctttgaatgaataaaaatttgttattttatttcattctttggcttttctcgcaattaggtaatttttttaaagaaaatattgactatctaagaaatgaaccttcgcctttttattctcattcgcatttcaaccgtttttgtgaaatacttttttttatttaattttttctcttttttattttatttctttaaaaacagacatttttctattttcttttttttcaccctttgacgacaaacagaagcagcaatg

SEQ ID NO: 101137 - DNA, 159 bp, Heterodera glycines
  Promoter: Source sequence=SeqID_1224; Location=310..468; Strand=-; Gene=SeqID_70165
aaacccacaattttttgtttctcatttcctcaaatatttattgaaaaatttaattcgcaattctgttaattggctaagagttcattctgtgatgctattattatacaaaattttttaaaaaacaaaatttacacattttttcaaaacattttggtgatg

SEQ ID NO: 101138 - DNA, 292 bp, Heterodera glycines
  Promoter: Source sequence=SeqID_4529; Location=4104..4395; Strand=-; Gene=SeqID_54788
acacctatttcaaccaattccaattcccacaaaagtgtcctctattaaggaatttttttcgggggttcccaacgtcaaaagtgccgcccttttaccagttttcgtttttcaggtttcccatcaatggcatcacattttgtctgccaaatcgttttggaaggattgggccgagctgcgcaactatcatcccccatggcgtcaattcttctccacactcagcattcattcaattcgacaagtggctgttcgacgcccatttggacgaaattttgtgcacgacgcatgggacatg

SEQ ID NO: 101139 - DNA, 235 bp, Heterodera glycines
  Promoter: Source sequence=SeqID_912; Location=1227..1461; Strand=+; Gene=SeqID_63843
tttgttgtttgttcgttcgtcgtataaaagattatttatacaatttttaattgttaaaagctggacaaataggtatgttatttgaaaaaaaaaatggttacgaataggaatagtaacggtgtgaaccagggatggcacggaattccggtttacgacatttttggagtctgaattccgatttgcgaaaaatttttgagcctcggaattttccgaaattttttggggcctcggaatg

SEQ ID NO: 101140 - DNA, 420 bp, Heterodera glycines
  Promoter: Source sequence=SeqID_19958; Location=1..420; Strand=+; Gene=SeqID_84723
cgcagcaacgatcaggtagaagaagctcatcttggttgatccggagaacaagcgcggtcgaagttgacgtgtgtggaagacgtgtgggttgaaggtgtcgcgcaattatcgtcgttgagattattttattattgggaagtgagcgaaatgcgaatgtccgttccttttatacaatgtcagccacgacaattcttaaacccaacattttgccaaatttcatttgatatataaggggatgcgttttcatccttttcaccttcgctactaccatttacccatttcgaagtgcacccgctgcaacacttttgtgagttttttctttctttttttcgtgttgtttttgtattcattttatatcccctccatttgttcagaaacggcctcgacaaaacaagcaaattcttcaccaacacaccgatg

SEQ ID NO: 101141 - DNA, 1003 bp, Heterodera glycines
  Promoter: Source sequence=SeqID_2512; Location=1322..2324; Strand=+; Gene=SeqID_80148
tgcttatggtcccaatttgcttttttattaatttttttaaaccggtttccattagaaaataataaataatttggcgttcgttggccgcaaatatttccatcatccgccggccgtaaatgtcattttaccccgaaattcgttcttctttcttcagaaagttatgtgcttaactcaaagcattgaccagcagcagcagataaaaccgctttcagtttgtcaagctcattttttattaaaattattttgtttgttttaaagctgaattcttaaaagagttagcgtcgaatgattcatagccgccactcggcaaaataatttggaaaacatagagcatattgacttccaagtgaatattaagcaataaatgaagctataattggggacgcctagctaagtgaaatcaaaaaaacaaacaaagacaaactcgagattagttgatctaattatccgaaacagcgaaaactaatgaatgtaaataatttaattggtccaatgacaaataattcatcattttaatgctaatgccttttttagcttttcccaaattaacttttaaacaatcattttcagctgttcaaactttttcacatgaatgaatcacatttctcctctataaatatttaaggccaaaatttgttcatccaaaaaaagtcatttccaatttttctattctctctttcgtcactaaattttcattatttcaatttaaaatctataaggcttaaaaatgaaattcataattcttattttattgatgcttatatatcagttatataattccctgcaacaggtataataagttaaggaaaaaattattattttttaatggtttgtattcaaatattctatttttgtataaaatctccaactcaaagatcctttatttttattttatgttttgttttaaaattgaaaacaatttagacataatttgttaacaaatcacacctaaatagttcaaaacataaatggttcttgaaactagaaaatatgatacaatatg

SEQ ID NO: 101142 - DNA, 355 bp, Heterodera glycines
  Promoter: Source sequence=SeqID_16057; Location=1701..2055; Strand=-; Gene=SeqID_80415
ttttttcttcctgatgctcattatttatttactttctaatccattagttacctaccacttattaaagctaacaaaataaatcataatttttcaatattaattttctcacccgctcgttccaataacaattacttttttacttctataatcaactcacacaaaaatataatatttttgtaactttaaattttaaaaatctccttttcaactctctctcttattattattgaatttttaccatgactatttaaatatttgattgccctcttccttgcacttactcctctgacccgagcattatttaagctccaaattcctctctaacctcttctattctctatcgctttccaaaatg

SEQ ID NO: 101143 - DNA, 976 bp, Heterodera glycines
  Promoter: Source sequence=SeqID_6658; Location=777..1752; Strand=+; Gene=SeqID_46280
aaacagatttttttttattgggaggagcgcacttcgtgtgtttaccatgttgtttttgtcgtttgttgtggcgtaaaacaattaaaagagacgatagaaatcgcaattcaatagcaacgcttatatcataaaattaggtaattgcaattttgaatttaaaattaaaaaaatcagagcaacgaaataaaggcgacgggtccaaaatggctttacggcagtttacgcgttcaatcgatgaccatctttagtttcttaggctataacttttttcattactagataaatgcttatatcttatatttttggtatcaaattaaagcatacagctgcggaagtttgtaaatacactgtctttaaccaagacaagaatccaattaggaatataaaaataaaacttattggttgttgttgattgtttataaaaacgcctttacaaaaaattggcattttgtcaacgcgctttggcgcttcagcaatggcgtcagtgtcagtgcgtcagcgcagtgcgtaatgcccaggcgtccttcactccacttcaaaaagaagtgtccaattgacacctactttgtggcggtgcaaaaattgggatccataacctttctttgctgttaacccaatatttaccactcgccgggcgagcttcgctctatctgcattttaaatttattattacaaatagcatctaacttttgtagtttttttcccttttggggccacacacagatttaaaaaagtcaacaaagagcgcgttgaacattcgtatggttcccatattcataaattaacatatttaaatggcggactcattcgatgttactttggcacagataaagggggggggcgggagatcatcgatagtattatccttttaaaatgaatgtgtgaccctcaaacggaaaacacccttttgtaacatttttttaaagaatatttttgttttgctttgcttcctgaagagaatacgcaactgaagatg

SEQ ID NO: 101144 - DNA, 81 bp, Heterodera glycines
  Promoter: Source sequence=SeqID_38536; Location=546..626; Strand=-; Gene=SeqID_67320
tcttggttggacaaaaaaatattaaaaaaaaaatttttccaaaaatttgctaccatttcgtcatcctccgccaacaccatg

SEQ ID NO: 101145 - DNA, 216 bp, Heterodera glycines
  Promoter: Source sequence=SeqID_6286; Location=1..216; Strand=+; Gene= SeqID_61009
aatatccaaaattgaaaatcgtaagttagcgttgataattaagacattgtttctagtttaaaaccattaacagaatataaagtaattcacttattgtgcggattagacaattccaacttttttttttaattttttaatttttgtgtctttttgtttttttattttccaaaaatagggtcaagaggtgtcgttttcaagaactgtccttgaaaaatg

SEQ ID NO: 101146 - DNA, 1003 bp, Heterodera glycines
  Promoter: Source sequence=SeqID_3133; Location=2172..3174; Strand=-; Gene=SeqID_83353
ttgactcggtaaggcgctttgacaaagacggctttcgttttgcaattagtcggtcaacattcggaaattggtctcgaattttttcggcaattacgtgcaatcattttaaaagaaaaaaaacataaaagctaaaatttattaatttttttagcgcaaaatcaacaacaaaagcgaaattttcgtttttttgcttatttttgacataatttattaatttttaagaaaatttaaatttattcaatattctcgagaaattttggcgaaaaaatgattttttgaaaaatttttcgggttttgggctcaaaaaggctaatatagctgctgggggccgttctaatagaggtttttttgaaaaatgccaaaatatggacataaaatatggaccaaaatgccaaaatatggaaaaatatggaaatatggacataaatcgcgaaatatggaaaaatatggaaaatatggatatagaaatccttcctagaagcttcaaaccaagctaaaaacatgtttttcgtgcgtttcaggcctcccacagtccaggaaaaaaatatggatttccatgtaattctattccctactcataatcaaaaattgtatcttttttggtgaaaatctattaataaatcacactcaaatttttaaaaatttcgcccggcagcgcctatcggcatcgcgtgccaccctgtccccaaaatttttatggaaaaagcgcgccgcaaaaaaaaacagttttgtaaagcaaacaaaaaaattgtttgcattaggtcgttaaaatttgtcaggaaatttgaggatttttgtttttttaaatttattttttgatacaatgtgtgaagaaaactagcattttttgatatttataaatgaattaaataaaaatgaaagaaatttaaaggacatttttaattttcaaactcaaaatctgaattttcaaggacgtccttctttgttagtccaaggacgatggaaaattatagtcagtcataaataatatttcaggtacatg

SEQ ID NO: 101147 - DNA, 84 bp, Heterodera glycines
  Promoter: Source sequence=SeqID_15718; Location=1..84; Strand=+; Gene= SeqID_80039
gcgcattcttctacctagaaaaatgcttcttaaattttttaattaattttatgcagaaaccacaaaactgcaccattgccaatg

SEQ ID NO: 101148 - DNA, 176 bp, Heterodera glycines
  Promoter: Source sequence=SeqID_16697; Location=578..753; Strand=-; Gene=SeqID_81094
aacaacacaaaaatgaaaccatttataaaagcctcattaaaagcatttaatgatgtattaaaaatgttgcttaaagttattcacttgacttaactctattttatttctgtgaatattaaaattattcatttatttcaatttaaagaacaaaatttcatcacaaaaatttcccaatg

SEQ ID NO: 101149 - DNA, 1003 bp, Heterodera glycines
  Promoter: Source sequence=SeqID_1826; Location=291..1293; Strand=+; Gene=SeqID_76194
aaaaaattttttcaaaaaattaagcgatttttttttgaaaatattttgaaaattctcagaattcgtcataaatttgaaaaaatcgcctgagaattttcaaaaattttttcttgaaaaatttctaaattttaaaattcaaaacggggttctgaattttttcagaaaaataacaaatttcgagaatttcagaaaataaaattctcccgattttctttatttttaagctttataccattaacattgtccaaccatggagtgagcttgaactttgctttattattgacgcgatgacattttttggagaaatattcaaaataaatttcaaaaattttccactaaataaatcattcgaaaaataatctctctgtctccattaatctgccagtatctaattatctccccctttctaagggtgttgataaataatatacccgggcatataattagagaaaatacggtatgtacataagggatggcattccgccgaggctccaaaaatatgcgaaatgaatgtttttgggttagtaggcgaaatgtcaataggcgatatgtcggtaggcgagatgtcgagtaggcaaaatgtccgtacacacagcggcccaattttgtgctctcagtgcaaataggtttattatttatttagtaatcagaacgccaaaactttgcaaaacttaaaattttttggggattttcccttgtaaaaatagaagagccgatctcgagttaaaaactagacagctaaaacatgaactgtttttacgacacttaaacttgaaaaaaaatttcattatgaaaaattgtaacactccaccttttattcgaattcggaacccggattaaatagttgatccgtagcgattcgatggtcccaaaaactccaagaaacatgttttaacgactattttttccaaaaatgagggggaactatcaacagtagtacagggaaaattttaattctttatttttgtttaaaatttttgttaaaaagatttcattttttatg

SEQ ID NO: 101150 - DNA, 346 bp, Heterodera glycines
  Promoter: Source sequence=SeqID_2933; Location=4259..4604; Strand=+; Gene=SeqID_82415
ttttttaacgaaaaaaactttggttaaaaccttaggaaaagctataatgacgaaattgaccttcataaagcctcggaaatggaattttttaaacggaaattgaatttgtttttaaaaaatacctatattggttttaatgattttttgacaaatttcagttacacacaaagtctttttagacgcctctaataaattttctatgttttatctctacggaaatttgttaagacgactaccaaattttgcgcaattttccttccatgtctcacattttaaattaggtgcacaaattattcgatgcatcattgaaaattttaattttttagcgaaattttcgccaaaaatg

SEQ ID NO: 101151 - DNA, 228 bp, Heterodera glycines
  Promoter: Source sequence=SeqID_14402; Location=1485..1712; Strand=-; Gene=SeqID_78439
atcattactaaaataggaggaccatggaactgcgttttttttgcaacctatcgaattgtgtcagaaaagaccgaagcggagaattccattgggacattgtgtgaccgggttatcaacagatcaaccatcggccgtggatttggaaatttcattacttttgcggtgagtaataatttaacatatttacttaattggcatatctaattatggttaattaaggaattgatg

SEQ ID NO: 101152 - DNA, 237 bp, Heterodera glycines
  Promoter: Source sequence=SeqID_21808; Location=437..673; Strand=-; Gene=SeqID_52436
tcttccaaaaaaataatgaatattgtgcatttattgtccgtacatggtggcccccttttttggtgcaaatggaccgttatcttttgtattcctgtttaaaaattttttaatccaaatttgcttacaaaaaatcgccgaccaaaaaacaagtttggaaaaattatcatcacgttaattagaaattctattttttatttatttacttatcacataaataaatttcatcagatatgcatg

SEQ ID NO: 101153 - DNA, 525 bp, Heterodera glycines
  misc_feature (208)..(208): n is a, c, g, or t
  Promoter: Source sequence=SeqID_7697; Location=1738..2262; Strand=+; Gene=SeqID_65657
tgggcctattaaaaaattcggaaggccttttgacaaattttaacagtggaaatcaataactaatcaaaaaaatcttttgaaagactaaaaaatgtttaaaattactaaaatgcattacaaatttctgtaaaacctttaaaaaattagggaaaaatggcaaaaagaaagcgttttttgataaaaatgtaatccaaattttatttttttnttagaaatcggggaccggacgggtcgaaaaatctgtctaatcaaaaaccggaccatttctgattgattcgattcaagcaaataaattttcattggtcaatatctgtttttatgatcagtagaattggaattaaaatttcataaaatggttttatctttctgtataattgaaaagatttgagaatcagtagagagaaattatatatacaaattgatgataatttttgaatgaatgcctcttttgccaaaatctaagcgctttttgagaatatttaaataattattttataatttaacacaataaaattgtcaaaaatg

SEQ ID NO: 101154 - DNA, 974 bp, Heterodera glycines
  Promoter: Source sequence=SeqID_4106; Location=162..1135; Strand=+; Gene=SeqID_53208
attttgttgcttcggaattgcaatttcttaacttgctaaaagattttcattttttttcactttttttttctacggctttttaaagaaatagaatttaagcttttgttgttttttgtacttttccattatttgtttttttttatcatttttatatcccctcattttatcaatcattttttaatttattttcatttatccataaaatattcacaactctcatactctttttcaatcccttacaatcgctagcagctaaaaacatttgctggaaaaatgagatgattttatgaatgaattaattgccagcaaaagttaaacaaatctattcttactatattgtattatttttagcatttgatttaacatctgctgtcatttgcacaaataaattccattccaaataaacaaattcagcagcaacttgtcaaccaaaagataataaacattcattattcattgggataaaataataattttcattttccgattgccaaatcggcttccttctttatttatctgatctgactttgttggccgatccgtcagcgaaacgaaaatatccaccattaattaattattcttttcttttgaattttgtttttgcatatcatttccatcatggccttggggtgccccgccccctcccccttttttctcctctgcccattttcccattttcattttgcatttttttttctccaattcgttggggaagacattttgattccgaattccaaattatgaaaatccaccaaaagtttggcttttttaaattaataaattgacacaattaattttgtagagaatgaatgagtgatgcattggcagcaacagttctgcttctgctgatggactgggctctcgcacctccttttgaaaattttacaggcttttcccggcttttccaaagcctcgattcacattttactctaaattgatcatatttgctccactttcatcctggcccaatcatg

SEQ ID NO: 101155 - DNA, 148 bp, Heterodera glycines
  Promoter: Source sequence=SeqID_35498; Location=786..933; Strand=+; Gene=SeqID_65038
tttctatgatttttaagatgatcaatatatttcaaaaggtccaatgttcgaaatgcaatttctcaaaagatttttccaaattttgtcggtgcgtttgccccgaatctcggcttttccgtccgaaaggtcgaacttccgacggagaatg

SEQ ID NO: 101156 - DNA, 1003 bp, Heterodera glycines
  Promoter: Source sequence=SeqID_6547; Location=155..1157; Strand=+; Gene=SeqID_61967
taaaaatgtttatcttaaaaaaattctgctctgatctgaaaaattttgatcgaacgccggctaaaataaacaaattaaatattttatcaactcgaatttttcaaaaagcttaattgtataatttaaaattttttatccatcttttaatataattttatttgcgtcaaatttttgttatttttccacaatttctgaaaaaaaaaataattttactcaaatgatgagagtgtatcaccaattaaaatgtgttttcgtgcttatctctgcaataagtgcgcagaattttaggcatttgactaaaaatcgcatccctactaataaatcgaccatttatttagaaatattttatactttatatcacaaatctgatagtatattttaataaataaacgatttttttaaatcattttattttactttatataataattatgcataaatgcttcctaaatatttttgtggtagcgatgattcaatgtgaaagtggataaaattgtccgttttgtccacataaaatgaaaaaaaggcatttgcatcgcttctctcccaaacactgcactgatttgtgaatatggaatggacaaaattccgatcagcagaaagataaagccaataaacgatgagtcaccgtttctattggcttttttggctttttaagcgattgcaaagccagctaaacccactaatttaccaatcattttacccattttcagcaaatttattcctttcccaaaatcaaaatgaatttaatttgcttttcgctcttttttgttgttctggcgacaaatgccatcggtgaagggtaattaaatgaatgcaaatcaattttcaaatgctttctgtttctttagaattgccgaggacaaatggaaaaagtgcgaattgaacggaatgatcagaatgggaaaggacgttaaaaagtaatttgcaaataattttggtgataattaattaattttcccgcattaaaattagtctgctaatttgctacaagagcaaaatg

SEQ ID NO: 101157 - DNA, 823 bp, Heterodera glycines
  Promoter: Source sequence=SeqID_19792; Location=613..1435; Strand=-; Gene=SeqID_47609
atattaacgcaatgggctgacaattatttgaatttttccatttaaaatgaattaaagtcctacttcagaactttttgttcacggtatgctacattgactccctcaacaaattttttttgtatcagaaaatttctctggcaaaaaataaagttttttaagaaaaaacaattcctccccccataaaagttatttactagaaaattaaaacattaattttgcaattttacaaaaagtgagggtagtgattgtgagatagggggggggggggtgaattgatacggggtggggagttcgaactgctcccttcttgtcagccttacaattagggtatcattttgctatttcacggtaacgtaatttttgtcaggcttttgaatcaaatgtccttagaagtgccgtgtgaaagcgaccaatcttcaggtgattagtccttcagaccgaaatgcacaaaaaacaacataaaaaatacaaattttcacttatgttctaataacctatttttgggtatgtattttttttgttgccccgttaaaaaacaaacaaaaataccaatggttgaagaaaactataattgtgccttctgtattctgaccaatttcttttacacttttcccttaagatcgctattcttttgtgctggccgccggtttcgcaattgggctgattaatttgggtttgtcctttcaatttcaaggcagttcatttaagtccattctttttaggaaaaggcaaagaaattagtgacactgaaattgccatttcgtcgtctccctcgttgaaagaccgtctgattaaactgctaaagggggctgagcgaaggatg

SEQ ID NO: 101158 - DNA, 1003 bp, Heterodera glycines
  Promoter: Source sequence=SeqID_17909; Location=1532..2534; Strand=-; Gene=SeqID_82458
gtatttggcgtaattgtccatctgtttaacatggaggagcaaagagttgtcgtatctgtgcaatttggcaaaaaaggattgaattggatggatggccaatcaatacaataccttcgcctctcggcgggtctcctcagcacatcataagcttgttttagctccaaaaaatcgttttttgtagcaccatcacatttcatgtcaggatggagctaaaagatttaaacctttagaaaattaaacaaaataaggaaataattgacagaacgagttcacgagaaaagtttcaagaaagtcggttttagaagccaaactcaatttacagggacaaaaaaaaagggtctaaaaatcaacaacacaaagagaatccccaattaacaaaagatgcgaactcactttgcccaaaataataccgttttgcactttgaaaagtaagcacttttgatgtcgtattgtgaagcatcagatttaactccgagtaaatcgtacaaattcttttccgatttttggacataaaaagagagcaaacttaaaaatggaacggaggaaatttgagacggatgggggggggaactcagaaactcacttaatggcattgcatcggttgggagaacgtgggcacagcaaaaggcacagagagttcacatgatttgaatacaaactggaccaagcagctttatttgcgacaatgagcacattcatacgaagctaattgagatgaataaacaaaaattaatttaataacgaattttatttcagaaattttaagaaaacctaaaaataatttgaaattgcggttaaatttaatttttggcgttgcaaaatattggtaaattaaatttttgattgccaaagtaccgccttctcatcaaaggctttgtttctgttagccatttgctctctgtttattttgttcaatttcatcgtgtaaatttggtcatcctttattcacttttcttccgatcattcactttaatccgtttctgaagctcatattgaggcaatg

SEQ ID NO: 101159 - DNA, 150 bp, Heterodera glycines
  Promoter: Source sequence=SeqID_14929; Location=1..150; Strand=+; Gene=SeqID_79092
attcggcatttagataaaacaataactaacatacatatgtacaattattgtattattcagggggaaaactaaggtgggcggtcaaaaacaaatatatacattatatatatcatatatacgtgaactgtttcattcagatttaaaataatg

SEQ ID NO: 101160 - DNA, 1003 bp, Heterodera glycines
  Promoter: Source sequence=SeqID_4316; Location=447..1449; Strand=-; Gene=SeqID_54013
atcggatcgattttcgaaaaaaaacttacaacaaagttttttttttacgttttgcaactttaatagaatatttacaagtttatttctgatgcattaattatggcaattagtgtgccattatttctgctttttatatttacaaacaaaataatcacatcaccctcatttaaatgtctctctgtgatacgatccgatacaaaacggtaccgtactaacaaaatggggcgggggtacagtaattgtcatttttccgtttacggtcgcttttttttgaccaacaaaatcggcagcatctgtcccccttatcggatgctaaaactgaggaaaaagtgcaaaaacaatgtggtgagttaggaaaaaaccaagcagggataaatgcgcgactaataaaagcaaaaaaggcacaaaaatatttaaaaaaatcattggcgacaattgtgggcaattaaattaaattaggcaaaaaaataaagaggttttgttttgtgattagagatgctcgagagtcggaatgaaagttgagcccgagactgacaaggaaaccagccgaatttatgtcgatttgaacacaggacctccaaaaatgcgaatttaacaaacattttctcacttggctaccatcgctgaagggaaaacacagacaaatttttgattttaaaattttgaaaaagcgtgccgcaaaacaggtcaaccttttgtttgtaaaatcttattttttgagcacaaaatcttagttttgctctccggacattgttcgtagaaaagtttagcgtgtctttgtttattgcccaaaattgacataggacgatgggttcgacattgtcaggcttatgcttcaaaacaccgacaaaagggcatcgaaaatccgaaaaatttcccagctcgaaaaccgagaccgatatgtcgaacattatcacgactcattgctttgtgtttatttgcttttacagtttgtctcggctcggaaaatggtcggaatacaatcagcgtggcacgtggcatg

SEQ ID NO: 101161 - DNA, 1003 bp, Heterodera glycines
  Promoter: Source sequence=SeqID_14578; Location=243..1245; Strand=+; Gene=SeqID_78652
catccatttccaccggattacggtagccccccatatctatgggaggggtgcaggccaactgagcgccagccatttgagcgccgccaagtgagcgcgggccttttcagtacagaaaccaaaacctattgcatgttttttttgcgaccccgtacctattacaggggtcgcgacttttaagtaaaagaaaatccgaatttttaaagaaaaaccgaaaaatattattataaatacaagtgcttactaaataatgaacatcttgcgaatggacaataaattaaaaggaactttgcataactatcaaaaataaagacgctgtaattaaattggcaatattcttcctatttggtcgaatgcatccattaaaagacggaaattgatgaaccacagagatattaactttgacaaataattttataagatcaataactattaaaaaggcaataaaaataaagataaaagtcattagaacaaaaattgaaacgggaaaaaagcaacaaaagaaaaggaatggacaaatttaaaaaatacacaatgtttatttttgaccccaaatgctgattttattattgtccaattgctgattttgaaattttgcagttcaaaaacaagtgtataagtttcaaatttaatttgtacctaatcgataaatattaaaaacgttgttttccttgctgaaaactttctgaatttggaataaatccacgagagctcaatttgtcaactcccaaccccgaaaattgttatatgtgcaaaaagaatttttgttaaatagtttgaattttcgaacttaaacatcaaatgatagttcggtattttaactaaatttttattaaacattttgaagttatattagggaggaagtgtttaaataatgacatttattttagtgccgtaatcgtgtgcatatatttatatatatcatttcttctatattttttgtaaagtgatacgaatagttatagaattgaattattaaatttttttacatttacttacagtgatg

SEQ ID NO: 101162 - DNA, 175 bp, Heterodera glycines
  Promoter: Source sequence=SeqID_597; Location=705..879; Strand=-; Gene=SeqID_57251
ccccccccctccccaaccccgttctgttccatcccctctgatcattcattcatttgccttcaattttttacacattttaaataaatattaaattatttatttcccacatttttaagcagttcacttcaacccgatttgttcatcaacagcaaaaagtgcgtcgaccaacaatatg

SEQ ID NO: 101163 - DNA, 119 bp, Heterodera glycines
  Promoter: Source sequence=SeqID_137; Location=2214..2332; Strand=+; Gene=SeqID_74206
ggtaagaaaaaatgtttttcaatggatcaaggggatatttgattttgtttttttcattcgaaaaaacacgaatcctgtttaccgtctgaataattattttttagatgatcttagacatg

SEQ ID NO: 101164 - DNA, 532 bp, Heterodera glycines
  misc_feature (41)..(41): n is a, c, g, or t
  Promoter: Source sequence=SeqID_2335; Location=3180..3711; Strand=-; Gene=SeqID_79176
ggtgactcagaaaatttataatgagaaaacacgaaatgcgncaagttcatttatgaaaaatttattgtttcaaggccacaccatcaaatcacaagcgcgtagacaagtgttagaacattgtcaagtgataaaagaaaggatttgattttatggcttcttaatttgtgattttttgtaacgcgttctgttccttatttgtgaatttagcaagttctcctctcgtcccttttctaccagtgttatctgaacgacccccaattcgttttttgcggattcgtttttgtaacgattcgtttttgacccaattcgtttttattatcccgattcgtttttattatcccgattcgttttttgcctgcaattttctaattcataatttcttgattataaaaaaaaacgtaaacaattatatttagtgccataatgaaattatatagcaagcgtattggttctaaaacagttatgacaactgattgctccgaaaatccgaattattgctacaaatggacatctgcaggagtcaaaaaagatg

SEQ ID NO: 101165 - DNA, 354 bp, Heterodera glycines
  Promoter: Source sequence=SeqID_19229; Location=1666..2019; Strand=-; Gene=SeqID_83968
tcctcattcattgggttgtttttcttcctattttgtgctcccccaatttgctccgtccctccgacaaatatttatttgtttatttattttccatttgtgttaataaatttatttggtgttcgacttccacaaataattgtttgagcaattaaccggctcaacattggcgacgcccgttcttcaggacttcacttcgaacattttcgtgttgaaattgttcgaattgtggaaattcaaaaatctcgtgaaatttttggatttcgcagaaatcttcaaaaaagcaatcactaatcttgtgtgcggttctgctatgtgcagtttcttcgtcaaattccttcctccaaatcatcaatg

SEQ ID NO: 101166 - DNA, 159 bp, Heterodera glycines
  Promoter: Source sequence=SeqID_36703; Location=758..916; Strand=-; Gene=SeqID_65956
tttcgttcccctttggtttatctttaataaaattcaaaaagcgccttcatttcaaatgtcaatccaatccaacattgttcaacataataattgcatttgaaaattttccttttaaatcaggtgagtcaccatttcaattcgcttgcccaacggagaatg

SEQ ID NO: 101167 - DNA, 136 bp, Heterodera glycines
  Promoter: Source sequence=SeqID_11954; Location=1662..1797; Strand=-; Gene=SeqID_75476
atttttttcaataatattttttcgtattcgagttcaatttttatgttcttgcagaaaaccattgtataattctgaacacactggtggacgacaatattgcaatggctgtgggccaaatttgacatgttttgtcatg

SEQ ID NO: 101168 - DNA, 403 bp, Heterodera glycines
  Promoter: Source sequence=SeqID_22808; Location=1314..1716; Strand=-; Gene=SeqID_53516
ttttggctaagttcaaatcgttgttgtctgaaacattttccatttgcttctttggctgcactctcaagattcagtacactgtcttcatttcaatgaatgcggggctttttattggctttttaagactcgtaagtatgtatttcacgaacttatttgatcgaaaaataaagcatttctactctttcactctctttttttcttttctctagcattttttcagtaggcaaaaattcgtaggcgaaatgtcagattttggcttagtaggcgaaacgtccgatcttggcttagtaggcgaaatgtccagtaggcgaaatgtcgtcgtgccatattagcgtataataatcatagtcaactctaatacgcattaaggaattttgaatatttaacattcttggtcaaaatg

SEQ ID NO: 101169 - DNA, 90 bp, Heterodera glycines
  Promoter: Source sequence=SeqID_44549; Location=1..90; Strand=+; Gene= SeqID_72029
attcctatcactactcttttttgttatgtatatcaatgatttataaaatattttagtctaaatcaattaatattcttaaaattaaaaatg

SEQ ID NO: 101170 - DNA, 52 bp, Heterodera glycines
  Promoter: Source sequence=SeqID_14866; Location=1..52; Strand=+; Gene= SeqID_79016
tttcgattcacctttattacaactattttatttacagataatttttaaaatg

SEQ ID NO: 101171 - DNA, 1003 bp, Heterodera glycines
  Promoter: Source sequence=SeqID_912; Location=5133..6135; Strand=-; Gene=SeqID_63844
attttttcattctctctctcctattcacacacaaatgcatattcaaatttccatccataattctcctttgaccgttgttgtggccgccttttaattttttttttggtgcgcaaatgtgaaggaaggtaaggtgaatgaatgtcccttcaatgctaatttttactcacaccgctggccttttccatttaatatttattatttattcaatttatatacaatcattatttgcaattaataaataccaaacaaaattaaaattaaatgtttcatattttttaaacattttctgtatttgttttttgtcctctcatttcgttactgttacaaaaaacttaactagtctctgaaattttaatagttttgaacaaataaatgctcattcgaaagagcagaattaggactattgaatcatctcccaaatacttcttcggttgattctcgtccgacttataaccatccaaataaggtgctcaaaaaacaaaaagaattaatccttacactttctactaataaagatagacaaattattttttttaaacatatttttaatttataattgtcaaatttcacttataattgatactttttgccaccgttatccaacttatctctgtccatcatcatatttttagctattcttaatgtattagccatccattcatttatggttcacgtgattcatggccactcaatgctctgtggcaggagctaatgctttctcttaaacgagattgttccgccatttcgttgatttcaaactctgcccataatccacagatctccgctcattttttgttcattttcaatatgcttgctcatttatttatattttcgacaattatttatttatttatttttcactttcttttaatttccttttattttcaatatttatttctctttcgcttgtataataaaaataaaatgtagctttaaaatgccaaaaatcaaaaagaataagagttctaaaaaatccatctcggcggccccgtcacgacaaatg

SEQ ID NO: 101172 - DNA, 332 bp, Heterodera glycines
  misc_feature (218)..(218): n is a, c, g, or t
  Promoter: Source sequence=SeqID_25314; Location=1..332; Strand=+; Gene=SeqID_56062
tgaacaaaacatcatcatttgaaacattcaagatttcgatttatattcgagttcgggttagggattagaaattagtcaaaatacatgtcagattcgtgattagcgacctttaaaaccccggataaaaaattatcatggttttttatcgtaaaaaaattttgcaaaacaaaagggtccccccttttgtttcaaaaaggcccacttttaaagtagcgccnaagtaatatcacgattttttatttcaaaaaattttgcaaaacaaaagggtttgtatttagatatagattaaaaattcacaaattttcatctatttgacgaaaataagcgcgatg

SEQ ID NO: 101173 - DNA, 412 bp, Heterodera glycines
  Promoter: Source sequence=SeqID_392; Location=1..412; Strand=+; Gene =SeqID_51214
atccagatgattggcaaacattcatcggaaacatcaaaatgagcatcaaagggcgtgaagtgttcaacgcaaatgcactgatgccctacaaaacctatttttcacatgactctcctactcacaaacagcaaaggactcgcacttgaatgctgcaggctattactgggatacgggcgagacattggagacggggccgggatgcattcaacgcagggatttgtttgccgaaagcaaaacagcccaatttattgccaaaattgataccgacctattcaaccagccgctgtacttgattaacttttgtgaattggatgtcgaaattttgccaaatgacaacgattttgtgctaattgcacccgccatcggcggtgttgttcctcgttaccgtttcgaggtgatgggactcaaaatg

SEQ ID NO: 101174 - DNA, 596 bp, Heterodera glycines
  Promoter: Source sequence=SeqID_5205; Location=2032..2627; Strand=-; Gene=SeqID_57267
aatatgtgctgaaaattttaaaatatctgttaaaaacaaaaaaaaatgccaaaatatgtgagaaattatgttctcaaaattggaaaaatcaagtgtgtttatgcataaaacccaagaaaaatgtttctttatttttttcgcccgcataatagtgaatgttttggaacgacgaattaatgaaaaatttcgatttagcatctttcattttcgaaaaaaaaatttaagagtattgtaaaaaaaatgatttttttaggggggtatattttttaattttcatgtatttttttataaattttctcaaaaataccaaaatatgtgctaaaaattccaaaatagcccaaacacgtgcgatatgttttttatgtgccaaaaaaccaaaaaccaaaaaaatgaaaccaataaaaactagcccctaacgatattcattagttgttctcttttcaaatgttttgcccgggtggaaattgaaccgaagtctctttttaaacagtggacagctttaccattgaactacaatacattggcacatttgcatccctccttcttcgccctttatcgccctcctactatattaacactgtacagatgtgctcatg

SEQ ID NO: 101175 - DNA, 502 bp, Heterodera glycines
  Promoter: Source sequence=SeqID_31048; Location=112..613; Strand=+; Gene=SeqID_61419
tctgatcatttaccaccactaattcaaaatgattctacatatctgcgccaactatgtcctttgatgaatctatttagcaaaaaaacggacagaggaataactacttaacttataacttctattattacctaaatatacgtattcacgccaacagtcaccttgactcctcattatgccaactctaagaatcctgtctgatttcttaaccagacaagaacaccctcaacgaattatgataattgcgcatagtcttgttgaatcaattgactctcgaatgcacaattacagacaaaatgaattattgcgaatttcaatgatgttggacccccgatttgcataggatctgagtttatttatgagtggtttctggaaatcattgcagaggatttaattgattttgcaaaggaaagtaattttaacaattttaacagaagtttattttattttaagttaatcccgaaatgaaaccaatgagcaaaattttaacgaaacacaacaaatg

SEQ ID NO: 101176 - DNA, 101 bp, Heterodera glycines
  Promoter: Source sequence=SeqID_35016; Location=67..167; Strand=+; Gene=SeqID_64677
atcagcattttaaagcaattaattaaacgattgaaaatttgaataggatgacatgctaattggaaaagtgggccaaattgtgcacattttggtccataatg

SEQ ID NO: 101177 - DNA, 101 bp, Heterodera glycines
  Promoter: Source sequence=SeqID_17175; Location=626..726; Strand=-; Gene=SeqID_81615
ttttgtgcaatggaaaatttgaattgaaaatggacaagagtctccaaaaattgcaaaatgaattctgtaaatcatttgaaaataaaaattttgaaaaaatg

SEQ ID NO: 101178 - DNA, 421 bp, Heterodera glycines
  Promoter: Source sequence=SeqID_22160; Location=1439..1859; Strand=-; Gene=SeqID_52818
ttctgttccgcgccgccgactcagtacacatccaattttcggtgcgcaggaaatttttcgtcgctaagtttttgacatttcctaaaaaattttctttttggtctgtttcgaaacggtttggtattttttatgttgcaaatttgggttgcatgccaaaaacagaaaataaatttccgaaattctgtctttgcatttgctttacccatttttcccaaagggttccgctcgttcgtctcccatcgatctcttcaccaagcctcgctctgctgccgtcactgctccctcttctgcgggtaatgccatcactggcgccatctcgcgtttcaccgtatcgccgacgcccaacgcggtgccgcctgcggcatttggcaacggcgactccccaaaattctgcagcgaccgcggaaccggcactccaatg

SEQ ID NO: 101179 - DNA, 354 bp, Heterodera glycines
  Promoter: Source sequence=SeqID_10444; Location=700..1053; Strand=-; Gene=SeqID_73648
tttcccgtcggaatggtcagcggaaatcggcaaaatttatctccggaaacaaacactgaccttttgatatatgtggttgaaattgattcagttgatagattcatgaaagagggagaccatttttttagctaatttaatttcaggcaagttctctgatgttttggtgagtgtctttctcgttttgcctgatctctctcgcgctctctctcatccccgttctctctctctatctcgctctctctctgtttctcttctgtttcctcctcgctctatcctattcctctgtattcactctcttttgaatttctgtttttcattagggctctttatgtggccgaccctgagttggtgatg

SEQ ID NO: 101180 - DNA, 889 bp, Heterodera glycines
  Promoter: Source sequence=SeqID_1069; Location=287..1175; Strand=+; Gene=SeqID_46557
tcgcaaaaaatttcagttttgttatgaagacaataaaatttaaaaaatttaatggcttatgagtccattccattaggaaaaagcgaaacaaaaataaattttctattaaaaaatgaactaatggcaactcagaataattcttctgtccccttctgtttcggcatgttctgctcaattttctgttgcacaatttccctttgtaagttgttttctttgtaaagctcctccgcgtggcgtatttctgccaaatattgcacaactttcctctaaaaaacccattttgtctaactaacccaaaaagtaaattagtaaaacatacacccaattccacttgcttcactctccgattaaattccgactcagtggtgaaaggaagcctacgaccatccacaaaactgaaatccggcccacgctccaatggattgaccacgggactttgataaatactaaataagacattaagaccaatccaaaataataatttaaaacacttacggctttttccaccattgaggtccaatgcggtaactgctgctggtactgttcatacatttggacacgatcaaagaacaagaatttcttatgtttctcataatctaaaaatagaaattcggtgatggagttatacagtgttaacgatacacaatacaatagcagtaattaaaaaaggaagtaaaaaatccgtatgaggttagagttcaaagcaaatttttaaatttctaactaactacatttagccaataatttatttaaaatatttaatgaaaaaatgactggttggtctaagaccagagcaatatatgattagctgattgggcaaatcagcttaacattgtttcgtagtatcgacataaagttgctttttagccatacaatatttgcttagatg

SEQ ID NO: 101181 - DNA, 218 bp, Heterodera glycines
  Promoter: Source sequence=SeqID_23234; Location=919..1136; Strand=-; Gene=SeqID_53948
aaaaccgatcgaaatataaaagccaattttttcctggtcaagatgcttaaacagcacgaaaaaatcaaatagatcaagttccaccaccaatatgtaatttcagcggccttctgatcactcagctgagggattgtcctgcgatgggcgtttattttgcttcctatgcttttttgaggcgttcaatggactccgaaaatggagaacaatcgcaaggaatg

SEQ ID NO: 101182 - DNA, 77 bp, Heterodera glycines
  Promoter: Source sequence=SeqID_5606; Location=1007..1083; Strand=+; Gene=SeqID_58621
ggtcccttttgaaaaccctttaaaattggctttattagtgtttctttatccaattttagctgttttgcttccgcatg

SEQ ID NO: 101183 - DNA, 234 bp, Heterodera glycines
  Promoter: Source sequence=SeqID_35159; Location=1..234; Strand=+; Gene=SeqID_64783
tgaaaatatttattttattattttcataattataaaaacatagctttacgactcgctaccccatctgggcacccaagagtgcatgtgctgaacgaagaggtggaatggtcagcatcggcagacaacccctacgatctctcgcttctgaaagtttgggtcattcccccgcgaaactgtgatgtgccggttctcccagtgagagtgggtgaacggctttgctttccgctttgcatg

SEQ ID NO: 101184 - DNA, 162 bp, Heterodera glycines
  Promoter: Source sequence=SeqID_2278; Location=1543..1704; Strand=-; Gene=SeqID_47232
ccaattattattttattttggcattaagggcaattaaatttccaatttaaggtcaatccaaaggacattggctttctcgcggttggcaccgaaacattggtcgacaaaagcaaaagtgtgaagtcagtgttaatggatttgtttgccgattcgggcaacatg

SEQ ID NO: 101185 - DNA, 428 bp, Heterodera glycines
  Promoter: Source sequence=SeqID_28357; Location=283..710; Strand=+; Gene=SeqID_58987
ttcgcactgaaatattgttttttcactctaattcactttacctattatctctaattagccccccccccccctatctaaggaggttgaacaataatcatccggggggataattagagatatacggacggtatcagctcaatcaattttgaattaggatacggagaatccaggaaaaaaatatatgcatttacaaaaataaggaagccgtgtaaattatgtatgtattgaacaaaatcagcaaaacacccttccccattactctctctttatatacgcataaattaatgcgttatggccattatttttggccaacaaatcattttaatctccccccatccgttcatccgttttcaaatctctcacttttattttggtagatatataaagaggccgaaaagacatttttgatgcataatagagaaaaaatg

SEQ ID NO: 101186 - DNA, 63 bp, Heterodera glycines
  Promoter: Source sequence=SeqID_9577; Location=725..787; Strand=+; Gene=SeqID_71957
ggttttcatagatgactaagggttgtacatttgttttaaaatttataggtgcaaagtgcgatg

SEQ ID NO: 101187 - DNA, 189 bp, Heterodera glycines
  Promoter: Source sequence=SeqID_1063; Location=2400..2588; Strand=-; Gene=SeqID_67035
tacacggaattttgttaatgtgtttttcctattactgttttgaagcttttgcctcatttttgcagctccatgaaaaccccaatataccaatttttagctcaaaataactttattagggacatccattctgtaggattgaattttttcgtttcattccttctggttccttttagacaagatgacacaatg

SEQ ID NO: 101188 - DNA, 453 bp, Heterodera glycines
  Promoter: Source sequence=SeqID_6985; Location=3551..4003; Strand=-; Gene=SeqID_63503
tccattcatttatggttcacgtgattcatggccactcaatgctctgtgggaggagctaatgctttctcttaaacgagattgttctaccatttcgttcatttcaaactctgcccataatccacagatctccgctcatttttgttcatttctattttcgacaattattttttttatttatttttcactttcttttaatttccttttattttcaatatttatttctctttcgcttgtataataaaaataaaatttagctttaaaatgccaaaaatcaaaagaataagagttctaaaaaatccgtctcggcggccccgtcacgacaaatgccactggcacaaaattatgaagacctcacatcatcgcgcgatccgccactgtcgacaaacattcgccattaactccaacaacgaatgtcgtcgttgaccgaattttttttcgggtgatcctgaaatg

SEQ ID NO: 101189 - DNA, 284 bp, Heterodera glycines
  Promoter: Source sequence=SeqID_11701; Location=4331..4614; Strand=-; Gene=SeqID_75182
gtgttaatgtaggtgctaaaatacaaggttattgccagtcaaaggtttttgatcatatcaatatgtaagtcatatgaaatcgaagaaattcgaaagcgagttgatggtaattggccttcactctggtgaaaaccagcaaattgattgaaagtatgtgagacttaatggaaaatataaaattaaacaaagaatatacaaatatccagcataaagtttttggttatggtaatcagaatagtgtagataaataattgaaacatttttttaggttgttcaacagaatg

SEQ ID NO: 101190 - DNA, 1003 bp, Heterodera glycines
  Promoter: Source sequence=SeqID_137; Location=358..1360; Strand=-; Gene=SeqID_74207
tattaaggcttttagagcatattttcgtcttttttttttaaattttcacaaaaaatgcgaaaaatacacccataagaattgagtcaaaaccgtggtaatagtaaggctggtgcccatccccttttttgaaagaaaattttttttctaaaattcgtaaaatcttgttttaagggtattgagggtcgtgatcacgaatttaaacacatttcgaccaatttctaaccctagattcgaacccgaacaaaaagttgaaaattcataattttaaaatttttacttttgttcctaatagattaaacaagctaaatttgtaaaaaaccactacagcatcaaaaaaggtcaatttgggtccgggtttgaaagtggacaagaggaatgtcagattcatgatcagagaccctggaaatcctccatgtacatattctcacgacttaagaatgttttcttccaaaaaaaggcggtaggggagacaaagcatagtaaatattacccataaatttaaatgcattaacttacaaacaatctttaattcgtccgaattaataatttggccattcatttgcgcaaatttgctagtaaatcgcttctaaataaatgaataattattttaatcatcaaaatgaaaggttaggaatggtgctctatttttatgtagtgatctctggaatccggcatacacgcagtgccgccctgaaaactcatctttctttttacggaattttgcaacaaaaaataaaaaattttgccgtttttaggtcaaaatttcaaaaaattgaaatgctggagggttgagtcccgttgattggaatgttggtggattgagtcccagtgattgaaatgctggtgggttgagtcccagtgattgaaatgctggtgggttgagtcccggtaattgtgagtaatgtagcctttaaagttaggctttttatttattactttactttcacatttttgtttacaaaaacttttgattttgtattactatattagaaaaacgaagatg

SEQ ID NO: 101191 - DNA, 572 bp, Heterodera glycines
  Promoter: Source sequence=SeqID_33808; Location=213..784; Strand=+; Gene=SeqID_63754
tcgtaagtctctgtccccgagaccgaatcggttggggtcgccctttgtaccatgaccattggacaccaaataaagactgctattgttggatattggataaataagttaagatattggcaatattatgtccttgggcaccccgcccccctgccctatccaaatattcacaatgtttcgaatcattcatttaaaagtaaaatatgttatttggctgattagcgtccattagttgaaagataaggaatttaagtatttagtgagcgtaaccaaataataattaacaataattaatcagttcattaaataatttaatgctttcggaaccaaaaactgagtcttcaagtcagcaattgcttttcattaactataatttcagctgagtctgattctttaggtccgatcacttctccggacaacatttctcagctttgcactccgtcaaacccctcaccccctcagggcattttaagccttccggaatttgccaattcgtaaaatcaaacattctctcatcataatacattttctcataagctaccaattggacattatctccgcgttgcgaggcaatg

SEQ ID NO: 101192 - DNA, 218 bp, Heterodera glycines
  Promoter: Source sequence=SeqID_21023; Location=1654..1871; Strand=-; Gene=SeqID_51603
tgttgtaattatcaagctacaatctttcattattcatggcaaataaatttctatttgttcctcaagaaatttatcggggtctcaccattacgacggacacgggcgatttaaacttggatgctgttcgacacgatttgaaccgtgcccgggccgaacgagcacatccctctcgaaaaaatgtcaactacaaccagcagcttaggcgatatttaaaaatg

SEQ ID NO: 101193 - DNA, 87 bp, Heterodera glycines
  Promoter: Source sequence=SeqID_23430; Location=1..87; Strand=+; Gene= SeqID_45782
ttttccaaggaggacgaggtgcagcgtgaccgtgtgtctgccaagaacgccttggagtcctactgcttcaacatcaagcagacaatg

SEQ ID NO: 101194 - DNA, 497 bp, Heterodera glycines
  misc_feature (102)..(102): n is a, c, g, or t
  Promoter: Source sequence=SeqID_1583; Location=1..497; Strand=+; Gene= SeqID_74625
actcgagaccgagactcttcgagcatcactagtaaaacccaggcacaactacagattggtaatgagaaaaaaaagattattaattattgtagaaaaaatatntaatattgaatttaaatataaataattaaaatttttagactttgtatctccgatttattctcaagaaatatattatatgttttaaacacgatcctaagctaaaaattattagttgggtcaggcggtgtcgtgccaacagcaggggaaaatttgaaattttttacgcgatttattacactgcgagataaaataagaaaaactcatatatttaagttatttattccgagtcaatgaaaaaataagaaaattttaaaattttatttagaattttatatataataaatatatttgctttaaattaaataaatactcaaacaaaaaatcgcattaaatataactgatcaaattcatattcaaatcaattttaaaaatttttacaaaatcggtttttaatg

SEQ ID NO: 101195 - DNA, 442 bp, Heterodera glycines
  Promoter: Source sequence=SeqID_11142; Location=748..1189; Strand=-; Gene=SeqID_74489
tattgttctatccctattccctctcttatttttccatttttctctgcgcttgccttgcccgccaaatgctcccatttctctaccaaaaaatagtttggcaaacatagagcatttctctctgcctgctccccatcaataaatccccttctttctctctgccgaagagacaacggaaaagggggagagggggcagagacagggaggaaaagacgcttatttttgtggcattattatgtgtgctgcctgcgcctcccttctcccttcctctcccccattcatttcttgcatcattttcatttatatggcgtatgaatatttgttgtgggagcgcgccaaaattttgaaattttgttttataaaaatcaattttttggcttgggcctgcaaaaatttttttttttaatttagcctaattactctacattttctaaaattcccaatg

SEQ ID NO: 101196 - DNA, 1003 bp, Heterodera glycines
  Promoter: Source sequence=SeqID_18889; Location=1115..2117; Strand=+; Gene=SeqID_83593
tcaaaagcagtaagacactgtacccaatacgattttcattcccttaataaaatgcattttattctgttttctgacttgcatttttataaattctctttgccaaaagcaaagaaatgacccaacagaagaaaagggcatgggaagggacggggtcatttcgctgcccaattagagaagtcattaattctttcataaataaatgaccctaattagtgttctccttcatgactaatcgttaattgaccccacttcgatcagagcataaatcctcccccctcattaaactcatttttctcttcttatttcattcatttttctttgttaaaattatttttcaataatcttggtatcattcgaaagtttaacatgtttatagactatttcgaagataatgcttcgcgattagacaatttctaaaaaagttatacatgaaaattgcgaaaaagtcgaaattttgaagttttttcttaataaaaatattttccagataatattcgatcatttagtccaaaatgattaagtgtttgaaataaatgacctaaatttaatattattaatttggtttaacttttgaatttttaaaaatccccggttgttcccggttccagacgaaaatcgatgtcccagtcccagtcccggcttctcaggtcccggttttggcaaaaattcccggtcccgtggcactctattataaaatgtattaaaactcgaaagaaaataagagcaaaacaaattttggtaaaatatagtgcgcgttatgaattctcttttatatgcaaccacgcgaaaacgaccctgaccgcaaaacttaaaatcaacttgtagatttacgattctaaagatacatacaaacattattcattcatcaattccattttcataactttaaaaatgttttgtttttcgccttgcctctcattattaaaaaacaattctaacgcaattaattattctgctatctgtgtgacagtggcaaaattgtgctcgaattgccacaaaaatg

SEQ ID NO: 101197 - DNA, 142 bp, Heterodera glycines
  Promoter: Source sequence=SeqID_41824; Location=1052..1193; Strand=-; Gene=SeqID_69874
cccccccccccgcgcacagccccttaaatgcattaaagggaagggtgacagggcaaaacaggtgccggaaatagcgattaggggaaggggcccaaacgaagaaaaaggaaaagcatatggatggagggagcccaacggcatg

SEQ ID NO: 101198 - DNA, 334 bp, Heterodera glycines
  misc_feature (24)..(24): n is a, c, g, or t
  misc_feature (65)..(65): n is a, c, g, or t
  misc_feature (137)..(137): n is a, c, g, or t
  Promoter: Source sequence=SeqID_23076; Location=1..334; Strand=+; Gene=SeqID_53779
ccttgaaaatttctctttttttcnttcgcatttttttatattgtgttacgactgtttttgggtgnatatacggaagcaaggtaattaaaaaataaaaatgacgtttctaaaatactgaaaaataatttattaagatntaaaaagcctaacggagcctaaatcatattttatcaatcacttcggatacaactttcaaaaaggtatgaataattaataaatgtagtttataaattaaatcttattgaaagcaaaatgaatttaaggtaaaatttacgaaaaatttcgaaaaaatgaaattgaaaaactaaagcaaaagaaaatgcgaaaagaaatg

SEQ ID NO: 101199 - DNA, 295 bp, Heterodera glycines
  Promoter: Source sequence=SeqID_33154; Location=1..295; Strand=+; Gene=SeqID_63304
agtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaattttgaaaaattttaaaaacaacaagcgttggcattttttcaggttaagttagtcctttacaatg

SEQ ID NO: 101200 - DNA, 285 bp, Heterodera glycines
  Promoter: Source sequence=SeqID_43683; Location=2181..2465; Strand=-; Gene=SeqID_71303
taaagcaaaaacgaatgaaaaataaaaggtcagaggacattagaaaataatacaatgcaaatggacagaaggaaagtaacggaaacacacaaagaatggagcgggtgaaaatggaaagcgaaacgcaggaaagtcgaacattcgaattctctttaaaaagcatttaaacccaaagtcgattcacaagaaatggctctattgcactttaggcatccactcaatgaccataccctgtttcttaggccatggtgatcaggggttttgaaatgggtcgaaaatgtaatg

SEQ ID NO: 101201 - DNA, 167 bp, Heterodera glycines
  Promoter: Source sequence=SeqID_39270; Location=770..936; Strand=-; Gene=SeqID_67873
tatgacaatttgcctggggcggtccttccctttgtctcctcccccaatgtgcttgtatatgcttttcctttgtccatacacacgtcactccacctggccgttggatccggatcccgaccccctccctccccgctccgaatcgggaaagctcaccattgttaaacatg

SEQ ID NO: 101202 - DNA, 1003 bp, Heterodera glycines
  Promoter: Source sequence=SeqID_9898; Location=1240..2242; Strand=-; Gene=SeqID_72925
acattttctcatcagatgttctacttgcttctcataataaacgttttgtccaactgattgttcttcattttcgaatttcctttcatcgatcaaaattaaaaaatgctaaatttttgaaaatcctaaagatttccccgtgttttttgaatttgcagtgagtgccgagcaatgcaaagaatcgaattggcaactgataaggccaaaatgggaccatcgaaacaaaaattgacaataaaattaaagcatcagtcagatcaatgaatggtgttcttctctaatttcaatgagaaaataaacgaattcccaataaaaaatgaaattatattttaaaaataagaaaattttttattagtgagaataaattattattttattgaattaattcttccggcaaaacaaaaaaggaacaaaaactttttatcagttttttatcctatgattttgccattttgtttatgacattaaataatttttgcatttcgctgggcggacaaaggccaaatttaagggaaccggccactttggcgcaagactctatatcattttgatttcacagcaacattaaataatcttggtatgattttaagtggcttgatagtgcctattaacctgcaaagtttcaaaaaatttagatgagaaacaaaaaagttatggccaaaaaatctcaaaaaattgcattttcctggccattttggcgcagcgcgccatattttttttaaaacctaatataattttttgaaattttgcaggctaataaagcatatttagacctattgattaatatcaacattattttatttggtcgaattaaaaaaaagttatgaatctttaaacttgtctgcgccaaaatgaccccgaccccaaatttaaggggaaaagagaattcagaaaataaaatattttattttggattaacatttattaataaattatttgaaattgttttgataagaaaacattcccaagaaaatcagtgaaaaataattcgaaacttttaaaaatg

SEQ ID NO: 101203 - DNA, 178 bp, Heterodera glycines
  Promoter: Source sequence=SeqID_24434; Location=1058..1235; Strand=-; Gene=SeqID_55170
ggtattttcgaggaagaacggagaattttgccataaatgccccaatccgtcttgttttaaataaattcctagctctaagaacattctcttttaggtaacctgaacagtagtctgctgtctacacatgaacggaactcgcgcaaaaggaatttgcaaaatgtggccgattttctaaatg

SEQ ID NO: 101204 - DNA, 665 bp, Heterodera glycines
  Promoter: Source sequence=SeqID_30600; Location=1..665; Strand=+; Gene=SeqID_61002
cggcatgatttgccacataaatatggatttttcaatgcttttttcactgctttcgtcaaagaagcaaaatgacgtcacaacaaatgtagataatatgaatcaaaaaaattttctgacgccaaataggtaataataaattaaattactaattttttattcaattgaaaaaataaaataaaattaaaaaaacttccgacgatgggtctgctgctccagctgctagtactaatattatgcatgattcacacaatgagttgttacccggcatcaatgcgtaatcgttttataacggcaataaataacttaaaaatataataaaatcataaattttaatttacaaaaatgataaaattaaaatgaaactctttagtctattaataaatagaaaaattgtaaaattaaaatgttcaaaataagaaaaattaaaaatatagaagtttttatttcgattaatgcgtttatttccaagcgatcaatgtttttgttctgttttaattgtttggctgtagtttttaaatatcttgcaaatcttgcaaacctctaattagagcctctatggttcaaaataaaaaaacaaaaatatcatttataaaaatattaaatccgctaattctaactcagaatttccatgtcgttcgggcagccaacatttggtcgcactgatg

SEQ ID NO: 101205 - DNA, 228 bp, Heterodera glycines
  Promoter: Source sequence=SeqID_11184; Location=877..1104; Strand=-; Gene=SeqID_74530
ttaatccaacaaaaaggtgagaaaggagaggatgaggaggaatggataatgatatcacagagaaggaaatggaggacaaataaagcgaagggaaggcgggggggggaagtacaaaaagaaaccaaaagggcagattcaaaagggagaaaaatgccgaaattgagcatggcattggcacagtccgactcatccccccccccctccgttccagatgattccatccccatg

SEQ ID NO: 101206 - DNA, 1003 bp, Heterodera glycines
  Promoter: Source sequence=SeqID_4437; Location=7329..8331; Strand=-; Gene=SeqID_54459
attgcacgccgaagaatcaccaaaaaatggggggggggcaattccatggattgttatgagaaaattgggagagggacgaaccgccggcggggaaaagcggtatatatacgacaaaacaaacaaattacaaattattacgatgattaattcccctcccccttcctaaattggttttgtaataaaaaaaataatatatgtataataaattaaaaggaaaagtatggagagaaattgtcagaattcggaaagggagagagcatggaagtgtttaatttgtttgctcgatgccaaatttctgaatttgatgaattaaaaaaaaaaagtttttgcaagaggcctggttcgatgcattctctttaaaattaattttgattaggcccaattagaaaattggacgggctaacattttcataaaatttctaaaaattaagtgtcggattattaatgcaggattgccgaggttggcaatatcaacgatctgtttgaagtcgggaacatggctcagtggttgagctttccccgtactgctggatggtggcgtgggttcgttccctccttgcctcacattttacccgttacatattttagccattatgatgacgtattttttgaggtggacaattgaggcgcgtgcaacagcggcgcggcgcgattttttgtgattgtgtggtggtggagtgcaaacaaagttctgcaacacaaccatcagcgtcatgttcattatgtagaagatgtaaatgaagaaaaaaaatacgcgcaaatgacgcggacggatggattgggtggtggacatttgggggggggcgggggaggaagtggacaatgtgaacgaatttttcactgagggagaattttgtataagggagtgatcagattggaatgaatgtgttaattaggggacaattaggaaaaatgatcggaaaaaatggtcggattggcagcagtatagacggacgtgaaagcaccggaatttgaaagtttgtccacttaaaaagctctaatg

SEQ ID NO: 101207 - DNA, 711 bp, Heterodera glycines
  Promoter: Source sequence=SeqID_21158; Location=2008..2718; Strand=-; Gene=SeqID_51741
taatataaagacaaatgggatgggcaatcaattttgtttcttcttttttgttgaccactgacatgcccttcagcgcacaaaacaacgaaaaggacgccttaagaaaagaagcggaggagggaaggggggaggcaacgaagaaaaaggaaaatgcattgatttccaaaaaaagaaaatatgtatttggattatatattacaactttaatcaattaatgattaaataattcaaaataatttgaaaatgctactttcaacaatcaaaattcaatcactgaaatttttcaaattttttaaataaaatcacttaaataagctaccaaaaaggatgctcaaattaaattttaacaatttgaagtcgaaaaaaaattattcttaataatccaatataataaataatataacaaacgcctgcttttatgttaaagaaactaaaaaataaaaaagcttgacttgaattgaaagagaagaagaagaggaacggcatttttcatttatatttttacaataaaaagaaaccttttaaattgaaaaggctaaatttacaaaaaattctatttgcagcttagataatgccaacagaactataaattctggagttgatgaatttgtgaattttatgccgcctgtttaatttttcattgttatttttattaatgaaaataaattaaatgctttactttataattatttagaaaaaattaaaataatg

SEQ ID NO: 101208 - DNA, 107 bp, Heterodera glycines
  Promoter: Source sequence=SeqID_4043; Location=1..107; Strand=+; Gene= SeqID_52937
tcaaaagatcatggtaaggaggaaaaggggaaatccattaataataatttgggagtaaaacaaaaaataataaatcaaatttaattattaaacataaatagatgatg

SEQ ID NO: 101209 - DNA, 1003 bp, Heterodera glycines
  misc_feature (610)..(610): n is a, c, g, or t
  misc_feature (651)..(652): n is a, c, g, or t
  misc_feature (660)..(660): n is a, c, g, or t
  Promoter: Source sequence=SeqID_10537; Location=599..1601; Strand=+; Gene=SeqID_73774
tacaggaaaaaatatgtgtattctcaaatttcaaaccttcaaaaaaatgggtaacggttttagagaatttaatttttaacaaaagcgctggttgactacagcatgacaaaaatcctgttttgtcaatggaacgccaaaccagattttatgtattgttcaatttcaaatgatcgatgttgacaatttggccagcattaatgttaacatgtgagatatctttaaaaattttcagaattttgcattaaatattttttcagtttttaatttaaaaaaacatctcagtaccagaaacccattccggttcgggctctatgtagtctttatcttctaaaaaaattttctctgtatcaacagaagcgaattcgaatgcgaaactgacgaagcgacgcatttgggggttttgttgcagcattcgaagacacgaaaaggtgaagccaacggcggaaccaatggcgagaaaacgaacgaaaacgacggcatcgacacacaggactaggaacacaacagaagaaatgccaatgacgacaacaacaacaacaacaacaacaacaacaacaataaaggaaaacagggcagaagaagaaatggaactgaatggcacattgaattncaattcagtggaaaatgagagaaaaaggaggccccaatcannatgaatgngcagagagagcgcgcggaagggagagggacggcaaagaaagaggggaagatggaaggaaggaaggcgcgaaagagaggcagacagcgaggggaaagtgcagagaaggggggagggcaatgatgggataccataagagacccctattaaggccattgttcctcctcgtcatcttcagagcagtcggagaaagccgacttgatggaactgtccacaaaacttgaccgatttatcagcggagtgcgccgaagggcaaaactgcccaaggggcacagacggacgacgcggccaaaacaacggaatgggaaccgaaaccgaacaaaatgggacaggagagaaaaaatg

SEQ ID NO: 101210 - DNA, 100 bp, Heterodera glycines
  Promoter: Source sequence=SeqID_1709; Location=1679..1778; Strand=+; Gene=SeqID_75440
cgttatgacaaaagttttgccgagaaattttctaaacatgaaattattttgtttcataacagcaagggaatgaccaaccccgtgttgagcatgactaatg

SEQ ID NO: 101211 - DNA, 114 bp, Heterodera glycines
  Promoter: Source sequence=SeqID_20352; Location=1729..1842; Strand=+; Gene=SeqID_50871
ggttgctggtgctgcaccggccgtcgtccaacctcaacacgttcaagacataattccttggtagagcgatttaaattcgctctcgactgctctacaaaagtcaaatgtctgatg

SEQ ID NO: 101212 - DNA, 214 bp, Heterodera glycines
  Promoter: Source sequence=SeqID_30463; Location=1335..1548; Strand=+; Gene=SeqID_60869
tacgaatccgtttgagtggaagctcgctttgtagtagttttttcctctccacatccgtaatgtctgccgaaagttcactctcctcctgttttacctccttttcaaactgctcttgtttggtgcgtaattcgccaatcttttcccaataatccactggattttcatgaaaaaataggtctgtgacctgccgtttcgtccggctagctccatcatg

SEQ ID NO: 101213 - DNA, 75 bp, Heterodera glycines
  Promoter: Source sequence=SeqID_17078; Location=315..389; Strand=-; Gene=SeqID_81506
cgtgagtgccattggactgctaaatttggacacaaaaaaattgcaaatttttccccttcaaaattttcaggcatg

SEQ ID NO: 101214 - DNA, 179 bp, Heterodera glycines
  Promoter: Source sequence=SeqID_36441; Location=351..529; Strand=-; Gene=SeqID_65750
tgtttgaagcatcaaacgaaggtaaaaacatgttttttcctcccacattccaggggattaccatatcatttatgattttgaataaattttcgaaaatttccctaaatcggaaaattgtccatttgagaggcgaataaaattttatttgttgcccttttcatgctcaggtgtcagaaatg

SEQ ID NO: 101215 - DNA, 141 bp, Heterodera glycines
  Promoter: Source sequence=SeqID_19848; Location=1071..1211; Strand=-; Gene=SeqID_84605
ccccaagggtttccccactactcccctaccccctccacctacctatttgattttccaaattataaatctccctccccctacgggttgtccccccgtctccgcctccctctcctcccactgcgtcttccgctccccaaaatg

SEQ ID NO: 101216 - DNA, 270 bp, Heterodera glycines
  Promoter: Source sequence=SeqID_21347; Location=1..270; Strand=+; Gene=SeqID_51949
ttaattctgcgttggatttttgctccccataattgtttgagtaccccaaacggacactgaaaaaatcgatttttttgtttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttaataaatatttttttcagaaagtcatg

SEQ ID NO: 101217 - DNA, 369 bp, Heterodera glycines
  Promoter: Source sequence=SeqID_10152; Location=571..939; Strand=-; Gene=SeqID_73254
ctaaataaaattttatttgttaattataaattaaagtattaattagcagattaactctattagggaaattgacttaagcataaaaaattaaaaatattcctaaacttgtataaaaattattaaaaaataaaacgacacaataatatttaattaatctaaaaaaacgtttaatatattctattttttcattttttttaaatcattaggcattttttttatattttatattttattttataaattttataaattgtctgaatttaaaaagaaaaaaatagttctttttttagaaaacgagttatattaaaaaatgcgctaatttaaaaaataaaaatatgtatacataataaatccaggattaaacggatg

SEQ ID NO: 101218 - DNA, 608 bp, Heterodera glycines
  Promoter: Source sequence=SeqID_6052; Location=842..1449; Strand=-; Gene=SeqID_60150
aaaaaggcgaatgatttcattttccatcgcattttgcatttacggccctttcttcgccatttccgccggccatggtcaatggatgacggcacttctcaaacattccgccgctttttctgatgattcctccccccccccctgttctgtgtgatgaattgaattcgaattgcgccctttgtcaaatgccaatttgccctttttgtttcttcatttccgtcatattttgaataaaacggccgatttctcgtcccacccattcattccgttactttgcatttttcaatttttgctttttattagctaattactctccgtgtcgtcccaaatgtcctccggccaatccttatctctgctggtgttctctgttttcctcgccatcctttgctcattttgctcctcttttcccctccaacaaatgccctcccaaagtcggcaaatgtttggaaaaattggcacttcggcacaaattggtcaatcaaaaagttaaatgatttttcatttgttaattgctcaaattcagtggctaatgtgctgcccgaactgcaaatggtcgaaccttttccatttgatcaaatcagtgacaattcgcaacaattgaaaagcgaatg

SEQ ID NO: 101219 - DNA, 625 bp, Heterodera glycines
  Promoter: Source sequence=SeqID_26908; Location=1..625; Strand=+; Gene=SeqID_57645
ccataaaaaaatggaagtttttccggtgccaaatttttgtgaattttctttcgtcccgtcataaacggattgtttggggcaatatgaatacaaattttgtgttattcgaatgcgctagccgatctatacattttcttatgtatcagcccatagtgtctctccccgggtggggggaggggggaattgaaatggaaatggttctgctggtgattcccaccgccccgcctccccaccccgtcccctcccaccatcttcctatgtccatatgtcctctgatgatgagatctaaatcattttatggccaactacgatcgacgatatggaagtggcgcttagtagggcatcagacttaggcaacaatgagtacagagatccctcaaaaaattttcagaaatccttttttgtttatttttaggttggggccaaaggtggacccaaacgaccgggccctttagtaagcttatagaaaatgtcaattcatcggaaaaatccttttttatagccaaactcatatttggacggcacacaccgtctttcatgtcattcttatcgaaaattaataaattaaagcttttttagaaagattcacaattattaaaaattagcgagtgagagagagaaaatg

SEQ ID NO: 101220 - DNA, 1003 bp, Heterodera glycines
  Promoter: Source sequence=SeqID_812; Location=2329..3331; Strand=-; Gene=SeqID_46263
ttttctatacaatccccccccccccccccacaattttttactccattttatatatttatttctcaattctaataattttttcttctcaaatttctacaatcccctcccccctcacaattttttttctccaatttttattttttttcaattctttgtaactttgttttctctcaaatttttacaatcccccaccccctccacaaattttttcttcaattttatttgttgttagtcggttgtgttgccgtgttgctttaactagcaacccgatcctgtgccagcacaggattcgaggcaataggtgcattaatttgcaccccgctgactaattatgagtaagattgttagaaaaatttgagtgagggtgtaaaaaactgtcgaaaattttccccaaatttgaaaaatttatgtaattgcttttcggcatttaacctcctttcataatttctcttctgttttatttgttttagtcagctgtgttgttgtgttgctttaactagcaacccggttctgtgctagcacaggatttgaggcaattggtgcattaatttgcaccccgctgactaattatgagtaaaccagttagggagcttttgaaaggggatgaaaaaaaattttatatttgaagcacataaatttattcagataccaactccatcattcattcattctcaatggccccagccaaaaaaaaccctccccccaaaatgttttgtaaacccaaagagggcgtgcaaaaaatgtgaaaggtgccgtgagatgcgccttatggccgaaattaaaaaagaaaaagaaaaggccggcaaatgtcggggagagcatctccctgacattataattaatgcaaaaaaggctcacccatccgattttcaaaaattatataccgatggggatggagtgttggaaaaagttttgcaaggtaccccccccccccccatccatcgtaatatttaaaaaaaattttaaggcccatctgttgtacattgtaatgagtgtaaaaatg

SEQ ID NO: 101221 - DNA, 465 bp, Heterodera glycines
  Promoter: Source sequence=SeqID_13279; Location=1187..1651; Strand=-; Gene=SeqID_77112
ggtgctaggacgaagtgacaaaaatatcagtgtggcgaagtgacaaaaatatcagtgagagactttcagaggggtggggtcatttcagtacgaataaattaatttaattaattaataacataatttaaaattgaataataagctaataataataaatatatttgttctctatttcagtttatacggccacaaaaaatacacgaccacctaatttcttgataaatttcatgcatcataactttttctaaaaccatcaaaattatacattttggtatcttttggtagccctaagtgttctctattttcctgtaaaatttcaaaaaatttcgttgagtttcaaaaaagttgtggtcacaaaggtttaccaaatcatttatgaaatttacaagccacaacttttttgaaccataaccaaattttttaaaattttaaaggcaaatagaagacacttcgggctatcaaatg

SEQ ID NO: 101222 - DNA, 393 bp, Heterodera glycines
  Promoter: Source sequence=SeqID_26344; Location=429..821; Strand=+; Gene=SeqID_57087
tgtgtgtgggttttttaggcgcttagagttgagggccacaaaatttgaatcgagagtgcgttgagagagggagagagagagaaagaaagaaagaatgaaagaaagaggagagagaggtagagatagagagagagaaagaaagagaaatgaaagaaagaggagagagagagagagaaagaaagaaagaggagatagtgatagagagagggggcgagggtaagaagatacagaagagaatggatacagtaagcacatggtctcactatatcctaatcttgtacatgatgcgcctaaagtgggggcctgagaattttaagaggggtgtggctggctgctaggtacctgaaattcttgaaatttttctccacattttccattttcaagaatggcatg

SEQ ID NO: 101223 - DNA, 190 bp, Heterodera glycines
  Promoter: Source sequence=SeqID_42311; Location=506..695; Strand=-; Gene=SeqID_70228
agtatggacaataaaaattatttttttataaaaatattatttatgtatatttttatttatttgtttttttttttttgtaagattgcccggcttcggccctggatgggctcgtggacggccaatcaacagttgtgatcaccaatttgtggaggagcgcgcttttggcaaaatgttgcagaattgcaaaatg

SEQ ID NO: 101224 - DNA, 333 bp, Heterodera glycines
  Promoter: Source sequence=SeqID_13882; Location=1681..2013; Strand=+; Gene=SeqID_77828
agttcgttcaatataaaaagagaatattaaaaaattaatttaagcactcattttggtaatactgtgctttgtcccccccccccttctttcgaaaaatttttttatgatttcaaaagtcatgaaaacatgtttaaaagtgttttcggggtcggtgatcacgaatccggcacccatttcgaacaattccgaatcccggacccgaactcggacaaaaagttgaaaattcaaatttttcagattttccgttcaaactttgtttaaatacacggaagtgaactaaaagtcattagtgcttcaataaaagataatataaaccatttttagacaaaaatg

SEQ ID NO: 101225 - DNA, 207 bp, Heterodera glycines
  Promoter: Source sequence=SeqID_22426; Location=1329..1535; Strand=-; Gene=SeqID_53100
aggtgggttttgaaattttacccaatttaacaattaatctcccccgattccctcctagctcatgtgcttcgccaacaaccctctcattgtcaaattcgggcgcgaataccacgtggaaggcgcgctctacaggacggacctcatcgttggagcaccgcagatgcgacagggccacttgcgcgttcaacacttccactggcgacaatg

SEQ ID NO: 101226 - DNA, 104 bp, Heterodera glycines
  Promoter: Source sequence=SeqID_10497; Location=552..655; Strand=-; Gene=SeqID_73712
tctgtaaaccctgacgactatgagcacacggtgatgaaatttatgtgcgtaattaattaatttaattaataattggatatattttttggatttttcttcagatg

SEQ ID NO: 101227 - DNA, 309 bp, Heterodera glycines
  Promoter: Source sequence=SeqID_19804; Location=2045..2353; Strand=-; Gene=SeqID_84540
aagtaatagtccccaccagggatggcattcctaggccccaaaaattttcgaaaatcggaattccgtgccgtccctgttccccaccagctttttttttgacccggcacatccatagtcctcatcttaatgatggcttaatgaatttatcagggcctcttttcaacaaccaaaaaaatgccattgaaattttaaagaaaattatgccattaattaaattcgaattttgatattattttctaaagtttttccacaaaattcactaaaattcacagaacctatcgaccaccgcctccgtcttcgtcagcgatg

SEQ ID NO: 101228 - DNA, 895 bp, Heterodera glycines
  Promoter: Source sequence=SeqID_28738; Location=1..895; Strand=+; Gene=SeqID_59313
tttggacccaccggttttcggtttcggtttttgacccaaaaaagccggttttcggtttcggtttttgacccaaaaaagccggttttcggtttcggtgcggttaaacgaccgtgacccaccctagttttagctttaaaattaattttaaattttaaataataatcctttagtatttatcaaactaatattttttaaattttgtttcaaatttatttttaacaaatatattttttgcttttagtttaatgttcccatttttgacatttaaaatattttccgtataatattaaactgatcacacacaacaatctttccctgtggcacccattcatttcattcattcgtttcattgtcttttgtgtgactcattttcattctccaccatttgtcattttctctcgactatccttcggtttctctctccattttgctcccaataaatttaattttaatttaatctttggtccgtttttctcgaataaatttccataatattttaattaaattaagtaagcatataatttttgagtgaattaagcaaggaattcgagttttttattgttcccgcaaataaagaaacatttttatgtccgtttttcaacaacagaggcggagggcagagaatgggcgcgtcatctttcacataaaattgtgaaaaatgtccataggaaatgttttttttggcgttccactgaggccgtaaagaatcaaaataataaaaaaaaaactaaaaattagttaacaatagagtcaaaaaaaatttttttaaaactatttttaagcgaacaggaattttttttaattgggtctcagggttttcggtcggggtccggacaatccgtcggtggacaatccgtcagtggtcaatccgtcagtggacaatccatcagtaatg

SEQ ID NO: 101229 - DNA, 271 bp, Heterodera glycines
  Promoter: Source sequence=SeqID_38404; Location=562..832; Strand=-; Gene=SeqID_67223
ttccgtgtttatggtgttcaccatcactgccctttcgtgcttcggcgtggccctttttgccacaatcatcaaaaaggacttgactaagtgggtttcccgtgagaaagtaggcatttaaaatgtactaaaacaaaactatttttgtaatgcaaattgtaagaattttttgatggggaaaagaccgacttatggcgggggggggcaatacacaccaaaagagcaagtgccttctactgctaattaatccgtgttcatttaatacagcataatg

SEQ ID NO: 101230 - DNA, 54 bp, Heterodera glycines
  Promoter: Source sequence=SeqID_14538; Location=507..560; Strand=+; Gene=SeqID_78592
ggttcgcctccattaaaacgacaaaattacctaattaatcttcccattttaatg

SEQ ID NO: 101231 - DNA, 1003 bp, Heterodera glycines
  Promoter: Source sequence=SeqID_17642; Location=1380..2382; Strand=+; Gene=SeqID_82170
caaagttacggggaagttcgggcttcattccataaaaaggagacaccagcgaaagttgagactgactgcctttgagcgaaattttagtgcgcaaaaaaccagaggaaatcccgctagcagcagcagcagcagcagcggcagcggcttgttgttggtccatgtggacagcacacttcggagttcaatgttttccaaaaatttccaattccgtccttattcttttaatctaaatttgaatttacgtgagatgataatgattaggtatttataaaaatcttaattttttaattctctaaaatcggaatttttgtgatacttgatgaaaaaccataaatcatagacaaatgatggcttttgtaaatctacacaattgccggaataagcacaagcatcaatatgggtccgctccagggatgcgcgggatgccgatttcgatttttggactcgggattaatttctgattgtcctcggcatacatcccgagaacggctgtgaagcacaacaaacacaaacaaataatcaaaaaacaaaaaataaaaataaataaatgcgccaaagcaaatttacaaattcctgaatctgcttattgtgtgcaaaatctcgtactttcctgttttgaggccacacccaaaattctattcttatgtgaatttctctgtcgtgaagactgcaaacacagagaagctgatcaatttgagaaattttgatctgcaattattgaaatttgcctcctcactagtgttacgcgcgacttgtttattttgcgcgcccttttgttgactttttaaaattgggtgtggcctcaaaacaggaaagtacccaaaatcttttttaaaccgtcaaagttagccatttcacagtcatctgagtaataatttgtcccattagaactcttttctttttagatttgtctgatttcaaattggattgaaacttgagagtgccgatcttaatcgaattttgaagataatttcagaattcccatatattctttcgtaaaatg

SEQ ID NO: 101232 - DNA, 1003 bp, Heterodera glycines
  Promoter: Source sequence=SeqID_14169; Location=1215..2217; Strand=-; Gene=SeqID_78173
gtaaaccggggaacggtgataaaaaaaacttttgattttattaaagaaagaagaaaatgaaaatttttctttaaataatacatttttatttgtgatttttatggctattttcccgttttctgttaaaatattaatttatagggatgcgatttaagtacctattctgggatttttcttacctaaaaatcgcatccctattaatttattaaaaaacccattaagataaaatgtgaagattttctacattttaaagttgcttttttccatctctctgaccattgacggcctttcccttttttttgcatttttttttttgctttttccaatccataaaatttcacaaaaatatcagcaaaagatcttttgctgcggaatatgtggacgatcttttattgcattttaacaaatgattctctattctcacatttgagaaaatcaaaatatttccaaataaaatgcaaataaattcaaaaatacttttttctaaacttaaaaaataaattattttccgtcgacttttgttcccattcattgatttacaacaattaaaatagaatttcaatattttcccaaataatttttcgctttaaatgggcaattgttgtgcatgagttttcgtcgtttgtactttttttctaagatttttgcttatttccttttaagaatttccaaaaaactggaaaatcaatttaaattgctatcgttcgttttgggaaagtctgacaccaaaatttttccgtaccgcaggcctaaatttcacaaaaaatttcgctattttttccaaaaatccacaaaaattggctcaaaatcgcaaaagtgcgccgaaaaaaaaccttctccaaggcaaaatccttggacagtcccttcctctaatattttctgcacttaacaaattttattttggctcaattaaaaataaaacaattaatttatttttccttaacaaaatgatgaagatttgaactgaccaaaaaaagactcaatttatttcacataattaatg

SEQ ID NO: 101233 - DNA, 1003 bp, Heterodera glycines
  Promoter: Source sequence=SeqID_22621; Location=1094..2096; Strand=-; Gene=SeqID_53296
atttttttaaatttatataaaaaataactaaaatttttatactgaagtttttaaatatttcaaagaaggtggaagcaattaaaattttaatctttatttaaaaaattaaaaattaacaaagataattctaaaatactatatgttagttttggaaacattttgatatcagaatgaatctttagaaaaaaaagaaatgtgaaagaggtaaaatattatctataatggtgctagggcgtttcttaaaaccaccaactcatatgattatgtatgtatatccgttaaattaaatatacaataatatctattaatttttatttgttgtgcaagtaagtgtcagccggaaatattattagtctagcagtgacagactaaaaatctttattaaattaatttacaattatttacttaatttttatttggttgtaccaataggtgtcagcaggaaatatgaggctggcagttttattacaatttaaatggtataaatagctaaatttctttaacatacatttattataaaaaatattattgccttaattcctttaataaattaatccaatgttaaaacgctgaagtgtcacaatgtttttcaaaattcgacaataaattcctatttataattggtcatgataatcaatatcgaaaattcaaaaaaacaaatgaaagaacggatacgatttatctctaaagaaaagatcaaaaaatcagagaggtcaactttttcttgaagtagccatatattttttattttagagaaaaagaaaattacgcacagaagaatctgcagaaaaattaaaaactaagggacaaatttttgctgaaataataaagaaaaaattaaaaagttctgaagaagaaatatctccaaaaagccaaagcagtaatgaaagccaagaaggtttaattttctaaaaaaattcaaacaaaatgaataaaaaatattataagtaaaaaataatttaaaaataaaaaattatcacaagttaaacatgttgaaaccatg

SEQ ID NO: 101234 - DNA, 112 bp, Heterodera glycines
  Promoter: Source sequence=SeqID_206; Location=4032..4143; Strand=-; Gene=SeqID_77580
tttttaagttaatgctgaacagtttgtggtatgttttaggaacgataaaaaaaaaaaaaaaaaaaaaaaaaaaaaaaaaagtaacccaaaatttaggggaaaattcagcatg

SEQ ID NO: 101235 - DNA, 909 bp, Heterodera glycines
  Promoter: Source sequence=SeqID_2619; Location=1167..2075; Strand=+; Gene=SeqID_80751
tgtacgatttgacacagaaattcactggcaactaatagtcatataagaaaaataataattactaggtcgttgcataaaaaagggcgctttttcaaaatgactttttttaagacttgattaacgtttgttatgtcttttttgtgtgtaattcttttatctgaatgttctcgtcatgtttttgccaaaaattttgattttgtccttttatatctaaagttacagtccaaaaaattgggtaaggtcaacaaaatttggctaccattttacaccaacgtccataacttgagttaaaattgtcaaaacgacttaaaacttggtcagattatgaaatttgatgagcttaacaagaaaaagcctgaaagaaatttttctgaaaaagaaaaaacaaaattttttggccatgtttattttggccaagtttccaaatctattggccaaaccgaaagtcaaaaacaaaatccaaaataattccatcggggttttgaggctttttatgcccttaaataatataaaaaattacagaatcgcacaagtttccaaaattgtgttatgggcgattattcgaatttctgaaaacgaaggccaaggagaaaacacttgtctttggacaaaggatttttcttatattttttgaacacatgcaaaattattccagcatagtttatccgtaggaaatccttgttttaaatccttttttaaaattttaaacaacttccctaaagccttttttggccatttttcaaaaagtgggaaaatttgggattttttggccataacttttttaaaaattgtttgagtgcattaaaattgacgccattcaattcatctcgttattctgcatcagatgatattaaatttattagaatttgttacacttttaataaagttacactcaattttctggttatg

SEQ ID NO: 101236 - DNA, 63 bp, Heterodera glycines
  Promoter: Source sequence=SeqID_24016; Location=1453..1515; Strand=-; Gene=SeqID_54719
ggtaatcaaagaatgtttcattcattgttaattaatgttattgttttaatttaagaacggatg

SEQ ID NO: 101237 - DNA, 142 bp, Heterodera glycines
  Promoter: Source sequence=SeqID_28842; Location=771..912; Strand=-; Gene=SeqID_59425
cgacttcttcgctgatgggcctaagaactacgggttccagcacgtggacgcgcgcacgggccaggacctgagggcggagcgcaaggtgcgatcctttgagctcacctacgcggcggaccaacagctgcagtacggacggatg

SEQ ID NO: 101238 - DNA, 384 bp, Heterodera glycines
  Promoter: Source sequence=SeqID_37265; Location=640..1023; Strand=-; Gene=SeqID_66371
ggagccgaatggtataaaatttctatacaataagatgcatattcttcactttaccaaatccgtaattacttcgtccaaaacgccgtaatttccgtaatccgtaattgcgtgcagccttagtattttattccccttttcaaggacagatataagctaaaacatatttccgtttcaaaatttcacaaaatgacgcatttgtcaaactgaacaaattgagggattaacgaaaaaaaatgaaaatttaatttgcttagctgtgattctgtgatttgaatgggaaatgaaagcacataaaaggagcgaatgaatcagtgaaattattcaactttaatttgactgtgcttccgaattgtcaaaatcattaattaatttatcgcaaaaatg

SEQ ID NO: 101239 - DNA, 376 bp, Heterodera glycines
  Promoter: Source sequence=SeqID_4807; Location=1..376; Strand=+; Gene= SeqID_55786
tttatgaaaattgaaacacctacctatgtaatttttttacattacacattcggacacgaacaggaaacaaaacattacgccaatttatcagaataaaatatcaaattaaaattaaaacaaagggagtcaagattttcacataaaattttcttcgacataacatacctacctacctatgtatggatttatcagtttttacttcaactgaattcaatagaaatatgtatatctgtcattttaatatgtcccaaaaaggggaggggttgttgttatgaacgaatgaaggatgattcttagattcgttgaattcatacaaagaaatccaaattttgtgtgtttttatatttcgtgtcaagttaaaagaattccaaagatg

SEQ ID NO: 101240 - DNA, 140 bp, Heterodera glycines
  Promoter: Source sequence=SeqID_22820; Location=518..657; Strand=+; Gene=SeqID_53529
tgtttggtgcaactattgagagttcagaagaagaaggaatgacgaccgattaccgattctaagggttttgccataacattttggttcttctgttattgttattatttttatgctttaaacaaacgtcgttcgattagatg

SEQ ID NO: 101241 - DNA, 144 bp, Heterodera glycines
  Promoter: Source sequence=SeqID_4567; Location=4874..5017; Strand=-; Gene=SeqID_45846
atcattcattcattgatttttcgttgaaatgagcaactctttctttgtaattttgccaagcaatacgccgggctttgtcggcaataaaacgaataaattcaaagtgcacttgcaaaagaaattggtgttcgatgggccaggatg

SEQ ID NO: 101242 - DNA, 205 bp, Heterodera glycines
  Promoter: Source sequence=SeqID_1263; Location=1..205; Strand=+; Gene= SeqID_71019
actcacacgatcaatcaataattatgtgttctttcgccgttaacagttttatgtttttttaacaattataatcataaactatttcctaatcgtaatgtccccgagaaaaatcaatgatcaattggtgtttgagaacaaaagtaatctttttttttttttttttgagtttcttataataataattaaatttgaagaattgcatatg

SEQ ID NO: 101243 - DNA, 62 bp, Heterodera glycines
  Promoter: Source sequence=SeqID_20642; Location=1192..1253; Strand=-; Gene=SeqID_51192
ttttgaaaaaatattcttgagtgtaaaatgtcaaaaatttcagtgaaaatctgttaaaaatg

SEQ ID NO: 101244 - DNA, 1003 bp, Heterodera glycines
  Promoter: Source sequence=SeqID_11108; Location=2120..3122; Strand=-; Gene=SeqID_74437
ggtgtaagctcatttcgcttccgaatttgggcaattagcacagcaaaatattaaaaaatgaaaatttttacactgactttttctttaaaaaggaattttttaaagtgatgaagaattcgcataaattaaaaaaaaaattttgaaaagaataaatggaagagttggcctcgtaagcaggaatgtttcagacaaaaaaaatgccagaatcaagaccaaataattagaacaaagattatttgtttttttataaaatacaaatttctacttttttgaaattcctatttgattaaaacaatttaatttttttttaattagcatacgatcacaaaattaacaaaacactaaggtgtctaaaaaattttttcaaaaagggaaaaatttaaagttaccaaaccaatccctagttatccaaacaaaccataaattaataaattttataacaaattaaaaaaataatttggttggcaatataagtttaaaaaaaaacacaaagattaaattaaataattaattaatttaaaggtgttcacttccctgataccattggtgaatagtggacatggatttaaaactaattaatcattttattattttaaaggattgaagccaaaaataaaaggatgccatggcgaataatcgagatcagacaattgatatagtaaataaagtcaaaatgaataattaaaatgaaattttttttcaaaatttattaattataaaaacacacaaaaaaataaatgttcgatatttaatataatagaaaataaatgttttaaaatatttaagaatattttgtaaattataattaaaaataacaaattcgtaaaaattttagttttaaaaaacaaaaaagagtttaaaaataatttataagaggaaataatcctaaaaataacaacagaacaaagaatattttaaaggaattgataataaatattttttattatactttaaactgtaactcattttaatataaggtttataaccagggttgtaaaatatg

SEQ ID NO: 101245 - DNA, 144 bp, Heterodera glycines
  Promoter: Source sequence=SeqID_3027; Location=2890..3033; Strand=+; Gene=SeqID_82829
atccttttcattaaaatccgttttcggatcttccataatccgatcattaatttcttgatttcaaatcactttccatgaaattttcacatgatcgaaattgatccaaaaatgtcttaggtgttggccaggctaagcagcggcatg

SEQ ID NO: 101246 - DNA, 1003 bp, Heterodera glycines
  Promoter: Source sequence=SeqID_3171; Location=661..1663; Strand=+; Gene=SeqID_83519
agtagtactgtatcacaaatcttttaatgcgatgcaatataaattaattaatttgatattaattagttctatgtatgcagtcagtattttaacaatttcttactgtagcaagttcaaacgcgtactgtgcctgcgaacaagcatttttgggtaattaaattattatatattttcttttgttgactttcattgtgaaatggcgaatgaaggtaaagtaaaaaaaaaaaatagagaaagtataaattttacaagcaaatctttgagtacttttaggccgatatcttaaaatctaaaacgacagttttgtagcaaatctttttctgatcaaaatgatatataattcattatacaaaatttaggctcctatgtgcacattcaaatttaattaggtgagccaatttgcctgtggttttgagagaaaaaaatgaagaattggcgatatgtttaattaaatgtttaaatgaatattttaaatttatttcatgtgaataaattaattgaattttaaataaggagaaaacaaaatatatttttttatgctcaattcttgttaattttaaaaaaaaaatttcaatctctctttctattttttccttttggtctcgactgttgcgcttgcagtaataccacgttttggataggggaagggctgaatatgccagttgaaaaatttgcattgctaaatgtcggagtgaaaaaggtttaagtgttgctgataagagcatgggttatcattctcgccaaatttgccgcaaaatcgctggtgttcgtctattgaccgtttcagttgtactttggattagccgtattttacgcgctaatttctattttggccgtttttgattgatttttcacattgattccctgttcctttttgtcctcctttttgtgcatttggccactgatgcctttccttgactgatcctgctaacaggattaaatttttcgtaccattttcatttttgggtcatatttacattaaaaaaaccttaattttagtatg

SEQ ID NO: 101247 - DNA, 290 bp, Heterodera glycines
  Promoter: Source sequence=SeqID_19573; Location=624..913; Strand=-; Gene=SeqID_84312
aaattgttttccaattatgcccattataaatttacaaatcgtacctttctcaatctgagcgtttttcgccagttaatctgtgttctctctctctctctctctttcaatggctgggcaattaaatttgtttgtgttttaaaataattagttggcacgaattttggggtattaaaaaaggattcgaattcgtccgttttaaattgaaggattattttcattgtttcgctctctatttaagcccactcttttctttctcccctcccaattcggcccattttctgtcccaaatg

SEQ ID NO: 101248 - DNA, 151 bp, Heterodera glycines
  Promoter: Source sequence=SeqID_4375; Location=4304..4454; Strand=+; Gene=SeqID_54212
aaattcaaattcatcaagcccaagcccgagtcgaagcagaagtccgtcgcgatttccatgccagttttgtgctgaaaaacacttcgctttagattgtgacaaatttagttcaattgtgaacaggcgaaaacaaatagaagcaaaagcaatg

SEQ ID NO: 101249 - DNA, 685 bp, Heterodera glycines
  Promoter: Source sequence=SeqID_25006; Location=1..685; Strand=+; Gene=SeqID_55742
acaaataattagaataaaccaatcccttaattgggaccaatctccagttatttgtttgcccatttcatctctaacttctttccagtcagagggagaggactcccttcactttggagtcatcaaattcaatcaggtaagtaagtttactaacctggaaaatatttgctgcgaaagaatgagaaataatgtcagacaaattggtaagtgctaagtgatgaaatgcatgagttttgattttaggaatttcaaacaatgaattggattctagtggaagattgttaactttgagaggggtgacggacccagtaatttggtccacttggactagggagccgttgataagaatgggaatgttgcggaactcagagcagggagcagttcgggcctctggagtgacaatcattgaaatggggtttaaaaatgctgattttgggccagaattagtggaaaattggattgggaggagatcaaaacaagtttgaagctcagttgccttaaattggtagctagagctgtttattggtacgcagggccatattttaattgagtcaattgttaattgtttggcaaaaatgtagggatttgagaaaatactttgtgctagagcagttggatttgagaggagggcagaagaggtccaatgtttattttcatcaataaagttacatagctgggtgagggaatg

SEQ ID NO: 101250 - DNA, 211 bp, Heterodera glycines
  Promoter: Source sequence=SeqID_29014; Location=85..295; Strand=+; Gene=SeqID_59583
ttataattttctttgaaaaaaaaatttgtttggcaaaatattttaactaaacaatcaaatttagcggtgctacgccaaaactgccaaaattgtttttggcacagcggacagaaaacgccacgcaaaacacaacaccaaattggaataaataaatcaaagttggcttttgcttcggtcgagcaatggaaaacgaaaaacgctgacaaaaatg

SEQ ID NO: 101251 - DNA, 471 bp, Heterodera glycines
  Promoter: Source sequence=SeqID_9692; Location=1965..2435; Strand=-; Gene=SeqID_72371
ttaaaaaaatgcaatttttttttgcaaaaggttgcctttttgaattccacaagaaatttaaattttttgtatgtattttaaaataaacatagatcttttttttggcttttttgtttgagaaaatttgtgattccgtccaatttttaagttcggtaaatttttgagaaatcacaaaagttgaatgccctgaaatttttcctaacactaaaaattgtacgagcatttacaaaattggcgtcggctgctcagcgctcattaaattttactcgaaaaccttccaaaaattggccgattttttggtttaaatcccccgggtgccgaacaattggcgatcggaccaatgtttttttaatgtattttttgcattcattgacttgccaggacaatgtgcagctgtacttggcactggtcgacttggcctacagttcgtcccattcgcgggacagtgaaattgtcagtgcatttgacatg

SEQ ID NO: 101252 - DNA, 262 bp, Heterodera glycines
  Promoter: Source sequence=SeqID_41273; Location=922..1183; Strand=-; Gene=SeqID_69439
acccaaaccgacggacaacaaaaaaaaacaaacaaaaatatttttgatattaattacgtaattaaaaagcacatgggacggaccatttggatttaattgggggtaaacaaaaagccaaaaaatgggcaaagcaaataaaacgtaaaaaaagcacacagcaaaacaaacaaacaaaaaaggaggcacaatggaatggacaaaaatggaaaaccacgatttttttttttttaaatttattggcatttaacctaaattaataatg

SEQ ID NO: 101253 - DNA, 63 bp, Heterodera glycines
  Promoter: Source sequence=SeqID_16715; Location=1..63; Strand=+; Gene= SeqID_81116
acgggggagggacaaaagcacatccgacggatggaaaaggcccaaatcggagggacaaaaatg

SEQ ID NO: 101254 - DNA, 272 bp, Heterodera glycines
  Promoter: Source sequence=SeqID_8972; Location=3886..4157; Strand=-; Gene=SeqID_69868
ttctttggggtttaggcaattcgtttataaattcagtgccaagaaacgctgctggaaaaagcaaaagtctaactaatgcatttttattttcgatgatttccgtccccccaaaagacgaaatcttagaaaataaattgatgacagctctaaaaacattgccatttaatgcattaataagggaattgaagttttatttgttagttgaaactcatgccgaccattacgtggtgaattcgtgcgcgtcggacagcagcggccaatgttcggtgatg

SEQ ID NO: 101255 - DNA, 80 bp, Heterodera glycines
  Promoter: Source sequence=SeqID_15427; Location=1..80; Strand=+; Gene= SeqID_79694
ctctcatcgtctacgatgttgcacatggtgcatacttccttgactcgctgcatatgagcagcttgagtgatgagagaatg

SEQ ID NO: 101256 - DNA, 798 bp, Heterodera glycines
  Promoter: Source sequence=SeqID_6575; Location=1..798; Strand=+; Gene= SeqID_62066
tttcttgtacaatttctcttgtgaaaattttaagggttaagtgaatggataccatgcataattagtaggtaattaattaattaattaattgctttttgttgtttttggctgtgtgtggttgaactttttctgctgtgacgacggatttggaaaggaaacacaaaagtgaatatgaaatgaatgtgacaaagatgatacagtatgacaaccatatgatgacaaataaatacgcggtggtgcgcaaagcaaaaataaatttaaatgacgacgacgataatgatgatgatgatgaaattaaaataggatttgtgttgcagggatgggaaagccaatgcgaaaaaaaattcggaaattggaatttctgggcttcaaaaacgagcaaaattgttggtgtgccgactccaaaaatgccggaaattttattggtccctaagaatttgatgggtttccgtgtgaaatttttcaataaattggcaaaatttggaaactttttggaaatttaaacaaacaattttagcacctttttttgaaaatttgcccccaaaaaggcagaaatagtcgtttaaaaaatgtttttgactactgacgacacattggttcaaaaccaaatccatcaagaattatttcaaaaaatataataatccatctccaattatgaataaaaatgaatgctctattttaactgctctctttttgaattgaattaaaatttaaaaaatttttgtctaaaaatccctctctttccacgcatttagccttgctggcccgtccgtggtgcggacccgaaaagccgaaatg

SEQ ID NO: 101257 - DNA, 72 bp, Heterodera glycines
  Promoter: Source sequence=SeqID_20822; Location=1..72; Strand=+; Gene= SeqID_51403
tcattcttggtacaggcactcctggaacattttggcaacgatttttcgtcaagaatcatcgttttgtgtatg

SEQ ID NO: 101258 - DNA, 62 bp, Heterodera glycines
  Promoter: Source sequence=SeqID_25180; Location=191..252; Strand=+; Gene=SeqID_55909
agtgccgaaatcaatttgaaacgaatggaaaatggagcaattaatcctacagatacatcatg

SEQ ID NO: 101259 - DNA, 1003 bp, Heterodera glycines
  Promoter: Source sequence=SeqID_14597; Location=1267..2269; Strand=+; Gene=SeqID_78675
tcacgattaaaattcaattatttattactcgaaaattttaattggtttaaaatttaaaattctctcaacggctcctttgacatcataaattatcatttgtttaaaaatgcattcaaaaaatattataaaaaccaatttaataattttcaaaaaataattaataattcctctcgtaaaatatttttatttataatttaattaagttttgcttttcgtgaacctaattgaatttttataagaaaatttattcagcattgaaatttaaaaatatatatttgtgtgggaatttaaaaaacttccttactggcgaaaaccccaaaataattcttcttcataaaataaaaatgccattgaactaatgggttaggaattatatgaaaatccatattttattttcatgaaaactgcgggaggcctaaaacgcacgaaaaacatgtttttagcttggtttgcagcttctagctggagttcattatctattttttccatatttcgcaatttatgtctacatttccatatttttccatattttggcactttgtccgtgttttatgtccatattttggttttcccataaacctctattagaatggcccccatcagttaaattgcgcttctgactactcctgatgatcagaaattttccgaaaaatcattttgaaaatttttagtttaaaataaacttacttaaaaataggtaaatttgtttgaaaaatatgcaaaaaaagagaggaaaatttcggctttttgatccttttcagagctttttttccttataaacgacttttatacggtattcagccattttacatgaatttgaaggaattttggaaaatttacctctcaattcggaaaatttatgttcaatttttgcaatattatgtctatatttcgcgatttttggtcctaacccacataattcccaaccctaaatagcatacttaaaaacgcataaaaatacttaatattgatattaaaattaataatttaattttcagcaatg

SEQ ID NO: 101260 - DNA, 62 bp, Heterodera glycines
  Promoter: Source sequence=SeqID_34855; Location=1..62; Strand=+; Gene= SeqID_64555
taaaaattctaattcttttttttaggcttgtataaaatgtcatagaggtgttaaaaataatg

SEQ ID NO: 101261 - DNA, 63 bp, Heterodera glycines
  Promoter: Source sequence=SeqID_17461; Location=1411..1473; Strand=-; Gene=SeqID_81948
tgtaagttatttattagttttttgcatttaaaatcacaattttaggagcaaattcaaaaaatg

SEQ ID NO: 101262 - DNA, 154 bp, Heterodera glycines
  misc_feature (77)..(77): n is a, c, g, or t
  Promoter: Source sequence=SeqID_6446; Location=1..154; Strand=+; Gene= SeqID_61594
aataaaaattttatttttttaattaaaaaattaaattactttaaatcaaaattctaattttttaataaaaaattcanctagatagttgaaattaaaatcaaaattaaaatttcttcaattttaattttttttttcaaagactcttcacgagatg

SEQ ID NO: 101263 - DNA, 182 bp, Heterodera glycines
  Promoter: Source sequence=SeqID_32746; Location=479..660; Strand=-; Gene=SeqID_63001
tttgtgtttgttctatgaatttagtgtgacacaataatgtgtcttatgtttttgataaaacaatagtgtttgttctatgaatttagtgtgacacaataatgtgtcttatgtctttgataaaacattagtggtttgttatgtgtctttagtgtgaggcactaatgtgtcttaccccaaaaatg

SEQ ID NO: 101264 - DNA, 62 bp, Heterodera glycines
  Promoter: Source sequence=SeqID_36714; Location=540..601; Strand=-; Gene=SeqID_65967
ttttgtattatgttaaagcctcggttccataatcattaaaattaaattacagaagtctaatg

SEQ ID NO: 101265 - DNA, 181 bp, Heterodera glycines
  Promoter: Source sequence=SeqID_34031; Location=1309..1489; Strand=-; Gene=SeqID_63929
ttagtaaaaatttataattttgtaaaggatagagttctcagaatatcattctcagaaataaaaaggaatacggtcctagtgaaaattataaataatactttagcatttttgttattaatatttaattaaaataaatgcacgtaaaaatcatcattaataacacataatcaatttaggaatg

SEQ ID NO: 101266 - DNA, 98 bp, Heterodera glycines
  Promoter: Source sequence=SeqID_6929; Location=330..427; Strand=+; Gene=SeqID_63331
gctaaaaataaaattttcagaaaacaaattaagttagtacgcaacttaaaaacatggattttgaggtttccagctgatgatgttgccttttcgccatg

SEQ ID NO: 101267 - DNA, 63 bp, Heterodera glycines
  Promoter: Source sequence=SeqID_23087; Location=1..63; Strand=+; Gene= SeqID_53792
aagccaacacggcttctggcggaagtgaggcgttcaaccgcggacgagacatatgtggcgatg

SEQ ID NO: 101268 - DNA, 241 bp, Heterodera glycines
  Promoter: Source sequence=SeqID_25326; Location=952..1192; Strand=-; Gene=SeqID_56075
gagatttactttaaaattaaaactattttctaaaaataaaggatttccgcaaggatttaattcttttggagtaaaaaattcttaataaaaaactgatgacatttaattgttctgtttagaataaattatcattggtgttctgcaattcacaagaaatgcgcattgttatcgcggaactaaacgacacaccaaatttcactttatttgagcaatgttttgctgcatttcagccaagcgaatg

SEQ ID NO: 101269 - DNA, 99 bp, Heterodera glycines
  Promoter: Source sequence=SeqID_1802; Location=137..235; Strand=+; Gene=SeqID_76065
ggtgagattttttcaataatttttgtataattttgggatttttcagtcatctcactctggactacatcaaaggcccgccttctgctgttgaaagcgatg

SEQ ID NO: 101270 - DNA, 304 bp, Heterodera glycines
  Promoter: Source sequence=SeqID_27152; Location=504..807; Strand=-; Gene=SeqID_57854
tgaacagtcaaatcaaatcgagattatttgtgcccgggaaatatttaattttgcaaattgcaataaggctgtcacacaccgtgtcaagacatttgcgtctatgccaaaatcagattaaaacagtttttttttgaagccctatagcctaaaaggattaaaatttagaaaacacaatcttctataggagcattaattctgcgttttgaatagtttctgaattttcaacaatttattaactatcaaattatcagacacaatcactttctatcacttaaataataaatgtttaggctattagggaatg

SEQ ID NO: 101271 - DNA, 173 bp, Heterodera glycines
  Promoter: Source sequence=SeqID_11455; Location=3182..3354; Strand=-; Gene=SeqID_74853
ttttctcatcagttcacacatctgcgatttcaccattataataaaccattatttttactgccaatttattcagccaaacatttttatttaaatattcgtacaaaaattaataaaaataaaataaatcctaacttttactttattgtaaatactatttttgaaattctaaaatg

SEQ ID NO: 101272 - DNA, 1003 bp, Heterodera glycines
  Promoter: Source sequence=SeqID_19045; Location=1066..2068; Strand=+; Gene=SeqID_83786
tcaacccccctccaaagggggcttatattcaagggggagcttccaatcgaggggggggcttttattgttcaacccctttccctatataaattcttaaaattttttgctttctgcataatggtacaatttaaatcttaatctgaaatttttgaattgaaaagatttttcattttttggcccttggaaatttaggcgaatgtttgaaaattcataattcacttctaaatgaatcaattaaagtgcaaaaaagcattaaaaatagagaaaaatctggagcattttatacttttttagaattttctatcttcaaaacgaagaagttattacataaattttggaaaaattcgttttttgagaaaaaaaaaattaatagcgctgttctaaaaaggttttttgaaaaacacgaaattcttcctctataaacttctgtttattctatatttttataagacttttgaaaaaaagtacaaaaataaactgattttggaattcgggatcatagatggaagcaaatggtttttttgtgccatgggttcagatccacttgcctgtaaaaatgttttttagggtttttgggaccactaatcaagaacttggcatccattttgcccaattccaaagccttgatccgaactcgaaaccccaaaaataattttttaaaaatgttgcaggcatgtggatttgaacccatggcccaaaaacccatttttaacaaaacaaaaaatatattggatataatatttctatatttgcttgaaaattttttagtgattttcatcaaaatcttttccagtgaatttattaacagaaattttttctagctattgcttcgctattagacaatttccaaaaaagttatacatgaaaattgcgaaaagtcgaaaattttgaagttttttcgtaataaaattttttccaggcttgaaaatcttttcgcttttggtaaggctaatagagcatgttaagagcttacgagtgataccaacaatgttgtatttggatg

SEQ ID NO: 101273 - DNA, 308 bp, Heterodera glycines
  Promoter: Source sequence=SeqID_9153; Location=1624..1931; Strand=+; Gene=SeqID_70417
tttccagtaaacaaataaacctaaaaaaattcattaggtgttcttgttaagacgattagctaaactaaaattcgaattttttttaaaccaaactttttttgttggtgttttggtataacaaaaaaattatgagtatccttcgtcttccgtacaatggaagggttttcacgtttttcaaaaaaaccctttttcaaatcaaataataaaaaatcaccaaaaaatgtaaaaattattttcaggaagtccgctgttacattactcactccgctaatatttaaaaggaatggttgttcaacacattaatgatg

SEQ ID NO: 101274 - DNA, 145 bp, Heterodera glycines
  Promoter: Source sequence=SeqID_14420; Location=1069..1213; Strand=-; Gene=SeqID_78456
catgaaaaacccaggcctggatctagtccagttcgagctcaaatataaatgaaaaaaaccatttccccatatcgagtccacatacccacacacgtacattatttccttcagacttgaaaagtgactgacaactaatttgataatg

SEQ ID NO: 101275 - DNA, 720 bp, Heterodera glycines
  Promoter: Source sequence=SeqID_4689; Location=1164..1883; Strand=-; Gene=SeqID_55393
tctaaaaaataaaaacaaaaaatggcactaataactagggccgggatttctagtgaaaaaactttttttttgcttaattgttttgaagaaaggagctcaaaaaacgcatttctgcgttaaaatttttcgattctgatgtcattatcagtcactagaaatcactattttggcgttttgtcactatttttattttttggaaaattccttaacaaaaacgcaataaaaccaaaaaatacacccctaagaatcgacctaaaattttttttcaaaaaatacacccctaagaatcgacctaaaattttttttcaaaaaatacacccctaagaatcgacataaaaattttcaaaaatcactcctaagaaatgaaaaatttttcacaaaattcactttctttgcaaaaatttttaattctaaaaattattttttaggtacctattttggattttttgcccttaaaaatcccagtcctactcatttgcaactgcaaatagtgaataaaaattatttttgctcaatttttggctgaaaattatgtcactattcgtcactattttggactttttggcactattttctcactattttggcatttttactcactattttagttaactattttgagatttttagtcactaaaagtcccggccctactaatgggagcactttttaaattaattagcgcatgtttctataagctttatttttcattgcagtggatg

SEQ ID NO: 101276 - DNA, 156 bp, Heterodera glycines
  Promoter: Source sequence=SeqID_1112; Location=2001..2156; Strand=-; Gene=SeqID_67988
aaaatataaatacagaataataaaacatctaaaagttatttagatttgtcaaatgaagaaattgacgaattaattggaacgataaaaaaggacacacccccacggtaattaatgggattaatttaattataaaaaataatatttatttctataatg

SEQ ID NO: 101277 - DNA, 131 bp, Heterodera glycines
  Promoter: Source sequence=SeqID_35994; Location=1..131; Strand=+; Gene=SeqID_65439
atatttggcactgatgaattttatttcccaatttacatttttttaaagttttgctatttgtaaattttatttaaaaatttttaaaatatttcttagattgcacaatacactttctttaatttgaaaaaatg

SEQ ID NO: 101278 - DNA, 416 bp, Heterodera glycines
  Promoter: Source sequence=SeqID_9068; Location=1142..1557; Strand=-; Gene=SeqID_70152
acattttcgtcagtgaatgatttcgtcagtgattttcgtcagtggataatttcgtcagtgaacgttttcgtcagtgtactatttttatttatttcactgttttccatttttttcgtcagtgttccaattcggcagtgaatattttcgtcagtggattcataaaattaaaatgtgcttcatttttggttaaactatttaatacagtatttatcgctttttgcgtatggtacttctaagcaaaataaaatgattaattgtgctttaataaatgatttacataaaaagaaattgtactttaaaactgttgaatattattagtaaatttacttctccaacttcttatctcgcgatcgttcccatgcgttctcgagtgcctatttgcatattttcttagtccttatctagtttttgcaatg

SEQ ID NO: 101279 - DNA, 64 bp, Heterodera glycines
  misc_feature (12)..(12): n is a, c, g, or t
  Promoter: Source sequence=SeqID_14012; Location=1618..1681; Strand=-; Gene=SeqID_77982
taaatatttaanagaatatttttgaaaaaatgaaaaacatttttatcatgtgctattttagatg

SEQ ID NO: 101280 - DNA, 143 bp, Heterodera glycines
  Promoter: Source sequence=SeqID_7224; Location=1201..1343; Strand=-; Gene=SeqID_64186
ccgtttgcgtcattcgtcgacccgtcaattctcaacgaatttccatcgcttcgctttgtcagttcatataccgtcaatctcttcggcgaatttccatgcgatgacagtgccacggcatcggatggacaagcggtgaccaaatg

SEQ ID NO: 101281 - DNA, 377 bp, Heterodera glycines
  Promoter: Source sequence=SeqID_12787; Location=1895..2271; Strand=+; Gene=SeqID_76499
gaaggaaaaggataaataaatcaatgctaaacggacaaaatgttttggtgagcgatgtccattatccattccctaatgggaatgatgtgatgtatgttgatgaggaagaagaggcggaacatttcgcagaaggcacaagcacgcagcaccaaccaaatttgagaagcgatcaacaacgacgactctcatttattcaaacgactgcactaatcaaaggcaagcgaaatggccaattgtttttaaaagccaattagtaatggcacggacaatggtgaaattttgaatagtttttgccttgtgatttctaagtacgtagtaatgtaaagtgtcgtatgcctttcctttttcgtgagcttattttcggaagttttaagatg

SEQ ID NO: 101282 - DNA, 544 bp, Heterodera glycines
  Promoter: Source sequence=SeqID_5453; Location=3155..3698; Strand=-; Gene=SeqID_58107
ttggggaacagatcaattatacaaattgatcagctttttcatttgtgctcgactcgtagtcaaatttgggggggggggggggaaacggcatttgatattgcgtattcaaattttattttattaattttttttaattttcggcggaattcatttttgggtgttccttaatcgctttgcacatttttcaaccgcaaaagtcgtattcttttagaaattcacatcaatgatcgcccttaccattgtcgctattgccccaaacgatttacgcaaaaggtcaaaaaacgcaatccgtcccatttcattaattgttgttgcagagccatttggaccagcacgagcgaattcacaccggccttaagccgttcacgtgccaatattgtgggcgtcaatttgtgagtgccatttgacacgcattccttccgccaattaatcgcctttatcccacccaaatcccgttaaaatgtcattttagcggcaacggtctcagcaattggggcacgaggcaacgcatatgaacagggaaaggcattccatgggcagcatg

SEQ ID NO: 101283 - DNA, 223 bp, Heterodera glycines
  Promoter: Source sequence=SeqID_16607; Location=1..223; Strand=+; Gene=SeqID_81022
caccgagaaggacgccgatttttgtgcccatttggtcaaaaatttcgagtccgccggccttccagtcagtgccgagctgctgcacgtggcgctcaaatgcgcctggtacaagacggaacgtgaacagcagctgcaaggccaaccaattgcgggcggtgccgtcggctttggcagcggggcgcgacaacggacggggcttggctatacggcggcgccaacaatg

SEQ ID NO: 101284 - DNA, 347 bp, Heterodera glycines
  Promoter: Source sequence=SeqID_24270; Location=1062..1408; Strand=-; Gene=SeqID_54993
attgtaaaaatttgttttctcctttttgttgatatttatatttacacgttaaatgattaagaaatcactgctgatttaagaaagggtcgccccgccccaattttatcaatcggcccatcgtccgttatttatactctgtttgtctgttgtccctttctcatttttcgtttcctttgcctttcattcaaacgacgacccctcaaacattcctttgtaatttaaatttcatttttgtttaaaatgtatgtcacatgattaaattaatcacaaatagttatttaaaaattcgtttttcatttgttttttaaattaaactaaaatgttttttttttaagatatttataatg

SEQ ID NO: 101285 - DNA, 811 bp, Heterodera glycines
  Promoter: Source sequence=SeqID_6083; Location=1..811; Strand=+; Gene= SeqID_60252
aaatggtttgaatgtgccgagtgttactatcaaacccctgccaattggataaaccgaagcaagtgctagcgaaaactcgacttattttcttttgcgtgatatggagacatttgtgccacggattaggaacaaacgaatagaattcacgctaaatttgaaaaattggattattcaattttgttggatacgggcgggattaatcgtaaagggtgggcaaagtggtggacccaggcgggaatcgaaccatcgccctctgttggtgtggtgataggctttccacccacaccagtgctcatcccattcgcccttcccttttatgaatcttttgcctccgctttttaagcatttttaactgtccgctggttagatccttgcaaaatataacgcccaaacaatttgttttttaaatttcagttgtattctcggagaatcgatcacagaatgaaaaatttcaaaaaccagtaaagcccccaagggagaaattaaaatgggaaaaatgcctgatttctcaggagcgaaatagcggactattgaatgttgagccgaaaagcatcccaaaagagtggagacaaacccatcggtaaagcgaaggcgtgcaacgcctcgcacactgtccgaattggtggacaacggctgaacgtccaaaaagcgggcgaagcgactgcgccgtgtggcaaaaacggaggggtagccaatgcgatagatggacctggaggcggtgtccacggaaacgacggcgacaattcgcgtgaaatatctgtgacgaaacgggggggagtaaaaatggaaaattaaagagaaaacgaaaatg

SEQ ID NO: 101286 - DNA, 673 bp, Heterodera glycines
  Promoter: Source sequence=SeqID_30439; Location=1..673; Strand=+; Gene=SeqID_60843
caattagattgaaaacatagttttcgtcaagccctttctacccagagccatcaagcccaatttgtacggtgattttcttattgacaagtaatgactgttgtcattatacattggacactctgctgattgatatttatttgggtgatgcgactggaattcgaccaatgtaaacggattgttggaggtaaatgcaaaaaaaataaaaaataatatgtatgggtttgccgtcttttgcgttcatcatgactcaagggcacataggatccccatttataaatgcaattttttttttgcctaattacctcattaattgggatggtggttgattgatgatgattgactttaacttttaatgagtccgcgcaccgattcgccactttgttttcgtggtttgttttgccaaaatttgctcaaaatatgggcaaatttctttccgtacataagtgtaaacaaaaaataattatggatgaatttttctcgtttaattgcaatgaaaaattaatccgttaacaactttattcatttcatttttttaatcgtaaaattaattttaaaaagtttaattatatttttgccgtttttaataaaaagtttaaaaaatttaaaaaaattgcttcaccaatttattaaatttaatgaatttaaaacggcaatattacagaatgagaatatg

SEQ ID NO: 101287 - DNA, 400 bp, Heterodera glycines
  Promoter: Source sequence=SeqID_2866; Location=901..1300; Strand=-; Gene=SeqID_82047
tttgtgcaaggttcaatgcctcaatttgcctacgaatccaaccgtcagcagcccaccagcatcaggcaaaagcacttcttcattttcgattattcgccttgggcaatccatttattgacaaagtacattatcagttctcgcagttcaggagtggaattcaatgatgaaaccaaaatgcaaaagtagttgtaaacaaattccggaggaacaaaggcgagagactgcaaacatcgaaggctccgttgaactttttcatcatttcggtagtcattcaacaaatttggcaagcgctggattcttcggaaaaggccgtgtcactgctgcacataaccatccagcaattttaggaaaaaaatggtaaaacagggggggggggtgaatggcaaaacgggggaacatg

SEQ ID NO: 101288 - DNA, 163 bp, Heterodera glycines
  Promoter: Source sequence=SeqID_15591; Location=2246..2408; Strand=-; Gene=SeqID_79886
cggtcggggtcggtttagtacggccggtttagtacggccgttttagtacgagggtcggtttagtacggcaagctgtttttgtccataactgttacaaatgtttttttgtcaattataaagaaggaaaaacttataatatctatgtttagctacaatacaaatg

SEQ ID NO: 101289 - DNA, 55 bp, Heterodera glycines
  Promoter: Source sequence=SeqID_127; Location=2289..2343; Strand=-; Gene=SeqID_73476
acgggcacctaatgctccacatgtaaagaaatggttcgacagtctatcaaatatg

SEQ ID NO: 101290 - DNA, 326 bp, Heterodera glycines
  Promoter: Source sequence=SeqID_41835; Location=1..326; Strand=+; Gene=SeqID_69890
ttttgatcatgtcaatgctttcgttttcatgacatcaattatgttcatgattccgagacaaatgaaacatccagttgtcccacttaaagttccaacgttcgttgaattcttcgagattttgtatacaaaccaacagttccaatttataaaacattttttactggattcacaaatatttgattggactcataaactctgatcggactcaaaaaagtcgattggactcataaagtgcactagagcccccccatttttctacgttcgaccttttgcatattttgtccattgaagacttttttatgctattcagactttaccaaaaaatg

SEQ ID NO: 101291 - DNA, 134 bp, Heterodera glycines
  Promoter: Source sequence=SeqID_17197; Location=1304..1437; Strand=-; Gene=SeqID_81659
cctgaaaaaaaattaacaataatttttaaaatcttcggtattttaataagaaattttaagaaaaatccagtggttttttggaaaaacttatacttacaattagtagtagttcattaaaaaaattttcagaaatg

SEQ ID NO: 101292 - DNA, 351 bp, Heterodera glycines
  Promoter: Source sequence=SeqID_19497; Location=2032..2382; Strand=-; Gene=SeqID_84215
tgcatgaaaatcccattcctcctcatcaaattttaaatgaatcaatgagttttctttaaaaaatcaaatcattgtttttcacggttaagaacttgtttttgtatatttcaattttatttgcaaaaaatccaaacaaaatgttagttttaaaacagtaaaattgcttgaactgcccgtggatctttttcgtggaaatgagagcgcaacccctatccgctaatttttcgatctacattgcaatatgaatcctttcatgatttttctcccctgccatgtgccacaataatattacataccgtacagtacgaagattcaacatttcacgcgcatcccctactcccttttttaatg

SEQ ID NO: 101293 - DNA, 222 bp, Heterodera glycines
  Promoter: Source sequence=SeqID_3384; Location=1038..1259; Strand=+; Gene=SeqID_84464
ggtaattttaaattaaaatattatctttatttaatttgaaaattttgtattcttaattaataatatgaaaaatgctaatagagtttttttgctatgaaaattctttggttgtgattttataatgccgaaaatgacaaaactagtcccaaaaactgtgcgctattgctaattgtttttcttgataattataaattttgtattacataattaggcaattcaatg

SEQ ID NO: 101294 - DNA, 885 bp, Heterodera glycines
  Promoter: Source sequence=SeqID_16877; Location=379..1263; Strand=-; Gene=SeqID_81308
tggcgaacaggaaaattttggaggtcaaattgaccatggacagcaacgacggtaccctcagcgaaatcgccgtccgccgcagcgcttctcaccgtaacctcggaaccgcgcttaaggggggaggtgttcggggcattgccgccgatgatttgaatgtccgtgacataatgccaatccaatcgattccccttatttcatgttgtttcctcgcccataaatatgctccctttcccctctcagagtgtcttcccttcattcatttttgcatttatattttgttcccccaaattattgtgactttcttttccttctccaataaataaatatttaattggacttaaacaaatccctcggaccgaacattttgtaaagagtttgatggtttttttctaaatgccttttaattagaatatgtccttttcaaaggttttatttgagtttttatttaattttttaaatttgcattgcattttaataataatctttttttaggcttatattaaaatattgagctccggctgtcatacatccatacataacggaatgcctctcaccactccgattaaccccccccccccccctcaacatttgccattttcatcccctaaattttaaaatagtgcgtttatccctccctctctttacgcttttccgtttgccaatgccctcaaaaactttccctcccaatttgcagaagccgtcgcagagtctgcgcgttccattcaaattcctccccttttggcttttttcgccgcttaatccctccaaatcggtcgcttttccgtgaacacttttcgccaactgccgcttctttgcgcacaatgaaatcagattgaagaagctttgaacagataaaaagggctgtagaaaaggaagaacaaaatg

SEQ ID NO: 101295 - DNA, 400 bp, Heterodera glycines
  Promoter: Source sequence=SeqID_32341; Location=1518..1917; Strand=-; Gene=SeqID_62651
aagaaataaaatttaaaaaaaaacaccccatggttatttttaagaacatcttgaattcaaggatattttaaaatttttcagaaagagggcccaattttccaggacgtccttgccattcaaggacgaacttgaaccctgattaaaaatttatacaaaagaataatttttaaagattccgattggaactgccgtggttcggcaactcttcgagttttgtcgcaaaatatcggcgcaacgcatttcactggaacatttaatgactttgttattaacaatgaatttagcacctttgaatttccattaaaacccgtaagtaaaatataacatttgaaatttttcttcccccccccccgccacttaattaatcaattattggcaaattaaggaattaattggcatg

SEQ ID NO: 101296 - DNA, 712 bp, Heterodera glycines
  Promoter: Source sequence=SeqID_23592; Location=779..1490; Strand=-; Gene=SeqID_54280
ttttattgaaaaaacaaaatctgtatctcaataaaagttaaatatatagagaaaaattcggctcttttgcgttttcaagaatgcataatattttacaacatcaattcaccagttaggtatgtcgagtaagttttttatttataaacagtacgcaaaactttcaaattaaaaaaatgggatttcctttgtaaaaattagagtccggcgggatcgggacttccgcgggattttacgggagtcccgctcccgactcccgcttttttcggtgaacgggatttttaacgggagcgggatttttacgggaatcccgttcgggactcccgtcccggaaaattttgaactcccgctcccgctccctgaaatttttttttaccggactctagtaaaaatgcaagagccgatttaaagttagttaaaaacttgtttcataaaataaacttacaaatcagaatcgatagaaggggtcaatgccgattgtacccccctcctttttttcgaaaaatgaaatttttttcgagaaaagattgtatcccggacccgaactcggacaaaaagtcgaaaattttaaattttttttgctcgaaactttcaaaattttaataaatttctacgatttttcagctaaaatggttttattttgtctattattgagcaagttataagtagcaaattagtttttatttatattttagataggtacattcacaaaatg

SEQ ID NO: 101297 - DNA, 172 bp, Heterodera glycines
  Promoter: Source sequence=SeqID_4689; Location=1..172; Strand=+; Gene= SeqID_55394
ggattcgtgttcagcgacctctaaaacccttgaaaacatgttttcatgacttttgaaaacaacaaattttttttcaaaaaaagtggggggcacttgctttactcttaccattatgccttttgaaagggcaaaatttctctattcgattgcttttcacaattagaaatggatg

SEQ ID NO: 101298 - DNA, 138 bp, Heterodera glycines
  Promoter: Source sequence=SeqID_13335; Location=1079..1216; Strand=-; Gene=SeqID_77206
attacccacctcatggaaataaaaattccttaaaaacacaaaaaaaaattgcctgaatctgataaggaccgtcgctgcgctggacccctaattcccacaaaaaaaaaaatttgctaatcactcatcatttgtcagatg

SEQ ID NO: 101299 - DNA, 56 bp, Heterodera glycines
  Promoter: Source sequence=SeqID_3334; Location=3013..3068; Strand=-; Gene=SeqID_84259
ggtctttttgcttttttcataattaatttatgattaggtatttgatttttagaatg

SEQ ID NO: 101300 - DNA, 1003 bp, Heterodera glycines
  Promoter: Source sequence=SeqID_15827; Location=25..1027; Strand=+; Gene=SeqID_80152
gaaaaataatttttcactaacaaaattttagtggggtggtaaaaattatttgtaacaaaaattaggatcatatctaggctgtaagaggccgaaaatttcactagattcgagaccgagatcgaaaatcccgagacttttttaattttttaaaaaaattttcgtattcacttttgtataaatttaaatctaatcaactgatttttccacttgccttttttgaggcgcatttttaaagaacttttttttgaggggggggggggggtacggcggtgtctttaggcgccgtcgggaaaaataattgaaattttagcgcactttgttaacagatttaggcaaaaaaatgaaaattttagcgattttaagcctattttttaagaaaaattgggtgttttacgcgttgggggtgaaaagtgttaattttgacctatatattaaaaatatacacttacatcatattttcaaaatgttaatttttggaaattaaaaaaaacaattagtcatagaggaactgatcaaacgcaaaaacaggtaaggaaaccaagagcacaacccactaaaccacgcatgtgacatatttgaaagcaaagaattaataaaataatatcaaaagccaatcattaggggtgtatttttcccgaaacttctggtaaattacccgaagccgaagcgcgaagttcgaagcccaaaaaccgcaaagttttcgaagctcgaagtttcgcccgtctctgcgccggaccccccccccccccctttaccatatttttgaaccaaaatgccaaaaacaattttttggcgaaaaccggcagaaaattttgtaaaatacacccctaacaatcgcaacccttatactggccatgatccgggcaaattggaataggataaccggatttacattcccttaattttttcaaatttttttaatttggtataatatcataacaattttaaataacttaactttgatagatctttcacttatacgtaaaaagcattggaagttatg

SEQ ID NO: 101301 - DNA, 1003 bp, Heterodera glycines
  Promoter: Source sequence=SeqID_16661; Location=1676..2678; Strand=+; Gene=SeqID_81069
aatataatttttctcacatttcatactctaatataaattagtaaaatatttttttatttattaaattttttctataacattttcaattttatttgactaattaataagacgtgtttatgtttttacaaattagctagttttaccctttattaatttaaattctttctaaaattatattttcaattttattgcctattgataaaagatgtttatgttttgagtagttacccatgcagattttgggggttaattttcagccccgccatttcagtcccaatggaaagggacttttcagtaccaaatttaaactttaaaaaacacctaataataattatatataaatcactgaagggtgaaaaaatacctaaaaaaggaaaaaaatatttctaaaaccaaaacatattaaagtattttgaatttatagaccaaatatcaataataacttttacatattaaattattttgcacacaaccaataccaataataacttttacatattaaattattttgcacacaaccagccaataccaataataacttttacatattaaattattttacatttatagaccaacctataacttttacatattaaattatttttcacacttggcctaacaattttcattggcagtttaccatattcaaacaattttccgtagaataaatgaccaatccactcaaagtaataaattttgaataataaattatttttgcactcgcataactgcaattcaactaagaattatgcatattaaatgacatttttctcactataaaaaccctagcatattcacacaaattctctcttactccattcatttgacaattcaaaatctcgtactgcactcatctttccacttttgaaagaacttcatattgtgttttactgtcacaacattttttccagttctgagctacccctgctcactatttaaattattaaaaataaaattaatacgcaatataaattataaatcaaaaatttccaatcttataatg

SEQ ID NO: 101302 - DNA, 300 bp, Heterodera glycines
  Promoter: Source sequence=SeqID_37276; Location=277..576; Strand=+; Gene=SeqID_66380
cgttagtttccattaggcgttagcgtaaaataaagattaggtttgtgttcagtgacgaaaattaaaaatataaagaacataaaagttgacaagaagggtgggtgagaggcgaggacgtacctcgcagacacacacttctggttgggttccccgcccatcacaggcaagcaatcaattgttagtcgatgattattgtactacataactcaggggtcatccacgggtcaacactgcccaacaaatgtcatcactttttgttaatgtttgtacatttactaatgtttcagaatactaattatg

SEQ ID NO: 101303 - DNA, 225 bp, Heterodera glycines
  Promoter: Source sequence=SeqID_19111; Location=435..659; Strand=-; Gene=SeqID_83849
tctgaaaaattcagaaaaatccattaatgctcgagactctcgacaaagcactagcgactgaccctaaacgtggacgaagtgctcgccgcttccgcgccactgtcgccagtggcgtcgctcgccgcctccaacaccaccggcggcggcggcggtgggtgcggcgactgatgaagcctggtggtgatttcatcgttgccggcgccgacaatttcaggcgcgccaatg

SEQ ID NO: 101304 - DNA, 223 bp, Heterodera glycines
  Promoter: Source sequence=SeqID_9603; Location=952..1174; Strand=-; Gene=SeqID_72056
atctgttgatcaacgcttgaggctattattgtccctatgagtgatcaggctcatgaaaacaattgatcatcattggaagagtctgatcacaaaaagaaccaagacagcactattgagcactctgtttcagatcagttttgtgtcacattacgcactttgagcgggcgccgctaagctgattgaaattgcgtgccgcgcccgacggtgggggcgacgggggatg

SEQ ID NO: 101305 - DNA, 88 bp, Heterodera glycines
  Promoter: Source sequence=SeqID_42974; Location=507..594; Strand=-; Gene=SeqID_70760
atagttagtccttttgttgaatttttagaaattctatccgtcaaatcggcttttggaattttaatgagtaaatcagtaaccgtaaatg

SEQ ID NO: 101306 - DNA, 609 bp, Heterodera glycines
  Promoter: Source sequence=SeqID_24591; Location=350..958; Strand=-; Gene=SeqID_55327
ggttaatcactttcttttttttcgtttttctttagcgccaaaaaatgtttcatttttcacgtaaaatgttttcgaaaagcggtgattaatattttatatgattaataaaaaaatgcctttctttaattgctttttcgtttccatagttatgtaaaggaagtaatgaaatcgcaagacatttatcgaatgtgttgcctatggttaaaggaaggaattggtttatcacgaataacaaaacgcttcaaaaattaggaataattgataaaaaaataaataaacattttttgtaaatagctttttcctggattataaataggaagcggataattaagcacccaaatgatcatcaagaattcctgaaataggcataaaattttaaaattaagaatatcttctgtgtcattttttattttatttttataaataacggacaaacaatttgaatttttgaaataaaaaattcgagatgccttaaaccattttccttaacgtaaatggtaggctcattaacgaaaaaagcaatttagtctgtttaaaaatttgtttttgaaaatacagtcaattattttaatttcaattgtttccaggaaatcattacgaaatttgatg

SEQ ID NO: 101307 - DNA, 385 bp, Heterodera glycines
  misc_feature (67)..(67): n is a, c, g, or t
  misc_feature (91)..(91): n is a, c, g, or t
  Promoter: Source sequence=SeqID_29891; Location=1..385; Strand=+; Gene=SeqID_60347
tttttcaacaatttgtattcacttaaaaaattaaaaacaaaaaattactattcattttcaattatanaatataattaccatgctgatgganacagtggtcattagtacacagaagccaaatggttttaccaatgagaaaatattaaataaaattaaattttttttgtcctttttaggtccaaccactgcaaaatccaccatcattcatagtaatgaataaaatcatttttataaatttcctttgtatgcagaatttttaatttgttatgtattttttagtttcattcaatacaaccaccaccgaaagagttgggacaaaatcaagtaaagaattttcttaattttattttatgaaaattttcatttacttttaaatctgaaaatg

SEQ ID NO: 101308 - DNA, 430 bp, Heterodera glycines
  Promoter: Source sequence=SeqID_40420; Location=445..874; Strand=+; Gene=SeqID_68757
gaatttgaatttcaattaattgaagatttattaaatcattattttaccaaatgacaattatttttgtcaataggaataaaattattaattaaattttttatttttgcttctttgcaattaagtaagattttctttttttccattaaatcaatagagttgtgcttttctgactgtttttaatcagaaaaaatacaaaatattttactttacggaagtcagaagaaaatttccatgttttatagtttgttttaatatgaaattgtttttttttgtggcattttacttcatgtataaataaatgatcataaataagaaaaagttaataattttgcaatttctttaaaaaattcgatttgagaatattgaagaaaatgaaattttcattttattagttttaattatatttttgatcgtccaaattaatcaaatg

SEQ ID NO: 101309 - DNA, 90 bp, Heterodera glycines
  Promoter: Source sequence=SeqID_10437; Location=3443..3532; Strand=-; Gene=SeqID_73636
cactgacaatgagcgtggcaatttggccttcccacgaccggccgcaattggacatgcacgtgccaattgggcgccgtttatgttgagatg

SEQ ID NO: 101310 - DNA, 1003 bp, Heterodera glycines
  Promoter: Source sequence=SeqID_69; Location=904..1906; Strand=-; Gene=SeqID_61206
ttttgattggtactaaatttataaaatatgtcgccaaaaagaagtttctctttttaactcggctctgacttaaattaaattattcaaaattcattttttatatgcgcgtctcgaatttatatagtaaataattttttgaaataatcttttttttacccatttaaaatactgaaattttttttaaattgctaaatttaaatttttaaaattccgaatggcagttgtctttttaataatttaacaggtgaaagaatgggcttctcaacttgaaagtggagatgctcaatccaaagaaaatgcattaatgaatttacggaacacaaaagaacagttaatgctacattcaattgccgaaacgcaatttacatccgagcaaagtaacaaagttaaaaaaatgtaaaaaaaaaattaaaggctaattcataaaattacttaaaaatacagctaacggtaatagtttagatggcagcccccctcatttttcgaaaaactgaaagttttttgagaaaaagttaatttatgttgaagggtcggagaatccgaactttcattctttttgatattgttaacacacatttgcgcctgctgttacgacctctaaaattgaaaaaacttaattgaaattcaatttttggcataggcgcaaatgtcttgggcgcaaatgtccgtggcgcaatagtctggacacgttttgatctatgtcgaacaccgaacccggattcaaacaaaaagtggaaaattcaaattttcgcattcgcattcagattcggactctccgacccttaagcccctaaaaaattcatttcttggtcatttcttggaaaactgtttttgacttctcagtaaacggggggccggggtaggctgccacctaaactattattgaggtaacattttgggggccgaataacaaaaatttatttaattatctcatttataagcaaatcatgtctatataattttctgatattaaatttcaattgaatctttttagaacaaaatg

SEQ ID NO: 101311 - DNA, 820 bp, Heterodera glycines
  Promoter: Source sequence=SeqID_35348; Location=333..1152; Strand=+; Gene=SeqID_64922
tacttaaggccttgtcctaaaaaaaaagatgcgttgataattaatcgattaacaatttaatggattcctatgaaatgcatttcaattaaacagtgggcaaattccaaatgacatgggaacgtcgtaattaattacatacctatatgtacatacataagcattaattattcattaattaatgaatttgatttaaatgacaaatgtcacaacaaatttatgtgttttgcttttaggctttccaaaatgagtcaaaatcgtaccatttgagttttagtcgaaatatcggagacccacccatgtaatctaacgatacacaataaggtggatactttttaatctatattctttagagggctttgcactggacttcataaattctgaggagtcattttcattagtttgatcgtattaactctctctgttcttttattaatcttaatccctctcctctcctcctttccgtgtgtatgtgcataccatttcgctgttgctgtttattagatctaccgctgccttttattagtcgttggactctaaggaaaagaaaggtgcgaattgcaatacatatttttttgttagttaatgacgaattgcaattctgctatgtgccagttgtcaatgtaattttcatttgtgagtacaacaaatgtatgtaagcgtaagctgtatttttactttaattttttgatccctatttttaatataaaaaaaagtgttaatttgatgcttacacgcaaaagcgtcatttttaattgattttaactacttcagtaatactcacaaacaattctggctttttaaaactgtcttccagcagatg

SEQ ID NO: 101312 - DNA, 84 bp, Heterodera glycines
  Promoter: Source sequence=SeqID_1621; Location=1238..1321; Strand=+; Gene=SeqID_74888
tgtttgttatttttaattaatagatttaaaagattaattaactgtttttttaatcggttttctcccaatacttaggagcaaatg

SEQ ID NO: 101313 - DNA, 301 bp, Heterodera glycines
  Promoter: Source sequence=SeqID_14929; Location=1543..1843; Strand=-; Gene=SeqID_79093
tggggggggggggggggggaggcgctcgctcatctccatttttaggcgtccattgggggaggagggccaatgctcctccaagagcccagaggacccttgcccagttgacaggaattgttgtcgtgtgaatttcggacggaccgaaaagtaaaaaaggttaaagcggaggaagcgcaccgcccaattcaacgaccgacaattccctttaattagcatcgaattacgggggctgggaaaaggaggacaaagacaacagccacaattagacttctaaagttgcgttttgtcagcttccgagatg

SEQ ID NO: 101314 - DNA, 541 bp, Heterodera glycines
  Promoter: Source sequence=SeqID_13296; Location=372..912; Strand=-; Gene=SeqID_77138
atctattgttttaaactttaatgtactttttactaataacctaattttgccttaactaattgtactttaatcttttgtgttgttctggacgacccaagccatcccccatccaattccaactcaattctcgctgctttcccaacaaaactcttttacatttgctttgcttttaatttgcatttgatttaattgctttaatctttgctttgctttttatttaattgcttttcgttttaataaacttttcttaaaagtccgtttggaatttgggtggctctagacaagggttgaacccaccggggacacaacacttttctggtgccacgacccgggacagaggtccaacagttctgagtaaagtgatttttggctgaggcttggtgcccacgccgaggctcagtgccgattcggatttagctggtcaaagttgtgtacttccagcggggcttttgtgccagaccctctcctaaagatttaagctggtcaaattgtgtattcccagttttgctgagtgctaatcgagaaaaaaaagggagagatg

SEQ ID NO: 101315 - DNA, 380 bp, Heterodera glycines
  Promoter: Source sequence=SeqID_2173; Location=2669..3048; Strand=-; Gene=SeqID_78278
atcaacaaatttaaattgatcgaattgctttcgttgccttcgcttgccaatttggaaaataaagccaaagcctaattgttcaaaaagtgtaacttggcgctcctggacgaccaaggtctggctcagtgacattttcattaaacggggataaacgcggtcataaaattgcttgaaaaccgacggttgaagaaatttgaaaaaagccctcgtgttggcgcattttgttgatttgattttgtcctcgtgtgggactgtacaacttctgctcgacaattgtttaaaagtactcgtgttgtactgagcctagatttaaaggcatacaataaactcgtgttgtttgaaacaagttaaatttctctcgtgcttgggaaaaagtgatg

SEQ ID NO: 101316 - DNA, 158 bp, Heterodera glycines
  Promoter: Source sequence=SeqID_6535; Location=1284..1441; Strand=+; Gene=SeqID_61926
agtgactgcctttgaagtgccaattctccccaatttgccctttttaggcactgattttccttgtactgctcgaatattcgttcgtctcttatttcttctcacgacggtcctttgactgtgctcaccgaattttacgcagcgaaagtgccgggaaaatg

SEQ ID NO: 101317 - DNA, 234 bp, Heterodera glycines
  Promoter: Source sequence=SeqID_39281; Location=1..234; Strand=+; Gene=SeqID_46593
ttccgcgtgttggccgtcaacgaagcgggtccgtccgcaccaccggccctgtcagcatcgcaaatctgcacggcgcgcttcctgaagccgcagatcatcaccgcgcagcgcaagtggaaagtgcgcgcaggcaacacactgacgctgggcatcaattttgttggcacgcctgacccgtccgtgtgctgggtgaaggcaggcgggaccggcactctgccacccgagctgattatg

SEQ ID NO: 101318 - DNA, 964 bp, Heterodera glycines
  Promoter: Source sequence=SeqID_1848; Location=6389..7352; Strand=+; Gene=SeqID_76348
tgaaagtaatactgtactatctaacaaaaaataaataaataataaataaataaaacaattccattataaatttaatggtataattatgctaaaatgagcccaatttatttggagtatcgaatcaatatgtcaatggcattggtcagcgccccccttctccattagcaaaagatgatgctgttttggttctcaacccctcactttgtgcacaaaatttttctctgactgtctgtctctctactctctcacccaatgtttgtttcttctctctctatctctctctctctctcaccgtttcactctctcacttttgcatacactcttttctctttctccacgcgccgccgttcctcgctgcagcgccgctgaccaccagcaccccccccccttccacacaaataattaatcactctcccaccgccgcaacacattccattggcacaacttttttttaccaaaaaagtttgtgccccccccaatacatcaaaagttttttccatcccccccccgtccttgtcaaaaaagtttccactccaccagcacttcaaaagcgacgccgccttccccccgcccgtgtgccacaggcacacgcgcggtaaaaccgcgcgccgcctcactcgcaccccctcccaccccccgaacccgtgccacaggcacgggttcgcgcggtaaacccgcgcgcggcggcccgagcgcggctatgacaacgcgcagaaccaaagcctgctcgccttacgcttcttccactggtacgccaaggagcatggagtgcaagtgcagacagcccacgcggctggaggagagaagcgcattgggccctactccttggatggatggattgaggcggaaaggcgcgcaattgaagtcaatggtagctgaattttatgcacaattattttaaaatgtgctattttaaggctgcacgtggcacgggtgcaaaaggtgttaccccaacgacaacatg

SEQ ID NO: 101319 - DNA, 227 bp, Heterodera glycines
  Promoter: Source sequence=SeqID_13902; Location=2046..2272; Strand=-; Gene=SeqID_77852
ttatcacgggttggtcataatcaaaacggattccgtaaaacattttggccacgacggcacagagtccaattgtggcattgaccgggccaccgcaattttattcggcaaagagggagccaaagtgacaattcagggcactgaagaggccgaattgcatgtagaagaagcaaaccccgagttttaattggcaaaacattcagcggacggtggtgcaaatggtcagaatg

SEQ ID NO: 101320 - DNA, 712 bp, Heterodera glycines
  Promoter: Source sequence=SeqID_13845; Location=3468..4179; Strand=+; Gene=SeqID_77787
ttttgccagtgtgcagcaacagttgctgttaatgaccgttaattaattaattaattagcaaccgggcacagcgcctaatctgtttggcgtgtcacagctatagccctaggaattggacggaaaacaattgccgtgagttatatttggttcctcaccatgccataaacgcaaaaatttaatcattaaggataagaggaaaattaattttaaaaaagtttggcaaaaaataaattaatttaaattgactggaaaactatatggttataaaaagtggtttcgatcacttattactcaaactcatagctaaattttggtacattaaaaagaaaataaaaatattttttaaatcattaaaaaatgaatgagtcaagcatattgtatttataatttatttattttaacttaaaattttaatatgaatattaagtattttgaccaattttaagtaatcaatttttaaaagaatttgttttttaatctttaacaatattccatactgtactttagctggctggccattttcctgtgacttgtcgctaattaattaattaattaaaggtaaacatatccaagggatctgcccttcacttttctctaacattttcagaacaaatttgtaatctttttttttctccggaggtcatttggtctttatatcccactcattaatgagtcattcattaatggtcgaccgttgtacaaattcgacatg

SEQ ID NO: 101321 - DNA, 1003 bp, Heterodera glycines
  Promoter: Source sequence=SeqID_19313; Location=389..1391; Strand=+; Gene=SeqID_84050
cttagaaaatttttcgtaaatttacacgatttcaattcatttttcgggttctcagatcaaccaacataaaggagagtaatgaggcgttgcaattttaattctttaatcaatttaagtagtggattttgagaattaaattcgttttttttttaatttatttgttttaattaagaaatcattagctgaacctatgaagttaaatattttatcaaccataaataaaatatataagtgctctcaacaaattgcttaattgtttgatctcccgagcaaaaaaaaaaaaaaaatatagaacaatggagatcggccaaagccacttcagcaagcacaaagctaaggcagctgctccaaaagtccatctgagttttaagcaaataaatttatataaataattttaaaattttaatttaattaatatcaattattttttgatttatattgttccattaagtttgttgttattaggaactgaacaaatgttttcgattgatattatcggataaaacgtcgacgatatcaatgccgagaaaattttaaaaaacctttcaaagctagaattttcaataaaatatctttaaaaaggtcgaaaatatcggtagagataaatacctaatcatgccggtctacatatcttatttccaggatagattacttttagaattccaagaatttaaaatttaataaaatttattagtaataatgtcctttattatttcaaggttgtccttattttatccttatttatgggacaaatctttattttacgggctgaacgtattaaacaaattattttttgacctattttgaatagataaataataaattttgaaaattccaataataataagtttattttaacccattcaaattcaattaagaaagttgtttctatttttttttgaatttttaaatttaatattcaatttattttttatttatatacacattattattaaatattatttcaatttttaagcattattaatttttgtatacaaaaatg

SEQ ID NO: 101322 - DNA, 524 bp, Heterodera glycines
  Promoter: Source sequence=SeqID_758; Location=770..1293; Strand=+; Gene=SeqID_46194
aaaccactcattttttgtattcattcattcattttaacgtaaataaaatggttcatattgtgtttgaccctcgcagtgccgggtacgacgagtatgtgcaatacggtagcggaatagaacacgaacatcacttcattgggtccagtccctttcaacgagggtatgggcagcggggagcaggggttggagacgtgtttcgcggtctttggcgcttttttctcccaatcctccgccgcgttggcaccacggtaggatcggaggcattgagcacgggtcaacgagtgttggagcgagtcgggaacgacggaatgccacttaaggaggcactggtaagcgaaggaaagaaaggaattgataccgtattggagaagggaggcctaccaaaacagtttggcagtggtggaagaatgggtataaaaagaagaagaaaacacgcaccaagtcaccatacaataattggccgaacaatcagtaaaccagcgagaaaacgtgttcgatccgacgcatttggactttactaaatg

SEQ ID NO: 101323 - DNA, 215 bp, Heterodera glycines
  Promoter: Source sequence=SeqID_3454; Location=910..1124; Strand=+; Gene=SeqID_84742
aaccttttaattatttaaaactaatgaataataaacatcagcatgaattccacaacgtttgcatggaactatggtaagtaatgcatactgtagtacaaaacgtatttgttcaacagaaatttaaacattaaaccaatgcttttatgcgtaattaaggctcctaaccaagggcaattgtccaatatgccgtgccgaaatttttgtcatcaagaatg

SEQ ID NO: 101324 - DNA, 514 bp, Heterodera glycines
  misc_feature (119)..(119): n is a, c, g, or t
  Promoter: Source sequence=SeqID_22437; Location=634..1147; Strand=-; Gene=SeqID_53108
atggaggaggagagggcgcagcggaacggcgccaccgatgatgggaagggacggaagcggaaacaccgcggcgacgaggcgcacgcagcacaggccgaaggagtacaaccaccacaagngcaaggcgagaaaatgggacaaaacaaatgccaatcaataacaatggacttgctttttttattacatttcctcatttttttacacatcaccacttttaccaattcaaattattagagatcgcttttggaaaacacttttaaccaaggtccggattttgaccctaaaaatctccgagctacggctgaaattttagaggttttaaaaatagtatttttctatatgatttggcgagtgcaaattatttttaatgagtcttgcgaacaaagaaagggacataaaatattttacaatcagacaaagtgctatcagaaaaatggtaaaaatattaaaaaactgaatactaattattccagaaaagaacaaatggaagagcgcgcgggccaatgtgaacatg

SEQ ID NO: 101325 - DNA, 954 bp, Heterodera glycines
  Promoter: Source sequence=SeqID_11911; Location=2914..3867; Strand=-; Gene=SeqID_75425
tttttaatcaaaatgctttataaaaatttcaatgaatttcttcgccaaattgttattgtgaatttcagaaaaaggaattttctatttaaaattaaaaaattcagaagcaaattcaagaatttttttatttttaaatgcattttttaccacatgaattatgattaaatacgccaagtacctcaaacttgggtaattaaaccgaagaaagccgtgcaatggggaagaatgacgcctaaaatgaaggaaatattcgatgctgtgcgaacactttgtgtcccctttatgactctcccaatgcagcagttgtccatttttaccactatttttatctcactcatcgtctgctcgcctctcctttttatcagctattttccaaagccaacgcccttttctccctcttttttatgccaaaaatagtcagaaaatagaaaattctcctttttttgctcaattttcttcaaaataaataaatattaaaatttgaaaatttgccctcaatttggaaaaatttatgtgcatatttttcactttttatgcgcatattttgcgattttatgtgcatataattaccatccctactcatcatacgttatggattttaagcaccgccgttaggcagcgcagttccaaaattattccttttaaatttaagatttggtcgattcaatatttatgcattacttttgcaccacaaaaaggttgtttttttttgactcggcaaattttctaatggactaggaaactaaatattatattttattcttgtacttttgctgtactttcttttcccagaatttaattatttacgttattttttcttaaatgttattctttttttatgtacgacactttggtgtttatcctttcccttctcattccttctgacattgtaaaataacaacaaaacaatcgcacggttcatttgtgactgccatattattgggcatgaaaatg

SEQ ID NO: 101326 - DNA, 676 bp, Heterodera glycines
  Promoter: Source sequence=SeqID_7940; Location=196..871; Strand=-; Gene=SeqID_66444
agggccgcattggacgaacatttgggcccccaaaatctcatcgacgtacttcgtgtcatccaggtgattttagaatgggaattcaactttttttaaattgaataatttgaaggggtacatttaggccttctcttccctttctccgttttttcaacccaaaaaattaaaaaaatttttttaatcaaccacctgaacactttgtccccttttagatgctcacttatgaacgcgtcaattttggcgattggaccaacgaattgttgccttttttgacgcggcaaatgtatgaaaattatggggaggactcaaaataaattttacgttttgtttttgttagtttggagtccgattccgtcccttcgtccgccgaactgttgccctattgcatgtgcattttgtgcaatttggtcggccagtccaagcagttcaccacccatttcaaagaaatggtgggtggatgatggaaggggacatttcgcggtttttataacacttacccatttcaactgacaaattttgaggatttttgggtctaattttgttgaaaaaataaagcgaatcaagtcaatgaatggcgaaatgacacttataagcacctccggtgaaaatttcttttttttctagaattttaaaagaaaaatatatttaaagaattcctttcctttttttcaggatg

SEQ ID NO: 101327 - DNA, 161 bp, Heterodera glycines
  Promoter: Source sequence=SeqID_28930; Location=750..910; Strand=+; Gene=SeqID_59499
atcacacagctgatttactctcacaatgttgttgccgataaattgtatgaattcgaaccatttgaatttaacaattaatagcggatttctattgtctgtgtttcattatttattttatgagattattatttaacttaatttcaaatgcttttagaaatatg

SEQ ID NO: 101328 - DNA, 787 bp, Heterodera glycines
  Promoter: Source sequence=SeqID_8857; Location=563..1349; Strand=+; Gene=SeqID_46653
gaccgatacaatgatgatgatgatagtgatgatgttcagttgacattgttttttgttttttttttgtaaaaattaggcgaatacaaataaatggaaatgccctattttttcaattatttgatgtactgcttgaacttgacgccgccgcattgggtggtgcaatttacctttcatttgccatgtgtttttgtcgccgcttttcgatctattgtgtgcattggccgtgccgtctgtgcattggcaatatttttttgaaaattattgggcgctcccctcccgatattccaacgtctaacagcgcgcaattttaccgttcgacgccggaaaaccccgagatttcaccgattcataaaaactgcccatcaaaatccacaattttgacgaccagccaaggaaaaacaacgacaatttaccgattacaaccttccgaattcgattatttagtgtccatttaggtttttccgacattttatggtagtaattttttgcaattagcccgataggaagtaaaagacggcggattgttcaaaactaatcggtgaaatggtcgaatttcggcttacgaattttaccaattctttaaaatttgctagactaaaatgatttacttcgtgtacttctcattgtctctgacaatcttccagttttttcatgacgtttttgtgccaaaattttgcatttttacgcctcatcccgtcattaataaatggatttttaggttttttttttcaattaacttcgaatttgtctaaaacattcccaaaacaacaacggcaccgaaaaaatg

SEQ ID NO: 101329 - DNA, 140 bp, Heterodera glycines
  Promoter: Source sequence=SeqID_24872; Location=1039..1178; Strand=-; Gene=SeqID_55621
atggaagtggagaagcggagcatttgctgggccgaatcagtggactccgaggacaattcgcacaacgaaaggccgagttgggcaggcgcagggagacggtacacactttggaggaactgtactcgcaatgcgaagagatg

SEQ ID NO: 101330 - DNA, 348 bp, Heterodera glycines
  Promoter: Source sequence=SeqID_2660; Location=1..348; Strand=+; Gene= SeqID_80937
acatcagacagttggcacgtgtgcgaagcgagaggggtgcgcgaaaactagtgcagcagtcaggcggatcactttttgcccctttgttggcccccattctgattgaggctgcccgatacctgctttcgcgcagcaataatggccaataaacattctgctgccgtacgagcactacaaggggctggttgcagcgagggagacaaagaatgacgacgatgacaacattgctgagcggacaaacttgggctttgtcaaacgataagtgaccgctgcagtacagaagcggaagggaaacgtcagcgaacggaacgcatgtacaaccagcagctgcgccggtacctaaagatg

SEQ ID NO: 101331 - DNA, 398 bp, Heterodera glycines
  Promoter: Source sequence=SeqID_22633; Location=1..398; Strand=+; Gene=SeqID_45727
ttttttcttaattttaatttaagatttgggttattagaatttaaaaaagtctttagaattcattatcctaaggtaaaaaaatatcttttttaaataaaaagtctgaatatttttaaggaaaggacggttaatttataaggtccgctgattttaaaggttaacatcatctattcttttaagccattgacgaagcttacaacggtacatagactgataaggaaatttaaaaatttagtcagttgaacggttaaatttcatggggccataaaaataatattttttaatgacagttaaattagaaattaattattaaataaatttaaatggagccttaaaatagtatttcttaatgacgcgttcattaatataaattaattttattaaatttttatgacatg

SEQ ID NO: 101332 - DNA, 308 bp, Heterodera glycines
  Promoter: Source sequence=SeqID_12237; Location=2477..2784; Strand=-; Gene=SeqID_75809
atttatttattcgattatttttggaataatttttttattgttattttattgtatggcacttgagaaagaaattggcagaaaaaaattgtttttgttgcgccaaaattggaagtatttaagggcatggaactgttgttgtggcacattcaaaacattttcaacaacaaattccttcccgaaaattcaaataatccattcaaaaaatggctttatcagcaattaaattgtaaatatccgtcattaattacccaattattaaaaatccctttaggctttcactgtttctgctcgtcctttgtattggcatg

SEQ ID NO: 101333 - DNA, 190 bp, Heterodera glycines
  Promoter: Source sequence=SeqID_28853; Location=222..411; Strand=-; Gene=SeqID_46139
atttgaattttgtaattgttacttttttgtttgattttttgtttggttttggcgcatacatttccatgaacgtcacaatattctcgctgattttgcttatgttttattcattttctattttaatatgtttaaaaattgtatggatttgtctttaaattggtcttttatttaagatttaatttccaaaatg

SEQ ID NO: 101334 - DNA, 1003 bp, Heterodera glycines
  Promoter: Source sequence=SeqID_10240; Location=1462..2464; Strand=+; Gene=SeqID_73387
atcgagcccgtttcaagatatttattttataaatattagtttttaaacagtgtcttaagtagttagtccacggtacccgtcgccgtcgaagtgtgaaatttcacacctcaacagtggccgggttttcacacctcaacgatccccggttttcaccttttttaccgcaaaaatccaaaggtattggctgttttttcgcgcattattttgggggaggggaaggaggtcgacggtccctggttttcacaccaaacggacccgggttttttttttaccgcaaaaacccaagggtatgggttttttcggcaccgccgggccccctcccctcgctcatttcctaaaagttttttggaaaaatgcgccgtaaaaaattgttaaaaatcaattctgatcccaaatgcattgaaatttatgaattgcttatttcttctccaaaattgtaaattcgataatgggaggtgaaaattatattatttaatacaatataatcgaataaattgtaaaaaaataaatgatttgaagcaatttagcaaaataccctgatttttgaccttaaaatctgattttttgcacatgatagtctgatttttgaagattttcgatcacaccgctattttagatgacttgaaccctttcagtaattttgaaactaacccacccccacccccattcaaacccatcgcaaattttggtatataccgggattttaactaattttttatcaatttattgcgaatgggaaagtctacttattttctcacaatcaggaagatttaaccttgtaaataattaattttttgctagatgttcaattttctaattttacactatattattatttagttttgccttttaattttttttatgttttgataaatgaagagaatttataattttttatttaaaatttaacggaccaaaaaatgtgcaaaaaaagagatagaaaattttaaatttatcggacgaaattggagaaaatcttcggcaagaatttgagcaaaaaatg

SEQ ID NO: 101335 - DNA, 1003 bp, Heterodera glycines
  Promoter: Source sequence=SeqID_7485; Location=1080..2082; Strand=-; Gene=SeqID_64965
ttttggcgaatttggcacccctccgattaaaaattattatcttttagatattcttcatcaataaattttcctttttaatttccctacaaaatttcgccaaaatttctgacattttcgccaatttctttcttttgaccattcgctgaagaaacgcggcacagtaaaaatggccacgtttctcaaacaaagcagcagaagcagagaatccatgtagtggggagagaaaggtgggaccattctcagaaaacacggcaaaaatggcaaaatgtgaaaaacggcaatggcaaagcttataagtccagcccccgttgatccgatcatttgctgtccattccctcccctctccttcctaagttgatctgatcattcaccccccccccctccccctctctccccttttgccattggttttgtccccatctgatcatttgctttttgtttttccaattatcatatcctcactttaccactcttccctgcagcacaataattgcccttttcccggtgatcgccggtcgtcctcaaatttttctccgaattcctcgcccttttcgcctcccttttttctcccaatttttcctttcccattgccaatttctcttcttcgtccccataattttcttcttcttcatttccctcttcacttcacttctgctcactttcttcacacacaacaaattcatccgccaaaacgccttcgccggacagacaaagcgcaaatagcggcggaagcagcggaggcggcggtggggcgcgactgcgcagtcgcaaccgcctcctccaacagaagcagcaacagcaacaagtgggacatggccaaggggaaaaagaggggaaaggaggagatgaagcggaaggggaggggaagcgaggggggggggggatgaggaacagaaaaagtgatcggaagtgggaaaaggaattaaggaaagcctaagataaatggggaggggaacgaggaatacaaaaactgatcagtgattggaaaagcccaaaaaggatg

SEQ ID NO: 101336 - DNA, 1003 bp, Heterodera glycines
  Promoter: Source sequence=SeqID_318; Location=918..1920; Strand=-; Gene=SeqID_81969
atgaaaattgtatactgtaattggaaatcaggtaggttccttcacaaaccaattaacaattaaaagttttcagaaaattttactatagtaaaactctctttcgatctctcatgcattttcctctaccgtattttctcaccagcagtgagattaaatcaataatgatcactagggagtccaattatatggaaatccatatttttttcctggactgttgagggcctgaaacgcacgaaaaacatgtttttagcttggtttgaagcttgtaggaaggatttatatatccatattttgcatattttggcattttggtccatattgtatgtccatattttggcatttgtcaaaaaaacatctattagaacggccccagcagctaaattagcctttttgagcccacaacccgaaaaatttttcaaaaaaatcattttttcgccaaaatttctcgagaatattgaataaatttaaattttcttaaaaattaataaatttatgtcaaaaataagcaaaaaagcgaaaatttcgcttttgttgttgattttgcgctaaaaaaattaataaattttagcttttatgtttttttttcttttaaaatgattgcacgtaattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaacaaatttgaagaaattttgcactcaattttgaaaaatttatgtccatattttgacatttttgccatttatgtccattttcgcaatttttgccattttatgtccatatttttggccatatttcgcgattttatattcatatttttggactccctaatgatcactatatatatatatatatatatatatatatatatttatttatagaaaaaaattatttttcttttttaaaattgaacagccagtgacaaaaccgtaagtcaacaaatg

SEQ ID NO: 101337 - DNA, 238 bp, Heterodera glycines
  Promoter: Source sequence=SeqID_6511; Location=343..580; Strand=+; Gene=SeqID_61835
tgcatccattccggccacaatgtcccgcacgatgaaccggtcaccagataaatggcctctgccaaaacggtccacgccgaaacgtcctggcccgtcaaaatacggtacattgacctttatttttatttcctatttaaaatttggcgaaatgtttttttctcgttgtgtcctatgatcgaaattgaaaaccaaatttcaggctgattgtaagcttaattgaaacagttttcttactatg

SEQ ID NO: 101338 - DNA, 464 bp, Heterodera glycines
  Promoter: Source sequence=SeqID_10647; Location=1634..2097; Strand=+; Gene=SeqID_73886
tttccttttttttgattgtttttggtgcacttcataaataaagagaatcagagcctaccattcactttgacgggcaaaacagaatatcgaattttctaaagaaatcatccaaaactttgagtattgtcaaggggtagtgtttatcttccgggtatttaactcgacttattcattcagcacatgtacattggtttaccaatcgagtagtgtgtagtaaaattaacgaagggtagagagaaatgaagtcaaatagaatttttttcattccgtcttcaaatccgctcatttatttgttgctcattaacattttagcgatctcgtagcctaatacacttacaactggatggacaacttgacttcgtataaattcaaaacgttttactttcctctcccgcactttatcttttatttttttcaattagacattaatatacatcttctaggtagcgctaattgcaggcatg

SEQ ID NO: 101339 - DNA, 350 bp, Heterodera glycines
  Promoter: Source sequence=SeqID_6710; Location=4747..5096; Strand=-; Gene=SeqID_62579
acctctccattttccctcaacattcttgggattaactttctctctgaccttcctcattcacttcaaaaatatattcactcatcaatctctaaatgccttcctttttcctacacaatttaaagtgttgctggtcgtcgttactccaaaaaatcagcaaaatgaaaattttaacaaaaaaaataataaaataataaacaaatgtttaattttttgaatgacgtcatagcgcaccatttagtaatttaaattctttgcaccaacaaaagagagacagacagtaagtgaaaaattttagcgccattttttggaggtatttatgtgaatttatttatttttgatccatgactatg

SEQ ID NO: 101340 - DNA, 334 bp, Heterodera glycines
  Promoter: Source sequence=SeqID_3206; Location=1559..1892; Strand=+; Gene=SeqID_83709
aaaaaaatgaaattaaatcacaaattaatacataccgtaatcccaataaaatagctttggtccataaaccgtactgctttttgtcggaccggcacctaaacgcttgagaatcggttgagtgcgatggcaatgtgcagcatgtaaagtgcgtagttgaacaagtagatcagaaatgtgccgacgttgtaaaatgccgacggcgaagtgccaaaccatgaggaagtggggccaaaaatgggcagccaatagtacacaacgtcgatgatgtaatggccaatttcctttattaatataaaaaatgtataatatttttaattttagttttaccaaaatg

SEQ ID NO: 101341 - DNA, 114 bp, Heterodera glycines
  Promoter: Source sequence=SeqID_23699; Location=296..409; Strand=-; Gene=SeqID_54393
gccatattttcgtcaatttgtttttgttttaccaatttttgtgtttagacatttcgccgtgccaccacttctgtctgttacaatattcaactttatttttgggtggacacaatg

SEQ ID NO: 101342 - DNA, 582 bp, Heterodera glycines
  Promoter: Source sequence=SeqID_22794; Location=1..582; Strand=+; Gene=SeqID_53491
ttaaaaatttattgtatttaatagatttttgcacaacccttgaaggaatatagattgaactttcgaaaaaatcgtaatcctttttatttttgttaatataaaaattcggctattttttaaaatatattttaggaaaattgatttcattgattcttcatctttattcgattagcattataaaattacatttgcgaaaaggctttcattttacaatagatttaatttttaatatttcctactcattcaattgtaaaattatatattttttcatttgatcatttatagaaattgaaatagatataaaattttaattcgtaatttatataaatcataaattggaaaattattatttgctatctattgaagccatcggaaatgtcttattttaatacttctaaattagaagcatgaaatatttttaaaaaaattatatataattttttaagaactatgtaggcttcagggattgaaaaacttaagttagaacccgattttcgacataggctcaaatgtaagggaaaccatctattcataaattataagaactgtcctacaaaaaggttccctttcaaagaaaagatg

SEQ ID NO: 101343 - DNA, 1003 bp, Heterodera glycines
  Promoter: Source sequence=SeqID_17686; Location=755..1757; Strand=-; Gene=SeqID_82214
aggagaagcggatgccgaagggagcggaaggatttgcgaagggcgggaggagagacggacggacggaggagggatcggacgaatatttgtgggggagcaggcgaaaaaggcgagcaaagccaacagaggcaaccgcccgcatttacactctaaaaaccctttctggatcagtaaagttgccggattcaagcaaaaaatttgtcaaaaatattgcggatcaattaataaaaattgaattaattaccaaaatagccgagggaaagagttgggtttgattatcaccgactgactgatcggcgtgtcattgcggacgcggagcgctggaggctcccgggggggggggaaggacgggggaactcagatatgatcgagagtgatcggacagcgatagcagtcagtggctggtagcagagtttttaatgctggtattttgcgtcggggagagctgggttggtggagggcgatcaaaattttgttggtggcgcggcgccgccagccccgctgttgtgtggtgacagacggacgggcgatcagtggcgactggcgctaagcaacggaccgatacccacaaaaaccaccaccaccaccaccagcgtcaacaacacactctgattatgatggtggcggaggtggtggtggtgttggtgggttatcaggaaatgggggggggggaattcggggagaggcggggggcagcggagcgtaagactgatgcaaccgatcacaaccattactataaccaagcaacccaaccaattgcagccagcgcctgcacgatggcgcgactaaattggtggtgtttgtgacggaaaaggtcattttttgatcaagcaccggaccgatcgacgcgcgacaaaaacaacgcaccgatcgggctatttaagcgcaaaagtgcggagcgaaaagcaaccatttaattgtttcgtcgtctactttattttttaaaaatccattcccccgtcctttctaaaagcagaaaataaatattttattttgaaaaatg

SEQ ID NO: 101344 - DNA, 399 bp, Heterodera glycines
  Promoter: Source sequence=SeqID_36871; Location=1237..1635; Strand=-; Gene=SeqID_66084
ttaattgatatttcgcaaaatttcccataacaaataaaaataaaaattcactcctaaaatgacttaaaattctataatacctaaaaagcaaaattcttaagaatggtttccgaaaatttacaccacaatttgtgatcccaattttttttcgtattttaatatttcattttcgaattaataaattcattttagccaatttaaatagaaataattaaccctttttttatatttacagaaaatttcaatttccaacaattgtttttcatctttttctgattatgccaatttttccaacgaaaacattcaaatttctgataatttttgccaactcaatgatctattttttgcatttgattttattctaattaattatgttttttattacagtactacttcatg

SEQ ID NO: 101345 - DNA, 94 bp, Heterodera glycines
  Promoter: Source sequence=SeqID_32614; Location=1111..1204; Strand=-; Gene=SeqID_62915
caaaattttgttttgtttctcaaaattctacttgaaatattttctgttaaggaaatggcgggacgaggacaccaaaagattgaacccgctcatg

SEQ ID NO: 101346 - DNA, 541 bp, Heterodera glycines
  Promoter: Source sequence=SeqID_3034; Location=1..541; Strand=+; Gene= SeqID_82868
gagtaaggaggaatgagcaaaatctcgatatttacattcgcacgacagcatggaaaatggcgtaaaatggtgaatgaataataaatatttgggcatggaaaatagtcaaaaaaacataaacaaactatggcctgaagagcagcacaccgccacccatgaagcacaagacgacagggcacctaaacgactcgtgaaattagtcaagtcaagagaacgacctcaagccctaaaaggaaattgctgccaggataaacggagctttgtgtaattaaagctaccgccctggttaacagcaaaaatattaatttaattatacggtccccaaaatccccaattaaataatacggtccccataaagtaaagaaaaatgagtagaggaggagagagaaacagcagatgtgcaaaaaaagataaaatttttaaaatgaatcgggaaaatgaccgggtgtacgttacgcgtacttaggccacgcccacttgcgcaccaaaattattcccaacaagaaatcgaaatcattctttattcaaattttggaaaatg

SEQ ID NO: 101347 - DNA, 167 bp, Heterodera glycines
  Promoter: Source sequence=SeqID_20835; Location=1157..1323; Strand=+; Gene=SeqID_51420
acttaagccataaaataatagtaataatgttaagtttattgtctttcaattatttttttttaaattttattactagagcccggatttttttatggttttaaaaatttttctgctgcttagtcatgactagggagtccaaaaatatggatataaaatcgcgaaatatg

SEQ ID NO: 101348 - DNA, 506 bp, Heterodera glycines
  Promoter: Source sequence=SeqID_26008; Location=1..506; Strand=+; Gene=SeqID_45968
aaatcagaaatgtatgtggaaaaaagtgatctttgcgtgccaaatctcgttttgtgttgctgcttgaacttctgccacgtcgattcaattgtgttcgtatgctgcccagtgaaaggatccttgaattaatccatttgtagcgcatttcgttgccacagtcacaaaaacgagtggtgtgtagaagcttaagttctctgagccattcttcgaattcttcgtctggtagagccaaaactttgaataaagcatcaagtttaaaatttttaagtgtttccattaatctaaaagcaattgtgacaataaaaaagtaaaaaaaactgaaaaatgtgaaaaaaaaaaagcggacccaaagtccactagtacctaaaaatcaatataccaccgaaataataacaggcgaacgtaatataataaccttctctaattaggtgcgaaacgttcgctgtgtcaaatgtcgcgcgtggggtcatttgaacacggaccgcgaatgcccactgtatggtatg

SEQ ID NO: 101349 - DNA, 703 bp, Heterodera glycines
  Promoter: Source sequence=SeqID_2772; Location=4745..5447; Strand=+; Gene=SeqID_81509
aattaagtaaaactttttgttttcctcccttttcggttcaatggcattctttggtcccttttgtttcctttctcggtttttaaggcaattcctttttgttgccattttacttcataattatttaattagttaattagttgggtaatttcatttttgccccctatcatttaagcactttatttccttttttgcactcacaagttttttttatttcacccctccttaacttccggtgttcacaccgtttacgctgtgatacaatcagtaggaacactttctcaccacattacggtattaatggatttccgctatttttttctcacaaagcgatttttacattagttccgataaaggaattattgtaacacgggaacgacagccacgcccattatcgggggcctttaatctaagcacttcacattcattcattcattcttccattcatttgatttactgttctccactttagatactcttgcacaatcccactgctacttctcatctcacatttgctctcattatgtttcctttctctggtgggggtccacctaatcaaagcgcggcggcgtcaagcaatgcgcagacagaccctgaggggctctccaaagatttgcctgagttatcagtggttgataaactgatgtttgctggaaagattctaagcacgccagcacgtttgtctgatgagaacaaactccatatg

SEQ ID NO: 101350 - DNA, 65 bp, Heterodera glycines
  misc_feature (37)..(37): n is a, c, g, or t
  misc_feature (46)..(47): n is a, c, g, or t
  Promoter: Source sequence=SeqID_10095; Location=1..65; Strand=+; Gene= SeqID_73162
tttcccggaatctgatccagatcccgactttttccancaatgcacnnatctcaaattttccaatg

SEQ ID NO: 101351 - DNA, 311 bp, Heterodera glycines
  Promoter: Source sequence=SeqID_18142; Location=1..311; Strand=+; Gene=SeqID_82730
ggggggggggggggggttggggccaagtgcattaattattgctgaaaggtgaaaaggcgagttgagaagagaaatcgcggatgagtgacgagcgaagtgccgatggttctgcttaattatgagaggagcttgtcatcaccgatttcattctcattttcgttttaatttcctttaatttccatatttgggcatgtcatttgtgccattgactaaatatgccattctttggccaaaagcccttttttaattgttttttaaagttttaaatttagtattcggacatttcacaacagcgaattctccacaaaatg

SEQ ID NO: 101352 - DNA, 77 bp, Heterodera glycines
  Promoter: Source sequence=SeqID_37838; Location=975..1051; Strand=-; Gene=SeqID_66826
ggggaaattaataaataaatatataaaagcgaaacaacaggaacactcatatatttgaggagagcgcaaaaaaaatg

SEQ ID NO: 101353 - DNA, 485 bp, Heterodera glycines
  Promoter: Source sequence=SeqID_15985; Location=1..485; Strand=+; Gene=SeqID_80342
caatgacgtggagatcttaatggctgcgttggttgcttttcgtcgagaattcattgggattcaaaggcggcaagagtacgtcgatggggtcgacgaccgggagaaccacgacgagaattgatgtcttacgggagtgcatgaccatcgcaagtgcgtgcatgaaacacttccgcaccaatcacctcccggctgagcacctcgccattgtacctgagcgaggatatgacaacgctcaaaatcagtccctccttgcgcttcgcttcatcaaatggtatgaagaacggcatggcgtccaactccaaactgcgcattctgccggtggagagaggaaagttggcaattactctctcgatgcttgggttgaagctgaacaaagggccattgaagtgaacggtaattttacttttaaacattttaaaatattgtttttaaaaataggttgtgtgtggcacgggtgccaaaagtgctttccggatgataatatg

SEQ ID NO: 101354 - DNA, 205 bp, Heterodera glycines
  misc_feature (19)..(19): n is a, c, g, or t
  misc_feature (31)..(31): n is a, c, g, or t
  Promoter: Source sequence=SeqID_14616; Location=1..205; Strand=+; Gene=SeqID_78697
ttttgggctgcgcttttcnggggaaaaattntcggtctaactatccaatttttgggttcattttatgctaaaattcattggttttttttaaattcataaaatttcgagtttttttctttgattatacgacgggttctaaatttttttttcacaaaaaaaaaatggagacttcgcgtttttgcaggtcaaggccagctgggaaatg

SEQ ID NO: 101355 - DNA, 192 bp, Heterodera glycines
  Promoter: Source sequence=SeqID_9401; Location=654..845; Strand=-; Gene=SeqID_71280
agtaattaacgaacaaaaaaaactaacgatatcaatttttgacgaatttttttacaggaaaaattaaattatatttcataattgggcacaaattaatttattttaaaaaagtatttgggggattaattccaaaaaaatgccattcaaataaaagctcggcatggcgctgggcaggacggacagcggacgatg

SEQ ID NO: 101356 - DNA, 558 bp, Heterodera glycines
  Promoter: Source sequence=SeqID_10781; Location=1..558; Strand=+; Gene=SeqID_74037
tattagtttttgattttctactaattttgggcaaaccattggcgacattttttgaaaattcatgccatttgaattaaccttatttaacccagaaatactgcgaactcaaacattagaaataaaagaagtgcaagctccaacatgaaataagataattttgaatattctgggctaaattttaaaattaatgaaaacaatttttaaaaatggaatgagtcttttgatgagtggatatgagccaaatttattttctggtaagaaataaaattcgaatccataataaaatccatgttcgattaaaatccgacaaaaacaatgaggaaaaaagtgaaaaaacgaaatccaaaaaatggcatgtgcactaatttagtttaattaaataactaaaaattgctatcctaatattttatctattaaattaaaaaattaaacaatgcaaaagaatttggcaaatattattgtaaagtcgcaaaatcggacaaaggcccaaggcaggtcaacatttccattctcgtcattggcagcggattaaatgtggcggtgaacaacagcaaaatg

SEQ ID NO: 101357 - DNA, 464 bp, Heterodera glycines
  misc_feature (9)..(9): n is a, c, g, or t
  misc_feature (28)..(28): n is a, c, g, or t
  misc_feature (37)..(37): n is a, c, g, or t
  Promoter: Source sequence=SeqID_45395; Location=840..1303; Strand=-; Gene=SeqID_72693
ttttttccnttggcctaacaaaagtaanggagaattntggctctgggagaaagacactattaactattagcacttatgttatcgcctctatcaattaattatcctaaatcattttgtaacgtttgcattgttaaaacaaatgtattttattacttatcattgtattgctcgtttattaacacacaaatagcaaagcattcgattgataaaaattgggccatcagataaataaaatttaaattgatttaaaaaaattcattgaaaagttaattggaaagaaaaattacctaaaaatgtttttaaaacggtaataacttctcgacgtttctctattggctcataatttgtacaacattttctattattccactcccaaataagcaattcgttattatgtccaatattcgttcaatttcgacgccaaatgcgcccgcggcgattgggccttacaggttggccaaatg

SEQ ID NO: 101358 - DNA, 1003 bp, Heterodera glycines
  Promoter: Source sequence=SeqID_2120; Location=1160..2162; Strand=+; Gene=SeqID_77956
catcgtgcactctgagatacagttgccgcaacttgctcagctcggatgattttttgatttggtttgatcggcagaggtgctccgaaatgatcgaggaaaggagggcggcgtaaatgactgggttaccattaaaaattgtttaattggactgataaaaactgatcagaaaatgcaattttgatgcttaatttgactgaaattattagaccattttatactcattacaatgttgtagtcgtctggctaattgccacatttttctaaatccaatttttcatttgcatatttattcgctatttttcgctgtcacaccttagcaatcgcaacaagttaattcctaagatggtaatcggcatggccagttggcaccggcaaactcgcaacattcatttaattatgtgtctgcctgacataattaattacttaattcaaatatttaaccggctcaaatgagtaagggagcagaacccttagctggaagcagaattccataattggcgatagccgaagcaggaggaggggggggggaggtggcagggtgttaagaaatggagaaggaaaaggaaaaatgaacatgaagatagcgatcagtctgacttatcgacgcgcagattcaacttcacaaattctccggcggctaatcggctgactcgcatgaatttgaattcaattacaaatccagctagcttacagcatttgcctagttcattttctaattttgcccggggcatctgacagttttagaggagggtaatgagagaaacggagtgatcgctatcattcttgttactaatgtgcaatttaaggccgacatgtaatcatatgctgactatagacgtgtacaatagggtatttaaggagaggccattcctgactaatttttgatttgctttatgctagattttgaccagaattaatcgtaaacttaaataatttaattccaactatgtattttgaaataatattttttaatttaattacagcgaatcccgactttcaaatg

SEQ ID NO: 101359 - DNA, 503 bp, Heterodera glycines
  misc_feature (79)..(80): n is a, c, g, or t
  Promoter: Source sequence=SeqID_8916; Location=1..503; Strand=+; Gene= SeqID_69631
aaaaacccgtgaaattcacggttttcgtgaccatgaccgtgattttttttgaaattttggctaaatttttaactgattnntgtttaaaaatgaccaactaaaatctagataaaattattaacatttgtcacagggtttccatttgttttgatttatcagaaatgttctggtttgaatgtattgattgtcaaaatttggttctgattcgttaaacaactcataattttgaaatatttaaagcctttacataaacctcaaatttagcaagacatttcatttcaaaaccgatacttttcatgacgtatttctcacaattaaaatgtgggattctgccgagcgcaaattttaaattgtctataaatcagtgtagcgttaattcttagttcattaaacgataattacttttcgtgtgtcatgaaaagaaatgcggcagttgtcctgcgcaatttgtcaagaatttttgatttaaaaaattatttagctcaatattgtctttaattatg

SEQ ID NO: 101360 - DNA, 195 bp, Heterodera glycines
  misc_feature (96)..(96): n is a, c, g, or t
  misc_feature (107)..(107): n is a, c, g, or t
  misc_feature (123)..(123): n is a, c, g, or t
  misc_feature (135)..(135): n is a, c, g, or t
  misc_feature (141)..(141): n is a, c, g, or t
  Promoter: Source sequence=SeqID_21995; Location=1..195; Strand=+; Gene=SeqID_52633
ttttgaatcaatttcaataggtgtgggactacgctgagtgggacgacacgctattcagtagctacgtcacagctttcgtcggtctcaaagtgcagncgagcggatgnccagagggatgtgaancgaaagagcacngtcagnccttcgtcgcagatttctgcgtacggaaggattcatctggaccgacaaaagatg

SEQ ID NO: 101361 - DNA, 367 bp, Heterodera glycines
  Promoter: Source sequence=SeqID_26184; Location=1182..1548; Strand=-; Gene=SeqID_56931
ttttttgattttcacagtttaacaatgttattttaattcttaaagctatatttctgcagcacctttttctccgcgacattatttaattgcataatcctataaagagccacaggccggccttgggtggcgtcgtcagactgcttcctccgccctccttctcgccccactacttgctccgtcttcgcatgctccgtttttcgtaattttgcaattaattattattttattcatctattatttctttggtactgaagtgtccattgttcactgggactcagttgtcccacactcagattgcatcgtttcggtttattactctgatttttagaccaagctcattaagagctctcgaatgataccaaatatg

SEQ ID NO: 101362 - DNA, 454 bp, Heterodera glycines
  Promoter: Source sequence=SeqID_20662; Location=1633..2086; Strand=-; Gene=SeqID_51221
gggaaaaaagggggtttgaaaaggtttattgggggaaaaaaagattttacaaaaattataccccttgggagaaggggagtggggaaacatgatttcaaaatttttcaatattttctagtctaatatactcaaaacggttcagaattcaataaaaataacgttcacggtgcgaaaaatggggtttgacaagtttattgggaaaaaagactttacaaaataatacccctgggagaagggagtgggaaacatgatttcaaaattttcaattttttctagtctaatctactcaaaacggttcagaattcaataaaaataacattcacggtgcgaaaaatggggtttgaaaagtttattttgaaaaaaagactttacaaaataatacccctgggagaagggagtgggagtagttagagactccattttcaccggattacggtagccccccataggtatg

SEQ ID NO: 101363 - DNA, 148 bp, Heterodera glycines
  Promoter: Source sequence=SeqID_1842; Location=1222..1369; Strand=-; Gene=SeqID_76306
ttgtgccgtccccatttctgtgccgtcccccatttttccccccattttgtgccgttcccccatttcccccttcggtttaattacccaagtttgaggattccaataaagtgtattttgaatcgctttcaaaattcactacgaagcaatg

SEQ ID NO: 101364 - DNA, 73 bp, Heterodera glycines
  Promoter: Source sequence=SeqID_40664; Location=1..73; Strand=+; Gene= SeqID_68923
ttggatatgctgcgcttcaacaaattaggcattggctctgattgggtgtcggagtacggcgacccggacaatg

SEQ ID NO: 101365 - DNA, 114 bp, Heterodera glycines
  Promoter: Source sequence=SeqID_15755; Location=3052..3165; Strand=-; Gene=SeqID_80080
ttttgggggtgggggtttagtagaatggaggaagaaattttttatctacatatttatatatatatgtgtgtgtgcaaatacagagggacgcaaaaaaccgaagaagggaaaatg

SEQ ID NO: 101366 - DNA, 94 bp, Heterodera glycines
  Promoter: Source sequence=SeqID_22183; Location=1..94; Strand=+; Gene= SeqID_52844
ttttctttcttcacaattcacattattcatattaagccccccaatattaaaggattaaaaaaaattatactgtatttattgataataagggatg

SEQ ID NO: 101367 - DNA, 147 bp, Heterodera glycines
  Promoter: Source sequence=SeqID_13737; Location=940..1086; Strand=+; Gene=SeqID_77657
ggttgacatttcttcggagtgcaaaatttggtttattaattgtgtttaattaagataaagcgggcggcgcttaacgagctgattgactacatcacggcaaccaaaggagctgtgtgtgagccgctttacccagaaataatcaaaatg

SEQ ID NO: 101368 - DNA, 1003 bp, Heterodera glycines
  Promoter: Source sequence=SeqID_6162; Location=535..1537; Strand=+; Gene=SeqID_60563
tcgagccccgcccccgcccccgtcccgtgacatcagaaaatttaatatattttaaaaatttttacaaaataccgaagaaaaacaaaaatttatcggaaaaatcttaatattttttttggtgaatatctgttaatagagcttagatttcaaaattcgcccgacggcgcctatcggcaaattagcccaaaacccctaaatttggtcatttttagacaaaatctgtgtttttggagctaattcaaatcaaacccccgctccctcgactctttgaccagttttgaccgggaaattcccgtcttttttcacggttttcccagccaaaaaagtcccggtttttcaaccaaaaaagtcccggtcccggtcttgctcaaatttcccggtcccgctgcactctcttttaaagtaaaatattaattgatttttaaaatttttcttgcctccaaagttactcaacagtttacaaagtccacttttaccagtgtatttttggacccggacctaccgggtcggataccgggttttggattttccaaaaacgggtccgggtattgaaaaaaccgggtatccgggtctgcgaccaggacacggcctgccttgattatagtgagaaatttctattcaccaactgttcattaaataatatttataagtgatgttttttctctgcactctctgtgcaggaaaactgaaggactgggaaaagatggaagattcaatctcaaatttcgtaccttaggatttgttcatttagatattatacttttaaattattaaaattatttattagatttccatataaaattaaatatttattcggaattttttaaattaaaataaatttggttgatgaaacgactaattttggcttggaggacgaaatgacagcgcgccgattcgatcggcgccacggcggtaaactttagaattaaggctaaaatcgaattgaaaaaacagaatgacaaaagaaaaaaatggcggcaaattctacatttaaatttatatg

SEQ ID NO: 101369 - DNA, 1003 bp, Heterodera glycines
  Promoter: Source sequence=SeqID_19062; Location=1167..2169; Strand=+; Gene=SeqID_83807
ttatgtcaaagatattcattttttcatttggttaaggtttttagtctatataaatccatattttgggggtttccgggaataaatccatatttcgtcattgttagttaaaaaatgacaaaattttgcgcaaaacttatttttgttgaaaaatagtatttctgccataaaattttcaaaaccgcacatgcttagcctggggcgactatcatccacgtattttgtttggcatttttcaatttggaatggcaaggcttaggggatgcatttacccatccagaccttcaaatgggcaggggggggggggcttctgattccacatttggcatgatacccttgcccaatttggtatggcatccttaaagaagggaggcatttggcatgccacaggacgacttctaacaaaaaaggcgtaaatttaaaattttcaaagtttatttttgggtcaaaacttttttttaaataatgaattttgtggaggaataagcaaatggtaaatttcagtgcattcgtgatcaaaaaatcagatttttaacaatttttttttgcggcgcattcgtgacatttctgacaaatgataacagtggacatggattaattgagtttaatcctctagctgactcaatcaatgtttgacttttgggaatttaattcattggcttttcagatgaacccgccgaccacttttttgctgttcgcaatttgctttttggcttattattgccacggaatgaaaaagggaggaaacagtttgtcggacaagttgaaaaagtgattatcaaaaaaaggaaaaggcgagaaaaatgccgaaaattcaaattttattgaaaatactcaaaatgccgaaagttcgaatgccgtggaaaaggcaaaaaccaaagaagtgaaattgtatttcgaagaaggtgctccattcacacttaaagcattccatgatgataaacttttatattcgcgtaaaacagaggccgtacaaagtaaagggtggccaaggccaagaactatg

SEQ ID NO: 101370 - DNA, 376 bp, Heterodera glycines
  misc_feature (354)..(354): n is a, c, g, or t
  Promoter: Source sequence=SeqID_353; Location=6194..6569; Strand=+; Gene=SeqID_83883
aatatgtttgtctaattcaccgcaattatgtacataattaattaatttaaataaatttttaataaattataaatgattataaatagggatgatatttttaggcaaatgcctattttttcctgagctccccgtggcctgaaacgcacgaaaaaatatgtttttttgggctgttgttaagctacttttcgagttattaacgcctatttctagtcttttatcccctatactaatttggtgctgtatgtacgtaagtttttaaaattgttaacaccaaagttcaaaaaccaataatactaatggtatatgattaactttaaaagtgccggatcgatggcagttgtgccaactctcaanaaattagattggtttaaaaatg

SEQ ID NO: 101371 - DNA, 332 bp, Heterodera glycines
  Promoter: Source sequence=SeqID_38977; Location=1..332; Strand=+; Gene=SeqID_67655
tgaacagaatgccacatttaacatgaacaaatccagcgccacaatcattcagcgggaaatgcaaaatggtaaagaattgaggcaaggggggggggggggggaattgagacgcagtaagcattcattaaatatgtgccatcgttttcatggcattttttaaacatatataaaaaaacaattaaaaatccaaaaatggcataataaaatccggcaaaattattcaattattttcaaagtcggcgtcgcggataaaaattgcttattaatagatcttcgtccaaaaatcaactgtctttttcttacatagattttttaatttagcgactgaaatg

SEQ ID NO: 101372 - DNA, 222 bp, Heterodera glycines
  Promoter: Source sequence=SeqID_9250; Location=1051..1272; Strand=-; Gene=SeqID_70758
ataatttctccacattattaatccgttttttcgctgattcttaacagaatatttgtccaaataattagccaaattgccattagctggactgtagagttctaaaataggctttaaaaggggccttatttctgaataaagatttatttcctttttatttcggcatttaccgaacatttcattaaaatatctttttatgtggtactatttaaaatttgaaaaatg

SEQ ID NO: 101373 - DNA, 315 bp, Heterodera glycines
  Promoter: Source sequence=SeqID_26331; Location=1064..1378; Strand=-; Gene=SeqID_57079
gaagcagtgcgcttacaccgccgacattttgtacccaccgtcggatggaattatccggttgtggtgcagctgctgaaggaacgatttggggacacgaacgacttgcaaagagcgatccgagctcagcttctacacttgcagccagcaaaggacaacgtgtcgagcttgacggcagtgatcgatgaattcgagagaggagtgtgccagctcgaacaactgggagcgaacgtggacgacgagtcgttcggcccgttgttggaggccaaactcccggtccacatcctcacagaattgaggatccgggagagtacgatg

SEQ ID NO: 101374 - DNA, 187 bp, Heterodera glycines
  Promoter: Source sequence=SeqID_7721; Location=1..187; Strand=+; Gene= SeqID_65727
gctctctgcttatttgttagaatagaaatctaaataaatattaaatataaaataagaatctgatagctcatcaaaaagcaatgttaatcaggtgttttttctatttttaaactaaaatttaaattatttttttaatgaaaaatagtataatattttttacgacggggactccaaaattgataggatg

SEQ ID NO: 101375 - DNA, 144 bp, Heterodera glycines
  Promoter: Source sequence=SeqID_25199; Location=504..647; Strand=+; Gene=SeqID_55939
aatcgttacaagcttttcaagactgagtgcctctcaattgatccgcaacagtgcttataataaaatattttattcgattttaatttgaatatttaaataatattaatctcataacttaagtaatgctttttaacttttagaatg

SEQ ID NO: 101376 - DNA, 343 bp, Heterodera glycines
  misc_feature (56)..(56): n is a, c, g, or t
  misc_feature (71)..(71): n is a, c, g, or t
  Promoter: Source sequence=SeqID_1406; Location=6539..6881; Strand=-; Gene=SeqID_73316
cccccccccccccccccaggtggtcaaagtcgaatcgaacgtaagaccctttcacntgaccaccccctttngtacaggtatggttgggatttaaatttggtggaggttcgaatagcgaaatcgcattttttaaaaaatctaaaaattactaaagtaagacatttgaaacttaaaagggttttacaatgaaattctgagtttctcatttgctaataaaagcacataaacaaaaaagtaaaagcaaaatttccacctttggtttgttagtctctcatggcaattgtctattttccttagtcattgttcgaatggccccccccccttaggccgtttccttcaaatg

SEQ ID NO: 101377 - DNA, 662 bp, Heterodera glycines
  Promoter: Source sequence=SeqID_23259; Location=827..1488; Strand=-; Gene=SeqID_53971
aatgtccctatttttcagatttaccctaaaaaatttcataaaataccaattttacccgcaccgggcctgaataatagcatggaaattcataccaattgacgtcttgtcctaactttttttaaattttcaatagagaaattagcaaaattattttttagctttttctagaaaaaaaaaatcattctaattttgtggaaaaaaaattctgacttattaaaaaaacattttacgagctgccggtgattaatacggtatatttcccataaaaaattgtaataattcgatttcaggaatggactgaaaaattgcgttccataccgtgccggaggataccataatcagtagatggtaagggaaggagaggaagatgaaaccaacatgcagcggaaaagcacttcgctcgtcggaaccaatcgtttagaatcctggaggaggagtacctgaagatcgtcaccgatcgtggattgggaaaaagagccatccaggaggagcaactcgcagtacaattaactgcaggacaactcgccacaagccgatcaatcgcgcagcttttttccaaggaatgccgcagaagttccagaggaggaaatccgaccattcaggccagacgacttttacgacgcaaggatgttatggccaggtggctaaacgaagacacgatg

SEQ ID NO: 101378 - DNA, 63 bp, Heterodera glycines
  misc_feature (47)..(48): n is a, c, g, or t
  Promoter: Source sequence=SeqID_5663; Location=1..63; Strand=+; Gene =SeqID_58827
aattcatttttatgttcatgtgcgtcaaatgcaaattgtgccattgnnaatggtgacgaaatg

SEQ ID NO: 101379 - DNA, 465 bp, Heterodera glycines
  Promoter: Source sequence=SeqID_29992; Location=455..919; Strand=-; Gene=SeqID_60454
ttcacacggatgacatcattgagacattcaaatcgttgcaactgattaaatattggcgaggtgagaaatgccgacgaatgaatataaaaaacatgcgttttccttttccgttgtcaggtgaccacgtcgtgcgcataagtcaaaaggtcgtctcccagataaaacaattgcatcttttccatccgccaaaattaattctccgcaaatctgcggtccgttggcgtcgcgggtcgacagtctctaacgaagtcggaagaaattggagggaagagcggggccgttcaatctcagcacattgattcattttccaattatcaaataaatatttctgaagctatttcttcctgacaagttacaatatttgttttcgaacaataatttttctttgcaattttttaaatcaaagtttattgtctttcaattagctaacaagcgacagttatattgtgtgactcgcccaaaatg

SEQ ID NO: 101380 - DNA, 115 bp, Heterodera glycines
  Promoter: Source sequence=SeqID_3618; Location=2368..2482; Strand=+; Gene=SeqID_51138
ggtattgacaaaaaattacattttttggaaaattgatgcatatttttttggacaggttgaacagcggttaaaacagtactttccgcctggtactcagttgctgccttatcgaatg

SEQ ID NO: 101381 - DNA, 130 bp, Heterodera glycines
  Promoter: Source sequence=SeqID_40879; Location=1..130; Strand=+; Gene=SeqID_69110
acaagtaaaagttgcacacatcgaccgccgtccatagacaacaaagtgccaacagccatttgaaagtgatgtgcttgccccgggctttgtacctgcgaacgacacgaaatgccaaaagaaaattaaaatg

SEQ ID NO: 101382 - DNA, 1003 bp, Heterodera glycines
  misc_feature (891)..(891): n is a, c, g, or t
  misc_feature (905)..(905): n is a, c, g, or t
  misc_feature (913)..(913): n is a, c, g, or t
  Promoter: Source sequence=SeqID_17842; Location=1578..2580; Strand=-; Gene=SeqID_82376
atataaagagtcaatagtaaaaataattcaaaaatgcttaaaagacccagaataataggatgctgtttcagcaggcataaaacattaattcattcatttaatcgacaggattttattagagaatcacgcagaaaatatttaattatttttaaaactcaaaaaataaaatagtccaattgctcctcagatatatgatgttgtctaggatttccacatgagggggtacggcttaagagaaatagcaatcgttacaggacatttatataaagagtcaatagtaaaaataattcaaaaatgcttaaaagacccagaataataggatgctgtttcagctggcataaaacattaattgattcattttaatcgacaggattttattagagaatcatgcagaaaatatttaattatttttaaaactcaaaaaataaaatagtccaattgctcctcagatatatgatgttgtctaggatttccacatgagggggtacggcttaagagaaatagcaatcgttacaggacatttatataaagagtccatagtaaaaataattcaaaaatgcttaaaagacccagaataataggatgctgtttcagctggcataaaacattaattctgaaatgtgatcgatcaattatcgtcgggaaaggggcgacaataagcaaaagggaaattaaatgcgaaatgaaataaatgtagaatgtgaaattcatagggcttcggccggcaaacaagaaaacccggatctaccttacaattatttattttgtaatcagaacgcccaaactttgcaaaacttaaaattttttgggaattttcccctgtaaaaatagaagagccgatctagagttaaaaactagacagctaaaaaataaactatgattcgatagatngggtcaaactatgngcctatgncaaaattgaagaaaatctgacccgatgaaaaatttttttgaccctagtgaaaaatttcaataaatttcaatcatttttcagctaaaaatg

SEQ ID NO: 101383 - DNA, 1003 bp, Heterodera glycines
  Promoter: Source sequence=SeqID_26508; Location=434..1436; Strand=+; Gene=SeqID_57238
ccatttgttatcactagggtcgcaacttttagtgaaaaaactttttttttgctcaattgttttgagaaaaggagctcaaaaaacgtatttctgcgttgcgttaaaattttttcatttggacgtcacttttcgtcactagaaatcactattttggcgacttcgtcactaaaatagttaaaaatcactattttggcgacttcgtcactaaaatagttaaaaatcactattttggcgttttgtcactattttttcactatttcgacattttttggaaaattctttaacaaaaatgcaataaaaccaaaaaatacacccctaagaatcgacctaaaaattttttcaaaaagcactcctaagaaatgaaaaaaattttctaaaaaaggtattttcgtggcaagaattttaattttaaaaattatttttttatgtacctattttgtttttttgcccttaaaaatcccagccctactcatttgcaatgcaatcagtgaataaaaattatttttgcttaatttttggctgaaaattatggcactattcgtcactatttcggactttttgacactattttgtcactattttggcatttttactcactattttagttaactatttcgggatttttcgtcactaaaagttgcgaccctactaataattgaaaatgtgtccgatcaaccgataataaacattgaatattaagtattaacagcacaattatggtgaataaaatgtatattcacgatttttatccaaaaaaaaatttacaaaacaaaagggtcccccctatggtttttgataaaattcaaaatctatcactttataactagcgccaaatttgcttaataggcccaaataattgtcatattcgtgatcagcgacctttaaaacacccgggtacttggtttcaggactttttaaacaaaaaaaaaatttgaccaaaaaaaagttgaaaaaattttcaaaaggttactctttgcaactagcgccgaattttgtcaaaatg

SEQ ID NO: 101384 - DNA, 162 bp, Heterodera glycines
  Promoter: Source sequence=SeqID_618; Location=2334..2495; Strand=+; Gene=SeqID_57573
aaaatgcgggatttgtgcaaaatttacaaataataaatatacatatcctaaaaaccctcctctaccagtgtttagagtaaaagggaaaagtgcatttgaacatgttggaattgattattttgggcccctctcagtaaaaacattggatggcaataaaaaatg

SEQ ID NO: 101385 - DNA, 304 bp, Heterodera glycines
  misc_feature (60)..(63): n is a, c, g, or t
  misc_feature (72)..(72): n is a, c, g, or t
  misc_feature (94)..(96): n is a, c, g, or t
  misc_feature (99)..(99): n is a, c, g, or t
  misc_feature (106)..(108): n is a, c, g, or t
  misc_feature (110)..(110): n is a, c, g, or t
  misc_feature (123)..(123): n is a, c, g, or t
  misc_feature (126)..(129): n is a, c, g, or t
  misc_feature (133)..(135): n is a, c, g, or t
  misc_feature (142)..(147): n is a, c, g, or t
  misc_feature (156)..(156): n is a, c, g, or t
  Promoter: Source sequence=SeqID_16623; Location=1..304; Strand=+; Gene=SeqID_47386
aaatttgaaaggtcgatccttaagggtcatttttttctctaacgtgggccccgctaagannnnaccgaaggnccggcctattccgaggagcaannnacnaacagannncncatcaaaaagggnaannnnggannnagggaannnnnngaatgagcncttaaattttgacccagcggttttatgaaacgacccaatagatacataacttgtttgtttaaccaaggtcattttttccattagtcctaattttgcatcataatatttaatgttaatttcagttttcttttattcaaatttgataatg

SEQ ID NO: 101386 - DNA, 737 bp, Heterodera glycines
  Promoter: Source sequence=SeqID_8053; Location=502..1238; Strand=+; Gene=SeqID_66835
agacacctgttggaccccacctttcggtttctgacttctaaaggcagggacgccttttctgattgttgagggatgttgtagaattttaattataatgactcattagtgttaattaaatttggcataatgtcttgtttcgcgttttttctcacttaaaattgtattctttgttttttctttccatctttcattccaattttttatttatctggtaatttttattgttttgcgccgtccaatttcttttgactttaaaattgatattcgtcaaattgtttctcatcgatatttgtcttttgggaattaaagtgtttggatttgacattggcctactctgtgtttggtataattgcgtccctgtcttaagtcagtagcaaaagtacaatttggcgctcccgaggaaacaggtacaaaagccccgatttttaaagagtttgagggtgagatcgggaataaaaaaatttttcggacgggttttaatttggagtgtattaagtatcagtccggaccggacgatatttaagttgtgaagtggaaattgactattccggatcggaaagttaaaaaaagcgacaaaaaactccagcgcaccgaaaaatttattgtttatcagaaaatttgagttcgggccgaacctttttttctgtctacatcgccgtataaactattgacaccgtgtcggtgcttagtttttctccgtcttctcgccgaatttttacatttgacttcgctggatg

SEQ ID NO: 101387 - DNA, 131 bp, Heterodera glycines
  Promoter: Source sequence=SeqID_36148; Location=1..131; Strand=+; Gene=SeqID_65543
ttgaacaagttgtaatcattgccctttgtcagttccatcgaattttccaatatttcctaaatcaaatcatattgtcggacactttcaaatgtcgccgataatttgagagggcagtaaaaagccaaaaaatg

SEQ ID NO: 101388 - DNA, 83 bp, Heterodera glycines
  Promoter: Source sequence=SeqID_41846; Location=582..664; Strand=+; Gene=SeqID_69900
ggttcgatggtcatacaaagaaccaaactgaagctaaacgaaaaatttaaacaaaattcgtatttcagtatgtaacagggatg

SEQ ID NO: 101389 - DNA, 417 bp, Heterodera glycines
  Promoter: Source sequence=SeqID_11593; Location=1..417; Strand=+; Gene=SeqID_75041
ttttacaatagtgcctatttaaaaaaaatttgcgatacgctctctgttataataacataccctcaaaagtttttatttgcgtcgtttataatatttttcattttatcgtgctgaatgaatatttctgtaatcccaataataatattgacaaaaaatataaattaaataattcaaaaaaggacaattttttgtggcactaattcattcattctgttgctcaattgtccgtttgctttacgttttctgtagtgtgtaagcagatgaatttgcagattgcttgactctgcaaattgtttgccacaatgggaacacttaaaaaatgaaaattaaaatggaaattcatcgatttaaaaaaatggaaattcatctattttaaacaattttaacttttttgtatttccagatctacacaccatg

SEQ ID NO: 101390 - DNA, 128 bp, Heterodera glycines
  Promoter: Source sequence=SeqID_481; Location=1..128; Strand=+; Gene =SeqID_53921
ttaataaatccaagtcatttaatgtaaaccttaacaatcaatggttttttcccccttagaatatttaattttttttatgactattatcaacaatactgtgtccatttagggttacatcgctggcaatg

SEQ ID NO: 101391 - DNA, 363 bp, Heterodera glycines
  misc_feature (69)..(69): n is a, c, g, or t
  misc_feature (79)..(80): n is a, c, g, or t
  misc_feature (82)..(82): n is a, c, g, or t
  misc_feature (90)..(90): n is a, c, g, or t
  Promoter: Source sequence=SeqID_2720; Location=3672..4034; Strand=-; Gene=SeqID_81260
ggggacctctagagtccagccaatagtcaaacaaggtgccagatttattgcagctcattcattgaacgnttgggctaanngnaaccaganaaaaaagttataataaccatgctaatttttttgataattgaaatgtttaatcgcgcgatcgaaactcatttaatcccccgcttcttttctttatttgatttttaaacattcataaatctgtcgcgttttgaataaatgattttgaataatttaaatttcaatgcatttttgcaagttttgttttgaagacaccctattccgtgattacataagcctgtctgaaatcttttgcttttttcagaaaatagaacatcattttataggactgaaatg

SEQ ID NO: 101392 - DNA, 243 bp, Heterodera glycines
  Promoter: Source sequence=SeqID_3597; Location=559..801; Strand=+; Gene=SeqID_51025
ttttgacgggcagcgccgctcctcaacattaatatttttctttattttttatccaattaaaaaaagagctgtttttgaaaagtttttgccaatctacaatacctaatttggatgatcatggtgtcatttaaaaaaattcacttacttttgttaactgagtcatttttttaacattttcaaaaacatggaccggctcagtctattcactatcttcataaatacatatacaattcagcttagatg

SEQ ID NO: 101393 - DNA, 286 bp, Heterodera glycines
  Promoter: Source sequence=SeqID_44990; Location=1..286; Strand=+; Gene=SeqID_72389
ttttgggcctacacctcaaaattttaaaaagtttcacattcaataatttaaacgcaaaaccgaaatggagaggccctttattgctactttaatttatgctatgtggtgaatggtacgcaattgtcacttaagcgctcccttttttgacatttttcaaaattttgaggtgtaagcccaaaacggaaaaatatcaacgaaactgctgattttcacataatttttcatctttgctaagccaattgaaatccgacgaaaactgcctaaatcattccctctcaataaaatg

SEQ ID NO: 101394 - DNA, 561 bp, Heterodera glycines
  Promoter: Source sequence=SeqID_7602; Location=666..1226; Strand=+; Gene=SeqID_65367
tcacgctattattgttgtgtaaaaaacgatccgtttttacctcttttcgggaaaaaaaactgcaaaaaattcacaaaaaaaaaaatctcacattgtgcacccttttctatcatttgtggagtaaagaattttcgggaaagacaacaatttgcatcaaatttttttgctgaatttatgcagaaaacagcagcagcagcagcaaatccccatcgatatctcagagcaatatcatttaggacaacagtcaaattcgtgatcagcgagctcaaaaagcttataaactcatttttcgactttttaaatctcaaaaaaaatttttggaaaaggggctacaccggtggtactcttacccagaaataatttttggaaaattttagaccaattaatgctttcataagatgattttattgaaattagccaattaaaaaaaacagtgacgaaatgattggtaaccattttttaaaattccatttaaaaggattattttaattactaaatctatacttgttaataaggggaattaacaaattggtgccacgaccaactaaaaaaaaaaaaatg

SEQ ID NO: 101395 - DNA, 216 bp, Heterodera glycines
  Promoter: Source sequence=SeqID_16894; Location=782..997; Strand=+; Gene=SeqID_81320
acatttacctagctatttgaaaaaagctttaagattcaagactcttgcctcctccgacgaaaaacacgtttaatttatttgttttggcataatgttgttgttttttaactaagtaaaaaaaaatttcgcttttttgttttttggcttattttttttaactaaatttaaatagttaattagatatatgagcttatagcttatatcattcagagaatg

SEQ ID NO: 101396 - DNA, 1003 bp, Heterodera glycines
  Promoter: Source sequence=SeqID_4101; Location=5619..6621; Strand=-; Gene=SeqID_53182
gagggggaaaattgagaattattgcccgatttaaataaattttgttcaataaaagccaattaattgtttagattttagaaataaatgcttatcataaaaaaaatgtgaaaccacttctattttttaaatttttatgaattgaggataaaaaataattatctatgaaaataatttatttcaattattttttattggtaattttttgcatatttttccattttttgtacatattttcaaattttttgcattatttttccattttttgtacatattttcaaattttttgcattattttgccattttttggacatattttcatatttttttgtatattttgctatttttcgtcaaatatttccgatttgaaatctcttaggaaaaattttgatttgcaattgcaaaaacaaccgataaaatttatgaggaataaaatttttaattaatttgcaccgctaattttcaagtttttttgtgcatatttcacgactttatttgcttatttatgcgcatatttggcaccatttttcgtgcatatttttgacagccctggtgatcgctacttgaattgattttgtgtgtttttaagttttctccaacaaaaacaaatgttatttactcaatttttatttttatgtaatttttttttattttaaatttattataataatatttatgttaatattttatatgtcaatcttcttacgcaaaattccaattcatacataatgaacaaaaaattaataatatcaataatattcatttatgaatgaatatatttgtcaataatattgatatttatgtaatttcattaaatttagtcaaaattataatttttttaaatggcacaatttcttcttaacattgaaaatattattacttttttttctccttttaatctttatatatatatatatttatttaaatattaaattatatcccacaaagaaatcaaatataattatatattttttaaattaagttgtacaactttatttcaaaaatg

SEQ ID NO: 101397 - DNA, 805 bp, Heterodera glycines
  Promoter: Source sequence=SeqID_3372; Location=349..1153; Strand=-; Gene=SeqID_84420
atttaatttgagaaatgatcaatctcaatttgatgctctctttttctctccgaaatgcttttgttgattctttcgttcgaataaaacatatgtacacttaatatcttattgaaaaccttactaattaaattaaattaaaaattaagtttccgaacctcggaatttaacaaaaaattcaaaattttcaaaactcacttttatatcgtacgcccaaagagcaaaaaacaaagtatcatcaaatcaatccaattcgtcgtaactcaaaaatgatcggtccttttttttaggaaaacagcgccacaaaaacaacgattaaaagcaaaaaatttaagaaattttaatttattaaaaaatccagaattttgggacccagaaaattccaagattccagatcccccccccccccgaaattggcattgcttttcaatggcaactcgtacaaacaattaccaaaaaagttatacatgaaaaacatgaaaattgcgaaaaggtcgaaattatgaagttttttcttaataaaattttttccaggctagaaaatcatttcattttttgtaaggctaatagagcatatgaagagctttcgaatgataccaacaatcttggatttggatgccaaagaaaaaagttatagcgaaaaacataaaaatttttaaaatctgcccacagataacacacaagtacctttttttgtacgagttgccatgaaaccttttgttttaccaatttttgtgtttagacatttcgccgtgccaccacttctgtctgttacaatattcaactttatttttgggtggacacaatg

SEQ ID NO: 101398 - DNA, 548 bp, Heterodera glycines
  Promoter: Source sequence=SeqID_40259; Location=1..548; Strand=+; Gene=SeqID_68656
ggggaactgacaccaaaaatgtcccttaaaaattctaaaattcttcaaaaaaaacataaaattgactagtattagtaccctgacttccgaattccaatgctcatccagcaaatcccggtttttgttcaaaattccccattccgtgcaactctaatagaatatcttcatcactttttaggcattctcaacaaatgactgctcactcatcattctttgtcttttttattgtcattctttggctttgcttcgattgtttgaatggaaatgagccaaaaaacaatggcaagtcttctcaaaatttacgtaaaataatattttcttataaatttttggtatttctccagcagagagagagtttcacaaacaaattttaacaaattttcaaattcattaaaattttgtggagcgaaacacacacatacttaagtagcaaaatatgaagtagacaaatatattaaatgttttcccatttttaattaaaatttctttgtgcttaagctaatgttggacatctctcaaagtcacaaaatgatcagaaggaaattatg

SEQ ID NO: 101399 - DNA, 102 bp, Heterodera glycines
  Promoter: Source sequence=SeqID_14715; Location=716..817; Strand=+; Gene=SeqID_78842
ttgttggaggcgcgagatgtgactgtctctgaatatgtgccggacaaacgttctctgatcgcttacgtctctcaattcgtttgccttcgcccccaccaaatg

SEQ ID NO: 101400 - DNA, 527 bp, Heterodera glycines
  Promoter: Source sequence=SeqID_10849; Location=231..757; Strand=+; Gene=SeqID_74125
tcacgcctgaggaagtccgacggcgacttatggtggtcagttgtgggatgccaaatggaacaaacaatcaaatcattgcaacttaattgatttgtaggaaaaaaggaacgttcggagggaaaaactgcgggtcaaagggcaacagaacgcggtgcgcagggggcgccaacagaaccaggaactgatcagagagtacgcgggatgggaccaatattgacgacggactcactcatttccatttgttgattattttgtttttttcttaattgctgaatgtcttggaattttatctttttgtcgtggacaaaagtaaacagtgaaatgatggctaatttttgaacgaccattcaaagggaatggaagagaattgtctgctgctaattttatcggaagcattccaaaatttttgcaaatattttgcttcacttttttgccgtaaaaaatgaaatttcgaatgcaaaatattttagattttatttgttctaattaactatattaattgttgctattaaccgtttattctaatg

SEQ ID NO: 101401 - DNA, 84 bp, Heterodera glycines
  Promoter: Source sequence=SeqID_25441; Location=1397..1480; Strand=-; Gene=SeqID_56179
cttgccttccgacgatagcaacgaatcctcaaagagatctctaagacgagatcacttgaaagttgggtcaccgaatcgctaatg

SEQ ID NO: 101402 - DNA, 229 bp, Heterodera glycines
  Promoter: Source sequence=SeqID_5074; Location=1428..1656; Strand=-; Gene=SeqID_56805
tctaaatgactgacagggaagtgaatgataaggggcgtggcataggagggcatactgtggatggatttcgaaatcctcccgtctggaggtccctgcgtgctctcagttgagtgggagtggcctattcccacgtgacaccccccgccctctccgtcacgttacatacagtacccccacacttttcccttctcattttcatcttaacacacaaaaatattcctcgaaaatg

SEQ ID NO: 101403 - DNA, 635 bp, Heterodera glycines
  Promoter: Source sequence=SeqID_13662; Location=2767..3401; Strand=-; Gene=SeqID_77572
taacttttttatttttgaatcattcatttctatttttacatgtaaatatagagcacacatagagctttcaaatgatgctagattggctaaagctaactgacaaataaaaaagttatagcatttcaaaatttgcggcgccgaaatggtccgcgccgaagtgaccccgacccgttttataatgatgccaatattctaggattttgtcgacaatgaaaaaatgtctcattccaaaaaactcgagctggcgcttaactccgatactgaaaagacccattccctgtatacataacccaatataaattgtaaaggaaatgaaatgaaataaatcggatttatataggcaaaaagtggatggttgtaaaccgcgagacgaaaaaaggtttaattgaacaccacacgatggctaaagagagttttttagagaattacaaaaattttggtttttttgtgaagcgcttttcttgtaaaaattacaaaaaatgcccgaaatacatatctctaaaaaagcaaaaatggtaaatatgcatttattctcgaaaatcactacaatatgcgtttataagcataaaaaacctccaccaaatcaaaaaaatttaacgtagaaattcccttttttattgcataaatagtaaatg

SEQ ID NO: 101404 - DNA, 137 bp, Heterodera glycines
  Promoter: Source sequence=SeqID_24602; Location=553..689; Strand=-; Gene=SeqID_55338
ttttatctaggcatccttaaaagaaaatttttctaattacttttggtaaaattacgattttttggtttgaattttgaaatttaaattattcaaacaaactgatcactcgttgaccatttacataaagccagggaatg

SEQ ID NO: 101405 - DNA, 83 bp, Heterodera glycines
  Promoter: Source sequence=SeqID_11819; Location=1043..1125; Strand=-; Gene=SeqID_75320
atgtccaaaatttgcgcgcgaaatttaattttcatcacattccgacataaaacctcttaaattttaagttgttggacaaaatg

SEQ ID NO: 101406 - DNA, 315 bp, Heterodera glycines
  Promoter: Source sequence=SeqID_1598; Location=1..315; Strand=+; Gene= SeqID_74744
tttaataaaacggttagttttatttcaaattcgaattctttttgaataaaaaaattgacgccaaataaaagtttatttaataataaatacaatattatcattttacttagtgttaataaaaacaaatggtgaacttttgattgtcttgataatttgtgcaaaaaaaaaatcaaacgaattaataatgatatcattaattgataatttaattgatttttttatgggtttttggtctttaaactagtagccaggcgctatttatcatttttatatgaccatttaaatttgttatgcatttagctttatacaaaaatg

SEQ ID NO: 101407 - DNA, 1003 bp, Heterodera glycines
  Promoter: Source sequence=SeqID_104; Location=172..1174; Strand=+; Gene=SeqID_69856
attcacattttattttgtggcctttggccggattttcctcccccatttgtccgcccattgtccactttttcggtttaattacccaagtttgagataaaatttggtgtgaattttcctctgcacttgcccccgtttgacccccggcacatttcccgtcccactttctgcttcctctcctggcaatttcaacgcccgaactcctcgggccttgtcgacaccaccgcggcgacctgcaccgcactcaacgtcaagcgcacacggccaactccaagcagctcaacggagctcaactcaatcaatcaatcaatcaacgggtggtgatcggacaagtggcgaccctggcaggacaaaccctcgacagcaccagcacaactgagcgacttcaagcagtattggaactgcaactggtgggaattttttgaggaaaattccaaaaaaagtatcaagtttgcgctctccgtagccaaacttgaatacatcaaaaaggggggatcaaaagtgggaaattgtggaatactgcttggtctccgtgccagcagtagtttcacaggggaaacagtgacttactattttggtcttcgtgccattagtatttcactttcaaattacttattggtctttgtgccataagtaatcggtaaaattactgatcggtctctgtgccgtcagtaattcaagtactgctcgctcttcgtggtagcagtacccaatccaagccaacaaaagggggatcggtgtgaactgtttgctctccgtggcaacagttgcacattcaacacaaacaaacaagtcaaacggcgggaaccccaaggtgtactgcttgacctctgtgtcagcagtacaaccacgcaagtgcagcaagttcagcaagccaacgaaaagcaaagcggcaaacgaaaagtacatcaagcgacacaacaaaagcagcaaagcaacgacaaacaagcagcagccgcacacgagctgatcaagcagtacagcaacagcaaaccaacaatcaatg

SEQ ID NO: 101408 - DNA, 160 bp, Heterodera glycines
  Promoter: Source sequence=SeqID_12186; Location=622..781; Strand=-; Gene=SeqID_75759
attggcattttgggagagagggagggagagggggaagtggaaggaagccaaatttacgaattggccaaggatttgaaacggagggaggacgacaattcagttatattacttaggttatcagatcaactgtgctgcgcaaagacatttatgtaaaaatatg

SEQ ID NO: 101409 - DNA, 308 bp, Heterodera glycines
  Promoter: Source sequence=SeqID_26687; Location=628..935; Strand=+; Gene=SeqID_57447
tgccctgaagaaaattatattaaaccagataaaattttgagattaattccttaaagcttttctatttttttacttttaaaaatcactccaattgccttgagtattcccgatggataaatgtgattaattttgagactaaatcccagattatttttgaacaaacatttctcaacaattatctgaaattgttaagaaaatcgtttaatttatttggaaagcgttttgaaattcgtcttgttttttattcagctatcccgatatattcattttaagaaataaaataaggcctaataaacggcctaacaatg

SEQ ID NO: 101410 - DNA, 183 bp, Heterodera glycines
  Promoter: Source sequence=SeqID_38254; Location=398..580; Strand=-; Gene=SeqID_67129
caaaataattattactatttttaaatattagttaactttttttttaataatttttccatttttttccaaatggcaggcgtatttgtccccattcaaaatattttttccccaaaattaaatttttaaaaaaacattttttttttgcattttaattcccttctcctcccaaaattgcagctgatg

SEQ ID NO: 101411 - DNA, 1003 bp, Heterodera glycines
  Promoter: Source sequence=SeqID_907; Location=931..1933; Strand=+; Gene=SeqID_63693
caaggtgtcactcaacaattgccctgacagtctacaaaaatattatcatcattaagggtgttttttaaaaaccaaaaaatcaaaagcagtaaaactggtacccccggctttcgggttccggttattggtttaagttcggccgcgaacaaccttacttaaagtctgtgccattctttaaggcgggttaccgactgcacaaccgcatcatcgaccttggcgtcttaattgaagcgcctgccgcgtaataaactttgatgaatgattgcttagcggtgaacttagttaagccatataatcagccgtacccattaattacaggaaggacatttctgaaaacatttgtagcatcgttagaaaaaaggatagaaaccttaatatggatgccgaaaaacaaaacggtgccatgggtgaatcaggcagaaattttccgcaattgttaaaaagacccaacaatccctttcgatattcaaagtatgaatctttcacattatttttttatgtttttaaaataagcgaatttttaaagtttttttttatcatttttgaggttttaaagctatttttttattgagttttggttttttatttggccattattcgtatttttatctatatttcaggggttttaaccttcgtttgaagcatgcattttcatatctttaaaatgagcttaaccctgaaacagatttattttaaaaaatcttaaaaaggacttatcagaagaaaaataattccgcaaatattggaattaagcttttattaataagttaaaaaaatgaaaaactaggaaaatcaaatatttgggagaaatcaatcactgactgattctttggcttaatcaaatgttttggcagaattaggtggaaatcatgagttaaaatcggaagccaatttaatttgccagtaaaacaagtatgggagcgcaactgtataaatactgagacataatttgtaaaaaacaccattcaaatcgatcatttaaaaacccaatttaataaatatg

SEQ ID NO: 101412 - DNA, 96 bp, Heterodera glycines
  Promoter: Source sequence=SeqID_21578; Location=2523..2618; Strand=-; Gene=SeqID_52187
ataaatgcatttaaaattaaattttcacttttttcgatttttaaaaaatttcatccctaacatttaaaaatttttcagcatcttagataaaatatg

SEQ ID NO: 101413 - DNA, 1003 bp, Heterodera glycines
  Promoter: Source sequence=SeqID_15283; Location=148..1150; Strand=+; Gene=SeqID_47282
aacttttttctttgttggccaaacttcacaatcatggtatcattcgaaagccctagatgtttagaagatatttataagctatttctcagtgattaatcagctctcaaaaaagttgtcagtttaaaaccgcaaaaaaaggcagaattttcaaagttttttatttctatctttttttatagttcgaaattttctctaatttttagtaggctaatagagcctgtgaagagctttcgaatgatatcaagattgtttgattcggtcaataatttcaagagttatattgactaatttaattttttttttctccaaaaaattctccttcttcaccattccctactcttttctcacccagacccccattcttaccagtgcaaatttttaccggcggtaccggtactagacaaaccggtaccgatactttgatttttgaaaaaaccggtaccggtaccaaaaaaaccggtaattaccggtcggtaccggtaccgctcaaccctaattattaggctcaatttgtacggattttcatttaaaaaataataaaatatatatatcaattaaaatatttaaagaatatattaatatattttttaaatttttccctttaactctaattttcattctctaatttttcactcagacccctattcttaccagtgcttgtttttcccggttgccctaccgggaccgggacctgagcttttcaaaatccgggaccgggacctcggataaccgggaattcccggcccggtcccgttcaatgcacccggacagaaaaattaacaaagcccatcagaattttcgagtgaagccaaatttacccgaattcgactattttaaaatatatgaggaatacgcctaatcgatccaacgcttgacctttcattaaagttcatatttctcttttttgtcctcttttcaagactgatgctaaccaaaggcattattaactgtcctttgtctattctcaattttgtttttaaccaatctctgaatttaagacatg

SEQ ID NO: 101414 - DNA, 802 bp, Heterodera glycines
  Promoter: Source sequence=SeqID_37430; Location=583..1384; Strand=-; Gene=SeqID_66511
atcagagtgctaacattaagttgctaataaaatttggtgcgctatagagctctatctgaacagaatatttatgagacaaaaaaatcgattttttcaagtgtccgtatagggtactcaaacaattatggcgagcaaaaatccaacgcagaattaaagtacaggctatagggaagctattcccgaaggattcggtctctccataaatatgggcgcatcggttcagggggactaccccgaaaacaaaaaaatcgattttttcaagtgtccgtttggggtactcaaacaattatcaggagcataaatccaacgcagaattaaagtacaggctatagggaagctattcccgaaggattcggtctccccataaatctgggcgcatcggttcagggggactgccccgaaaacccaaaaaaaaattttttggataaaaattatttaaatgaactgactagataatatttaaaataggttatttctcttcctttcagtatccctgcaaagtttggtgcgcttctgatttctagtttctgaaaaaaaagttaagcctaaactttttggcctgtttaaaaaggaattaaaaatttttaaaatttttattcatctcccttttgatagaaaaagcatcagagagccttatttaacttgtaaataacattttgtgtgtttcagagcactttctgaaaaaatacttatgaattaattttgcaaaaaataaataagtaatgaaaaagtcagaattttgaaaaattttaaaaacaacaagcgttggcattttttcaggttaagttagtcctttacaatg

SEQ ID NO: 101415 - DNA, 429 bp, Heterodera glycines
  Promoter: Source sequence=SeqID_13919; Location=1..429; Strand=+; Gene=SeqID_77872
attttccatttttgacttatttctgcataaatttccatttttataaaattattttcctattatatttttcgagaaaaaacacctaaaaaatatgatgtaacgacaatgacttggattttgtttttaagactttgattgagtcttaaaattatttacaatattaaaatttttaatactttattattgcgtcatttgaataaaaaaaataccaaataacaaaatacaattttctgtttaaaattaatttttttccggagagatcagatgaatattttttaatattttgtagtttattttatttgaaaaattgtttttatggtaattttacttcatttatgaataaataaatgtataaataaatggccatcaataatcaaaagaaagaattttgtatttttttaaaataattttgagaatttttgataaatg

SEQ ID NO: 101416 - DNA, 276 bp, Heterodera glycines
  Promoter: Source sequence=SeqID_22448; Location=618..893; Strand=+; Gene=SeqID_53121
agtctgttccacaactaactgactaactgatcactggggaaggagaaatgtgaagagaatgggcggagaaacattacaatgagaaaaggaaaaacgtgtgaaaaggataaatgtgattgaattgataatggccaatgggaaataattaaatgaggaaatgcgtcgaataatccttacaatactttaaataatttccataccaagtttttacattaaattaataattttgtttaaattaaacttttcggactttatctttaggctttgaatcaaatg

SEQ ID NO: 101417 - DNA, 417 bp, Heterodera glycines
  Promoter: Source sequence=SeqID_16894; Location=579..995; Strand=-; Gene=SeqID_47400
ttctctgaatgatataagctataagctcatatatctaattaactatttaaatttagttaaaaaaaataagccaaaaaacaaaaaagcgaaatttttttttacttagttaaaaaacaacaacattatgccaaaacaaataaattaaacgtgtttttcgtcggaggaggcaagagtcttgaatcttaaagcttttttcaaatagctaggtaaatgtattcgaccactaaatatttgagaattggcaaccggtctctgttaaaatttgctgtgtgtggcggctgttctccgtctccttcgctcgccgatgttcgatgtctgtcaactcgagacattttcttgcgcgatttgcccgcccgattagccgaattggtgccagaagttccggttcctatctataagccgtcgcttgaagaaatg

SEQ ID NO: 101418 - DNA, 1003 bp, Heterodera glycines
  Promoter: Source sequence=SeqID_26610; Location=774..1776; Strand=-; Gene=SeqID_57354
aaaattttagacagttgtgcgtcatatttttatcagtagcagctcttcgatgaagctttttatagtcaaattcagactcgtctttttatacgtcaaaaatcaatttcgatatatccacctctgagtcttgtaaaatttctcataaatgttccttaatattttgtatctttttttgatatatatttttggtctaccaattctataccagggttcggatcgaaaaattttcaaaatcagaacatcgggtccaaaaaatcagattttggggtcgaaaatcagaacattttgcaaaattgcttcaaatcttttatttttacaatttattcgatcaaaaatgtattaaatattatatttttcacctcccatgatcatctttaaaaattttggtgaggaaattaacaaatcgtaaatttcagtgcactcgggatcaaaaaatcagatttttaagaattttttgcggcgcatttttccaaaaaacttttgggaaatgggcgaggggggagggtccggcggtgccgataggcgccgccggtaaattttatgtaatttcgttctgatttgttaacagattttcatcaaaaaaggccaaattgcaattaaaagccaagcaacgacttttccttgcgtttaacaacgcttttttttgccgcacattttttcaaaaaattttgggggatggacgggggggggggggggtccggcggtgccgataggcgccgccgggaaaatttttgcgctttttaaagcgatttgtaatagatttttgtcaaaaaatgaccaaattttgccgcaaatcttatattttcttgataaaatagtgacattatgccacaaaatttcaaaaatatgagtttatttaagaaatcagaacaaatttgggtcactccctccaaatcagaacatttcttataaataagaacagatcgcacccctgtataaaaacgacataccaagataatatttcggaatttatttattttccttttcattaagctgggcaatg

SEQ ID NO: 101419 - DNA, 193 bp, Heterodera glycines
  Promoter: Source sequence=SeqID_549; Location=3524..3716; Strand=-; Gene=SeqID_55919
agcaattattgttaattggcatcattagcgtttattactttcaaggaattggcctttgcccgtccaattagccgagataaattatgaaagggacggcggatttttgagttggtcgccctttcgggaatggttcataaaacggcagacgacgcacgcacatttgcgcacgacaatttgccaacaactcacaatg

SEQ ID NO: 101420 - DNA, 299 bp, Heterodera glycines
  Promoter: Source sequence=SeqID_2031; Location=2469..2767; Strand=-; Gene=SeqID_77412
aattatgaatccaatcaactgaccactctcggtttcttaggccataaattcgatcgaagaatctcttgtaaagcattaaggcaacacaaaaaagaattgtactttttccagacctaagcatctaaattctctagacatttacgcgctcgagtgatatcaagaaagtagactttatacagcaagaataagtcattgccttttttcattcatgatttttagtgcatttccgttaatttatttgctttctgaacaattgaaattgcgaccatatttaagcagtttgatgtagttgaagcatg

SEQ ID NO: 101421 - DNA, 1003 bp, Heterodera glycines
  Promoter: Source sequence=SeqID_9423; Location=159..1161; Strand=+; Gene=SeqID_71359
atatatcggacgacgacctaaattttaatttatttaagcataattgcggtttataagccgctttataatttaaattcagtgtgaaaattttgtaaaaatagatattaaaaaaatattgttaatattatcatttaaatgtttgcaataaattgaaagaaaatttaaaaagaattatgcattaactttataccattttgtgtaagttaaaaatattttctgaatttttttttcttcttaaaagtgtggttatttgaaaaggactgtttggccgagttgttagttaattaactaaatatgtaatcatcaaactcctaacatctaattaattgaaataatgaatacttgtcatcaatgacgcattttcataattataatttgatagataaattttttcttcaatttaataaagcataaaaaaaaaaataataaatgagagaaaattttcaaaaatatttcttttatgagttaaaaatggttgatatacttattagagctctgtgtggctttttgccagaatttaaaaaatcactttttttctcaattatatcaaattacggcttaaataaaaaaattaacaactaagtgttagctctgtatgtttcgggtcaattaatttatgacagattgttttttctcttattacgaaaagatcatttaatattaactttttcattagttctttgtatgatgtcaactcattcacctgctatatgactttcctcacaatgtacctatgtacaataataataaagaaaaaaatttttgtttgtcattaatgcacgcgttttccgcttggtttgaggtgtatacgatgacttttataatgcctatttttgcatacacgtttttatcattaaatcaaaactttttatgtgggtcaaactgtataagtaccgaccgatatttgtatgcgtttttttgttgcatcaaaaacatcccccctttccgctcggctttagccattctttttattttacaaaaaaattgtatccgacttaaaatg

SEQ ID NO: 101422 - DNA, 188 bp, Heterodera glycines
  Promoter: Source sequence=SeqID_17158; Location=812..999; Strand=+; Gene=SeqID_81597
tttttgcccaaactagggtggagctgatcagaagataaaagaaaaatgcatatgaaatgaaaagatatattcagacaaatgcttattgttacttatattaaaatatgccacaaatttccattagactaaaaataaaaataaaaattgaattttacttattaagctaaaaaaaccaaagttttcacatg

SEQ ID NO: 101423 - DNA, 1003 bp, Heterodera glycines
  Promoter: Source sequence=SeqID_2692; Location=674..1676; Strand=+; Gene=SeqID_81109
tagataatgttgtttctttgttagatcaattataaagaaacattgatgggcttggccagcattttttaaaagattcaaaactaaatccgtacaaaatacagcataactgatcagcgatagtctacaaaacaagagtttatttaaaaatatttttttcagtaaaaaatgacatcaaaagaaagaaaaaaaattaattaataaaataaactaatacattaaataactatatttaaaaaataaataaaattgctaaaaaactattaattaattaattctttttcataattaacttaatttaatttgaatttaagttttttaatttttaaaaattcattagatgtattaacacacagtttttcccatcaaatttatttcgttttattttgcaaaaaaaagtaaaaaatttaattttaaaacttaatgttttatgtccataaactatttattttaaaaaatatattttttaaaactcttctcgtgggttatatctatctgtactttacttcctttcaaaaagttaacatcggcttgtaatttaatttctgcctttcaataaagatgaattaagatgcatatttttattttttcaatgtggctttatttaaaaaagtaacatatttatcatttgtacgaggaagagaagatcatttaatttgttttggcgattttgacattctgtttaaatattttttttaaatcgtttcattttttttgtaccattatttttcttcgatttttgttttttgtgcacacaatttccatctttaaaaatataatttatcgcccttaaaaaataaagttatacaccaaaattgactttgtgttgctatttaaaaaattgtgaccaattatccaaattaatttcctctccatcgccggattccgacccaaatacccgaaaaatcgtacttggcgctcctggccgaaacccggactgcatcaacctttcggttaacagcgattgcaggtcgaactcaacagaaagccacaattagcaacgatg

SEQ ID NO: 101424 - DNA, 1003 bp, Heterodera glycines
  misc_feature (210)..(210): n is a, c, g, or t
  Promoter: Source sequence=SeqID_22647; Location=14..1016; Strand=+; Gene=SeqID_53319
aatgttgcgaattcctggacatttctttccgaaatgtgctcggtccatttatcagcagtagaaacacaattgaatataaaggcaaaaaataaaaacagttgcaaagtgtttacagctttacaagccatcatttcttttaaaaatcaataaaattagtgaagccatggagagcaacggaaattcccatttcctaattgttgacttataatntaagcttccgaatttttttattggtatcagattagaccgacttctgacacttttaggtttggaaccacaacctctgaaatttttccacactttttggaccggaatttcagttttctcaattttttggatccagcaattccgagtttcggtccgaaattggttcgggtgtgtcacgatgagaattaaattgctatgaaacgaaaacttaaattttttgagtgttcgcccctaaaataagtttttatccctattttggcgtttcgcccttattttcgcccctatttcgcgatttttgggaaatctattaacaaaaatgcaataaaaacggaaaatgcacccctaagaatcaacccaaaaaatttcggaaaaatacagccctcagaatcgacccttaaatcctaaaaatttctaaatgtacttcatttctaactgtaatcagtaacaaaattgtttgacttaattttaactaatttacatagagaaaacagtaattttaataaattcaccctctacatttgaaattttttcgcccctattttcgtccctatttcgcaaattttttgcccctatttatgcccctattttggactttttcgtacctaaaaatcccatccctagttatggccaagaatgactgaaaacctggtttctgatgtacttttggacataagtttgttcaaaatttacgaaattttttgcaattttgtaggctgatagagcacatttagggctatcgaatgaaatcaacaatgtttgattttgtttataaagaaaaaaatagatcaaaaacatg

SEQ ID NO: 101425 - DNA, 86 bp, Heterodera glycines
  Promoter: Source sequence=SeqID_3304; Location=2216..2301; Strand=+; Gene=SeqID_84143
aaaacttaggaagtgctaatgatattattaattgtctatccccgcttattaaaaaggtggagagagagagaagcaaaaaagcgatg

SEQ ID NO: 101426 - DNA, 117 bp, Heterodera glycines
  Promoter: Source sequence=SeqID_7806; Location=1326..1442; Strand=-; Gene=SeqID_66023
tttgtttaatttcataaattgtttcaaaatacctacattttctattttatatatacatataataaaaataagtgtgtgtgtgtttagatcattcttaaattgttcaaacaccaaatg

SEQ ID NO: 101427 - DNA, 128 bp, Heterodera glycines
  Promoter: Source sequence=SeqID_24038; Location=910..1037; Strand=-; Gene=SeqID_54735
cgtaaatcgtaaaaactttaaataaataataaatttaatgttatgaattcttcatttgattttcatttcaatacctacaactttttgttttattttaaataattaattttcagttatttattattatg

SEQ ID NO: 101428 - DNA, 792 bp, Heterodera glycines
  misc_feature (143)..(143): n is a, c, g, or t
  Promoter: Source sequence=SeqID_28864; Location=1..792; Strand=+; Gene=SeqID_59442
ctttttaggcgctaaaaataaaagcctagaaaataggcactaataactcgaaaagtagcttaacaacaacccaaaaaaacacgtttttcgtgcgtttcagaccacggggagctcagaaaaaaaggttttttgtctaaaaatcncatccctagttatgaatttatgtgttatacattttttgtttttctaccccttggcggttttgagaaaacgcccatttggcggtttttaggaaacgacctagcacccttacaattagcaatgctattgaattttctggactagaatcaccgtgctcagatttacattcaaacccaaaaattccgatttccagttgaatatatttttttgatagagtagaacgagaccgggatctggtactaaaaaacgtacaaatgagtacctaagtcccggttttgaccgtgaccgggaaaagtcctgggtttccttgccaaaaagtcccggccccggctttgctcaaaattcccagtcccgctatactctatttttggataagaaaattttatgggaaacttcggggtttttgtgcttcgaacttcaaacttcgccttcgaataaaaattgggcttcgccttcggctcgtttcaaattgtcattcgtttcaaattgtcattcgtttcaaattgtcattcgtttcaaattgtcattcgtttcaaattgtcattcgtttcaaattgtcattcgtttcaaattgtcattcgtttcaaattgtcatctcccaaaaatcaatcgatggcaaagagaacggcggcgaatttttcccctcccatg

SEQ ID NO: 101429 - DNA, 464 bp, Heterodera glycines
  Promoter: Source sequence=SeqID_1786; Location=623..1086; Strand=+; Gene=SeqID_75957
tattaataaagcaaaataataattttgtaatgagaatttaagtgaattgctagctttataaacttttctataatctcttttcttaattttctctcaaatttgtagatcaaaaaccatacattggctatccttaaatctgtgactgaagcatagctgatcagagaccaaaaattaatttttaagtgatttttaattttggtgacgttttgggtcggtgacctttttgagtggtgacgtttttaagtggtgccgtttttgagtggtgccgttttgggttggtgacgttttgggtggtgacgttttgggtggtgacgttctgtccggtgacgttctgggttgtcaccttccgaaggagaagctgaatttattatatctttctataataatttaaaccaatttaaaacaaactaaagcaaaattgctgaacattccgacctagctcttttgaaattttttcaaaaatg

SEQ ID NO: 101430 - DNA, 97 bp, Heterodera glycines
  Promoter: Source sequence=SeqID_35425; Location=1455..1551; Strand=-; Gene=SeqID_64979
tttgattaggaaaaagcaaacaggcaaacaaaacgcataacgattaagtattgaatgggaattaagatgatcaaaagcattaatcagaaaggttatg

SEQ ID NO: 101431 - DNA, 697 bp, Heterodera glycines
  Promoter: Source sequence=SeqID_19996; Location=830..1526; Strand=-; Gene=SeqID_84767
tttttttacaaatttgtttcttaagaggtgggcaaaccatcgttctgaactcgttcaatggcgcaaatgggggcaatgggatgaggagaagcggaaacggagcgaacggaggggcggaaaggggggcgcaacggcaaacgattgcctcgagaagcattcccgtttagagacagcgcaacggcacaagccaattaaggaattaattaacgaattaattaattaattaatgaacaaattagctaattaacgaattaattacgaatatttgttgatcagctcgttttgtttacttattaaatataattttgctcattggcaaatgtccactttatgctttccatctccttttaatttaaacgtaatttaagcggtttcgattcaaagccaaactcataaaatctgaattaaatatttttgaattttcggcacttttttcctaagaccaaataaaagctgcacaaaaaattgatttattttacatatttttgtgataattcctccatttttcgtgcaattcccaccgaaataaacaaaagtgtgaagggaatgaccaaatggacgcaaaaaagaagcggagattcagttattaattaaatatgacaatttattaattgtataatttaaatgaaaattattttacgcctttttccaattatttttgattttacgcattttcttcgattgttcacccaaaatg

SEQ ID NO: 101432 - DNA, 205 bp, Heterodera glycines
  Promoter: Source sequence=SeqID_26755; Location=1..205; Strand=+; Gene=SeqID_57519
actattggctggagaccagccgtgagcgaaagcccgggctcggctaccttcaagaatcccgctggaaggtctgtacagcaaatgacctttaaacacacttcaattctttgcttgttatcaggtaaaggtcagagtgccgaagggtccgcttgccgacctcctcctggagcaactcagcacgccagaacaagtgcaaagaataatg

SEQ ID NO: 101433 - DNA, 591 bp, Heterodera glycines
  Promoter: Source sequence=SeqID_21654; Location=465..1055; Strand=-; Gene=SeqID_52258
aaaatattagctgactacagaaagagatttttacaaaaatttggagatgtatttgatttgcaattgtgaaactagaatttaataaaaattggcattttttaaggttaaatcattttttggcagcttttagcgtatttttaagtctgttttagcaaatatgaatataaatacatttttctgaattttttagggtttaaaagtctagcaaaaaacctgaattttggatcatatcttctgaatttcaaggacgtttgtactaacattaataactgattctccgattttccctcttttaatggtcactttttgcactatcgttcattaaaaaagagaaaattggtgaaccaattcaaattctcatgtcatttactttgcccatattctgctgttctcctctctcccactttttgggtcatcattttgccgtacatttatttatttgtgtcgaccctataaatattggcaatcaatcagcagtaagccattcaaaatgcacacccatcatattaatacgcttacataaaaataaaaaaattattacaaataaaatttttataagtttcagcaatttttgaaaaaaataaataaatg

SEQ ID NO: 101434 - DNA, 84 bp, Heterodera glycines
  Promoter: Source sequence=SeqID_8290; Location=2003..2086; Strand=-; Gene=SeqID_67587
attttttttatttcataaaaattatttgtctctggaaaatttttttgtcgaatttgactacctttataaaaagtgaataccatg

SEQ ID NO: 101435 - DNA, 112 bp, Heterodera glycines
  Promoter: Source sequence=SeqID_21375; Location=900..1011; Strand=-; Gene=SeqID_51982
ggtacaaatttagtccattttgcaaaaccatgccattgccccccccccttcgtccattagttcccaagtgatcactttgatttccgccggcactttaattttcgtcgcgatg

SEQ ID NO: 101436 - DNA, 443 bp, Heterodera glycines
  Promoter: Source sequence=SeqID_44267; Location=1..443; Strand=+; Gene=SeqID_71768
attaggtgctgggacaaatgctgcttcttggggacccgcaagtggaagcaatatgatgatgtggactttacaaaattcattcaaaatgaggtaggatggtaatattatgatccatccctagatgggataactaaaaataaatatctggctgacacggcagcaaaaccagatcttgaactaatgagcagatgatgaaaaataattatgaaattcggacagcagtaaaaatggaaacctaaattaaactcttataaaattagaatgagcaatttgtaattaaagcaaaaaatataattgaatgctctaattcttcaaaatcttttttggtccaattttattagccgccccaaaaacgtttcgattggtgggctctgccgaagggaactgctccgttggatagtgctcgtctgtttgccaaagataaaaaatgcattggcaaaatg

SEQ ID NO: 101437 - DNA, 767 bp, Heterodera glycines
  Promoter: Source sequence=SeqID_2423; Location=2261..3027; Strand=-; Gene=SeqID_79642
attgagggacgaggggcgcggactgtcagcgggcaaacattgtttttacaacacctttttttagtctaccaaatccatcaaaactgagctacagtagactactagatcttacgttatccatattataagggaaaatgaacaagggctggaacagtgtggatcaagtttttaataaaaatcaaatttgggcgaaagtaaaaatgcaacaattttagtatgaaagtcccaaatagtgataaaatgttttgaatttcttacaattttttttaattaaataatttgtttatgcaaatcttttatcattgtaaatttattgacggattgtctattgctgacggattgtccactgacggtttgtcattgtttttggcgatccgcagatcagggtccatatctcgctcaaattgcaggcgagaaggaatatttgtatttgttgagctattttttctttttttaaattgaataatacgattttccatactgacggattgtccactgacggtttgtcttggcatagtagggaaaggaaaataccgtatttcctcgattagaatccccgggacttctattattcaaccccctccaaatgtggcttatatttgaggggcgggcttctaatcgaagtgtggcttagaatcctggaaatatggtattacaagaagtacggtatgtttatccggacacccttagaaggggagaagggaatattcacaaataagtacggtatgttttaattgccagcgcttcttgctgcatatcgcgcgatg

SEQ ID NO: 101438 - DNA, 590 bp, Heterodera glycines
  Promoter: Source sequence=SeqID_31629; Location=1..590; Strand=+; Gene=SeqID_61950
tcactaattggggggtactaattggtcagcggtcaagagggcactaattggtcagccgtagggtgtggggtagcaattaattaattaattggggaaacctaaacctattgaacggtttcaaattgtcttgtactttttttgacagaaaatttgattgatttaaaaagtgacagccgaggggggagggggaatttgattgatttcaaaagtgacagatgagggcgggaaattttttgattaattgtaaaaatgacagatgaggggaaattcaaatttctgatgggggggggggatcggaattttgattgatcaacatatgacagtttttgatattattaaattattcaaatgaagtgaaataatttgttttgcactcggtctttatcaaacttgttatgaatgtgcaaatttgcaatttgttgacgatttcgcgcaatgtttcgaccgaaattaaattgtttgtcacttataaaataggtcaatttgtgaatatttaaggtttccaaaatggaattcattgtaattgctacatttgttccatacttttcttccaaaaattttccaacccattctattgtttacccaaaatg

SEQ ID NO: 101439 - DNA, 128 bp, Heterodera glycines
  Promoter: Source sequence=SeqID_25028; Location=289..416; Strand=+; Gene=SeqID_55759
ttcattaatacataaaatatttattattattatttctgttttcttaaatatttcactaatgtctcaacaatgtaatttaatttaatattttttaattaatcaactaaaaatccgcccgtttagctatg

SEQ ID NO: 101440 - DNA, 938 bp, Heterodera glycines
  misc_feature (64)..(64): n is a, c, g, or t
  Promoter: Source sequence=SeqID_9738; Location=3300..4237; Strand=-; Gene=SeqID_72534
cccccccccctcccgctctcccgatcaaataaaattttgaaaaatcacgcgcaacaaaaccccncagaatgaacgaaatttcgtttcgcttttcattttgttcccttgtcattttttcgttaattttcgtccatgaaaaagtttcttttaattttcggtttttaaaattttatgctcatttcgcttctttttttatttttgtgaaaaaaaaagattttttttttttgtttatttttgttgtcgagtcttttttttatttcgtcatccttggaagcaattagaaaagtttcgaataaactactaatgagttatagaaattggctctactccctccaatgggcgatctatccaattggacaacagtcaactaattagcgagcacaatattcttcagagtgaattaaattcctaaaatatacacaaaatgcacatctcttctcctacttccgaccaaactaattaaccactaattactaaatatggtttaaaagtcgcctaattagtgaatgagtgattgtgtgtcgtggaaagtcaatctctgtgtgacaaaagcagctttgccaacagcacaaaaagctgtgaaatttttcgggcgaagaagcgaatgtgtgaataatgtggtgtgtgtgtggatcggataaaaggatggattataaatttagtttttttttagttttaatacatagtagaaaaatcatttcaaattttcggaattttctatattttcccatagatttttgaaaatttcaaactgaaagtttcaattttttagtgaaaatttgtccttattttttaaaattcatttgtttttgtttttttaagaaccggcttggtcagaaaagcccaggtattcaaaacttataaatttttcaaaatatttaaaaatctaaaaattttgcgccccaattacttttaaaccaaactctgattatgtgatg

SEQ ID NO: 101441 - DNA, 683 bp, Heterodera glycines
  misc_feature (25)..(25): n is a, c, g, or t
  Promoter: Source sequence=SeqID_27722; Location=1..683; Strand=+; Gene=SeqID_58392
ttttaatgattgcgtcgcaattatntggaactaataccaacaaatgcgatatgttcacttctcaaatgcataattgtattaagggataatgaaaggaaaaatccattttgccgattcatatgatgagtgaattgagttgtgcgttcattttgagtcaactttcaacaaaattagtcaaatcaaaaatctacgccgcagttggcagaaaacgcaacgccaataaattttcaaaaaaatttacgaatggctaacgtgtgggcgacatgaagtttgggcaccgggaagtttgggcaccaggaagtttgggcaccagaaatttgggcaccgggaagtttgggcaccagagggagggatttcaaaaaaataaaacaatataaatatataaaatgttatataaatcattaaaatttagtaaatttaacaacccttgtgctcaaaaatttctatgttcttgaaaattaaaaaatttttatatggaaacctggcaatcttataatttagtcaattcttatgtactggtttctgtttggacttagacctgaataccgtcttattgttagttgggcccgaaataacaagagacccgtctaatactatttaaatttataaattttaaatcttgaacatactgagccgatttgttggatttggatgataaataaaaaagtttaaccaaaaacatg

SEQ ID NO: 101442 - DNA, 67 bp, Heterodera glycines
  Promoter: Source sequence=SeqID_33910; Location=87..153; Strand=+; Gene=SeqID_63833
tcgagtgtacaaagtgagaaaacggggaacaaagaaatgccaatgccaagagagaaagaaagaaatg

SEQ ID NO: 101443 - DNA, 104 bp, Heterodera glycines
  Promoter: Source sequence=SeqID_5035; Location=1385..1488; Strand=-; Gene=SeqID_56662
ttcttaaaccaagaattgacatcataacaccattctcccgtgctgctttaggcttcgcaaatacagacactgcctgggctcttggctatttcggactgaacatg

SEQ ID NO: 101444 - DNA, 511 bp, Heterodera glycines
  Promoter: Source sequence=SeqID_8696; Location=1..511; Strand=+; Gene= SeqID_68885
ctggtgcgcttctgatcactactcgaaaaatgagtgattgaattttcactaaaaagttaagcctaaactttttggcctgtataaaaaggaattaaaaatttttaaaaatttattcatctccctttttgatagaaaaagcatcagagtgcctaaactaacatgtaaataaaatttggtgcgtttcagaaccctttctgaaaaaaatatttatgaattaattatgcaaaaaacaaataaataatgaactctcttccttaataattttcctgcaccgaaggtactcactcggccgcttcgcggcctcgtggtgggccttcggtgcaggtcaattgtggaggctgatgcttcacaaggaggaattggtgcaacaatcagccatcaatttcccgacaaaagtgaacgtgtcattgaacacgcatcatgcactttcacggctgcgcaacaaaattacagccaaatcgaaaaagaggctttaggattggtttttgcggtacaaaaattacaccgcatg

SEQ ID NO: 101445 - DNA, 435 bp, Heterodera glycines
  Promoter: Source sequence=SeqID_20134; Location=796..1230; Strand=+; Gene=SeqID_84921
aaatgtacaaaacataaatatattcaccacttcaacacgtcatttattagatttttggaccaggatttccaaggtttaggttcaacaggaataaagttgatacgctaacatttgttattaaaaaaattttccggctattcttttatttggcttattgtgtttgctctttcaagaaggagaaatttatactacgacattgtgagtctgatgaaattgaattatggacggaagcatttggaaagaaccggtttgaccctttttaagggttagtaggagtacccgccccattttgttcattttcagataataaaataggtaatttagggatgcgtttttcacgtaaaaacttaatcaaaaaacttaattttgcttatattttaattgttttaaagttttttcggtaaatattggtcatatggcactgaggccaaaatg

SEQ ID NO: 101446 - DNA, 77 bp, Heterodera glycines
  Promoter: Source sequence=SeqID_17248; Location=3638..3714; Strand=-; Gene=SeqID_81717
aagaaacacattcatcattcggttatctgttgcttttctcccctgctccctctccaatacgctcccgtttcgaaatg

SEQ ID NO: 101447 - DNA, 466 bp, Heterodera glycines
  Promoter: Source sequence=SeqID_38432; Location=805..1270; Strand=-; Gene=SeqID_67248
ttttatttttttttaatttgcattcgtttttaagtgttggtgggcatattatttaagaaattttgatcgaagttatgtctttgttcataattgtatgagcataaaaagcttaattatttaaatatgacaaatatttgaaagtaatttttattttactgactctttaataattaaataacaaaaattaataatatattataaaataaatattttgaataaattatttattcaattaactgttattttctcaatgaatcatctcttttcgctgcaatcacttgctccacgaaatcatagagttttagctattagttggttgaatggaaaatttttgcagtcattaagtaatcattttccattttcattcattaaattccattttttaatttgcttaagaaaaatttcttttatttttatttccattttatttcaaattaaattgaaatttttaaattaaacaaaaatg

SEQ ID NO: 101448 - DNA, 426 bp, Heterodera glycines
  Promoter: Source sequence=SeqID_3842; Location=2555..2980; Strand=-; Gene=SeqID_52096
acacttccgcaatttagcgacaaagtaaaaacatttgaattcatttgaattagccaataaaataaataagaaaatttagcatttaaaagcagaaagcacatctgcagagccaaggcaaaaaacgacaaataaataaatctattattggataattaactctaattaaggcaattattaatttacgatgaaattcgctatcgttaattgccataggtgtgtatataaaattgttaatgatttcttttctaaggtaaagtctgcacagatgctgctgctgataatgatattgttgatcaacttcttgtggattttgaaaaagaaagccgaattttaggccttgttgaagaaatgaaaaattcaaaaacagaaacggaaaaattcatcagcgaaattaatgagaaaactattaaaagttccgaaggaatg

SEQ ID NO: 101449 - DNA, 457 bp, Heterodera glycines
  Promoter: Source sequence=SeqID_19029; Location=1594..2050; Strand=-; Gene=SeqID_83761
ttttataatttatttatatcaattatattattttttctcatgcgttaatgtgtagtttttttgagtatgttactgtaatcctttttttaaatttaaaataaattgtttaaataacggattttatttgatttatctgaaaataattgctgttattaattattattttataatttgtaatttaagataacattttattttttatcttcataattttagaatttttttaaatacttagcttctttttttattttcttatttaaaattatttcatttgtttttaattaacacatattctttattttatcatttttatcattacaatcactgagacccaattctctggcatacaatcattgtaattctatctaaccacttctgcatcccaatcgccgggactcaattctccggcgttccaattacttagactcaaactcaacaatccttcggcattccaatg

SEQ ID NO: 101450 - DNA, 1003 bp, Heterodera glycines
  Promoter: Source sequence=SeqID_11929; Location=2870..3872; Strand=+; Gene=SeqID_75449
cattcggacgaatgggtgggagagtaaagggggccgaggaagtggaaggcaattgcttactcttttgaaaaagtcccgaaatggccaaacggagtgtgtgaatcgtttgagttaggatcactcgcaaaaatcgattgattggcgattattttgtcctttggccattcttccgccggctttctcttcgattggcttccatttctctcgtttttcccttcctttctctttgtattcccttgggcaatgaattcgttgaaatggtacagatggattggatgcttttcctcccaattcaatttgtgttcatcggatgaattcctttcgttccttagcttgattaggcttcatcttcttccccctcattttcccttttattttccgatggttttcccacaattcttcgcttttccttcccaaattcccccgcttctcatcgttctcttcgttctgttgcttcacctccataataattccccgcaaattgttggggcggtggcgacgaaacgcgcggccaatgggcgagaagaaattgggcgaggacaccgccgaaagggccgggcggaagagacggagggggagggggagcatttgcgtgagttttcaaaggcatcgccaaatcagtgaaagtgccctttggcattcattgctcaatcattatccattctctcacatcgctttccttccgccgtctactgattaattactttctctctctctcttttttatttttaattagaatttctcaatattttatcgatggaatcgaatgggcaaatgcgccgggggaagggggagtaagcattttattatttgcgcagcagatagacgtgggcaacgacggacagtttatgtacaagacgaaggggggggggggtggggtcgagcagcgattgcttctcccataatccctcacagtctctcctccgcccgcttctgcttttcccttccatttccccctcctccgcccattcttttcatttccccatttaattttctggccatg

SEQ ID NO: 101451 - DNA, 689 bp, Heterodera glycines
  Promoter: Source sequence=SeqID_37849; Location=744..1432; Strand=-; Gene=SeqID_66834
atgtgattaagtgataagcggataatgagagaaaaaaggatgggatttggtaattagcaaatgttaattaattggataagcggataatgacagcaaaaaggatgggagacggtaatttgaatgtgattaagtgataagcggataatgagagaaaaaaggatgggatttggtaattagcaaatgttaattaattggataagcggataatgacagcaaaaaggatgggagacggtaatttgaatgtgattaagtgataagcggataaagagagaaaaaaggatgggatttggtaattagcaaatgttaattaattggataagcggataatgacagcaaaaaggatgggagacggtaatttgaatgtgattaagtgataagcggataatgagagaaaaaaggatgggatttggtaattagcaaatgttaattaattggataagcggataatgacagcaaaaaggatgggagacggtaatttgaatgtgattaagtgataagcggataatgagagaaaaaaggatgggatttggtaattagcaaatgttaattaattggataagcggataatgacagcaaaaaggatgggagacggtaatttgaatgtgattaagtgataagcggataaagagagaaaaaaggatgggatttggtaattagcaaatgttaattaattggataagcggataatg

SEQ ID NO: 101452 - DNA, 1003 bp, Heterodera glycines
  Promoter: Source sequence=SeqID_14221; Location=2612..3614; Strand=-; Gene=SeqID_47187
aatatggatcaaaatatggactaaaaactccaaaaatataagctttaaccctcaaaaactccaaaaaatgtgtatttattcaattttgcttaaacagagataaaaacactaaattattaattaatggatttaaattaaaaaaaagccaaattttctcaaattctatcttcacaacaattgcaaaaaatacatcccaaaattttgggcaataatttcattttgttgtcagcgaaaattttcggaagcgaacaaaatgcctaaaaaatttgccaaaatttctaaaaaaattcatttttttgggggtttacttttaagaaatttccaaaaagtcgatccttaggggtgtattttttcactttttttccattttcatgtgaaaatttgctaaaaatggccgaaatatggacttattcccgaaacccccaaaatatggatttatatggactaaaaaccttcaccaaatcaaaaaattttaacgtaaaaatgatatttttgatcccctttcttcatagcatatgcgcagaaaaaatatgtttattcaatataatttataaccctactacatatttacggaaaaaagcaaaaaaacatatacaaggtgacattttgatggaaaatgcgtcagtgaatcaggatttattcaaaaacgagtactttagtattattacctgaaagcataagcgttgattggtatttaagcaagcttacaacaatccattagagtataatttcatgttattagtgaacctttaaaaacttaattgaaaaaattagaacgaaatttttctacattctgaccttttgtaatacaatacttaatgaaacagtactttattttataaattctgtattactgatgcattttctactgacgctttttacacttacgctttttccgggaaccttttaaatcagttccccgataaaagctgaaaaataatttaatgaaataacctataacaatgagagtataaatttttttaaattctcaaaggttgagatg

SEQ ID NO: 101453 - DNA, 219 bp, Heterodera glycines
  Promoter: Source sequence=SeqID_22921; Location=1..219; Strand=+; Gene=SeqID_53623
cgatgtgttcattcattggtggagcgaatcatacaatcctcccaagcggcagaacaaagaggagggcagaaagggtaaatctttaatttaaaataaataattaacggaccgaaattttgcatactttaaaaaggcgaaaaaattttaacggaccataagcttttacaattttgatcagttacaaattttaaatgaacatatttaattagctgaccaatg

SEQ ID NO: 101454 - DNA, 432 bp, Heterodera glycines
  Promoter: Source sequence=SeqID_35740; Location=380..811; Strand=+; Gene=SeqID_65221
aacaaatgcaaagtccaaccaaccgactatgatttttttgttttgttttctttaaacggatttataaaatatgaaagaaactaaacaaattgctgattcatattttattttaaattgtaatatttcaacaaataatcgttttttatccgtaagtcgtaaataacaaattgtcgtcacaggtatctacaacgatgccaactgaagtggtaaacaacaaatgtgataaacaatttctggagcttttaggggtcgcgtgtcatgagtatacatccattcgggctaattcagagtcccaaactcggggcaaaaagtcgaaatattgtgactgggatttttattttagataaatccgttgtctaaacgtcgaaccatcaaacaaatgattcttaggattggctaatcctaaaaaatctttcagaagtctttgtcatg

SEQ ID NO: 101455 - DNA, 514 bp, Heterodera glycines
  Promoter: Source sequence=SeqID_1280; Location=693..1206; Strand=-; Gene=SeqID_71405
aactacgttataacttatactataggcatttttaggagagagtttctatttatacttttaaactataaaataaatgatcattttggcaaattccaatgcaaatggatgtcttttttttttgctcgcgtcgtttccattccctcgagggatgacgacacccttttggcacttccattgtgagacttccatctttttatttcatttgttaatggattttgtttgttatactccttttggcatttaactttaatttgacggaaatccgctgaatgataatatcgctttgatactcgtccatcttttttcattcgttggattatttttagccagtgaagaaaggaggaaagtgctcaaattaaatgccattgcacgctgtccattaacattgattagattcgactttaatccccacttccttcaaatgaatgtccattgcttgagttcttccatatttatggccttgaagcattccattcgcactttcattatcatacgattctgttaaattcagatg

SEQ ID NO: 101456 - DNA, 753 bp, Heterodera glycines
  Promoter: Source sequence=SeqID_34877; Location=1..753; Strand=+; Gene=SeqID_64575
taccggctatagtgaagctattcacggaaggattcgcgtctccccataaatctgggcgcatcggatcagggggactgccccgaaaacccaaaaaaaaatttttaaggataaaaattatttaaatgaactgactatataatatttaaaatagggtatttctcttcctttcagtatccctgcaaagttgggtgcgcttctgatcagattctgaaaaaaaaggtaaggctaaactttttggcctgtttaaaaaggaattaaaaatttttaaaaattttattcatctccctttttgatagaaaaagcatcaaagtgcctaaactaacatgtaaataaaatttggtgcgtgtcataaccctttctgaaaaaatatttaagaattaattttgcaaaaaataaataaaaacgaaagactcatattttcgaaaatttttttgagccagctagctcggcgctcatttcagtgtaagttactcctttaccggggagtatccctgctaagtttggtacgcttctgctcagattaccaaaaaatatgagtgatcgaattttcactacaacagctaaggctacattttttggcatatttaaaaagcaattaaaagatttttacaatttaataattttcctgcaccgaaggtactcactcggactcttcgcggcctcgtgcgcggagccgttccgcgcatagtaagggttgaacagctgcgagactttttgactgctacattgcggaatcatagtggtgcaaaaatg

SEQ ID NO: 101457 - DNA, 551 bp, Heterodera glycines
  Promoter: Source sequence=SeqID_2161; Location=613..1163; Strand=+; Gene=SeqID_78185
ggtaggtcgtccgtcaatacaatattttaaataatatttattttaaaattcctatttttgttagtgccatccggcgtgttgaccagtgacgagttggtcggcgtcttcctgacccacgcccacgcggaccgtcgtgccaactccgagttgtaccccaaccaatttcccacccaccatcgcactctgctcagcgcttttttcaacgaaaaattgattagtcgataaagctattttgcaaattgttctgatttttaaccaaaaaattcattaaatttatatcttttctttcttttgtcgctttaagttttgacttttgaaattaacaacaatgaaagatcgaactttttttggcattttttgcgatttaaatttgatttttgacaattttattgcacatcaacattatttaatgtgcaagaaaaatttacgcatttttcccctgaacatttcggcgacgggatcgaaagtttaaaattaactttttttttcagtatatcatacatatactgtacccaaagcaaagtagtttttgaaaatttttcaggcaaatg

SEQ ID NO: 101458 - DNA, 191 bp, Heterodera glycines
  misc_feature (25)..(25): n is a, c, g, or t
  Promoter: Source sequence=SeqID_22007; Location=1..191; Strand=+; Gene=SeqID_52640
ccgatcagagcagttgaacaatttntggtcattgggaagcaatcgggataagagacgacccgacagacgacgcggatgcgcaagcagtgatacaattcgaacgatcagtgcgccaactcaacgacgggcgctactccattcgattgccatggtgggagtgccaccccgctttgcccaccaatttcagcatg

SEQ ID NO: 101459 - DNA, 100 bp, Heterodera glycines
  Promoter: Source sequence=SeqID_8378; Location=2550..2649; Strand=+; Gene=SeqID_67857
tgtcgattaattaggaaagaaaatttgttgttttttgcgatcttatttggacaattaattgccatgtatcataatctaacaaatatttcagtttctcatg

SEQ ID NO: 101460 - DNA, 364 bp, Heterodera glycines
  Promoter: Source sequence=SeqID_305; Location=888..1251; Strand=-; Gene=SeqID_81643
ttctttccttattttttgtggccttttaaatctcattgcccaattctttctctgaatgattttattggcttgtgaagacttatttttagtttttttaatttctattcattatttttatcttttaacattccttcccatttaaaagtgcaatattttttcattttcattaattgtactgtgattgttggaaaatgtgttaatttggagagataattttgttaaattcaattttgtccattcttttcctttaaattaaaataacagaatgccataaaatgcgtatttgtctatcagctaataattttgggtctgattttgcggttctttttgagaaggaaagcgcacttttgacgaattctaaatg

SEQ ID NO: 101461 - DNA, 273 bp, Heterodera glycines
  Promoter: Source sequence=SeqID_39393; Location=640..912; Strand=-; Gene=SeqID_67969
cgctttgtggagaatggaatttttaacaaattatctggggctttaagccgcttcgcggcctctaacgggcgcttcgcgcccgttttttaaatttggtgattcttaggccgtttcgcggcctcgaacgggcgcttcgcgcccgtttctaaaatttgttgagcttggacgggcgcttcgcgcccgttgttaaattttgttgaggccaaacgggcgcttcgcgcccgtatttaaatgttgttgagctcagacgaggtacaaaattgttggaagatg

SEQ ID NO: 101462 - DNA, 191 bp, Heterodera glycines
  Promoter: Source sequence=SeqID_38021; Location=1..191; Strand=+; Gene=SeqID_66961
caatgatgatggaaattgttgaaaagtttcacttttgtaatgtgaagaaacgaggtcattatcgagatgggtatactgtatgctactagttttgctgtggatagcaattgttatgacaggaattttcttctattttaactctttaattagaaatttatgtaagcttatgcatatatgtagagacgaaaatg

SEQ ID NO: 101463 - DNA, 149 bp, Heterodera glycines
  Promoter: Source sequence=SeqID_41123; Location=416..564; Strand=-; Gene=SeqID_69324
tgttgcgccccaacaccgcagtgccagggatcacacatcagctccgtaagaagccttcactttcattgcgcctttgggttttgaacacccaatgacttgcgcatacgctaaactccttggtccgtgtttcaagacgggtcgaacagatg

SEQ ID NO: 101464 - DNA, 148 bp, Heterodera glycines
  Promoter: Source sequence=SeqID_10163; Location=1..148; Strand=+; Gene=SeqID_73268
agctgctcccgttttcacggatttttagaacaacaacaaaaaattatcaagagggtggggggggcggaccatcggcaatattacctaatgcattaattcattattcaattcgttctttgccttctcccgtcagaacaccgccctaatg

SEQ ID NO: 101465 - DNA, 165 bp, Heterodera glycines
  Promoter: Source sequence=SeqID_6980; Location=1..165; Strand=+; Gene= SeqID_63475
agtgccaaaaccaacggcacgccccccgtcccttccttttaccctccgcttcgttcccaaccccacgcgcgagtggacacttctccgctttactcggcacaaaccttcgaatttctgttgcccccgccgccgcccgtgcgccgacgtcaccaaattgagacaatg

SEQ ID NO: 101466 - DNA, 458 bp, Heterodera glycines
  Promoter: Source sequence=SeqID_4257; Location=1..458; Strand=+; Gene= SeqID_53778
taatcaaacacaacatcctcaaattcgtaccaatgcttcttaggcctataacaaaaaatgttttaatgtcaattttttgaatatatttttttaaattttgcctgtattcgcgtaacagccgtttgttacgtaagcctagcactttgccaccttcgccaggaaatgcagttattcctgaaacgtaatttatatatcaaaatagcaaatcctgtatacacaatattcgaatgattaaattcggattttgaattaaatgaatgagaacacaagtgctgcaactcgcctccatgtggtgctgttttgtcgttgggatgaaaacggcgttggtgttctaaaaagttcgaattaggtggctgaatttcgatgtaaaaaaaagaaaatttcaaaattaatccagggcgttttatttcccggtaaaagtcgggaacattggtcccacaaaaaaagtaacaaaaatg

SEQ ID NO: 101467 - DNA, 907 bp, Heterodera glycines
  Promoter: Source sequence=SeqID_25867; Location=303..1209; Strand=-; Gene=SeqID_56640
aaatcattcatccgaagaaaacaaacgaaagaaacattgtccattttaaaacagtaaagcatagtgaagaaagaataataaatcgaattaggtaatttttatggttccaaacaatgaaatgaaagtaagcccaaaaaacagtgacaatcaattcaatggtcttggcaattaagcacccttaggctacacttttttctctcttgaaaccatgcatgaatataaaaatgatgattatttcaatgattatttgccgacgattgcccgccctactcagtcaaaatcgctgcccctaaaaatgccgatgcttcggcattaatagccctaaaaatcataatataaatgtagaatttaattgaaattttttaatttctttagtattatacagaatgttttcatcccgttatcccctgtaatctgaactcggaattccgttgcatcctgagaactcagcctattgttcttttgtacatattgtaaaacaaaacaaaatccaaaaataggttttaatgattttctatcatatttttcagtaatatttatttaaaattcttatttttgttcttttctcaatttttaatatttaataataaaattgttaatttacagttaaatcataataaatttctttgtttgtaatgaatttttatgattttaaaatattcatcggattaaattacctttgtttttcatttgaatttgaatattggcattttgttttctacgccaatgattttgtgcgtttcttttttaccgtccgtccgtgaaaaggtaaaagcctcgccgggttagtccggtctctactgggcttgatccataatgcattcaatatttattaagattttctttagaaaaagaatagcttgggaatattcaattttctttataaagcagaaaatcgtgtaaaatg

SEQ ID NO: 101468 - DNA, 56 bp, Heterodera glycines
  Promoter: Source sequence=SeqID_31081; Location=1..56; Strand=+; Gene= SeqID_61453
cgcaacaaagtgtggacttgagttgcatgacgtttgccaatgctggactagaaatg

SEQ ID NO: 101469 - DNA, 329 bp, Heterodera glycines
  Promoter: Source sequence=SeqID_3461; Location=949..1277; Strand=-; Gene=SeqID_84758
ttcatttcctctcccgtcgtgtgtcaatctttcgccccaaaggcatttgccgcggcttttcgcctccggcgaaatgcttttgccggattatccctccgacggcttttccctcatttcccttccttcattttctcgcttttccaacacattcgctgctgtcattcatcatcagcagccgacagatgtggccaattaatattttgtgtgctgtcctataaagcaattggctgccaaaattcgctccaaattaaaataaaatgtgaagtgattaaaacaattaattaaatcaggcagaatgaattaagacataatccctttttaacgtgatg

SEQ ID NO: 101470 - DNA, 378 bp, Heterodera glycines
  Promoter: Source sequence=SeqID_12952; Location=2050..2427; Strand=-; Gene=SeqID_47091
acgacgagtaattaaaggaataattttaatatttctgtatttgttcattcattcataatttttgacagatcattttgttgtttttaattctcactaaaagagcgtatcataatgttctattattcattctcacattgctttaatccattgttttgcattttgacatccgaaataaaaattgtccaagaaatatggtggaagtcaattacttttgtaatattaattaatttattttttatatcttttcaaaattagccaggaaatgtaagaactcaagcatatgttattgtcccttgcaggtcacaaattccataaatggcttttccaaactcaatgataaaacctgtgaatacattaaagagtttaatgaggacaatg

SEQ ID NO: 101471 - DNA, 1003 bp, Heterodera glycines
  Promoter: Source sequence=SeqID_26342; Location=777..1779; Strand=+; Gene=SeqID_57086
cccaccatctgtcatcatcaatattcgaaacaccaaaaaaaaaattaaacatttttgcttcaccaaagccttcggacactttcggcgacgaattattgttttatgtgttgcgtaaccgagcgagagaactgatgagactgttcacaatacacaaacacataaatattcctcatttgtttttttttgatattttcaatttgcttttaaacaggtcgaacacctcacttatcacaggttttctttcaaaattcaatcctcagagtttgttcactcggtgctgcctttatggcttcttcatcgacactcatagaccaccgccgtcttctcattgttttaattggttgttatattgtgcatggcgcaccgtttgccgatcggagtgactcgcaaccagcagagaaagcgcggtgagtttttcgggataacacatgtttttcgggttccttttgagtcccttccttaaatgtggtactctgtaagtcttctaatttatggtactgtgaaatttggagtgatgggccccttttgtacggttaccgcacatcaattgtcgatttattactgaaattcgtgcatattgatggtagaatcagccatttgttggtttacggatgggctagaccatgtaatttgcataacttataggataaaaccgctcatttgtcgttgtgtttgttcaatgagtttctattcggcaaacggtgatctgaccactaatcctccctccactttttattttcttttctttttgtccaggcctcgttttctttgtttgttttctctgcgggtaatattgcacttttgaaaagatctcagtttaaagttggaaaaaattcaatttattttgtgaactaaacagttaacgcaataaaattaaaaacaaattcattcgtgtaactatggaaacttttttgtctaagaaagtcgcaacaaatatttttttgtgtctgaatttgcatttttatgtccactttaaggtttctttttatttctaaacattatg

SEQ ID NO: 101472 - DNA, 74 bp, Heterodera glycines
  Promoter: Source sequence=SeqID_16416; Location=3226..3299; Strand=-; Gene=SeqID_80819
ccgattttcatttttcagatattaaatccatttaattggccttttattttcgttcttgttgtctgctgattatg

SEQ ID NO: 101473 - DNA, 424 bp, Heterodera glycines
  Promoter: Source sequence=SeqID_7749; Location=1..424; Strand=+; Gene= SeqID_65817
tttgagtttaggccagtcattctgaacatgccgccatccttttgtgggacacacgcaattggaaactgatgaacaccttgaaagcccatcaggtttgacacggtcaggcgccacccccccccccccttgaaatgaaaatttacaaatttttcaaaaaaaaattcaaaattttatgaaattttgcatattatcattttgtttttcgtcctggcgctcaaattttgcactaacaaaataggaaaaaattttggccaaaagagcaatacgcttcaaaagtttttttttcaattttttttgtattttttttactttaattttattttttacagttgactgtcacccgtttgtccttttcacacggtcattcattttctttgctcacttttatgtcactctttttgaaaatgtcttattttttcagatg

SEQ ID NO: 101474 - DNA, 872 bp, Heterodera glycines
  Promoter: Source sequence=SeqID_30318; Location=785..1656; Strand=-; Gene=SeqID_60736
aagggtgtggaaaggtcattttgaacagccaatttcattttcttcgtacaacattaagcaattttgtcaaagaaatgaaagaaagtaggcattggaatttgattgatcaaaatttcacttataatccacataactacgacattcgtgtgcgaggatgcattcccattttttatttgcctattttggcacaatcagtctccttcggcgacggcattttcttacctttttgtgtaacctactgtcggattgtgcactgtccgatttaaatttgtcaattatgagtactttcgcggtttttgagtcaatttacaaaataaagggaattttagggctccggcgttgccgattttttttaaattatattttttgaataaaaatttttagggctattgaatgatatcaatcatataaaattttgtcggttccaaaaaaagttatgatggtttatcgaacttttttagaaaaaattgaattatttaggcggtccatttgagcgttagacataccaaatagtggacataatatgaaatttaaaacacaccaaagaaaaaatggtgattaaaaaatatttaaaatgtcgtataaaaattttaacaaatttattcatataattcaaaataaacattgctaattgccactggtaaatgttgaacagcgacataattaaaaaagaaattacatcgatgtccaatttatcatttatgtccaatttccacagtgcaaaaaatttgattcaccatccaaattctaatgtttttgccagcagcgagcaaatttacttcggaaactgtaattatctttaaatttttgaaaatttaaatccaagtctttgaaaaattaaacttatgtttaacttcagaagaacagaaatg

SEQ ID NO: 101475 - DNA, 657 bp, Heterodera glycines
  Promoter: Source sequence=SeqID_12288; Location=511..1167; Strand=+; Gene=SeqID_75879
tgtaccattagtacatgtgtagttagaagtacttttttaatgagaaaatttttttgtttttacccgccagcgcccgcccgcccgctaatgtctcctcccgccctaattacgtctccccgtcccgctaattccccaaaaattcgtccgtcagtccgctttggtccccctcgcccgcaaatgcgtcgtcgttgtcgtcgtgcagcaacagcaaaaagtaacaggagaaagaagcaggtcacatgagcgcgaccgataatgcaccgctgataaaatgcattgaaaaatccccccaaatattatgaagaaaacatggagacgacgacggacatgtttttctttggcatgtgaacatcatcataattaaccgagcaacagattatgacagcgaataattaacagttggcttatatattagggattaatgctgctcattcatatgccagtctcactcatcacacattgatggatttgttgtccccaaagccaaaaattctgataatccttggtgaacaataccttctctgttccccatatacggtgctttaccgtagtctgtaatatactttattacgacatatttggatctaaatattctgattaaaagcatatttattctttagaaatttgtttgtaaaatttggtctattcaattcaatg

SEQ ID NO: 101476 - DNA, 762 bp, Heterodera glycines
  Promoter: Source sequence=SeqID_32048; Location=1..762; Strand=+; Gene=SeqID_62358
cccaaattttttttacagcttacttaggcccaaataagcttatttccagaaaatctcgcatgaattctcattttaaatttttttatagatttttaaatgtttggatttttttttggcttaacaaaacttcatcgaacctggttctttctatttctctttcaaatcgccccaaatttttttttacagcttaactaggcccaattaagcttatttccagaaaatctcgcatgaattctcatttttaaattttttatagatttttaaatgtttggattttttttggcttaccaaaacttcatcgaacctggttctttctattctctttcaaatcgccccaaattttttttacagcttaactaggcccaattaagcttatttccagaaaatctcgcatgaattctcatttttaaattttttatagatttttaaatgtttggattttttttggcttaacaaaacttcatcgaacctggttctttctattctctttcaaatcgccccaaattttttttacagcttaactaggccctattaagcttatttccagaaaatctcgcatgaattctcatttttaaattttttatagatttttaaatatttggattttttttggcttaccaaaacttcatcgaacctggttctttctattctctttcaaatcgccccaaattttttttacagcttaactaggccctattaagcttatttccagaaaatctcgcatgaattctcatttttaaattttttatagatttttaaatg

SEQ ID NO: 101477 - DNA, 157 bp, Heterodera glycines
  Promoter: Source sequence=SeqID_42577; Location=1..157; Strand=+; Gene=SeqID_70438
tccacagaatctcgaatgggtcaacaacttcaaagaggtgtgtctcgccatattttctataaattgttgttttttccaattttttatttagacatttcgccgtgccaccacttctgtcagttacaatattcaattttatcttcgtgtggaaccaatg

SEQ ID NO: 101478 - DNA, 1003 bp, Heterodera glycines
  Promoter: Source sequence=SeqID_1548; Location=1250..2252; Strand=+; Gene=SeqID_74385
aatgacgaacaaaaaaattatggccattcccatttgaaattgtacgaactgccttgacaccgaaaatcccggtcccgtggcactctacttaaaatagtgaaaatttactattttggcgttttgtcaatattttttttactatttcgacattttttggaaaattttgcaacacaaatgcaataaaagcgaaaaatacacttttaagaatcgaacaaaaattgagccaaaaatttattatttactaattgcagttgcaaatgagtaggactgagatttttaaggccaaaaatgccatgaaaatgaatttctgggaaaatttttaatttcttaggagtgtattttttttaatttttgggacgatttttaggagggtaatttttctgaaattttttaagtagattcttaggggtgtattttttggttttattgcatttttgttgagaaattttccaaaaaatgtcgaaatagtgaaaaaaatagtgacaaaacgcacgccaaaataatgaattttcactattttagtgacgaagctccaatggtgacatgaagtttgggatgaaatttgggcaccagagtaagggatttcaaaaaaataatacaaaataaatatgtaaaatgctaaataaatcgttaaaatctagtaaattttatgaacccttgtgcttaaaaatttatgttttcttaaaaaacggtaaataaataaaataaataggggagcaaaatagaatttagtgctaatttggattttggtgatgaatggttttggcatctttcatttgtgcttttatatgccatggtttctctgcccatctctgctgttcccattttgtttctcttctctaattgccattaatctgtccatttgattttccttgggttaatttgagtggcttaatgccctcctctgccagtgaatgggaacggacggcattttctttgctcgcacaacggcactttgggaaaagcaacctaatcctcaaccaaaaaatgaaaagcaaaaatg

SEQ ID NO: 101479 - DNA, 59 bp, Heterodera glycines
  Promoter: Source sequence=SeqID_6024; Location=1147..1205; Strand=-; Gene=SeqID_60050
gggccccccaatttgccgccttttttatcgcgccaaaccgcgacaaagtgctgaaaatg

SEQ ID NO: 101480 - DNA, 351 bp, Heterodera glycines
  Promoter: Source sequence=SeqID_5691; Location=422..772; Strand=-; Gene=SeqID_58920
tttcgccaactcagccaaaaacattcatttcgccaactcaaccaaaaacattcatttcgcctactaagccaaaatctgacattttgccaactgacatttcgccaaatagttaaaaaatagttaaaagaatcaaagaaaaaaaagtaaaaagagtaaaaaaatgctgttttaatatcagatacagccctattccagtttatacgtccaatcagtgaccatcatcatttcttatgtcctaacttttttcatatttgttcattccaaccatttttggatcaatcaaagcttaagaattcctttcacttttttataatttcttttctagcgtaattcagattctagcaagaaatg

SEQ ID NO: 101481 - DNA, 644 bp, Heterodera glycines
  misc_feature (278)..(278): n is a, c, g, or t
  Promoter: Source sequence=SeqID_17857; Location=629..1272; Strand=-; Gene=SeqID_82400
ttttattaatgacctcaaccgaaaggtcctaatataaaagaatttaaaaaacagcgtaagtctagctttaagccaaaagcttaggcttagtgtaagccattgttcgagttgcctgtgtatgagttgttattatactttatgtttaacaacgaagttttagttaaaaatttgagcctcggaatgaaatccctgccatggacacaaatgtcatgggacgcataaaatgccatgggacgcgtaaagtgtcatgggacgcgtaaaaccgactagaacccaanattttttgaccatttacaaactcgttcttttctaattcgagtccggtgttcaggaattgggtacttatcggttttggtcctataactctaaatttcaaataagtcaactaaagtcgcgtgggaagcaatttagcgcacaccgccgccattttaaggagcacaaatgccacaatttgcatcaaaatttcatcaaatgagttcaaatttcatattttgcagtcctcgcgggaagttacttccactcaacttatgtagaatttttgaaaacttagaggcgtagaatcaaaaccgaaattaccccaaattgtgaaagccatccaccccaaaattgcaaaaataaacattgtatggcggcggtggaggatg

SEQ ID NO: 101482 - DNA, 141 bp, Heterodera glycines
  Promoter: Source sequence=SeqID_33592; Location=1..141; Strand=+; Gene=SeqID_46349
atgattagatactatttaaaaaaaacattttttgcaaaccaaagggtccaaattgcaaaagtgacacttggcaaatggcgcccaaaatgccattttcgacattcattaattaattcattggccttaagtcactgcaacatg

SEQ ID NO: 101483 - DNA, 102 bp, Heterodera glycines
  Promoter: Source sequence=SeqID_10804; Location=2234..2335; Strand=-; Gene=SeqID_74066
ggtaagatgactttaaacatactttttttttgagaaaaccattgaatttaaatatattaaaatattaaattaccagcgcttcaatgttatttggccattatg

SEQ ID NO: 101484 - DNA, 365 bp, Heterodera glycines
  Promoter: Source sequence=SeqID_31116; Location=534..898; Strand=+; Gene=SeqID_61496
aaagataggtcagatttaaggccatattcggattctactggtctaatttgtacagaaaaccttcttttttgttatatcaggttacttttttgaccataaaaaattcgagaaaaattagtgggccaattttcaatttttgcatggtcgggaaaaaatactaaaaaaattgaataagcaaataaaaaatgaaacaatggcatgaaatgaaagaagactttctgacgaacaaaataaaaaaaagaattattaaaataactgcagaaattacggagttatgaatttttgaatttgtcaaaaaaaatagagttgagcgggaacttatgttacatcctaagtaatttacagaaaccccaaaaattggcatg

SEQ ID NO: 101485 - DNA, 67 bp, Heterodera glycines
  Promoter: Source sequence=SeqID_44829; Location=1..67; Strand=+; Gene= SeqID_72245
tagtcattctcgattggtgttgacgatccagcattcagtgtacaattgttttaaacctctcaacatg

SEQ ID NO: 101486 - DNA, 117 bp, Heterodera glycines
  Promoter: Source sequence=SeqID_8082; Location=1..117; Strand=+; Gene= SeqID_66926
tttgttcagctacgactgcgtttgatccttccgcaacggttcaatgccttttttggccaggcgccgcacacgcagacggagaacaacgcgcacattgagcagattcaggagcaaatg

SEQ ID NO: 101487 - DNA, 253 bp, Heterodera glycines
  Promoter: Source sequence=SeqID_28313; Location=665..917; Strand=-; Gene=SeqID_58940
gtcgctttctcacgcgttctgtcgcggttgtatccgcgggcaggcgcaggcggcgaccgacgaaattccgctggcggatgggggcgtgggactgaagtgtatgatgccgggctgcaaaaacccaattctttactgtgggtgtaacatttggttatttcacatgttttctgttttagctgacatcagaattctgctgaagcgcgaagtacggagaaaattggacgaacgcattgttgaggaaaacattgggatg

SEQ ID NO: 101488 - DNA, 262 bp, Heterodera glycines
  misc_feature (43)..(43): n is a, c, g, or t
  Promoter: Source sequence=SeqID_20977; Location=1..262; Strand=+; Gene=SeqID_51552
agagaatgtggaatgtgaaatgaataattatggtgattgcctnttctgtgtcccagtgtcagcagaagaagcagataaaatcattttattaagccaaatatagcagaaaataaaaataggaataaaataaataaataaattgttattattatgccatttttgtagccaattttttaaaatctgatttctagttttttccacattaaagtctaactttacctttttttaagcatttgtaaattttagcattgtgctaaaaatg

SEQ ID NO: 101489 - DNA, 901 bp, Heterodera glycines
  Promoter: Source sequence=SeqID_27489; Location=1..901; Strand=+; Gene=SeqID_58178
ttagtcatgggattacacacatgcacatgtggtgtagtcgttaaactttctacctttcataatttttcgcctgggttcaattccccacttggatagaatattcctcacattttctttaccattattttaattaaaattttaattttaaaaaatattccaacttttttctttcatgttaagcatcctaaaaacccaaaacttaatcaattggtcattttttttacaaattctgttaacaaatcgcattaaaaattacaaaatttttcccggcggcgcctatcggcaccgccggccctccttgtcccccaaaagtcttggaaaaaacgtgccgcgtaaaaagcggtgttgaaagcaaaaaaaggtcattgatttacattaatttacatggccggagaccccttcgcaaaattggaaaattggctgctgatcccttgttttgcaataatctgaattttgaggtctatatctgaattttagtgttctatgtcctgaatttgaaaaaaaaacttggtcaacctgaatatacatatacttctgaacaattctaatgctaaaaaacaggcactcgcgcgaaaactgaataaaaattttgtatttggaaaattttgtccaaaaatttttatgttctaaaattaccggtttttaccggtaccggtaccggtaccggttgaaaaagttggtaccggtaccggtaccggtttttgcagtaccggtcagtaccggtaccggtttttttgcaattaccgattaccgctcaactctacaaaaaaccattaaatgttgacactttaaaaaaatacatacctatttgttttttcaaatttactttaaaagtaaatttactttataaagtaaataaaaccacaagatacaccaagaaaaactaaaattttcagaaatg

SEQ ID NO: 101490 - DNA, 261 bp, Heterodera glycines
  Promoter: Source sequence=SeqID_518; Location=2880..3140; Strand=-; Gene=SeqID_55095
tgacggtaaaatttagaatttttttaaataattttcaaaattgcggtaaatcttaaaacttttccctttttttcattttcttttcatggaactgtttattggtttgattgttcctccatggcaatactattaaaaaacttttggtgggttcagcgtgttttaattggaagggtccctgtgcccttctgagttcttagtttgtatggtgtgtcaatgtttgtcgtcttttgcaccatttctaatatttatagggcacaaatg

SEQ ID NO: 101491 - DNA, 654 bp, Heterodera glycines
  Promoter: Source sequence=SeqID_40675; Location=30..683; Strand=+; Gene=SeqID_68929
gcaattgacagattttgcagttcgaattcgacgttccatcccttataacggctcattggacggtaaattccttagtcttttcgtcttttccctctgtatgggcagctataggaaagctgttttgaaatggattgttcatttgtctgtggattttgtgtccagacatttgcgcctctgtcaaaaatctgggaaaacttacagtttttcattcttagaagtcttaaacagcattaatttaaaaacaaatctccgaggcgcaaatgtggggtaaccgtggattttgacctcatgctcagaaacaattcttcgaagtttaagactttgtcaaattgacaaaaggggctgatttaattttaattgcattaccccaacaaaatttcggccaattggtccttttgtcatcgtttcgcttcccgtgccattccctccccacccccactttttttgttgccttttctcgctgtgtttggtgtttcgacttttgcctctctttctgtccaattgattcggtcccctttttctgttcattttgctttttgtgaatgtttcgttcgcttttggtaatggtggaaataaactgaaaacaacaagtggttaattaattaattaattaattaattaattaggcttttgtccgcgttgcttcaaagaatg

SEQ ID NO: 101492 - DNA, 76 bp, Heterodera glycines
  Promoter: Source sequence=SeqID_1132; Location=1180..1255; Strand=-; Gene=SeqID_68374
aatagaccaccttttcacaaatttgtatattatcagttttacttttcacggaacaataaactgcatattaaaaatg

SEQ ID NO: 101493 - DNA, 500 bp, Heterodera glycines
  Promoter: Source sequence=SeqID_8472; Location=1476..1975; Strand=-; Gene=SeqID_68190
tattcggattctactggtctaaattgtatagaaaaactaagattttgttatatcagctttggtttttgaccataaaaaattcgagaaaaattagtgggccaattttcaattttggcatggtcgggaaaaaaggcagaaaaatctatcaatcaaataaaaagtgaaacgatagtaagagatataaaagaggacaccatgaagaacaaaataaaaaaagaatcatttaaataggcgcagaaataacggagttatgaatttttaaaaattggaaaaaatttgggtatcaaaaattatgttccaccctaagtaacccaaaagaaaatgtttttcctatatccgactacgtagaatccaggaaaaaaatatgcatttgcatattttggacggacagccctgataataaatataaagctatttttcttaggtatgacaattcaaatttttttgaaaataagaaactgaagtttgagtcaaatgttgcattccaattacgaaaaatg

SEQ ID NO: 101494 - DNA, 224 bp, Heterodera glycines
  Promoter: Source sequence=SeqID_13378; Location=1..224; Strand=+; Gene=SeqID_77261
tatattctagagttgagcgggaccgggacctgaacacggacaactgagtaccgaagtcccggttttgaccgggaccgggactagccccggtttttcccggttttcccaaccaaattcccggtttttcaacccgaaaaggtcccggtcccgggtttgcccaaaattcccggtcccgctcaactctagtatattccataatttatctatttatttttaaggaaatg

SEQ ID NO: 101495 - DNA, 485 bp, Heterodera glycines
  Promoter: Source sequence=SeqID_2511; Location=963..1447; Strand=+; Gene=SeqID_47318
attttgggaataattatttttttttgggataaataacatcccaaaaacaaaaggtaattttgggaattgtatttttatttgaaaaataatacccataaaatttaatttctattttaaatatttaatacctattttcgacctaataaaacaggctgacagataatttaaactttatgaaaaataaataaatttattacacgaaaaaacgtaaataaaaaactttttttatgaatcgttttcgaaatttataccatgcaaaaatattgaaaaaaaatttatttattaaaatcagtttaatcaaataattttttaatttgattagtaaatttggtttaaaattttattacggaatatttttgttcgccaggactgcgtttggcgacccgaaagcggtctttctgttcgtggccagcaaaacgagtcgcaatcggtttggccaacggcaaattgagtaccttctcgagaaaatatcaaattacaaaatg

SEQ ID NO: 101496 - DNA, 206 bp, Heterodera glycines
  Promoter: Source sequence=SeqID_8340; Location=1879..2084; Strand=+; Gene=SeqID_67736
attaagagattcattacggctaccaaggtgtttggctaacggaattaggccaatttggcaaaccacgatcactgccatttatgtacggcattcgatgcgcattaatccattttaaatgacaatttagcaaaaaagtgcggctggacaacgtggtcacgcgtcacagtttacgccaaattcaaacggtggtcgaccatttggagatg

SEQ ID NO: 101497 - DNA, 704 bp, Heterodera glycines
  Promoter: Source sequence=SeqID_36016; Location=1..704; Strand=+; Gene=SeqID_65457
aaaaaaagagagatacccatttttcggggatagagtataaatttaaaaattccctcaaaaataaaaggtttgttgcgcgccgccctccctatcatgctcgagaccatttggtagggtgtataaaatttctcaaaaaaagagatacccatttttctgggatagagtataaatttaaaaattccctcaaaaataaaaggtctattgcgccccgccctccctatcatgctcgagacctttggtatggtgtataaattttatcaaaaaaggagatacccttttttggggaataacctaaaaatataaaattcctctgagaaataaaatggtgttcgcgcccaccctccgttccattctgcaagccctttggaggggtataaaatttatcaaaaaaagagatagccatttttctgggataacctctaaatataaaaatcctctgtgaaataaaatggcgattgtgcacagccctccgtctcatacgcaagcgcttttgtgaggtataaaatttctcaaaaaaagagatagccatttttctgggatagagtataaatttaaaaattccctcaaaaataaaaggtctattgcgcaccgccctccctatcatgctcgagagcatttgtatgtgtataaaatttatcaaaaaaagagatagccatttttctgggataacctctaaatataaaaatcctctgtgaaataaaatg

SEQ ID NO: 101498 - DNA, 194 bp, Heterodera glycines
  Promoter: Source sequence=SeqID_19587; Location=1..194; Strand=+; Gene=SeqID_47593
ggttttgttatttctgttaccgattgatcatttgggttttttgaatgtcacaggaaaaaaaattgttgttgtttgtcaacacacggttctcgagcagtacaccactgctcaagttgtgatttgtccacacatttttttcatttaaattcgttcttttttttacagaaagtgttgaatttgcatttgattcaatg

SEQ ID NO: 101499 - DNA, 105 bp, Heterodera glycines
  Promoter: Source sequence=SeqID_10608; Location=1039..1143; Strand=-; Gene=SeqID_73840
ttttcagggttagatttttgtacgactaggaaaattctgcaaaaaaaaaaaacaggtttaaatggtcattttatataaattttcagctcctcggtgtttgcaatg

SEQ ID NO: 101500 - DNA, 261 bp, Heterodera glycines
  Promoter: Source sequence=SeqID_9669; Location=1940..2200; Strand=+; Gene=SeqID_72276
agtactatctcgtcgtttctctttttctttgtaatttgtctcactttggcgtactatctcttcattttaattatgtaaaaaacaacattcacttcgtgatgtttaactttttttctgcatgttaaatccacaccaaattttgcatatcgatagagaaaaaaattctgcatcgaacgtatcaaatatttttttaggttatacatcccattttttcaataaaattcattttatagcttttaatatattcttttttgttctatg

SEQ ID NO: 101501 - DNA, 168 bp, Heterodera glycines
  misc_feature (25)..(25): n is a, c, g, or t
  misc_feature (31)..(32): n is a, c, g, or t
  misc_feature (40)..(40): n is a, c, g, or t
  misc_feature (62)..(62): n is a, c, g, or t
  Promoter: Source sequence=SeqID_16696; Location=1680..1847; Strand=-; Gene=SeqID_81093
aaaaatgaaaccatttataaaagcntcatannaagcattnaatgatgtattaaaaatgtgcnttaaagttattcacttgacttaactctattttatttctgtgaatattaaaattattcatttatttcaatttaaagaacaaaatttcatcacaaaaatttcccaatg

SEQ ID NO: 101502 - DNA, 523 bp, Heterodera glycines
  Promoter: Source sequence=SeqID_13043; Location=1..523; Strand=+; Gene=SeqID_76824
aggttggtttgttaggccggccaaccgccgatttcaaataaataaaataaataaataaaatttgatgggatccaattttttcaaaattaaacataggctttaaaatgggcataaaatgaggatcaaaatcctatttttatcaatttatttatctacaatcattttgatgttttaaaaaaaggattgtataagatggttgccggacgaaacgacgtcggtacttaacgtcgccgcaaaaaaaaataattaaatacttgaagaaaaattttaaaaaatggttttaaaattttttgataacctaaattctacagaaaaaaaaaatttgctgaatatccacaaaaataaacaaaaacttgaaaatttattttatttcctggaatatttctaaaaaaattttagaattaggccaagttactaaaatttttaataatatttttttctaaaataaaaaattttaaaaattgacaaaaaatgaattaagcctgacactgatctgtacgaccgtgtagcctatttggacatg

SEQ ID NO: 101503 - DNA, 830 bp, Heterodera glycines
  Promoter: Source sequence=SeqID_5103; Location=2079..2908; Strand=-; Gene=SeqID_56918
actaattacaaccgaaatgggacaatttgggaaaataaatttagaaaaaatgaatgaacgcaaagattgtgggcttcaaaagtacggctcttccaaattcaaaataaattataaacaatgaaaagagttcttcgtctattcctccctctctcatacacacaaaacaaaacaaaaaaggaagaaacaatccaacaattaaaatataaataaaatccaaagaaaatattttttacaatttttaaaaatattagttttgaattattaatactaatgataaatcagttttatttaaaatttggaagaggcccactttccgttcatttttcaaatatttcatatgggattgtccgcaaatgtctgtaagctaattagtacaatatgactcattcgcccctttcaattggtgacactttccgtttcaattgcccttggcttgtcttaaattcccctcccttctgaactgattatgctttttcttttcttttttcttattttacctccaaaaaagaacacaaagtcccaaaaagcgttggcgcccccgccgaaattgccctgctgctgttgcgaaagagcgtccgttttttcgccggcggaattcgacggaccaaccacaatttgcctcacatcttttggaaagtgaaaaggtcgaagaattaaaagcggaactgatcaaaatctgctgttcaactcattgtcagttaccagaaggattgaccggcggcagaagcggcggcgcactttcattggccattttttgctgcaattccaacagtttctggcactttcccttcgcttaccgccttttcggttggcatttcgtcgtgcggatg

SEQ ID NO: 101504 - DNA, 393 bp, Heterodera glycines
  Promoter: Source sequence=SeqID_7283; Location=1..393; Strand=+; Gene= SeqID_64342
aaaaatttttaattaataaggataatatatttgtcaaaaaatatatttctaccgcaaaaaagtccaataattcgaagtcaatttattaaacatggccgtttgtataaataatggagcctgattaaggattttcaaaattttgtttttcataaaaagggagttcttgtttttgttaaaacttaaaatgtgagtgatgttgtaatcactcgccgggtacgtgatcagaaggaagcatcggatgagcgctgacctcagcttccgtcggtcgaattcgcgctgccgcttcggtgttgggtgaatgcttgtgcagtgtgagcttaggcagattcataagagtgcggggaggagcagaaggtaatatatagcagtaagttcgagtgcttagaacaaatg

SEQ ID NO: 101505 - DNA, 248 bp, Heterodera glycines
  Promoter: Source sequence=SeqID_21388; Location=1531..1778; Strand=-; Gene=SeqID_52000
aattccgccaaatccgttgccaaagaaagtcgtcggattcgaagccatttcaataaggtgaagcgaatgatttgttgttttctgtttgtaaaacgattcaatccattttcagtttcatcgatcaaaatgtcattgcttttctcggccattttcgtccgcttttcgactcattctgtccaattaaattgtccatccaaacgaacaatgaccgcattttggagttcattttgcacaacatttggccaatg

SEQ ID NO: 101506 - DNA, 173 bp, Heterodera glycines
  Promoter: Source sequence=SeqID_16641; Location=568..740; Strand=-; Gene=SeqID_81051
cccccccccccccccgtttgggcgttatttacgagcgtctgctgttgccgctgcaggacggatgggtaggaaaaccaaatacgaaagaggaggaggaggaggaggaggagacggaagcaaacattggcggaagaggaggcgaaggcgaaaaggaggggaaatggacgtggatg

SEQ ID NO: 101507 - DNA, 153 bp, Heterodera glycines
  Promoter: Source sequence=SeqID_10046; Location=787..939; Strand=+; Gene=SeqID_73109
ttgctcaaatcaatgaccaaattcgaaagttcggagatgagactccaatttaataatcaataaccgaactgtgaccgaacaatttaaaaatttggaactgaaactccaatttaatcaataaccaaaagactctgattttaccaagtgcggatg

SEQ ID NO: 101508 - DNA, 185 bp, Heterodera glycines
  Promoter: Source sequence=SeqID_38265; Location=1..185; Strand=+; Gene=SeqID_67135
tcagaacccaactgatttcagctaagtttgacctggaccagtttcttgacaacaattttgtatgtcaaaagcacataaatgaattgctgatcaaatgggccgactcgcaaacccacttccggacattaaccgaagcgaccggaacctattattactgtgcctttccaattactgtcaaagggatg

SEQ ID NO: 101509 - DNA, 162 bp, Heterodera glycines
  Promoter: Source sequence=SeqID_41857; Location=408..569; Strand=-; Gene=SeqID_69908
tgtttcatgcgcccaatttgctaattttgtgctggacattgaaaacgatgaccgcgagctgaacggagtcaaatacgtcagcctttgtggcaaacattcaagccgatcacagcaccaacggagcagaaatttccgattcaatgtttgtttcgtcaaactatg

SEQ ID NO: 101510 - DNA, 1003 bp, Heterodera glycines
  Promoter: Source sequence=SeqID_15300; Location=567..1569; Strand=+; Gene=SeqID_79532
aatttattaaatttttacagacttggatttgtaaattttcaaacctatagatattttttatgaaatttgttcaaataaattcatgaaatatttaaaaatcgcaagtttgctcatttttctggtgtaaatctgttaactattgcaatcaaatttcgctgaacagtagtgatcactagggctgtgaattttagtgacaaaaaatccctaactaaaatagtgagtaaaaatgttaaaatagtgacaaaatagtggcaaaaagtccgaaatagtgacgaatagtgacaaattttcagccaaaaattgagcaaaaataatttttattcactgattgcagttgcaaatgagtaggactgggatttttaagaccaaaaaacccaaaatagttacctaaaaaaatttttaaaattaaaaatttttgccaagaaatttttgatttcataggagtatattttgaaaaattttagctcgattcttaggggtgtattttttggttttattgcatttttgttaaggaattttccaaaaaatgtcgaaatagtgaaaaaatagtgacaaaacgccaaaatagtgatttttaactattttagtgacgaagtcgccaaaatagtgatttctagtgaccgatagtgacatcagaatcgaaaatttttaatgcagaaatgcgttttttgagctcctttcttcaaatcaatcgagcaaaaaatttagttaaaacctaaaattcacagccctagttattactagggatcggattcttagttttttaactatttgctcatttttctggtgtaaatctgttaacgattgcaatcaaatttcgctgaacagtagtgatcacgaatattgcgctatttgaaacccagcaggacccgaattcgaacaaacagtcaaaaatacgaattttcaaagttcaatgttttaccaaactgtatgcatttttctgtgtattgtaatactgtattttagcccgaaaaaactctaaaaagcattctcaaacataatg

SEQ ID NO: 101511 - DNA, 117 bp, Heterodera glycines
  misc_feature (40)..(40): n is a, c, g, or t
  Promoter: Source sequence=SeqID_9054; Location=1435..1551; Strand=-; Gene=SeqID_70115
aaaaataaatttatcataaaagattgttgtgatattttcncttgtgaattttttcattttctcatcaaatttgttttaaattattaataattttaggtatgacaacgggtttcaatg

SEQ ID NO: 101512 - DNA, 137 bp, Heterodera glycines
  Promoter: Source sequence=SeqID_18055; Location=1228..1364; Strand=-; Gene=SeqID_82647
ttcagcggaaaatcattgagcagcaaatggaaaagagtgccgtggggggggggcggagattggccgaccaaatcactgagacggattcagccaaagtgcgcaaaacgcgaattgaactgacggaagacgaagagatg

SEQ ID NO: 101513 - DNA, 73 bp, Heterodera glycines
  Promoter: Source sequence=SeqID_23874; Location=1..73; Strand=+; Gene= SeqID_54560
ggaaattgatgcccaaggccgcgccaaagtgctgaatattgtagctactaatatgctcaagttacagtaaatg

SEQ ID NO: 101514 - DNA, 548 bp, Heterodera glycines
  Promoter: Source sequence=SeqID_7098; Location=85..632; Strand=+; Gene=SeqID_63837
tttttgccttccgaatttaaattataattatttaaaaaaataaaaataaattttagaaggaaaaatggaattaacaatttttcttttgaaatatttagaatttgaacaaaattttatattttttaacatctttttatttccgtatttttaacatttctttatttttatcaatatttcaacattttcacaaaaaaaaatatatgaaaaaacaccccactaaaggtcaaaaatttcagttactctcttagagatggaaaattctgaaaaagaattcgaaattgtcgaaaattttcttgttaaaatataaacaaattttatttgaaaattacttttttttagtttctaaaaattaatggtttaattttttcaataattgaaattttttttgtccatatttctgaaatttttcggaaattttaaattaatttttgtttttgtccattaccggtgtctccattaatttctaaagaatttttaaaaaattggctcggatcagatgttacaaaatccctcccccccccccccctcgcagtgccatcctgaacatg

SEQ ID NO: 101515 - DNA, 1003 bp, Heterodera glycines
  Promoter: Source sequence=SeqID_12777; Location=1366..2368; Strand=+; Gene=SeqID_76488
aaaaataaagtcccctggggctctattccagtaaatacggtataataaataaatataaattccggcattggtataaatttttgttgcgaatactcagcagaatttggaggaaaggagttgatgaaataaatgccaaggacaaaccattaaaaatttacacaaataaaattttttaaaactagaaaatggtgaaaaaatggcaaaaaaaataataatattggccgaaatgccaataatatttagaaaaattcgatttttaccaattttaattttctaaatttaattttcagatttaaaaactttgttcaagcatgaaaatgtgctgttatagctgctctagtaaatggatgtgctggtgcggctttcacgtgacaactgtgggccaaatattaattaattaataattaattaattaatgccaattaatgaatcattaacatttgattatattatttgtcatggctcattgcctaattgattaattaattaattttaattaattaattaagaaaatttgattaaattatttgtcatagttcactcgcctaattaattaaatcaaattaaaaaatgaatgaatgaattaattaatagctaattaatgactcattaaatttgcgtaagctctttgccagtgctgaccgcacgatttatttaattaattaatgcctacttaatgaatcactaaaatattgatttaattgtttgtcaagggctcacttgtcgtcgcgtggattaatgtgttggccggcatttatggctttctatctgccataaatttatttggttataacgttaacatattccacattattaatttgatttcggtaattcttattattttttttactaattttcttcaaataagaaaatctttaaaaaatttaatccctaaaaataaattaattaattaaatttgttttttcaaatatttcatttatccctttcttttaagagtattttgcttttgtgcggaagtgtgccgataattgttggcgaaatg

SEQ ID NO: 101516 - DNA, 201 bp, Heterodera glycines
  Promoter: Source sequence=SeqID_39232; Location=1039..1239; Strand=-; Gene=SeqID_67851
tgatttgttcacactagataaaatttgtaatttaattaattaattcattaataaagtaaaaagtaaaattaaaaatttaagcaaattaaaataattttaataaaaaataatttattttcataaatttattaggttaacagaaaaatatagtgattttttgattactttcgagaaaattatgacgattttttgccaaaaatg

SEQ ID NO: 101517 - DNA, 336 bp, Heterodera glycines
  Promoter: Source sequence=SeqID_20472; Location=1..336; Strand=+; Gene=SeqID_51006
aaggaattcaggggtttactaaaagcaatgagttctgagtaggaaattttctgtgccacatatacactatattttaatcacctgtgaattttaacatttgatttattttattcatttttattacggtattcattttgtattttttatttgatcatttttatttgtttgtttttggcaccatataagagcactaatgtgcctttggtttgctcgataaaattaaattaagtttaacttaataaatccgtcgtccttcgcctttatcctttatctcattgttctttcttttaagacattttgcgaaacaccttcaaagcccaaagaaagccgtcaatg

SEQ ID NO: 101518 - DNA, 678 bp, Heterodera glycines
  Promoter: Source sequence=SeqID_31497; Location=830..1507; Strand=-; Gene=SeqID_61828
gagcacggcacggattgctgaggtcgtgggttcgagtcccaccgggcgagttaccttttatgttctacactttcctttttgtgtttgcgaacaaaaatcggacttatttacatatttcgaggttttttcatatttgttatatattttggacttttttcttacatattcattttttttttacatattttttggattttttacgaaagtttttgaaagtcgaaaaaaatccaaaatttcggcattatccgtacattttgagaatttttgaaattttatagtgaaaaatattttatttattttattttttttgaaatgtactccataaaatactaaatgtgattctctgcctatttaggtcatttttatgacaatttatgccaatttcatcctttatgaagaatttttaaaaaaccatttacaaaattctatttcatattttcgtacaaagtttggattttgtacatgtttcctacatatttcgggatttttttttaatatatttatttacatattatgatcactttttgtacactatttttttttgttttttgatttataaaatttgttttccttttatgtcgtttgccaatccctgcgatttaaaattgttaattttttaaaataatttccaacaaaaattgagtgccaaattggagttgtatggcaagcgcagaaatg

SEQ ID NO: 101519 - DNA, 95 bp, Heterodera glycines
  Promoter: Source sequence=SeqID_4135; Location=1..95; Strand=+; Gene =SeqID_53314
cttatacttttctagatcgctgttgacattgctttgtttttttccccagacaattaggaaaggttacatcaattggaagtaaagtggtccacatg

SEQ ID NO: 101520 - DNA, 676 bp, Heterodera glycines
  Promoter: Source sequence=SeqID_11111; Location=2675..3350; Strand=-; Gene=SeqID_74451
agcgctcaccaatcactcattttcaattgataatgatcgtttggaaatattatgcaataaaatagaagcaatacttacaattagcctattttattcatatcatttttaattttataaaatttgttttttgtgtttgggtgatttatagtgctgctcgagaccgaaaaccttaaatttataaaaatagaagttaaccaaaagccagtcattaggggtgtaaaaaagtcacggtctcgaaaatcctgaccgagacttaataacccgagattcgataccaaaaaaacccgagacttttctcgagtcgagaccgagactctcgagcagtactagtatatagaaattaatttattggaattccgatttaaattatgaaaaacgactatgctttcatccggctcacacgcattagtccaattagtcaattctctcctgatcaattaaaattaactcgcactcattagcccaattaaccgatcccctcccaatcaattaacaatttcaacgtcaagcacataacaagaccgacgctttttaaaccttatagcaattggccaagttggccaaactgcgtgcccaactgtccaccgcgcttggtgacaatggcattttgttgttgcccccgtggcccaccgttgcgccgttccatcgtcagaacatgttcaccccgatgaacatg

SEQ ID NO: 101521 - DNA, 658 bp, Heterodera glycines
  Promoter: Source sequence=SeqID_15520; Location=2252..2909; Strand=-; Gene=SeqID_79799
atagaaaacaaataaatcaattaaaataatattaatttattaattttatatttaactaaaagcttaattttgttccaaaaataaagcaaatgccaaaagcaaaacaaaaattgtcaaaaaaataaaataataatttttctaatggagtttaattagtttttcggtattttcgttgcttcaatttttgcttcattttttaaaatttaactcatttctcagtccatttaaaatcccgagccttttcactaattggtgctgactttggacaaataaagggattttcttttttgaagctactttacctggatgtggaactttcattttgaaaatcatttactattgcatttttatgtaaaacctctcacttggagccattctttttaggtcaccattttgctcattattaataaaaaaagtaacaataatctagaaatgacaaaaaatgaatgggtaaatgagtcaactatgccattttttgctcttctccaatttttgagtatcattttgccgtaaatatattgagtgaccccaataaataccgtaaatccgctatttgaaggcccgggccttctattgttcaacccctccaaaaaggggcctttaattggagggggccttctaccagagaggggccttcaaatagcggatttacggtatg

SEQ ID NO: 101522 - DNA, 266 bp, Heterodera glycines
  Promoter: Source sequence=SeqID_23541; Location=320..585; Strand=-; Gene=SeqID_54231
gctgtacaaatttaaaaataatttatgttaattttaaaaatttgtaaattattttaattattgaaataatttatttttttttaaactaaatattgctatttattaaaactaatttcaaacaacaaaaataattaataaaaaaggtaaaatataatgaatattaatttaagtaaataaaattcttaacgaataaaattgttttattttattaatttaaaaattattaaaaaatttatttaataaaatatttttttacagataaaatg

SEQ ID NO: 101523 - DNA, 102 bp, Heterodera glycines
  Promoter: Source sequence=SeqID_3349; Location=2880..2981; Strand=+; Gene=SeqID_84310
cgtggatttggaaattcagtccttgactgaagctgggtttgaggtgcctcaaaagaataccatgggttttcattccctttgtagcaagtgccaacgaaaatg

SEQ ID NO: 101524 - DNA, 285 bp, Heterodera glycines
  Promoter: Source sequence=SeqID_12439; Location=1..285; Strand=+; Gene=SeqID_76053
cccgacatttgcccctgtgtccaaaaatgggttcagaatttaaaattgcccccgcttttggacatatgcgcaaatttggggtaacccactacgccccccccccccgtatcaatgcccccctccctgaaaatttttatttttctaaatttcttagaaagaaatgattatacttttatgcagcacatccgtccgctgttccaaatgcaagtgccgctttcacgggaaatgcgttaagatccgtccgcaggaggcaaaacgcattccgtactggcaatgtccaaaatg

SEQ ID NO: 101525 - DNA, 536 bp, Heterodera glycines
  Promoter: Source sequence=SeqID_11585; Location=1747..2282; Strand=+; Gene=SeqID_75027
ttctgaagtaatatgaacaactcttggggttttgattttgtgataattccctcgctattcaatcggcttttataatgatagcacacgcacgccaaagcgcatagcagcatttcgccagattaatgcgcatttttatgaatattccctcatatattaatcaatgtttcaccagattaatgcacatttatgatggcaagcacgcacgcctaagcatttgccagcaacgcaatgtgtatgcttaatattttttacacatcaataatttacttttatgcatatgtcagtctctgtgttgtatattatgtgttatgcttttctagcccatctctgaattttataatttattaatataattttcttttcatatgcacgcataccgtttcatgcatatgcgtttttatgaatatatcatttgaatacacacacgtttatgcacatgcccctcatatcactcctttttatgcatagcgtaaatgtgaatattttatgaatagagcaaatgaatgcactttttaggcatatgcctctcatatatg

SEQ ID NO: 101526 - DNA, 115 bp, Heterodera glycines
  Promoter: Source sequence=SeqID_5103; Location=1673..1787; Strand=+; Gene=SeqID_56919
cctttaaatatgatgatgtacgatttgatcaacgacgtgagcggaactctgcgggccacggaggagaagcggaacatcagctgcatttcctatgcggggtccatgtgtctgaatg

SEQ ID NO: 101527 - DNA, 728 bp, Heterodera glycines
  Promoter: Source sequence=SeqID_1375; Location=655..1382; Strand=+; Gene=SeqID_73118
tggcgctcgccgtgaccgggccttttcatagtcgaacccattattgaggtttttaggacctaatcctcgcttagccagctctaacacctaaagatagccgtagctcgtagcgctttttgccgcgactatccgacccattactcaaacacatattattgttattataccattacagacaaaaaaagaaatgcctgcaccccccccccccctagatacgcccttgcgtggtcaaacgaatttttggattatgagcttttgattcttattctgtaatagtccgaatcttattaaaaatataccaatcaaaatgaaaactaaaaaaaaaatgaattgaaaaaacccaaacgcactttatacggcaatgaattggcaccgccgacaattgaccattcaaagccggacggcccacgtcgcatttgcatgttttttcgcaccatttttattgaagcctttgggggaaaaatggggtaaaattatgaggtatttattattgcagcatttttcctggaaattatgaaaatctatgaaatttgtgaaaatttggtaccaaacttggcaattttggaagattttttgggccaaatatcgaaaaaatttaaaaaaagaataaaatttaaataaactccgtgcccttttccatctaacggtaagcaatttgatgggtttaggcatttaaaacaaaaaatatttttgtgcacacttttctgccaattccatcggcaccaatg

SEQ ID NO: 101528 - DNA, 122 bp, Heterodera glycines
  misc_feature (39)..(39): n is a, c, g, or t
  Promoter: Source sequence=SeqID_26766; Location=1070..1191; Strand=-; Gene=SeqID_57527
gtgacttaatgattattttaaatcgctgtgtaaactttntaatattcctagggatgtgactcatatcctttggaaaataaagaaaattctcaaatatttcagtcgcttcattacgccaaatg

SEQ ID NO: 101529 - DNA, 543 bp, Heterodera glycines
  Promoter: Source sequence=SeqID_25878; Location=1..543; Strand=+; Gene=SeqID_56652
tattattctctgaataagagaatttaattttttaaccttttttataatctcttttcgaagtttaacagagggcggacttttgggtttttaattgtctgatactcacattatccatcattttagacaagtaatttaaaacgatgaaaattaattatgcatacggcaatttgttaattattttatttctgttcctcaatcattttatattgagttgcaactgcagaggtttaaacaatgaaaataatttaatgaattaatatattattaatagcgatcgatgtcttaacaaaggagcgcaaatctaacggaagaagccaaaagaaaggaaaaagccaaatcggtaaagcaaattttaggataaaactatttaaatttttgttttttttctagagcaagttaaaattttaaatcttttttagcgaaataaaaaaaaatttttcagaaaaaataaatttatataatttaattttatttttaaataaagttaaaattagatatacggaatattttcagaaagtaaaattttcagacggaacaaaaatg

SEQ ID NO: 101530 - DNA, 104 bp, Heterodera glycines
  Promoter: Source sequence=SeqID_28051; Location=1385..1488; Strand=-; Gene=SeqID_58709
ttaaatttaaaaaatatattttatattttttaaataaatatttatattttaataaaaaaaaacaatttcagaaaattgataataaataaacaaataaataaatg

SEQ ID NO: 101531 - DNA, 1003 bp, Heterodera glycines
  Promoter: Source sequence=SeqID_8316; Location=2088..3090; Strand=+; Gene=SeqID_67670
gtgaaattgacaggtcttccgacaccaaaaattatttaatttggcattaaatccaacagaagatttataatattatgggtgaattgtttgttggcaaatcacattaaaagtaatttcctctgcttttaaagcagggttcgatctcaaaattttgaaatccccatttcagccataaaaaatcctcatttgccactaaaatacctcaaaaaacctcatttggaattaagttctcattttttaaaacctcataaaattgcgaacaaaatcagtcaactgtcatatttttcgtttgaaacaatcacggcgcctatcagcgccgccggacctatttttttttttaaaaattggcccaagaatcgcaaaatttgtaagttttggtaaaaatttataacaatctcatttaaaacgaccaaacaaataaaaaattcgatttttattgttttaataaattgacaattctcttaaattttttgcttttaattgcttttttgtgcgtggtttttccaaaaaaaaactttttgggaacgttgggagggcattgccgataggcgttgccggaaaaaatttgagattttgagtgcgatttgttaacagattttgtcaaaaaatgatttgactgagggtttttcgaaaaaatttttaagatttgaagaaaagttcgaacattttgccaaatatacctaatttttcaaaaaatcatgcgtttttgtcactttttttttatcaaaaaaccacaaaaatccgcaaatcctcattttaaaagcatttttcagatgcaaataacagaagtttaatggaatttcacattggcacaaatcggtctctgaatgtcacatttcccgacgtaaaaaatggaaaaatattaatataaaatacataatatttatttttttattttaaacattattttaaaatataattatttttaataatattttaattaaaaaaggtgtcgccttatgaccaaaatttcgcaacattgccaaatggaagtttcacaatg

SEQ ID NO: 101532 - DNA, 348 bp, Heterodera glycines
  Promoter: Source sequence=SeqID_2958; Location=1889..2236; Strand=-; Gene=SeqID_82510
ttcttccgatgggctcagctgttaccaaggcttggccaatctcagcgcgccggtgagcggttcggccactcaatgcgttggcgtttcgttggcatgcgtcaaaacggtggacttcaacagtggccaagtgacacgttcatgcttggctacaaattgcaccgtacaagccactcagggacaggtgagaaaaagtgatcggaaaggaagtgatggcaatatcaaatggaaagtgatctgctgatagtcgtagtcatgccaatttgaaataatttgaaaaacggaatcttatgacaaactctaaagaaaacattcgatttgatcaaagattccccccccctcccaaagatg

SEQ ID NO: 101533 - DNA, 737 bp, Heterodera glycines
  Promoter: Source sequence=SeqID_23722; Location=456..1192; Strand=+; Gene=SeqID_54418
ttcctattttttggcgtattttaaaaagcatttttttcgtttgaataattatttttaaggtcatctggaacttggcacttttgcttttgctccttttcgccttggtaaaatgtttgggctgttttgaaagtagaaatttccaatactccaccagaccgtggcatgaaattaactacgcgctacgagaccgaaaccaaaaaacccacgaatttatggaccccgaaacagagactttattcttagaataaaaatattatttttacagcaatttttaaggcttagatttttaggaaaccagcctgttttttacggaaatgaaatacaaatatgtgacttttgcttttttaaatgcctaaaaatttagtaatattttaaaactgaaaaaatttatcattttcccgttttaaccgaaaactcaagcttcatagtttgtttgtaaaaaatcttagtcgagaccaaatgcttgagaaagttttccgagtctcaaaaaccaaaaatttcttgatttgaggatagtgaacagctctaggaaaattaatgccatgaaattttgccctaaaatctcaatgcccttattttggattccgaaatggataccatacagtacattttaatatggtaccttttttaatatcgaattgtttgtgtcaccggcacggttttgtgttcaattggatctgaccgttcaaacattgctacacggcaaccagcagggcagcaagcacgcttcactgatg

SEQ ID NO: 101534 - DNA, 368 bp, Heterodera glycines
  Promoter: Source sequence=SeqID_31640; Location=1208..1575; Strand=-; Gene=SeqID_61956
cggccttcatttgttatcggaaatttttacatgcccttgaaaaataaacgggatttcagcttcgagtacccgaggaaaatattaaaaaatttccattataacgggtgccattctgcaaatcagtaactaactttttaaacggcaccttaaaatggtttcgttttggtaaacatttgaccccctccaccctcctctcagcggtggttttagtctctgctcggagggcaaagtgcgcaaaagtgggcgtcataatcattcactcattcatttgccctttcatttcgccctccacccaaaacagcgacaaattcttcgccaaattcctcccaaaattacaaaatttatgccaaaaattcaattcaaaaatg

SEQ ID NO: 101535 - DNA, 481 bp, Heterodera glycines
  Promoter: Source sequence=SeqID_7190; Location=918..1398; Strand=+; Gene=SeqID_64094
tttggggattttaataaaacaaaaaatataaaaaaatttaatttttgtccaaaactagacaaatttagtctgctttagtcagagttaattccattgcattgcaagaaaaacaaaataatattttttaaaataactctgtttccggactgagatttgctttgcaagtgagtcaaaaaaaaataatttgttaaaaaatgaatttaaagcaccgcacaaagtcacgcgaaagataagaaacagaaaagatagtctcggcattaaacagcaaagccatctgaaatgtccttgacgagtgtctgttaccattggcccttgggaaaggcgttttaaaaaaaatttgtccaattttggacataaaattaaattttttaatattttttgttttattaaaatccccaaatgtcgggttccctaagtgtcggatccccaaatgacgttcgatccgcaaatgtcgggtccctaaaagtcgggtccccaaatg

SEQ ID NO: 101536 - DNA, 229 bp, Heterodera glycines
  Promoter: Source sequence=SeqID_12971; Location=656..884; Strand=-; Gene=SeqID_76727
tctccaccacacttacgagttgtattatcgttgcatttgcaattcctcctagcgtttcctgtcccgggatgaattttcgcaacacattcagcaaaacttgttcaatttggtaattttttcatgcgccgagaaaaactatcaaatcgccgattcttatacctaaaaaaaaaaaatttttatcaaaaaatcagccatcaatggcacaggcatttgccaaaaccggaaaatg

SEQ ID NO: 101537 - DNA, 242 bp, Heterodera glycines
  Promoter: Source sequence=SeqID_23023; Location=1819..2060; Strand=-; Gene=SeqID_53722
aaaagtttccaaaaagaaatgcgaaatttttcaaaaaaataggctcagatttcgctcttaccaatgagagttcggacaggactgtatgtgaatttccagggtcccagtctgggttctgttcttgtgtttttctgaaaactgtaactgaacccggagacctgttaaaattttgttgttgttttttgtgccaggccaacggtttcctcggtgcgcacggactgtccgggcacatccccgccatg

SEQ ID NO: 101538 - DNA, 213 bp, Heterodera glycines
  Promoter: Source sequence=SeqID_13940; Location=4318..4530; Strand=-; Gene=SeqID_77894
ttttacgcccttaataaaattaagtggtgattctttccacaaatcagcccttgggcaggtggcgtttatgaacgccttgtccaattgtgcaaaaattgcttcaaaaggactttggggagaaaagtcctcagttatgatcaactcataacttttgtggctgaagttgaagccacattaaaccatcgccctattacttctgtgtcagaagggatg

SEQ ID NO: 101539 - DNA, 342 bp, Heterodera glycines
  Promoter: Source sequence=SeqID_3100; Location=1..342; Strand=+; Gene= SeqID_83191
taataggccccaaatgtcggagggagggatcggataatttgcccaaatctcgggggtggggtcggataataggcccaaaaatcgggggtatgttcggatgggtcggataataggcccaaaaatttcgggtggctcgggatcgggaggtaaccttaaataatttatgcttcatttatctcgaaacttccaataggctccacctcttctggcggtggatgttgctgcgactgttgctgttgcggtggtaacaacaacaacaataacaataatagcgatgccgcaactttggctgcacttgccgccctttcctcgtcgtcatcgtccggcgcgccaagcacaatg

SEQ ID NO: 101540 - DNA, 258 bp, Heterodera glycines
  Promoter: Source sequence=SeqID_17266; Location=2527..2784; Strand=-; Gene=SeqID_81732
ctttgatttgtaacttttcatcataataaagtctaatctatcacatattcatgattaggagcatattcatgatcaggagaccccccgaaaatgtaaaatttctccaaaaaatacaagtcaaacgagtcatttctatgttatttcctcgtcccacctaaactgaaaaatgcttcctactctgtttttcgtctaatattacaaaatttttaataattttttgctttgtttagggctcgagtgtttgtgggcaacataatg

SEQ ID NO: 101541 - DNA, 128 bp, Heterodera glycines
  Promoter: Source sequence=SeqID_19043; Location=143..270; Strand=+; Gene=SeqID_83776
tgtaattcattttttgaaattaaattataagaaaatatttaaaacgcaaccaaattttaattgcataattagtcaacatgattttttcaatgtaaatcacatatgtacttatttttagtgaatttatg

SEQ ID NO: 101542 - DNA, 1003 bp, Heterodera glycines
  Promoter: Source sequence=SeqID_2; Location=4028..5030; Strand=-; Gene=SeqID_50777
gtaaaattttctgagggcaccaactcggcattaaacacaaattgcggacgaattccatccacaatttgacgggagaaagtgttcaacaacggcgacaccagcaatggtcattcattttttatataatttttatttttaaatttacataatttactcacattgaaataactaaaaaattttaatattgttcaaataattactgcatcatatgcttcaagtgactaagaaattgcctgaagtgataaacggcaacaatttgagtttaaaattgagatgaattcgtaattttaaaaaaatttatttgatgaagattttcggccaattaaatcgattttttagatgattataattttcctccttttttccatttttcaaatgtttttaaatttgctaaaaattttttttatatttattttcaacgggtgaagacttacttttattatttaaaaatttgattttttaaaattaagtttctcaaatattacattttgttgctgttacaggctttctcttcgtgttcgctcaacacatatataaaatttaacggcttggcacacaaaatagagagtgctatttccaagattcccggtctaaattcaaaaaattcctcggttaatggtacttaatctcaatttctgtacaaattctcgagtctcgtgaaacattttttttggcaaataattagtttacttaaaccttttttaaaaaaaataaccggttaatgtatcttttaatttattaatttttccattagttctgttttcacttttatctgttaaatgatattttatatatttttatgaatccttattcttatcattcttttctgtgcaacaaaactgactttccaaataaattttttgcttttttaatttatgttaatattcaatttcctaaaggattgcatttaaatttaactttaacttgcaaataaatatttgcatttctaatattaaagcaaacttatttaaccctccccttcagattgttttccctttgaatg

SEQ ID NO: 101543 - DNA, 161 bp, Heterodera glycines
  misc_feature (10)..(10): n is a, c, g, or t
  Promoter: Source sequence=SeqID_30014; Location=1..161; Strand=+; Gene=SeqID_60468
tttatgaganataatgttgggctgtgaaaaatttaattaaaaaatataaatttccgagaaattaatcttttttttttaaaaaattcatccttttctgttaagcttactaatatgatcagctaaatgggaaaacaatcttttaaacattaattttcagtatg

SEQ ID NO: 101544 - DNA, 185 bp, Heterodera glycines
  Promoter: Source sequence=SeqID_21043; Location=1..185; Strand=+; Gene=SeqID_51630
catttttttcccgtgaacagggactcgggcccaattttttcggatctcgaatttcgggaaaattttcggtatggaccgcattaaataatatttggccgagctcataaaatattaaaaaacaaaaataaacaaataaatttaatttgctttcatttaaaattatttctagacaaatactaaacatg

SEQ ID NO: 101545 - DNA, 69 bp, Heterodera glycines
  Promoter: Source sequence=SeqID_95; Location=4470..4538; Strand=-; Gene=SeqID_66043
ttttacttttttttatgtaattttctttttatttatagtttttttttttattttcacagattttaaatg

SEQ ID NO: 101546 - DNA, 425 bp, Heterodera glycines
  Promoter: Source sequence=SeqID_37860; Location=1..425; Strand=+; Gene=SeqID_66841
ttttcttgcataaaaaatgccaaatacttgctatactttgctggcttttgcattaattaatgtccatagaatatttggcgattttgccgaccaaatccgtcatggaaagcgatagagccgaatcatttgctgatgaatgcgcacgagatgatggacttgttgcggggcgagtttaaaaaaatgggaaacagacaaaagcaaaagacatttgtggcacggattaaaaaatgccaacaaaattaaaagaaaaaacgcggcgatttaattcatttgttataaaaaatatactttttcaaaaatcaaaaatattaattagttttttaaatatagaaatcggacaaaaattctttctccttcatttattgggcacttatatgataagcaaagtgtgcagttacgacactttattagcaggtgccgtaatg

SEQ ID NO: 101547 - DNA, 321 bp, Heterodera glycines
  Promoter: Source sequence=SeqID_7990; Location=1..321; Strand=+; Gene= SeqID_46521
agcgcttgatgccgaaacgattccgacccatttttgttaggttttcgtgtggcaaaattagccaaaaaaaatttttccacatttggcgttgcgcttttgcctctgtttaggtgtcattcaaaaacatttaattgcattttttatttgattaaaacaaaacttttttatgtatgtataaacttgaacaattgctaaaacttaatcattcactgtaaattaattaattatccaatttgttaaattgtttatctatgtaaattcttccatttttttttacaaattgatttaaaatttagcattttccattaaaaaaataaaatg

SEQ ID NO: 101548 - DNA, 95 bp, Heterodera glycines
  Promoter: Source sequence=SeqID_9459; Location=940..1034; Strand=+; Gene=SeqID_71498
agtgttgaaaaattctgtcgttgctactcttctcggtcctctcatctactctcgtcgcattaataatcattgtaaaaatacttcccaaataaatg

SEQ ID NO: 101549 - DNA, 155 bp, Heterodera glycines
  Promoter: Source sequence=SeqID_14648; Location=1601..1755; Strand=-; Gene=SeqID_78746
gctaaatcaattcccttttatacaacgcattcattcaacattttgaaatttctcgaaatttatacaatttattgctgtagaattgtctataaaagagaaggaattatcacacacaacgcattttattttacaacattcaccaaaaaacgaaaatg

SEQ ID NO: 101550 - DNA, 474 bp, Heterodera glycines
  misc_feature (11)..(11): n is a, c, g, or t
  Promoter: Source sequence=SeqID_33603; Location=1..474; Strand=+; Gene=SeqID_63619
tttcagagcancgttctaaaaaatatttatgaattaattttgctaaataataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatg

SEQ ID NO: 101551 - DNA, 374 bp, Heterodera glycines
  Promoter: Source sequence=SeqID_20052; Location=2525..2898; Strand=-; Gene=SeqID_84830
caaattcaaaataaaacaattaatttaatcaattaaatcggattacaaatttaatttatcaataataatctgtgataatgcaaaggatgtgatgacatgatgtacaatttatcaaaattgcattgaatttaattcgcgaattttggctaattaaaaatgttccaactcattattttctgttaaggtgtaatcagacattaattatattaaattgttttaaattttaatgatttttcatgctttaagcagtgttatgtccaaaccaatccttaaaaatgttcttaccaacaaaaaaacaacacaaaaggtgatttttatatgagataattaataaaatagctaattattcattatattttcacagcaaaagcatg

SEQ ID NO: 101552 - DNA, 119 bp, Heterodera glycines
  misc_feature (19)..(19): n is a, c, g, or t
  misc_feature (47)..(47): n is a, c, g, or t
  misc_feature (100)..(100): n is a, c, g, or t
  Promoter: Source sequence=SeqID_16990; Location=1..119; Strand=+; Gene=SeqID_81409
accgaacgaaccagtcatnttctgaagtcaagcaaaattcaaatttnaacccttaggcattgcgtgccctcgaggaagtgccacaaacggagataacgcncaaaatatgtttcacaatg

SEQ ID NO: 101553 - DNA, 294 bp, Heterodera glycines
  misc_feature (47)..(47): n is a, c, g, or t
  Promoter: Source sequence=SeqID_8960; Location=2656..2949; Strand=-; Gene=SeqID_69820
aaatgaaggtataaaaaccgaacattacagaataatgagcaaatacntgtagaatttcacccttataaagctttttttttggtggaagattctatagacaaatgtcgtaatgcaccaatctcaaatgagtatataagataaaaaaaaatagacaaaaacagcattattatacataataatactccaatccaaacgagctattacgtcctgaattttaatgttgttgattttctgtgttccatttttaattaaaagctattaatattaagcatataattcgttttgtaaattatg

SEQ ID NO: 101554 - DNA, 73 bp, Heterodera glycines
  Promoter: Source sequence=SeqID_22018; Location=2075..2147; Strand=-; Gene=SeqID_52655
agcattgctggcacttctctctgcacgcccaactaaccactggcgatggcacttccgccgaggcttggcaatg

SEQ ID NO: 101555 - DNA, 69 bp, Heterodera glycines
  Promoter: Source sequence=SeqID_6522; Location=356..424; Strand=+; Gene=SeqID_61884
ggtttaaaaaatggattaaaaaaaaaattttttttttttaaacagtaaattgaaattcgattaggcatg

SEQ ID NO: 101556 - DNA, 825 bp, Heterodera glycines
  Promoter: Source sequence=SeqID_26206; Location=438..1262; Strand=+; Gene=SeqID_56951
agttggaaaaactggcgcatcacaatggcagcgaacccatgagctgacaaccgtcgcagcagatgccgtcgaggctttggccgaacatcttcgcgactacaatgttgccgtgtccattctcctggtcacaattgccgccggacttgccgagatgaacaatcactacaagggaaacttcaaagggaacagaaagtgaattctcggccgccggagtgtcgctaatttcatccttagcgacgaaaatttaaaattttatgattcatctgtttaaaataattttacgccaaattcataacctttgtgattttaagcctttttattagtcagcattgtttacatttaaatttctgtcagcccgcctatgtaaaattgccgtatttaaaccattgcaaaatcaacatttcttatcgttcaaatcgttcattaataaatatatttgttcgatcaaaattcactaataaagtgtgaaatataattgaagtattgggaaatccaataaaattaatttaatttaaataaaataaatatttaaattaattcttattgactatctgaaaagagagtcaataaaaataatcaaaatttaaaataaaaaatattttttcttcaaaacataaaattgctaacattttttcctcggcatccgccggaaatgcaattttgtttccagccaaatagtgaagaagccaaatgtttactttcatttaatgaaatatttaatatataaagacaatcattttgtatattgaaaattattataatttttttaattgaaaaataaattacgtttttttttaaatttgttgctttttgagctgtataatg

SEQ ID NO: 101557 - DNA, 496 bp, Heterodera glycines
  Promoter: Source sequence=SeqID_37542; Location=121..616; Strand=-; Gene=SeqID_66591
tctgaaattacgaagatataacattggatttggttttcaggttatatacaaaactatattttttgtcccaggcccgtaaacttaaaaaaatttcgggaggagcagttggaacttttttttctctttcggtcaaaaattgtttgtcaaatgtaagtttcctgaatttttgtctaccgtgggaaaaacgggaaattttagtcatttttgcaaaaatttgaaaattttgaggctaattgtaagccttggcaaaaaataaaaggaaatttggatccggcgtagggaaaatttggggtcatatggtcaaatttgtttttgtataaaagagcactgttttcaaaaaaataaaacctggaaaaactggtgttgataagcggcatagaatgccgccgcgctttggttgttaaacatttgctgttgctgctgggtgtggtgattgaatgtcggagcgcgtgccatgcccgccgcagctgccgcatttgagccgggatgaagcatg

SEQ ID NO: 101558 - DNA, 804 bp, Heterodera glycines
  Promoter: Source sequence=SeqID_562; Location=3348..4151; Strand=+; Gene=SeqID_56222
tgttaggggtttttcgggcgcttcgcgcccgttttttaaattttgttgggcttggacgggcgcttcgcgcccgtttctaatttttaaaaaattgacagtgattaaaagaggtacaaaagtaatcagaagaggtacaactgtgattttaagagctacaacagtgatcagaagaggtactacagagattagaagaggtacaaaagcgattagaaaaggtacaacagtgattaaaagagagaggtacaacaattcgcggccttagtcgggcgcttcgcgcccgtttttcaattttattggccttggacgggcgcttagcgcccgttttttaaattttgttggttcagatgggcgcttcgctccctttttaaatttgttaaactcatacgggcgcttcgcgcccgttttttagcttgttatgccgttcgcggcctcagtcgggcgcttcgcgcccgtttttcaatttagttgggccttttcgcccgcttcgcagcctcagacgggcgcttcgcgcccgttttttaaacttgttgagatcgcacgtgcgcttcgcgcccgtttttcatattttgttttgctttgacgggcgcttcgcgcccgttttttaaatttgttaagctcagacgggcgcttcgcgcccgtttttaaatttagttgggccttttcggccgctttgcggcctcagacgggcgcttcgcgcccgttttttaaatttgttgagatcggacgggcgcctcgcgcccgttacaacggtgttagaagaggttcaatagtgatcagaagaggtacaacagtgatcagaagatg

SEQ ID NO: 101559 - DNA, 564 bp, Heterodera glycines
  Promoter: Source sequence=SeqID_40686; Location=348..911; Strand=-; Gene=SeqID_68941
acattactcacatagtatatacataggtagattaaaatattaaacttcgtgagtatcttttgtttttttttatattttatgttcatgtgaagttattttttggagaatgtaaagcgagagtcaatttatgaaattattgtgcagaattttgtgctggtaataataataaagataattaccgaaatttctcattttaattcaatttttaaataaaatggggatatgaaaagttataaaatcagttacaaaaatattttactactaatgagcatcagagcagcaaaacaattaaaaaaaattcaaatgaaagatgaaaattggagatttaaagtttatttacattgaatgaatatgtatgtaaaaaaaaatgaaaataataaataaatgccttttgaaacacttcgcccggggggggggaatcaaatgggaaaaagggaagtgcaaaacattgaccaaaagacccccggggcccgtaccaaagaacgaggtaaagttaccgggtaaacctacccgtgtaacacctggtaaacctacccgcagctgcgggttaacccatactaaatg

SEQ ID NO: 101560 - DNA, 1003 bp, Heterodera glycines
  Promoter: Source sequence=SeqID_12661; Location=875..1877; Strand=-; Gene=SeqID_76335
tcattgctgaagtttttgttcggcataaaggacattttaagtcgaacggaggaaagggctggcgaagagcacaattcgaattctgacagcaccagtaccaagttgtaacatctttaattcaatcacagttacctatctacgctttgaattcaatttcgcttgaactacccgtgactctgtccgtgtcacaccatgaacacttcttcaatgtcgaagtgttggtctgtgcacagcttggacatgtccaattcacagacttgggttgaggatgctcgcacaaaacaacgggagcatggtaaaagtgtacattttgttcactttttggtacgattgaatttgcaacaaaatcaatggcattgtcaatcttttccaatgccgagttgagggaaatatgtggtactaaaaaactttttaaagctttactcttagctaacaataaaaataaacaaacatttaattttgtgaagaaattttgatcgcccatttactgaaggacattcgaattggcacgctctacactttaagtcgttaattctattaataagagtacatcgctggcaactccaattcctaactccatccattctcgaaaaaggctgtgaaaataaactgtgaaattaattgaaattcacatatcattgcaaaaacaaaagcttttacaattagtgtctgcgtcggcggagattaaaagaaactttttggcgtgactttttcttttgcttggataattcattgcaacgattgttttcctttttctctatttcttacatttctacggcttttcctcttcttctttttcgtatctcttaattttccttccgcattgacattggcattattcgcgtcgcgccttttattcgttttggtcgcgtgccgtgccttaatgttacttttcgttccttaattaattaattttgttatttttatttcctcctttttgtgctttcggttttgtcactttagtttattttctatttaggtacaatatacctaattcagtatg

SEQ ID NO: 101561 - DNA, 376 bp, Heterodera glycines
  Promoter: Source sequence=SeqID_18845; Location=1318..1693; Strand=-; Gene=SeqID_83538
tttttaggttcgcaaaatttttttttgtatattccctcaaaatacgagaaattttccagttttttcggtggatccctcgcaaataagaaaatttctcaagaaattttgtactttatcaaaatgacacttcaaatttatggcagtaattttttggttttgcattttgatggaatttcaatttttttccttcgaattctgaaaaaaaaaattcgtcactggattaaaaaaaattttccgtttctctgcaggtcgaacagtgaggaggaggcgatcgatttttgtcgtcgctacggggagtgcggtgtgctgtttcggacgtcaggtggcagaggatttttcaaaaattaaaaaaaaattattattttttgtagacatg

SEQ ID NO: 101562 - DNA, 242 bp, Heterodera glycines
  Promoter: Source sequence=SeqID_11036; Location=2632..2873; Strand=-; Gene=SeqID_74367
agtgggtaggaaaaattgaaaaatgcgaaagaattaaaaatttgctaatttttaactattttgtcggtttacattttccagttaaataaaatacataataaactgtttagagtggtttttttgaatgattaaactcaatctcgtgaatttttccgtcttgaatttcgctattatttgcatttttttgcaaatattttcctacactaaaatttttacaaaaattttttcgtttatttagaatg

SEQ ID NO: 101563 - DNA, 498 bp, Heterodera glycines
  Promoter: Source sequence=SeqID_2012; Location=714..1211; Strand=+; Gene=SeqID_77315
tttttcattaaatgaaaaaatcatttaatttataaaaaaagggatggtgggcccgccggtgccgatatgcgccgccttgggaaaaatagaaattttattaatgtttaaacagaatgttcgtgcttattcgctaaacgatagccgctgaataaattaagaaattataaaaaataaaaattaacgactcattcataacagtgataaattaggcattaaatttatatgtttcatttaattgaacaaaattttcccataaaataaaataaaattgtttggtttttctccaaaaaacttaaattatgttttcttcaaaattattcacctgctaaaagatttttttaaatttttttgataactcttatccaatccgaaccaataagacttcatccaatcacagataaataatttgataatgcaaatgcaacagctacaacaacagtatcaagcaacaaatgatcaaatgattcaatataatttgttacaacagtatacccaatg

SEQ ID NO: 101564 - DNA, 133 bp, Heterodera glycines
  Promoter: Source sequence=SeqID_27185; Location=1698..1830; Strand=-; Gene=SeqID_57877
agatcctcttccaatctttgtaactcctctatcaaacaatttataaacgcactttgaacatgcgctatgtgtatttgctacgaataacggatatataataataaacatttaaaattttacagtctttcaaatg

SEQ ID NO: 101565 - DNA, 285 bp, Heterodera glycines
  Promoter: Source sequence=SeqID_13777; Location=1..285; Strand=+; Gene=SeqID_77701
ctaaaaatgggcaaaatttactcatttatcaacaaaatatgtcttttccaatcgctttccaaaattgttccaccggcggcactccccatgttccacaaaatttttgaaaaaagtgtttcaatctcccattgtattggcctgcgagacatcccttgaatatgtttggattttttttttgtctaagaaataccagttttgaaggtctaagggaattgaagggacccctcttggggaacaccaaaaattaccgttacaattttccattttttttgctggtgggtaatg

SEQ ID NO: 101566 - DNA, 52 bp, Heterodera glycines
  Promoter: Source sequence=SeqID_37714; Location=1..52; Strand=+; Gene= SeqID_66714
gtgtgccttctgcgcaattctgatggccgtcttttggacctgtgaagtgatg

SEQ ID NO: 101567 - DNA, 130 bp, Heterodera glycines
  Promoter: Source sequence=SeqID_20223; Location=521..650; Strand=+; Gene=SeqID_85023
aaaatttttcattcattttctttaccatgtttttaaaattaagtttagaatgtgtattttttaaatgaaaaaaaaaataattttggccatatttttgaataattttaattaaattcaattcaccaaaatg

SEQ ID NO: 101568 - DNA, 680 bp, Heterodera glycines
  Promoter: Source sequence=SeqID_12982; Location=407..1086; Strand=+; Gene=SeqID_76745
ttttaaaatctaataaaaatccataaattttttaaaaaatattattataatgataaatatgcagtgaaaaggagtatttatatgagcaatactcatcaaaaatacaattggtcatgaaaaatatatgagaaaaatacacaattatttgaataattgattaaaaaaaaagacaatatcaacccatcttgacctgatgagcagcgcactgccacccatgaagcacaagacgacagggcacctaaacggctcaggaaattagatatgtcaaaagcatgacctcaaggtctaaaagacaaattaacaaaattttgctgccaggataaacggagctctgtaggtcgaactaccgccctggttaacagcaaaattgaaaataaaaattatttaaaacctagataagagaataaggaacaaatgaaaaattctatgtctttacgcgcttttaaagctgttgtctccgcccatcaatcgataattttcggcgaaacaatgcgcatttccctcgggaattgcatatggtgacagatgtttgtaatcaatcgataattttcgacaccttttcaaaatttccttaatggtgtagggcattgccttccaatatcatccctttctccgtctagaaccaatccctaatagcattcattcgttcactttcatttcctatacattaaaaaaaaatg

SEQ ID NO: 101569 - DNA, 213 bp, Heterodera glycines
  Promoter: Source sequence=SeqID_32883; Location=286..498; Strand=-; Gene=SeqID_63116
tttcttccgtcagttaccaaattcatttttctgttcctgcgccgtcaatgccaatggtgccatttgaattggtgaacgaatggacaaaggaaaagctgacattggccaaaacaaatgaatgggacatcgattggataatgaaacgatgcaaatttggggagacggcggcggtttattgggaagacggaaattgggacaacaattgtaacaatg

SEQ ID NO: 101570 - DNA, 376 bp, Heterodera glycines
  Promoter: Source sequence=SeqID_6215; Location=1..376; Strand=+; Gene= SeqID_60760
ttatccttcttaattgcgtcaaatttcttacagttagttattccatgtacgtcgttaaaataagcaattacattttatggcaaacaaaaattattataaaaaaatattatccaaaaatctaaaaaatatgcaaacagcataaatagtcaataaatttatcaatcaaaaatggtgaatatatttttaatgtttcaatattttattatacccatgaaaaattcatccactaaaatttgcaatttttttcctatttttgctctacaattaggcttttttacgattagaacatatatgtacatatttaaattatttataaatttattattttttcttttaataagaattttggagtttttttcatacagttacaggaatg

SEQ ID NO: 101571 - DNA, 608 bp, Heterodera glycines
  misc_feature (34)..(34): n is a, c, g, or t
  Promoter: Source sequence=SeqID_38999; Location=1..608; Strand=+; Gene=SeqID_67669
aagcggtggttttgttcaccaccaccaccgcccncaaagaatgaaagaacgcctcaaaaatgcgttcgttttgtcgtcgtccgtttttgttcgccaaagtgacacaaggaaatacaaaaatgtgcaaaaaaaaaaggaaaagatttttaattaaatattattattattattgttagtgatttgattttggggaagggaagtggcgtaaaatttggaaaaaattgggtgggtagaggagtgagttaaaaaaaattaaaataagggttactaaaatgagagtatatatttttttaaatttgattgctaatggtatgggatttttaggaaaaaagaggcaatagggaattttgagaaatttaaagcgagatgctaaaagatcgtaattgttaagcattaatgatccaggatttgagacaaagactcttgagtattaagacaatgtgactaatgagtgaaaaatccaaaatcgaggaccctcattattatgaaaatgaaatttcatcgggacggggtaaaaaaaaaatcaaaaatttacaattggaggctgtttgtaatataaatttagcaaaaaataacgaaaatatttttaaaaatttatttttaagatg

SEQ ID NO: 101572 - DNA, 399 bp, Heterodera glycines
  Promoter: Source sequence=SeqID_9304; Location=1..399; Strand=+; Gene= SeqID_70917
tcgatttttcacaaaaattgggtgttgattatgcagttgtagtcatatattttatttgcaaaaactggtctgttactattatgtgaaaaataattttttaaggttaaggaaccttaatcattttgtacttcactgtgttccatggcctggggacatccaaaaaaatcgtgaaaatatttcgggatttattgatgacgtgttagaactttatgccatcaaaaattgccgaatttattatgtaactgatgaaggcagcaatttatctcatttgggtgatcgagaaagtcatcatttttgccttgcgcatatcatttctacaatttgtcggcggatcactgaaccttatgtcaatgcgaatttaacaaacgaaaaaaagcagattgttaacttgtggaaatg

SEQ ID NO: 101573 - DNA, 1003 bp, Heterodera glycines
  Promoter: Source sequence=SeqID_3044; Location=759..1761; Strand=-; Gene=SeqID_82943
cgaacagcatttgttgtgttcaatgaactgcaacacaacatgctatgcactttaccactataattcgtcaatcactgagtatggagaagaacaattacgttgggcctgcgaacaaataatcaaaaattttggagacaaatttagtcaatcatctaatttttggctaacaattggcttaattgtccttttccttttggcaatattagtctgcataaaaatcctcagatgttgttgctgtattgcaagtgtgaccgctccgttttcaccatcgtacaccctacagtttttggctacaaaatttgaaatggaaaattgatttcctaattttggtaaatttttccgttggatttaaggattggattttcacatttcaattccaattttttatttttcaaattctctctccgctccaccgctcgctgagggaacactttgttgaattaatggctgatgggtgcctctttcaggtccggcccatccgcgcattcaaagaaaaagcaattaaatgttgcccttttcgctcttcccaccggtttttccctctctctcatcgctgatgcacaaattgtcgctttttgaacaccacaacacaattttcaatttttgttccctctttccttcccattcccactcaaataatttaactcaaaaagctagcgacggccttgtgaatcatcaacggtcacatcttcgctccttagacggagcaaacgcccatcgcctgtcatcttatttttgccgccgacattacacattttacattttcctccgactggcaaataggccactcctccgatccaatcacatataaaccttacaacatacatattttctcgtttcttattcagttcaccattttctgtatccctttccccacttttttacatttcacaaatccttccttcaactaattctttttatattttagctataacaaatcctaattccttttcccaaaaatgtccttcgaaaaagcctgcgggcaaatactgaaaatgaaatg

SEQ ID NO: 101574 - DNA, 53 bp, Heterodera glycines
  Promoter: Source sequence=SeqID_6879; Location=2159..2211; Strand=-; Gene=SeqID_46321
ccccttttcagatgacccaaatcatgtttgagacgttcaacacgccggccatg

SEQ ID NO: 101575 - DNA, 105 bp, Heterodera glycines
  Promoter: Source sequence=SeqID_24153; Location=522..626; Strand=-; Gene=SeqID_54859
ggttggcaagaagggaaataaaacctatttttaaaatcatttagagaagaaattaatgcattggaaaactcaattgggcaggacgaggaagaaatagtgcagatg

SEQ ID NO: 101576 - DNA, 563 bp, Heterodera glycines
  Promoter: Source sequence=SeqID_6685; Location=4861..5423; Strand=+; Gene=SeqID_62484
atgagaaaaaagaatgcatttgttaataaatttttattgattgatcgttttatgtaaagggtttgagaaaattccctgattcctaaaaatttaagtgacagaattaagttttagcaaaatgttaaacgacacagaaattaatcagaaagaaaataacgaaaaaataattggattggctttgattttagtcatttattcgttttcgtttttgtgtttctgtgccgttatcgttagagaatgccaccgtgtcttttttagctaacaatgccactgccccctgagctattgtttgaaataattgaagccttcccctcctcaaaattgtctacagtcttcttgagcaatcatctcctgtcgtcgtgggctcaaaagcgtctcagagggactttcaattcgctgatgtcacagaaacaagaatggaaaaatctgttaaaaatatctcgtttggtttttgaaagtcacaacggattaaatgtgtaataattggtttttagtttttagtggttttatgctattttattgttaattcttaacgcgtttttaattagttttcagcaaaaatg

SEQ ID NO: 101577 - DNA, 82 bp, Heterodera glycines
  Promoter: Source sequence=SeqID_36822; Location=285..366; Strand=-; Gene=SeqID_66050
tgaaaaattaagaggctattaaaagaataatattttacttttttggcttatttatattttttaggtgtttttctgtaaaatg

SEQ ID NO: 101578 - DNA, 1003 bp, Heterodera glycines
  Promoter: Source sequence=SeqID_2; Location=12487..13489; Strand=-; Gene=SeqID_50778
ttaaaattaaattttgaacaaaagaaaattaatttacggcccctgtcgtgcagataaaggtgtaatgaataattctgttttttatgattcatattagaaatactattttttaaataattttacactcataactaatggtttttgcaattttttaagcaaataagtctttgcagtagccgactctcttcgccaacaaaatctgcataatttttgtgcggttgccttttcacttttttgcgttttttaattcaattgctgttgaacatctgcagttgtttgtcgctttgttgcaatgctctctgaattgttctgcataaaaccggcacaaaactgaactttgacttgaaaacatttatacaattaaccactaatttcaattaattttataaagaaagatttttgtaaattttttaaatatttttatactcacaataaaaaatatttgaacttttttttactctaacaataagcagaaatttgatttgcatttacgatgtgaggaaaatgtaaattcaactagcaacattaacgcaaaaatgaaatgtgaatcgaacgatcctttggttcacacataaattattgcggccacagagattttgtcgctgttaggcaaagatatttgagcaatatttatttttctttcaaatataattaaatattaaaaaatatgatataattaatttccatttttgaatatttttagcctgtttttttgtataaatttcgccgtttttcaagaatcaaaaattggcaataaagattttcaattagcgcactaaattgataaattaattaatttaaaggagattatccaaaaaattatgattttttttcttgtaacttttttgaaatttactggctaaaaagaataattaattttattgcttttaaacatacttgtgccaatttttggtcaaaaagggtgaaatggcaccttataaaattcgctggtaccctacccgttttaatttaaaaattatttccttattttagaaaaaaaatg

SEQ ID NO: 101579 - DNA, 1003 bp, Heterodera glycines
  Promoter: Source sequence=SeqID_5722; Location=354..1356; Strand=+; Gene=SeqID_59026
ggtcaccaattgagggagtgccggtcaaagcaagtatgccgagtgtgaaaagagcggcatcattctgcaatctgccctagtgtcaaaggaacatcttctgctcgttcaaagcaacagaagccctcgcccaggaacaaacagactttcggaaacgagcgcaactcaaggccattggtgtcatccgcggttgccaatgaggctgactcaatccctgagccgaaaactgttaacacaatcatggcaattgtctccccatccgttcctcatctcgtcatgctcatggccctccgagcaatttattaccaaatgtttatttttaattgtttaatattattttcaattaagtaaatattattttttaataaaatacttaatcagtttaattaactaagaaaacccattttcgatatatccgattgttaaaggtttgtagaatttcaaacaaattttttttttcaaaatatcgttgggctttaatttaaatcctcacttttattcctttctagaattcggaagtctttaatgcacagtccgttcttttacattcccaaatacagaatcatagtcaaaattatttttattcttattatttttcttttaattatgctccataagaatttaccaatttgtcattataattaattttctaatagtatttcattttgtgtccattttaacatattcgaaatttaaaatgcttttttttttgtctttttatccttttaaaattgattaaataattactaaaaatattgtaaattatatttatttcattataataaatgatcgatttgagttcataattattattttaaaggttattcgttatgcattcagttttttattaatgtttatttttgtatttattcatggctccaaattatttatttgattttaatttcggtgtaaaataaatgaaaacgtctttgattaaagtaactttgactaataacaatagaaactttttttacaaaaagaggaaggaaaaggggaacagcaaatg

SEQ ID NO: 101580 - DNA, 563 bp, Heterodera glycines
  Promoter: Source sequence=SeqID_811; Location=5028..5590; Strand=-; Gene=SeqID_61845
aaaaaaaaaaacgaaatgcaaaaaataaatggcattccgtcggaaaggcatctttggcacatatgttagcaaaaaataacgcctcccttcttccgttccactgcctgccccgccctcccgttctgcgcattctgatgattgattacaatactcttgaatacaatgaatttggcacttttttgtcgaaacgcggcatagtttaaagcgaacaaaaatgaatttttggattaaaaggttaattcaatatgatgattgattattatttaatgcttaaaaaatatttctttttatcataccgactttttaaaaatattttacaacttaaaataaaaattattcaaatgattgattattttttcgttttgcaaaaaaaatcctttaaagttgccgccaattttaaaaatttacaacttaaattaaaatgattgattatcgtatactataattatcctttgaactttccgacacaaattcttgcaattatttatcggaccaaaatacaaagtgtgaattttcattagattaggattccaacacgaaatggctgctcataacggaaaatg

SEQ ID NO: 101581 - DNA, 682 bp, Heterodera glycines
  Promoter: Source sequence=SeqID_2431; Location=1736..2417; Strand=-; Gene=SeqID_79696
attttaatcactttgatattttttgaaaccttcacattttaacacatcgccagaaaatgttgcagtctgtcaaaaacggaaaaaaatttgtccgtgtcatttctcattgttcaaaaaagcacggagcacttgtgcacaatcttaatgaaagaagaaaccaataagaaccggaaaaggcctaataaataacaatcattttttgttataaaaattcgtgaaaacatttttgtggggttttcagggtcgcagatccaatttcgaatcccggaccagaattcgaacaagtcaattcaaaattttcactttcgttcctaatttgtaagtcacattttttcgctcttccttttcgtctgctcttcaatatacaaactttttccctttctctaatttatgtgtttggcaaattagttgtttcttctgtttttcattcatacgcaacaattgcttttttggttgtggcttttctgggtctctgatcacgactcggacattcactttggttttttcagagtccctgacagaagtcgaaaaaattgaaaattcaaaactttcaaaattctcatttaaatgtattttaatctgtacggaatgactatcttttgaccaattgttttttattttttgttcgttgactcaatgtttaattcccttctcgaaaattaagaaattattcaacaaaatg

SEQ ID NO: 101582 - DNA, 56 bp, Heterodera glycines
  Promoter: Source sequence=SeqID_18174; Location=334..389; Strand=-; Gene=SeqID_82757
tgaattgagcaagagaagtgccttagtccttcccttcaaaagttggaatgaaaatg

SEQ ID NO: 101583 - DNA, 145 bp, Heterodera glycines
  Promoter: Source sequence=SeqID_16019; Location=1..145; Strand=+; Gene=SeqID_80370
tttttcgattttttaacgaaaaccgttcgaccgaccctcttgtctggtctctaatcatcacttttcaacaagatttccatccgtagtctttctcaaactttcccctcccctcccctccgactctcgccgatttcttcatttgatg

SEQ ID NO: 101584 - DNA, 104 bp, Heterodera glycines
  Promoter: Source sequence=SeqID_11308; Location=322..425; Strand=+; Gene=SeqID_74687
actgaacaaatgataattttaaagaaaatactgttccccaccgcgatgtcttctcgagaaatgcttcgccatgagtgaacaaaggcatgccatcctcggaaatg

SEQ ID NO: 101585 - DNA, 463 bp, Heterodera glycines
  Promoter: Source sequence=SeqID_7313; Location=1..463; Strand=+; Gene= SeqID_64428
ttttttttttccccaattttccatgggttaaaaaaaagggcccttagttaatttggcgcttttttttcccaacggaaggcccaactcgcgcttttgatgtcacgcggaaaagttgagcgtgggaggatagtgccaatttagacccgggaatgttagaacccctcaaaaaggggtaacaaacctaaaaaattatttaaaaattgttacataacaaataaaattaattgaattttaacccacccagcccatgtgcccatcggtctttgaccgtaccattgaaattcccttaagacgaaaaatgccgggcacgcccagcaacaattggcacagcgtttgcacctcactcaaacactgttcagactaaagaagcttaaaggaaattactttgaaaaatgattgaattatcaaaattccactaacaattcgcaattctcaccacaattttcattttctcgagccaatg

SEQ ID NO: 101586 - DNA, 99 bp, Heterodera glycines
  Promoter: Source sequence=SeqID_21092; Location=857..955; Strand=+; Gene=SeqID_51679
tttctgataaaaatatttggcaaacaaataaaaaggaatgaagagaaggcaaccagcggtcattcttatgattactcccttcattttcctaataaaatg

SEQ ID NO: 101587 - DNA, 124 bp, Heterodera glycines
  Promoter: Source sequence=SeqID_43555; Location=1046..1169; Strand=-; Gene=SeqID_71203
tgattcaaatcaatcatttaaatagtcacatatttctaaaaaagggcattcattttcttttcttttttcttaaatttaatttgcattaaaatttaattttttttaattaataaaaaggtcaatg

SEQ ID NO: 101588 - DNA, 434 bp, Heterodera glycines
  Promoter: Source sequence=SeqID_11136; Location=3804..4237; Strand=+; Gene=SeqID_74483
agttttgaagacttatttcttttagaaaagttctgttatatttttggctttttataaaaatttgctcccttatgaggtggttgctccccgacatttttttaatttctcagccatccccgacaaatttgtcgtgaattttcttcctgatctacgggttcggacaaacctcagtttaaatgagtttatttgaatcatgagaaataattttagttataaatttcataaaaattatttttgctttttaaatattatggaattaatttaaaattagttaaaaacataaaatttgaaaaaaaactcattatatttatttaaattaatgaattttttaaaatcatttaatataagtaacatcaatatattgatttttaaaaggtcttttaaaattacttaaaaaattattgatataaaagtttcagaccagccaaagtatg

SEQ ID NO: 101589 - DNA, 1003 bp, Heterodera glycines
  Promoter: Source sequence=SeqID_8111; Location=321..1323; Strand=+; Gene=SeqID_66995
taacttaatacaaacaaaaattatttaagataacattatcaaaaaaagcataaaacacggtcacgtcaaaatcacttaccgatgccatacgactggtcattaaaaaaaaaattggcaaaatacagaatttaatattttgaaaaacagaataatctaatcgaaaaaagaataaaaaatagagaaaattgaactaaaattaacaaaatcatgaatttttgattaaaacacgaaaataaaaattgcaaaaattaaaatttattactgaaaaattctaaatttctgaatcagtaacaaaatttaatcactcaaaaaaattttcggaatcattttgtttgctatgccttcttatagaaaactaatgaaaaaagataaaataatttttagaatgctaataaattttcaatataaaacaatatagataaacaaaaatacttattggaaattttcaaacaaaaacatttcattatatttgaattaactcatcatcattattaatctcatcaccattattattattattattattattaattaaaaatctaaatatactatgtgactgcgtcattctttaaaaaagagattcaaattaacgcataaaaacattatgccaaagaatagtgagctgccttaattagagagtggccaatgttttcgtaacattttgttgttgtttattgattctctcttttgcatttttttgttgtttattgattctttcttttgaaacgtatgttcaaatatttatcactttgtatggccattgttttatttatttatttatctaaatagttcttttataattcgacggaattctttcatttctaaattgctaaaaaatttatattccagttttttactagattataaatttgtatgttgttttttaatttagtattcaaacctaaggtttttttaattcttactcttttttcattgttttaacatttcattttaaattttttgttgtaacataattagtttttttttgcgttcagataaaatg

SEQ ID NO: 101590 - DNA, 57 bp, Heterodera glycines
  misc_feature (12)..(12): n is a, c, g, or t
  Promoter: Source sequence=SeqID_12037; Location=1643..1699; Strand=-; Gene=SeqID_47007
aaaacaaaattntcattagaatttgttgcgttcaaaattcgtaattgttgcgccatg

SEQ ID NO: 101591 - DNA, 610 bp, Heterodera glycines
  Promoter: Source sequence=SeqID_20989; Location=246..855; Strand=-; Gene=SeqID_51568
tttttagcacacttcttaaaactgtgaaaatgtttgcctgcttaattttctgatcattgacccgtcccaattcatcggccaattaattgtgttgtgtcccccgccattaatgagtcacttacaccaataatgatcgtagtttgcccaattaaaaaagtggcacactcaatcgacacattttccttttccaatgttttctttccccaaaaatgcgagctaatataaacattattaactttttgtttattttcactctttaaaattattaatggccatccaaatgaaatagtaaacacaaaaatttctaattgtttaaaatgacaaaatcattttgcatcagacatttggattgggattaaagaaggaatcccgaactctgaaaatggccgattcctctcctaacattttttgttcctgaaaattttacggttttcttaattaatttcattaaaaactgcaaaaacggtgttccacaggaaacacccgcgggcctttgccaatagtttttttttccattaattagctttaaaatgagaggtttttggtgaaatttagcttgattttgaaaataatttccaaattgctttgcctaattgccaaaatcgacatg

SEQ ID NO: 101592 - DNA, 1003 bp, Heterodera glycines
  Promoter: Source sequence=SeqID_5819; Location=4990..5992; Strand=-; Gene=SeqID_59328
ttttcagcatttttccggtttttcagttttttttttcgttttagcccctccctcctatgcaaattctatatatttatatttattttcatatttattatgtatgtgttctcttttggcttattctataaaattattaaaaatcccaaattttcgtattttcacattttctttccgccaatggtttgacacctagcaaaaaaattttaatggcttaaaaattttcataaaccaaaagagcatagcgttttcttatcatatatcatatacctaagtgataacagaagtataaatggaatgataatattaaaaaatagaaaatttcgaaaatttaatttaaatttttctctcctttttatgcctctgttttctgttcaaacaattagtggtggaaaaacaattcttgagaatatttctcatttaaatttcatcaaaaaacgctgtttaccaaataaagaaaaaacaataaattgtgcgcaatttaaaatttccttttgaaattaagtttttgttataatgaaaatttgaatttgaaataaaacaaaatcaaaaattcatatttttaatttctaaaaatattttttaaatttatttacaataattaattttctaaaaagcattttcaaaacgatcagctgtgcacaaactgaattccatcgtcaaatcggcggagtgcactcgccgacggacatttgccgtaattaaaatttaatttaaaataaaaaatagaacttttttaaattaatgaacttcaattaaaaaaacgaaccaaattttgctgttttttgtaaatatttctttttttcatttcactattcaaatcttttagcaagttcagccaagtgtttaataaatttctcaaaaatcatacaaatttctgtgattggcaaataaaaggtcaacaaaaaaatgtgtccacaaaatttgaattaaatgttttttttgaattttcaaataaatttattttttcatttttccaggcaatttttgttgcgattttctgatg

SEQ ID NO: 101593 - DNA, 94 bp, Heterodera glycines; identical to SEQ ID NO: 97954
  Promoter: Source sequence=SeqID_44456; Location=329..422; Strand=+; Gene=SeqID_71942

SEQ ID NO: 101594 - DNA, 64 bp, Heterodera glycines
  Promoter: Source sequence=SeqID_36033; Location=426..489; Strand=+; Gene=SeqID_65478
aacactcaaaaaatgtattaaaaaattgttccgaaaaagtaaataaattaaattaatagaaatg

SEQ ID NO: 101595 - DNA, 461 bp, Heterodera glycines
  Promoter: Source sequence=SeqID_7264; Location=1..461; Strand=+; Gene= SeqID_64296
cctatttttaatacaataagtttgttgctcagttcaatgactttcatcatttatctgcttcttggaattgcagtacatataaaagcttcaggtaacctcaagaatgatggaattaggggtggtaaaaaatttacaaatatttttaataactttattcctacaaaaacaaaaaaaaagtcactaccataattcgaaaagaatttccattattaataattagtcctttttagtgactacgcactttattaattctcataaaaattgtttctaaattcataaaacgtttctctggaaaatggtcaaaaaattgatgttccatcctcaaaaaatttccggcattttttgtctcaatgcttaaattctttgtgggtattacaaaaccaaaacatattggtagcataatattcattaatccgttggcaaattttgaatatatttttgtattgtatcggtcctgaatg

SEQ ID NO: 101596 - DNA, 136 bp, Heterodera glycines
  Promoter: Source sequence=SeqID_10636; Location=1132..1267; Strand=-; Gene=SeqID_73870
atttttaattttaataatataataataaataataattagggattggcctttgccgttacaattggccagaattaattacacaaagaaaggcgaatttctgagttggtcattggggcgcgaatggttcgacaaaatg

SEQ ID NO: 101597 - DNA, 872 bp, Heterodera glycines
  misc_feature (52)..(53): n is a, c, g, or t
  Promoter: Source sequence=SeqID_31193; Location=1..872; Strand=+; Gene=SeqID_61568
atgctatttttaagcccctttcttcatagcatatcgcttcttcaaaatatgnnaatccatataatttacaaccctattaatttattttgatggctgattttaaaaatggatatgggcgaaatgtccccaatcgtctatgggaaataaatttttgtgtcgtcattgactttttgccgctttttcctttgctgaattggtccttcccctccattttgatttcaaaataaaattcgggtaattaataaaaaagtttctaagctatttttcgatttttgaaaaaataaaattaatgaattcatcaaaaagtataaaaatcagtagggatgcgatttttaggtaagaaaaatcccagaataggtacttaaataggtaaaaaaaatctcaaaataggtattaaataggtacaaaaattccaaaataggtaccaaaataggtaaataaaaatttttattaacgattttttagcggaaaaaagcaaacaaagaggtaaaattttggttctacatatctctttgtaaacgaaaatttaaatatattaatattttcttagataatattgacattttaaattaaaaattttgtcaatagaaaaaataaataaattttgggataaatttttgagaaatttttccaattcttagggtgcatttttgaaaaattttttggtcgattcttatgggtatattttttgattttattgcatttttgttaagaattttttgaaaatccttaaaataggtaaccaaaatgccgaaataggtataaaaataggtacctaggtaataggtagaaaaatcccaaaataggtaaaaataggtattataaaagtgggtgtagaagctccaaaccaagttaaaaactcgttttttatg

SEQ ID NO: 101598 - DNA, 100 bp, Heterodera glycines
  Promoter: Source sequence=SeqID_1865; Location=3250..3349; Strand=+; Gene=SeqID_76446
tcttaaatttcaaaaaataaataaaattaaatttggcattaaaattttttaattttcccactttggcgttgtgtacatttgggcgccggcatttcaaatg

SEQ ID NO: 101599 - DNA, 63 bp, Heterodera glycines
  Promoter: Source sequence=SeqID_8185; Location=2336..2398; Strand=-; Gene=SeqID_67242
cgtaagaaaaaatttttaaattttgaaatttatttgcctttctcaggtggccattgccctatg

SEQ ID NO: 101600 - DNA, 68 bp, Heterodera glycines
  Promoter: Source sequence=SeqID_11308; Location=1920..1987; Strand=-; Gene=SeqID_74688
tatttttaatagacattttgtccacccaaatccacgtcatcggccttctttggctgttgaatacgatg

SEQ ID NO: 101601 - DNA, 194 bp, Heterodera glycines
  Promoter: Source sequence=SeqID_35282; Location=1..194; Strand=+; Gene=SeqID_64868
ctgccaagcatccttcattttaccatctgcttaaacatttaaagaaaaaataataaaataaaattttgtgttaatatagcaataacttatttggaaaattttggctttatccaattatccatcatgaatcgcaataacaaaagcacgacttgaacgggtttaaacagcttttattgcgcttttaccgcagaatg

SEQ ID NO: 101602 - DNA, 306 bp, Heterodera glycines
  Promoter: Source sequence=SeqID_6785; Location=1262..1567; Strand=-; Gene=SeqID_62896
attaggcaggaatgaaacagtttaattcatcagctaatctttgattgattggttagatggatcagaggataattacagattctaagaaaatgtttttttttattattattattatttgaacatttttttttgttgattgtttatgaaaaaaatgtttgcctttcagccaaaaaaaatttatttttcaaaaaagttgaataaataaaagcgaaaaattttattctaattaaggaaagacgtcaattttcatttcttttgtggtcaacgcgtttaatccagccaacatttgcttttgtttatcacatg

SEQ ID NO: 101603 - DNA, 695 bp, Heterodera glycines
  Promoter: Source sequence=SeqID_6181; Location=3437..4131; Strand=+; Gene=SeqID_60619
atcaatgagggaacgggtcaaaatgcgggtgttcgatcatttctggagcaattttatcaggatggcactacaacaaatgattttttggtcttcgattggcaaattggatcttacatcacgtaaaccctttcattactgtctgagtaaaaagaatttttttttagtggactaacccttaagctgcttgaatttaattttgcggaaagaattccttttcgcaatggcacatccgcgcacggcataaaccttttgttggaaaatgagcaacatttgcgtgttcatatttgtgctagagaggccagggctacccttttatcaaacactctcttggttggaggcacttaccggttcatgcatttgaatgtgagaccgaagcgcgattttggacaatctgtgaactacactttatctttcgcatttggaagttcagttcacttgattcgggttatcctgttttatttatttgtcattttgaatttgatgagtttaagggaccgacagtagcatttaatccattaactcttcgaagtccgagcgaccgggttcctcaatttgtttgtccaaaaactaaataaaattaaatagtcgatggtcaaaaaaattccctaccccctcaacatcagcagcacagtggaacgatttcgcacaatgatcgtccatataatcaggaaccaatgcaaggtagatacacaatg

SEQ ID NO: 101604 - DNA, 564 bp, Heterodera glycines
  misc_feature (489)..(489): n is a, c, g, or t
  Promoter: Source sequence=SeqID_191; Location=501..1064; Strand=+; Gene=SeqID_77164
tgccaatccaatagccatcgtaagtgtacgagtcacaacaccacggtacattgtccttttggcattgggcgtacgattttcgaacaagttctaagtacagaaaaaaaaaaaattaaatctgaagttggggtaggatttttgcccgatatgtcgggtgaggggcaaggcatagggattcgggattggatgtcagaaattaaatttacttgtcttaaattcagacaatatttttggactcatctgctgttaaggtcaggtcggaccgacgccatcttgtgcagacatttgtgccccggacaattgtcctatgtccaaaatcgggttaaaacaagttttttccagtccctgatagcctaaacaacattaaaattaagaaaaccacaggtcttctagtttattaggggcattaattctgttgtttgaataatgatgatttttcaaaaatttgctgtctatcaaatgatcatacccaattaattcaatcacctntatttaatgctgtttaggttattagggattgaaaaaacttaagttagaacccaattttggacataggcgcaaatg

SEQ ID NO: 101605 - DNA, 541 bp, Heterodera glycines
  Promoter: Source sequence=SeqID_3770; Location=2142..2682; Strand=+; Gene=SeqID_51801
atattcccgaagtttccccatttttcatttcctttcaggtgtgttttagaattttccctccctgtccaaatcccatatataaacccgaatatttttccctttagaatatctctcgaaaaatcattattccatcctttgattgtgcgctattccgacaaataaactacttcttgtctaagaagttttttgttccgaaggtgttcctttttctctacggtttcgacattccctgaactcagagttccgtgtttgcatttgtctaagctcgattgtcccgaagtccaccaggacagtccaactaagtctaaaggggctgtccatcccacaagtccattccaagagtgaaaaccccgtcccattcgctaagttcaataacattgtcgcggagcgtgtgcaaaccgacagccgaagcgcaaccgaccagtccagcaaacccgcacctcacccgcctcctcgacaagtggcgctcctgggaacgcgataactggcgctcctgtaaaacgaccacacaacaagtggacctcccgaaaagaccatcatg

SEQ ID NO: 101606 - DNA, 116 bp, Heterodera glycines
  Promoter: Source sequence=SeqID_498; Location=88..203; Strand=+; Gene= SeqID_54454
ggtgcgcgcatttttgaatttgcttttactgacattgtgtttattccttctgcaacgcaggcacgaaacgattcgacgcctctgacacgggggaccgagacattcagcggacgatg

SEQ ID NO: 101607 - DNA, 294 bp, Heterodera glycines
  misc_feature (37)..(37): n is a, c, g, or t
  misc_feature (54)..(54): n is a, c, g, or t
  misc_feature (64)..(64): n is a, c, g, or t
  misc_feature (91)..(91): n is a, c, g, or t
  misc_feature (116)..(116): n is a, c, g, or t
  misc_feature (126)..(127): n is a, c, g, or t
  Promoter: Source sequence=SeqID_26458; Location=1275..1568; Strand=-; Gene=SeqID_57191
aaaaataaatttcagcacagtgcaaattatttcgcanccacgcggaatttgctngtaaattggnaaatgggcagcaatggcctttacgacngtgatggcgaaacatcgcttgcccngagctctgcnncaagatacattgagacctgttggaatgatctgactcagtttctcaatgacggttttgctgccacatatttagcatatttggctagcatttcacaacgaaaagtggtcgttgttgacccaatggtatggagaaatggcttggacagagtcatgccttacaaaaatatg

SEQ ID NO: 101608 - DNA, 396 bp, Heterodera glycines
  Promoter: Source sequence=SeqID_12492; Location=2646..3041; Strand=-; Gene=SeqID_76128
agtattctatcgaaaatatttattgaatttaagtaattaaatttcaaaaagtttctaattttactaaatttcaaaatctgatagaaaaattttcagttttttcttgccgtcgcttttcgacacagccgtacaaattaaaaaaaaaatgttgttctaattaaatcagacgacaatttttattcaatttatctattttggttaaaaaaaacttctgatttttaataaatttcaaaatctaaaactaaattctcattattttttttggcgtcgtttttggaacagccaaatttttatttaaaaaaaattttttgaataataaaattaaatttccaaaaggctgttgtcattacggatcgacaaacgcagaaaagtcgcggttatggctttgtgacgatg

SEQ ID NO: 101609 - DNA, 174 bp, Heterodera glycines
  Promoter: Source sequence=SeqID_14683; Location=792..965; Strand=+; Gene=SeqID_78794
tttcgaacttcagtgtccaaatcacttttacaatttgggcacggtcaaataatataagtgcaaaaggatgcgtattgtaagtgggaaataccttgaaaagcaaccaaatttcaacatcggtcgggcgaattcgaaccaatgacaaatgtaataaaatttaaacgattaaatatg

SEQ ID NO: 101610 - DNA, 140 bp, Heterodera glycines
  Promoter: Source sequence=SeqID_21604; Location=1998..2137; Strand=-; Gene=SeqID_52203
gatgcgtttgggcaaacggacgaccgtttttctggcggaaaattcgttgatcagtgaatgaaaattttcatataagtaaaattacttacacaattttgattgttgagggaaactttacaaaaacaaactgtcggtggatg

SEQ ID NO: 101611 - DNA, 1003 bp, Heterodera glycines
  Promoter: Source sequence=SeqID_7612; Location=1975..2977; Strand=-; Gene=SeqID_65410
tatggtggaaaaagctcaaacgataggaacaacgaacagaaagaaaagatttgatccagaggttggactcgtctactcttcgcagttatcggctgaactcaccgctttaagcttaaggcttacccaaaatacccggcgtatttttgaagagactgtccgtaaaatatgtacaaatatgcaaattctgtcagatcaaattcttactttatcagtggctaatcctactctgttggcgagatattttctgggaaatccctttttggtgggacgattagtaacggaaaataagttggaggtgaagccctgtttagctattttcacgcagttgcattttaattggcaaaagggtgtttgtttttctgaaatcccggttactttcaaacttgatgggaaaataaagaatggttttatcgacccagtgacacgcataattcaccccttttctagggaggttgactgtggaaattataattttctgtacttaaatgaaggagacaaactcttagagtataatcaaaaaaccggagacattgagcaaattccaatggaatcagtgcgccaattaacaagacacggaagaattgatttcccggaaataagcgttcctatatttaaaaataaagtcctaacaaattttacggaactatactcgcctgaaaatttcaaagagactataaagagtgcaaagataatgcaagaaattgtacgcatgtctcaacccaatgtgtgggaaactttttccgaacatcaaaatgaattggctggaggaattgtcgctaatggtttattttcatttttgcgtggaggaattataagtgctaatcagttatgggtttttctatgttgttgttatgtaacgattacagtaatagtaaatttgttctgcccatttgctatggttcagctgtggcgacttttaaatgttagccgaatagtttcgagagtgtatgctctaactcaaagaaaaataattagggaaaatacagaaaaggtcgagaaaatg

SEQ ID NO: 101612 - DNA, 632 bp, Heterodera glycines
  Promoter: Source sequence=SeqID_15315; Location=1048..1679; Strand=+; Gene=SeqID_79552
agtcatttaacggatattaagaattttcttttattactaaaaaaggttggacttaaattaaaattggaaaaatgccattggggaatgtccgagatacggtaccttggctttttgctaagtgaaaaaggtgttagaattgacccaaagcaggtcgaagcggtacaaaattttaaggcaccaaaaagcctaacagaattaaagtcattgttaggagcactaacatattttcggcgctttatacacaattttgcgcatattgctcgaccattacagacattgactcaagataaatttgaagggaaaattgaagaaaattgggcccaaagcaggaacatgcatttcaaactctaaaacaaatgctcacgacagtaccagtattacagtccccatgattcgggagagcattcacaattgagtgtgatgcttcgaaaaaggctattggagcagttctccttcaggaaaatggtcctgttgcttacatttcaagagcattaaatcggcacgaaacaaattacccttcaattgaaagggaggcgttggcattagtttatgcagttaaggaattctcgccatatatcgttgggtctggggttacaaaagtaataacggattgtagtgccttaacaggcatg

SEQ ID NO: 101613 - DNA, 283 bp, Heterodera glycines
  misc_feature (21)..(21): n is a, c, g, or t
  Promoter: Source sequence=SeqID_25610; Location=1..283; Strand=+; Gene=SeqID_56357
aattaactatccgttactttntgagttattataagttccttctttgcgctaaaattttccccgagggcgatatcgacattagtggtaattatcaaaaacacccattaaagctcataattgatcattaaattttggccttcggcgtgtggtaatcctaaattgattaaaatgccgactgatcaaatcccgttcaatcactttacatattccatgccatttgcgaaatgctttttttactgctaaccagagaaatcacccataaaccattccagccagcctaatg

SEQ ID NO: 101614 - DNA, 170 bp, Heterodera glycines
  Promoter: Source sequence=SeqID_35304; Location=769..938; Strand=-; Gene=SeqID_64885
tattggccttgttgtccttgttgcagtcgttggtggtgttggaagcacaactttgggccgcaacctttgccatttcagcaccgtaccgtccggtccaactcggcgcccgtccggccatgtcctggtccgcaacggccaaccaccgcgcggctcatagtagccgccggatg

SEQ ID NO: 101615 - DNA, 1003 bp, Heterodera glycines
  Promoter: Source sequence=SeqID_15225; Location=1699..2701; Strand=+; Gene=SeqID_79433
tttttttttttttttatattttgttaaaaaagaaaaaaacccggcccccgggaagatatcccttttccctccccaaaaattccccccccccccccccgggggaaaaaaaaggggggggggggggggggggggcggggcaattttttttttcaccacccccacccaaaaaaaaaaaaataaaatttttttttttttttttttttgttttttttttttttttttttttttttttttttttttaaaaaaaaaaaaaaaaaaataaaaaaaaaaaaaaaaaaaaaaaaaaaatttcaattaaacactcaaaattttcacgaatcaatttttaaaaaaagggtttattttgggaaaaaaaaaaaattattttgcttgttttttggaagaaaaatgaattttctcttaaaaaaaaaataaaatttttttatgtaacaacgcaactccttttctttaaggtgaccaaaaattcatttttggacaaacaaatttaattatcccacataaatgtggcccatgtaaatataaacagaaaattatttataagttcattttttaatgctgaaaaaggaaaagtttgtttcaattgttggcgatggaaattgtttttatcgtacactttctttattactgagtggtgatgacaattataatacggctaaagaaatacacctagatttaatggaatttatctggggactcttgcggctattgcaattatttcggcaattgttctaactccaataatacttggttcggttgcaaccggcattgtaattggttatactttaaaagatggaagtggtcgtgaatgtatgaatataaatttaaatttaaaaataataaataaaatgataattaaaatattaattaataatttaattataaatgtggaggtaaaacagaaaattaattgttgattggtgattaaaaatgagagtttaggaattaatctcatgatcaagcagtgaaaatggtgaaaaatcattgctaagaatgctctaaaatg

SEQ ID NO: 101616 - DNA, 84 bp, Heterodera glycines
  Promoter: Source sequence=SeqID_2079; Location=3483..3566; Strand=-; Gene=SeqID_77739
atttttgtttttggataattttgtctcatgtttataacatttaatattttaaattaatcaaacttgtttcctatttttagaatg

SEQ ID NO: 101617 - DNA, 1003 bp, Heterodera glycines
  Promoter: Source sequence=SeqID_11974; Location=1186..2188; Strand=-; Gene=SeqID_75494
gcatttgattcgcaattgtgaagctagaatttaataaaaatcggcattttttaagtgttaaacccattttttggctgtttttagtgtatttttaagtctgttttaacaaatattaaatatacatacgttttttcgtatttttgagggtttacaacacatattttggcatttttaaatcaatattttggtccatatttggccatttttgaggtttttagtccatatttcgggcttttttagtccatattttatgtccatatttggcattttttagtccatataatttataaccctagtgagaagcgtcaaagtctgattttttaatgacgcatagtgacttcagaatcgaaaatttcaatgcagaaatgcttttttgagctcctttctttaaaataaaagcaaaaaaaaaaatttttttatgaatttttaaatgtatgcatatttttagcgtcctttttggcaatattaagaattggtgtccgacgaaaaaaatgttaaaaatttgtcgggtattttttctaggcttaaaaataagctgatcacgaatctgagctcagattttgaaaatcattgatttttatctaatattttttgtcaactacttgatttttttcggttttaaattatttttttaaaaagtttagcaatttttggcattttgccgttttggtgccttttttgtgttttgttccgaaaaattccattaaaaatgcaataaaaccgggaaaatacacccctaagaaatgaccagaaaaatttcagaaaatacacccctaagaacttaaaaattttctcaaaaaatatttttctccctaaaaatccttaataaaacaattttaaatgccttttttcatgcctttttcgggattttcgtgccttttcatgccttttttttcaattttttggtcctattatagtgcctttttcgcgatttttggtgcctttttttgcgaaccctatttataagttttatataaatttttaaagccttttatgttgaatg

SEQ ID NO: 101618 - DNA, 116 bp, Heterodera glycines
  Promoter: Source sequence=SeqID_13397; Location=1201..1316; Strand=-; Gene=SeqID_77282
ataacgatgaaataaaattgtgtttgctttttcagatttcattttttggctggattggcaaaaacagaaaccccctcaactatggcgctttgtccaatttttccttcctactgatg

SEQ ID NO: 101619 - DNA, 1003 bp, Heterodera glycines
  Promoter: Source sequence=SeqID_2103; Location=177..1179; Strand=+; Gene=SeqID_77858
taaaatagcacgtcattcatttttttgctaataaactattttttaaatttttttttaactttgaaatattcttcagaattttcccttcaaaatgagcacaaaatggccaaaacttttcaaaacttaaaatttattggggattttcccttgtaaaaatggaagagtcgatctcgagttaaaaacttaagttccataaaataaacttggaatcgctagaggaggtcaaaatattggcctatacaaaatttcaagaaaatctgacccgaggaaaatttttttgaccctagtgaaaatttcaataaattttttagccaagtgcgcaatgcctgtggtttgctcaataaatatataaagtaaaaatggaagagtcgatctcgagttaaaaacttaagttccataaaataaacttggaatcgctagaggaggtcaaaatattggcctatacaaaatttcaagaaaatctgacccgaggaaaatttttttgaccctagtgaaaatttcaataaattttttagccaagtgcgcaatttaaagccaaatcaaataaaacttacaatattctccagaattttctctttaaaatgaatataaaattattatatttggcctattattgcccgagttatgtctggaaaatttcataaaattatcgatgatgtacctaaccaacgctttttgaatatgattttttattgacacgaaaactttattaatggaaaataattcttcctttattctttaaacgaagaaattgaaattaacacacaacatgaggaggatttgaacctgagaccacccttttggtgactaactcacagaccactaagacgaaaaaactaacttaattgcacttggagcccaaaattgactcgccgtgtataagaaagagccttcgtttttattaaaccgatcgttttgactttattaaatcgtcttttttcgttatcatagcgattcacattccgtattcaatcgatatacctttcaatttgcctttactatg

SEQ ID NO: 101620 - DNA, 268 bp, Heterodera glycines
  Promoter: Source sequence=SeqID_31508; Location=184..451; Strand=+; Gene=SeqID_61837
tatgacgaagcaaatcgacgaagggaagactttgcccgcccccctccctcggctttgcctcccttcaaataccaagcgccgaagggaaatttggcaatttttcgtaaagccaacccaacccatccttcccaaccatcaaattgtataatactgtccaattttgtgctgccacattgccaacccaatggacataatccctttttactatgaaaacggccaattggaagctctttcctcggcccaccaatggcttaagcaaagcgaaatg

SEQ ID NO: 101621 - DNA, 526 bp, Heterodera glycines
  Promoter: Source sequence=SeqID_1801; Location=846..1371; Strand=+; Gene=SeqID_47038
aaaccactcattttttgtattcattcattcattgaacgtaaaaaataaaatggttcatattgtgtttgaccctcgcagtgccgggtacgacgagtatgtgcaatacggtagcggaatagaacacgaacatcacttcattgggtccagtccctttcaacgagggtatgggcagcggggagcaggggttggagacgtgtttcgcggtctttggcgcttttttctcccaatcctccgccgcgttggcaccacggtaggatcggaggctctgagcacgggtcagcgagtgttggagcgagtcgggaacgacggaatgccacttaaggaggcactggtaagcgaaggaaagaaaggaattgataccgtactggagaagggaggcctaccaaaacagtttggcagtggtggaagaatgggtataaaaagaagaagaaaacacgcaccaagtcaccatacaataattggccgaacaatcagtaaaccagcaagaaaacgtgttcgatccgacgcatttggactttactaaatg

SEQ ID NO: 101622 - DNA, 653 bp, Heterodera glycines
  Promoter: Source sequence=SeqID_15879; Location=1..653; Strand=+; Gene=SeqID_80212
cgccaaagcagtgcttccaccccaaaataaacgaatttttctgttgcttttgactttctcccgctattttgtgcttgtccctattccctcgatttataacaaattttcatccaaaaaattgacattttggaaaatttcgcgtaaatatattatttttttcatggaggagtagtcttggggtatgtacaccgcgaacccctccccctccctgagatagtccctgatgtccaatttaggattgtttattgttcaccaatatccacctgcggtggcgatggcacatcacaattagttgacggtggcgcgcgacacattagttgttgttgaggttgtatatgtcctcctcggattgggaattggagcagcaataaatatctatttgcttccgtgtaattttggttaaattttattattgtcagtaggcgaaatgtcccattttgggtttgtaggcgaaatgcccgattttggctttgtaggcgaaatgtaggcgtgcccattttagcaatttgtatgaaatacgcttatctaaaagggcgagggaaactcgaaggatccgaaaataggccaaaagactcattcaaaaaaacaatagtgactttgtatgttttttgtccgcaagtgtcgtaatattaagattcatgtcaaagcatatg

SEQ ID NO: 101623 - DNA, 669 bp, Heterodera glycines
  Promoter: Source sequence=SeqID_5131; Location=1..669; Strand=+; Gene= SeqID_57027
tttgattttcacatcactttttttcggagcgctttttcaaaaacttttgggaaagaaggggtccgacggtgccgataggcgccgccggaggaaattttgaaaatttgagtgtgatttgttaacaaatttcaacaaaaaaaggttggtttttgcgattattaagcttaattggtaggattttcatttaaaaaatgataaaatatgtatcaatttaaaaaaaactatgagtaaacatattttctttataggaaacccacgagtatacaaaaaaaaattgaaaataatctagtttctgtagagggattgaaccaggggaaagaagaagggaaagtcaaggagactagccattaggccatttgcacacttggcagtgttacttttaaagaatatattaattattattttttatttttccctttgactccaattttcttcactaatttttcactcagacccccattcttaccagtgcttgtttttcccggttcccggttgccctaccgggaccgggaccgggacctgagcttttcaaaacccgggaccgggacctcggatgaccgggaattcccggcccggtcccagtcccggtcccgtggcactctatttataaccattacaacaaaatgtgtttttttaattaattgcattcgattttttaagttgagaatg

SEQ ID NO: 101624 - DNA, 300 bp, Heterodera glycines
  Promoter: Source sequence=SeqID_1421; Location=1..300; Strand=+; Gene= SeqID_73445
tgtaaatgggacaaaaccttgtacaagtgcgcaaccaattaatatcagcagagaaaatgattttgaaatattgaaaattgtcatttctttaataaatttaaattacattattaaagacataaaaattgcattttcttatttctttaatttaatatgtaaatattttgatttattaaataatgtattttaatttaaaaaataaacaataaatgaattaattgtgaatttttggcctattatatttggccaaatgcggaggcgaacggggaaacaacctgtgcttatgtaatcaccgtaatg

SEQ ID NO: 101625 - DNA, 374 bp, Heterodera glycines
  Promoter: Source sequence=SeqID_10204; Location=484..857; Strand=-; Gene=SeqID_73325
tttgttgttgtagttgaagttgaaacaaaaacaaaaatgacgaaagtgaacacagaaacccccttataaggggagagaattttgcgcataaatttttgacgccttttttaagcggccccttttttcgctgacccacgaaaatccaatttttttaatcttaacccgatagatgaatcctataagatttttcgggaacgttgaatacaaataatccattccgttgaattaaattttgattgattttatttattttttaaatttcccaacaaattttttaaatacttcgtttttaagtgacattttccatcagcgtcactataaaagtggctttaccgcctcatttccaattcatttgccttacaattgccacgatg

SEQ ID NO: 101626 - DNA, 70 bp, Heterodera glycines
  Promoter: Source sequence=SeqID_26777; Location=493..562; Strand=-; Gene=SeqID_57537
tctaaaaatattttaaaattttgaataacatttaagctgattgtaaattttcttgcctcccatcacaatg

SEQ ID NO: 101627 - DNA, 651 bp, Heterodera glycines
  Promoter: Source sequence=SeqID_25891; Location=1..651; Strand=+; Gene=SeqID_56665
tcaattaacgggtggataccattttttgggaaatggagaatattcggtttcggggcagggtctttttgtcattgaatatttaaggcgaatgaatattttaggcgaatgaatatttaaggcgaatgaatatttaaggcgaatgaatatttaaggcgaatgaatatttaaggcgaatgaatatttaaggcgaatgaatatttaaggcgaatgaatatttaaggcgaatgaatatttaaggcgaatgaatatttaaggcgaatgacaaacaacattgtaagccgttgccaaaactgaaagcgccctctcaaacacaagattataatcgttgtaaatttgcattctacagtacactctgtatacaacaacaattaattaggaaaagtaattttgtcaatgagataaattttggcaatgttaaaatgcccgctcatttgcaccaattcttgttttcttcattaataaaagttaatttttaataattaattataaaacattgctgttttattttgttccaacgcaatcattttgttacattagcaattcataagaccatccgagggtactcatggagtttgtatccccctttttttgggtcgaattttttcaaatttttttttcttttttattgtcgcaattgcttttagattaatg

SEQ ID NO: 101628 - DNA, 633 bp, Heterodera glycines
  misc_feature (13)..(13): n is a, c, g, or t
  Promoter: Source sequence=SeqID_20321; Location=2088..2720; Strand=-; Gene=SeqID_50836
aatggtagacctntggaggaaatcgaaccctcctctccccacccaccctccgatcggcttctcactcaaaccgtggtgagtcaatgtgacaaaagtatcaatgttcgtaataattaaatttaattattattttaattttatttgctaaataataaacaataaagcataacttagcttaggcgagtcgttctgctgttcctcgggccgatgccgtcccaaacacagtctttctcatcccggggacaaattaattcgcattcatcggctggcaacaataatgaaaataaatattaaataaaaatattatgattaaattaatccattgtcactattctccttttttacattttcttcattttgattattttgcctttcctttcttcagcaaactcgttggctttttttagcaatataattgcaatttccatatttattgtaaagtaataaatttaggagctatgaaattcgatattttcttcctgcaattgccaaagtgaagccaaatcaacccgaattaaatgaccaaaattcgttagtttgttcaaaataaaaactatttgagtgtttagattatgattttggaccaattttgtgcaggaaaatggcattggggacggtcaaattggacaaatg

SEQ ID NO: 101629 - DNA, 166 bp, Heterodera glycines
  Promoter: Source sequence=SeqID_38591; Location=1..166; Strand=+; Gene=SeqID_67359
atgaagtgactaaaatttgagcactctaagtggacttgaaacaatataaattttttcgattttcattacattaactgcttaactccgaaaaatcacataaaaaactactttggagcatcaaattctcgaaaaaattattttcagacagttcattatagaaataatg

SEQ ID NO: 101630 - DNA, 564 bp, Heterodera glycines
  misc_feature (74)..(74): n is a, c, g, or t
  Promoter: Source sequence=SeqID_191; Location=499..1062; Strand=-; Gene=SeqID_77165
tttgcgcctatgtccaaaattgggttctaacttaagttttttcaatccctaataacctaaacagcattaaatanaggtgattgaattaattgggtatgatcatttgatagacagcaaatttttgaaaaatcatcattattcaaacaacagaattaatgcccctaataaactagaagacctgtggttttcttaattttaatgttgtttaggctatcagggactggaaaaaacttgttttaacccgattttggacataggacaattgtccggggcacaaatgtctgcacaagatggcgtcggtccgacctgaccttaacagcagatgagtccaaaaatattgtctgaatttaagacaagtaaatttaatttctgacatccaatcccgaatccctatgccttgcccctcacccgacatatcgggcaaaaatcctaccccaacttcagatttaattttttttttttctgtacttagaacttgttcgaaaatcgtacgcccaatgccaaaaggacaatgtaccgtggtgttgtgactcgtacacttacgatggctattggattggcatg

SEQ ID NO: 101631 - DNA, 567 bp, Heterodera glycines
  Promoter: Source sequence=SeqID_5862; Location=1..567; Strand=+; Gene= SeqID_59471
gaattgtctcatcagctgagttgtcatcagctgcctagtgcagaagccaagaaaaagctaaatcggaaagtaattgtaaaaaaataatgatatgttttcatattacctacctactgtatatatgatgtatactaatttaaaaattaatttttttctttttaaaattctttattttatttcagtgacaaaacgttcggtcaccccagaggaagcaagccaaaaaacagcaccataaagaaaataaagaatcaggaatctgaccaatttaatatagtttaaatgagtttgcttttcaataaaattttaattatccaaatttaaaatttattttttcatacatattaaaaaaattccttgtttttataaatttcccccatttgttattatttatttgttcaattctgttgaaatgaaaaatcgggattttaatcttaatccgtgctaaactaggggtttcaatcacagtatactattacggcctgataccgatgccggatcctaattccgggctctaagaccaacagaacatttaatttttttaaatttataatttaaggtgacagaatg

SEQ ID NO: 101632 - DNA, 735 bp, Heterodera glycines
  misc_feature (45)..(45): n is a, c, g, or t
  misc_feature (164)..(164): n is a, c, g, or t
  misc_feature (166)..(167): n is a, c, g, or t
  Promoter: Source sequence=SeqID_13595; Location=2693..3427; Strand=-; Gene=SeqID_77497
ttaaattttagagtttctcaattaaaaaaaaagccctggaccganatatggagcgggatttcatattgaagctggtggatctggattttcaatctgactaaaacagtatgcttaattatccataaattctttgttgcaattgcaattatacagtatactgagcntnngttcaaaatacagtatatggaattatagagaatattaatccaattttttctaataattggactcaatctgacaaacacatatgcttaattattcgtaacccttttttgtttcattttttttattgcaacaaaattatacagtatgctgatcctattttcaacatacagtatatgatatcatgtgaacgtattctcacataggcaggggtctgggacccctgcccctacaacctatcacatgggacccctgcccctgtaatctatcacatgggcagcggtctgggacccctgcccctacaacctatcgcaagggatctggggacccctgccctgtaacttaaagcatttctgcatataatcaacggacagggtcgttcagacccctaccacttgttctattaagtaccctcagacccatgtcccttgtcatattaagggtccagacccctgccccatgtcctattaaaggatccagacccccgcccctagcgtcactatataagcagctcgttttaagaaatgtacagttaatagagattattgtacccattacctctaaacattcatg

SEQ ID NO: 101633 - DNA, 56 bp, Heterodera glycines
  Promoter: Source sequence=SeqID_2590; Location=1908..1963; Strand=-; Gene=SeqID_80586
taaatttgtaaatcattcgcatttgcaatttttttcaatcgtttcagttggggatg

SEQ ID NO: 101634 - DNA, 1003 bp, Heterodera glycines
  Promoter: Source sequence=SeqID_9795; Location=1417..2419; Strand=-; Gene=SeqID_72709
ttatttggcacgacctccttattttgtgcttattcttggatttgaaaataaaattacaaaaacgaataactgttttgaattatatatgtatcattttttatggaagcaaatatttgaattaattcgattttgaaaaaaaaattgcgtttttatttcgttttcttgagtgtaaaatgctctaaatttcagtgaaaattttgttaaaaatggtcaacatttctatttttcctccggcggcgtctatcggcaccgccgggccttccaaaacttattttttcataaaaattgaccaaaaattgtcatattttgaataaaatttttcaaaatgctgattttttgtcggcaaatgctgattttgaaaattttcagttggcagccctggtttttccgctaataaaatattgttttaagtcgatttttcatgtttttattgcgtttccttcacgctactattagttttagaaaaatcttatttttggggtccgaattttagtttttgagccattttgtcttattttgaaaaaaaacatggaaactctgttttatttacctgctgaattttccctctaaccctccccctgcggtctaaatttttttgttgtgtatcgattatttttaatgctttcgatgtgaactgtctgacttctcgctgtctccactcctacacaaacacaaaaacaaaacgaaaacaatattcataaaacaaatattgctaataatttcgcaacttttaaaaaaatcattgttttgtttttcatttttttgaccggcaccaccggggaaaaaactcataaaaatagagggaaaaattggcatagatccataaatttggcaaatacctttttaaacaatatggaagtttcagcaaatttttggccaacgatttttcaaaatttgaaaaggctttcaaaaaatatcaaaaattatggtaaaactaaaattcgttttttttaaatttttatttttatcccttttataaatgcgcctcatttcagagctaatg

SEQ ID NO: 101635 - DNA, 982 bp, Heterodera glycines
  Promoter: Source sequence=SeqID_4535; Location=1583..2564; Strand=+; Gene=SeqID_54805
atggaaaaagtgatcggagagagagagagagattggatttacaataaattgatattcgtgagtgatcatcataaacctaataataagcgcttgaagtatttgaaatattaagcttacaataaatttgctgaataaatttatgaagcaaatccatttttctcggataaggatggtcagctgatggaaccacgaatttaaaaagaaaaacttttttttttcaaaagaagacttggcatttcgtatgaatgcctgtttagcatttaaattgggtggatgtgcgtcgaatggaaaaaatatacaaatgtctacgtcaaatttataaatttgaaaaaaacaaaaggctgcttagcatagtttatggaaatcccagcgagaaaattgaaatgttttcgtgactcacattggcattggcataattatcatcattttggagttcgaagctcaaaaaacccaaagttttcgaagccgaagtttcgccagccttggtagcgatacttcttgagggcggattctttcatcacacattgatttgtttttggttaccaagatataacgtggcaaattgtaccgaccatcagcaaaccaattttcttttaatttgtttccctgacttttttatggtctagtaaattggtatcattcgatttcgcgtgagattttgtacataatttttgggtttgactgaatgaaacggggaaaattttcattattttcacatccattgccttccctttctttttcgtccctcgtctaaatggtgtgggactttgtccgtaaattgtgaataaaatctgtgctgaatgttcagtacacaagaaaatggattcaaaatggactacaaatgtgccaaaatggaaataaaaagtgccaattgcttacgtaaatcccccaataaaaaatccgtttgtctggcaatttcgtataaattcagtgtccccatcccaaagaaatcactctttaaaactttccaaatttcgaaatg

SEQ ID NO: 101636 - DNA, 59 bp, Heterodera glycines
  Promoter: Source sequence=SeqID_21867; Location=295..353; Strand=+; Gene=SeqID_52497
ggtaatgaattagtgtttcaatttttgactcaattttatccctcaggtctggcaacatg

SEQ ID NO: 101637 - DNA, 520 bp, Heterodera glycines
  Promoter: Source sequence=SeqID_9086; Location=1472..1991; Strand=-; Gene=SeqID_70199
attattttgatcaattccgatttcctaatctaaattttaacaaaaaatcataattttaaaaattcaaaatttcgatttttattcgagttcgtgttagggattagaaattagtcaaaatacatgtcagattcgtgattagcgacctttaaaaccccggataaaaaattatcatggttttttatcttaaaaaaattttgcaaaacaaaagggtccccccttttgtttcaaaaactcactttccatatagtgccggttgcgctttgtcaagccttttgcttatgattttttaccatacgtttcatttgaaaatgacaatgagtcactgaagtgggtgggggtagggggacgtttcactgagcgtcggtccggtcgccatcacataacaaacattgtgaccttgccatttccttttaattttctccttttttattattcaactgttagctattttcagcttataaatacatatttatactgaatttcaaaattggatctcctagcattagcaaatcagtaaatg

SEQ ID NO: 101638 - DNA, 408 bp, Heterodera glycines
  Promoter: Source sequence=SeqID_8939; Location=5008..5415; Strand=-; Gene=SeqID_69736
tgaaaattacaaagatttctcaaatttctttgaatttttttaaaacttttctaaatgttcattttcaaggacgtccttggcatccaaggacattttttattttcaagaaagagggcccaatttcaaggacgtccttgcatttcaaggacggatgggaaccctgcaataaatatttgcaaaacatcaatgaccaaaaagacaaacattgaaaactcgtttctgaaaagctaaaacatcaaagaaatttgcaaaaagtcaaacattgcaaaacaagtttttgaaaagctaaaacatcaaagaatgtttccaataaaaacaccaaataatacaatatcgtttccgaaaagaacattaaatgatgtttccaaaaaacaaaacattatgtttctgaaaaagcaaacatcaatg

SEQ ID NO: 101639 - DNA, 329 bp, Heterodera glycines
  Promoter: Source sequence=SeqID_45256; Location=487..815; Strand=-; Gene=SeqID_72585
ttactgtatttatttcataaaaacgatcattgatctttttaaatgaactgccataggaaacggcatttacgttaatctcattaagtaaaatgatgttacggtatcagggtaattaattttaagattttattgcgtttaaactgttcaaaaactgaataaatcgcttctgattagctgtcactacccttaaaaagctacagaacacaaagctacagtatcctattcagtaattaggggttaatttggctttaagattagatttttgagaattcgcttagttttaactcaaaaaatgccaaaaatttctgcaggtcccttgtcgtcggatg

SEQ ID NO: 101640 - DNA, 436 bp, Heterodera glycines
  Promoter: Source sequence=SeqID_3137; Location=1904..2339; Strand=-; Gene=SeqID_83369
tttttttggtgtatttcctgatccaatatgatcggataatctgatcaccccccccccgaaggaatggccaacagcgctcacttgggatccaatcagtggtcaactctttgtgcttgattcgtcctccgtcatttttcgcattgacttccaactgagcattgtgactgttgttgccggcgctcagacgggctgcccagcggcagatggaagcgccgaatcaataccagtgatcgaagccatcagtttcagcgcagaagacggaaaactcttttggacagagaccgaccaaaaaggaatcaattcggtgagtgatctaacgaacaaatgccaataaaatcactgatcagaaagatgtttttgatcggaaaaagatattcactcacagatcaaatgtttgctggcggcacgcaattaccctccgggcgaagtgagcatg

SEQ ID NO: 101641 - DNA, 440 bp, Heterodera glycines
  Promoter: Source sequence=SeqID_17278; Location=432..871; Strand=-; Gene=SeqID_81748
ttatcaattaaaataaataatttaaaaatatttaatcaaattctttttttttcttttaaagaaatttaatctaaaagtatttcaatgactttctatgtattatttacttcgacgaagagcatcagctgtttttcacattttgagccctgaattttttaaaaagattttaaatctcccattttgaaacttaccaacaacaatttatcgatttaaataaattattaaacgaaaaacaatgtcattttaaattttaaaattttatttaaaatttatttatttttattaatattttctattaaataattataattatttgttaaaactaattcaaaattatattatttagacaaaatatagaaaaaaaaaattatcaacggaaaaattatttaattttatatattttttaatttttcaatttttatttatttatttttttgatg

SEQ ID NO: 101642 - DNA, 170 bp, Heterodera glycines
  Promoter: Source sequence=SeqID_19058; Location=1382..1551; Strand=-; Gene=SeqID_83799
tctagagtcaaaataaaaataaataaataaaatttttgttgttttggctttgccctaattaacgcccactaaaaacaattaatattattttttatagccccagaggggtggggcaaataggttttttcccggaaggcaaaatattttttataaatttgtagagagagatg

SEQ ID NO: 101643 - DNA, 120 bp, Heterodera glycines
  Promoter: Source sequence=SeqID_24911; Location=1029..1148; Strand=-; Gene=SeqID_55657
agtgagaaaattgggggcaaaaaaaaagaaaattaagcgggggaacgataaattttatggacagaaaaaaaacaaacattttcgtttttcagggaattcattgaaacagaaagggccatg

SEQ ID NO: 101644 - DNA, 443 bp, Heterodera glycines
  Promoter: Source sequence=SeqID_37871; Location=466..908; Strand=-; Gene=SeqID_66852
ctcatggacgtcatcaactgactccgcccccttattatgatgacgcaatcaactgactccgccccctttagcatgacgtaatcaactgactccgccccttattatgatgacgcaatcaactgactccgccccctttagcatgacgtaatcaactgactccgccccctttatcatgatgcaatcaactgactccgccccctttatcatgatgcaatcaactgactccgcccccttagcataacgcagtcaactgacccccccccctttatgatgacgcaatcaactgactccgccccctgtaaggtgaattatttttttgagaccgttcgttgatttgataataattttttcaggattttcttggctctctatatcgactcccctcgggatggtactgtctataaaattggctcacctcgcgcttctaaaaactttaaattatg

SEQ ID NO: 101645 - DNA, 213 bp, Heterodera glycines
  Promoter: Source sequence=SeqID_1832; Location=1..213; Strand=+; Gene= SeqID_76217
aaggttttattttgtaaataagataaaaatggattttccttcctaaacaattaaattaatttattttacaatttgcttaaaataaatttaaaaacttatattaaaattaacatgaatttaaaatatttcagcagaatatataatttaaaatttgtctaaaaatactttttaatgcattaggaggctcaatggtgtgccaacattgaacgaatg

SEQ ID NO: 101646 - DNA, 52 bp, Heterodera glycines
  Promoter: Source sequence=SeqID_25784; Location=1025..1076; Strand=-; Gene=SeqID_56524
tttttggagtgatttggggaaggggcgaacgaacggcgaagggggaggaatg

SEQ ID NO: 101647 - DNA, 167 bp, Heterodera glycines
  Promoter: Source sequence=SeqID_14668; Location=1599..1765; Strand=-; Gene=SeqID_78770
ggtggcagcactcggaaatcctggtcaggttcatgcgattcaaaatcggccccaaaagctgaatgatggcaattccaaaagattttttccaaagaaaaatcgggattttccgaaaaagggtccaactcaaattttaatgataaacgacaggaacaaagacagaaatg

SEQ ID NO: 101648 - DNA, 519 bp, Heterodera glycines
  Promoter: Source sequence=SeqID_14256; Location=2238..2756; Strand=-; Gene=SeqID_78272
tctattattgtggatttttgtacatacattcaacaaatgaatgggcaggaaaggagaaagtttctctcctcccgattcgcttttgctcgtccccccgggcgacgacgaattgctttttgaccataaataaatttgtttggtagcagcgatcactgatcaaacagaggacccaaaaatgatgattaatctattctgtaatcatcgtccttggctttatttgtacaaaaacatgctaatatacctaagtaattgaaacaataatgactaaatataaagcatgaatgaatgagaatgatcgagccgatcgggccaaaacaatgtgttgaaaatttgacaatggcccattatgtgggtgggctttgggacaggaggtgttttgtgtataggtatttaatcgcgccgatcactcaacagagcatcacacaattaattactcaaaaattaattactcaattaaaaatcattaaaaaaaataatattttaaatttgatttctaaaacaaaaaattaaataaaaatg

SEQ ID NO: 101649 - DNA, 386 bp, Heterodera glycines
  Promoter: Source sequence=SeqID_30931; Location=413..798; Strand=+; Gene=SeqID_61301
tgcttcttggccttagaatggccaaaggatcggatggaattcaatgagggccaaatcacttaatgccattaaatcatttaaaaattttcacgaaacttgaaatttttgtaaaattcccactgctgttgtgccgtcattctctgatgcccggccgtccgtgtcgatccatttaaaaactataccgtttcgaaattcgcatttttaaatgccaaaaattaatatgccaaaaactggcaaaccttttttcaatgaataaatttgtgcatacatatatatatatatatccctctcccctctcttttgttgtgatttttcggagcgattgccccaaaatttggcacattcgcccaatttgaatttgcatttttttcattgttcataaaatg

SEQ ID NO: 101650 - DNA, 448 bp, Heterodera glycines
  Promoter: Source sequence=SeqID_41460; Location=807..1254; Strand=-; Gene=SeqID_69572
ttctcgtggacacgcagctcgcagcaaaggcaacggtggttcgaaggagttgaacatctcgtcagagggaaccgagtgggacaggcgccgaagcgattatcgtgaacagcgacggctcccgtttctcatcgccatcgcccacagaacagttgccggaaaatcgtcgtcgggttcaacagcatcaacattcggtcgacatttcttcaacactcccaattttaatttaaattgttccccattttacaggtatttcgacactcgaagtgatcaatttcctcggcaccgaattcgccgcctcttctccacggacgtctctctcgcagttcgactttcggctcgacgcaaactcgtggttggaaagcgatggcacgtcacatttggcccctcgctcgaagaaacggactcatcatggctggtcaacgtaaagcggctgcacctcaccaggatg

SEQ ID NO: 101651 - DNA, 126 bp, Heterodera glycines
  Promoter: Source sequence=SeqID_22029; Location=1..126; Strand=+; Gene=SeqID_52661
aattcattttggatggtttttaaaatatcgcacataatgatgatgtttatatataacatgacatcgttgtaaagattcaatatatatttatataagatcataatttctaggaagatttggtaaatg

SEQ ID NO: 101652 - DNA, 185 bp, Heterodera glycines
  Promoter: Source sequence=SeqID_29749; Location=937..1121; Strand=-; Gene=SeqID_60211
aaaatcccgattccattccggtttagacaatttttcttcagaaactttaaattcaaacattttgccaaatttcttaaatttaattcagaggtttcatttttttagtttttcgacttatgaagatgtgtttgattattttgactcggattttttcaggttttatcaattttttttagcaaaaaatg

SEQ ID NO: 101653 - DNA, 260 bp, Heterodera glycines
  Promoter: Source sequence=SeqID_32790; Location=1..260; Strand=+; Gene=SeqID_63032
cattgccaatcgtcgactaatttttttctgaaaaagatatttcggtcttttgattacaatcaaaacaatttaactgaaaaaatgtttatctctctctatccattatttatatcgcatttaaaccatttaattatcctctctttcttcagaaaacttaaaaatacttccgatttaattttctgaaactttttaaaattacatttaatatttcaattgacccataaaacacctttactctcaaatttaagaatgccgaaatg

SEQ ID NO: 101654 - DNA, 1003 bp, Heterodera glycines
  Promoter: Source sequence=SeqID_2702; Location=1959..2961; Strand=-; Gene=SeqID_81165
aattttttaaaaattattaatacattttttaattatattttttcataaaccatttccttatttgtttaattttgaaatcatgattttaccctgttaaccatggttgtaccatttcacaatttttgtactttttctaatcacttttgtacctcttctaattactcttataacttttccaatcactgttgtaccttttataatcattgttgtacattttataatcactggtgtttttatttctgtttataattctgaagccgcaaatttttttttgctgagacaagtatctattaaattcatcaatgcctttgtttttttcttttgcaaaaaatgtttttatttaaaaatatccataatcattttttggctttcgtaatttttttttttaacatttcagcattgtatgtaatgaaattttgaatggacattttcccattttgcccatcccaactcggcctcaacttttgttcaatgaaaatttattttgccaccaaaaaatttcgaaatcaagtgcattatcgataaaaacgggggtcgtcccgggactcgcaatttttacagaatttggattcagttaattaaattagtcatttttgcagagtttggcattcaattcacacaccgagtcaaaaaacgagacatgtgtcaataaagagagagtgcagagaaaaaaacatctctcattttggcgtactatttttttatctctgttaatagagaaaaaccgaatttacttctctccatataactttttttctactcatacaatatgtactaaattttgcatagcgatagagaaaaatattatgaatatttttaacgctcgagttttatttttttacgctccgatctaaaattattcaaaaaacaaaatttcaaacgcttatatcttttttcggtaatagtaccgatggtatcacaccttttttgaaatttttttaaaaaatttcaaaagttaaaaatatttattataaggttttcggggtcgctgagcacgaatatg

SEQ ID NO: 101655 - DNA, 477 bp, Heterodera glycines
  Promoter: Source sequence=SeqID_20022; Location=1664..2140; Strand=-; Gene=SeqID_84795
tttcaaaaaaacgggagaggagagccgagccattcgtaaaaaaaattttaaattttgtaaaactcaaaaataagtcacgatacttttccattttgtgcctacacctcaaaatttaaaaaaggcgtgcaaaaacgaacgcttctctttttggaggccaaaaacgcacaattgacgccaaaattttaacatgggttaacattgcgtctcttccagtccttgcggtcaaatgtattcgcgcacaatgagagtcgagcatctttattgcctttttaaaattttgaagtgtaggacaaaacggagaaatatctaaatccccacgaataagtgccttaatgtggtggaattttttaaatatttcgctcagattgtagcgaaaagagtgccgttccgtcggttgcctcggcgacttcctccgcctattcgttacgaatttgtgcaaaatgtaaaaagttgttggacaggcgagaacgagccatg

SEQ ID NO: 101656 - DNA, 242 bp, Heterodera glycines
  Promoter: Source sequence=SeqID_16187; Location=1..242; Strand=+; Gene=SeqID_80549
ctgcacttatatttgaagaaaggctcaatctctttttactactttatttttttgatttggatttatttatttcgtttttttatagttttagagaattttagttatggttctaattagtctttaccgttggcagggccctcgttttttattattatttttttcagatggatccaaaaaatgtttagacaattgactatttttaagttaaaattgactaaaaaaatatcccttttttagcaatg

SEQ ID NO: 101657 - DNA, 52 bp, Heterodera glycines
  Promoter: Source sequence=SeqID_21678; Location=1..52; Strand=+; Gene= SeqID_52288
attgaccatcaaccagagactgggccaaggtcagcaagcgtacttgcaaatg

SEQ ID NO: 101658 - DNA, 63 bp, Heterodera glycines
  Promoter: Source sequence=SeqID_602; Location=56..118; Strand=+; Gene= SeqID_57364
ggtttgatgatcaaacttattgttagtttataacccccaatatttcagtacttttggataatg

SEQ ID NO: 101659 - DNA, 328 bp, Heterodera glycines
  Promoter: Source sequence=SeqID_42427; Location=1..328; Strand=+; Gene=SeqID_70324
ttcaaattttacaaaaagtagagtttcaaataagtaaaactaatttttttttaaggggggaaaatttatcttttattattattgcccgggtccgggtacccgaccgggtcccagaccttgatacccggttttttcaataccccggacccgattttttgaaaatccaatactcgctatccgacccagtcaggtctgggtacaacctggtccaaaagtatactggtaagaatggggtattgttcgatttgttgatcaaagtcgcggaaagaaaaaaaaatacaaaaaaaaaattaatgtttattgaaaatatcataatttatcaaacatg

SEQ ID NO: 101660 - DNA, 859 bp, Heterodera glycines
  Promoter: Source sequence=SeqID_12681; Location=2360..3218; Strand=+; Gene=SeqID_76360
cctgaactatctataaatggtagatatagagtaatgcttgcgaaccaaatgagaaaaagggcggtggatcagcaattctaactaaaacaaatattccttatcagacactattctctgggacaaaattccaaagcgaaattttacacattaaattactttttaaaaaaccaatccaaatcataaatatatattgtccaccgaattgtacagttcagaatactaaaaagctactcaaatttatttcggaccagagtaattctgaaaatatcatatattgtggggattttaacatcccaaatattttatgggatgaaaataaggtaaaacatataaatgatcctacgtcaaatatgctgattgagttaatggaccaaaaacaattgaaacagcatgttaaagaaccgaccagagaaaatacgattttagacttagtaatgactagtgaatcagaattaattaatgaattaattgtattggaacatttttcaacttccgatcataaaatggtcggatttaaaataaaagaaaaattccggcgtaataatcccagtgtttatagaagagattttaaaaatattaatttttcgaaattaagtcgggcgatacttgaaaatcgaattgatttatcaataaactcagtgcacaccgttgatcaaaaatataaagaattcttaaataaagtactgaattatatgatacttttataccaaatagacctctaaaatcgataataaaactatcgtatcctcaaaaaataagagatttattttcagagaaattacggttacataagcttgtaagaaaatttcctgaaaaaagtgaaatcattttaaattacaaagttatttctagtgaaatg

SEQ ID NO: 101661 - DNA, 173 bp, Heterodera glycines
  Promoter: Source sequence=SeqID_11055; Location=137..309; Strand=-; Gene=SeqID_74390
aaatcttaaatttcaacgaaactccgaaaaattacaacaccactttactgaattctgttcgcatttcattctgtaaaattattccacctttttcatcatcttttgtcgattcatttattgaaaatgtgtcgcatttgcccgaaaaaaccgaattcattatagaaaaccaaatg

SEQ ID NO: 101662 - DNA, 79 bp, Heterodera glycines
  Promoter: Source sequence=SeqID_2318; Location=5358..5436; Strand=-; Gene=SeqID_47249
ggtgacaccctcctcaattctctgcataacccatttttgtgtgtatttgttttttaggtatcgcaattttcagacgatg

SEQ ID NO: 101663 - DNA, 1003 bp, Heterodera glycines
  Promoter: Source sequence=SeqID_8297; Location=904..1906; Strand=+; Gene=SeqID_67615
aaaaagtactcttatatttaaattaatttatgtatatttttcaaaattttgaagaaaaaaaaacttctacatttcattttttcgatataagtcgtttttgtaaattactttaatagaaaaaaatacaaaataatttaaaaatttcctttcccccaattgattttatttttctttttgaatatacgtaaatggtaaattgattttttcaaagcattattgaaacatacataaacgaaactgatttattatttttacaaatatttccatttttcatttttactttttttctaatattgggtgatagataatataaatttggcaccatattttttaatgttttatttctttaacaaaaaaaaaccaactaacaaataagcaccaagggatgttgcaagtttcgctttcgccttttcgctttttattttggttttttcgctttttatttttctctttgcaacatccctgctaagcaccaaagaaaatttccgcttttatcagatttaaggccatgtttggattctacagaatgaatttggccataaatataatttttggcatgatttaatttgttaatttttgcaataaaaaaatcgtgaaaaattatttgtttatctttaatatatattctttattagatggaaattccaaaaacatttcattactgcaaattaaaattggtaattaatttggtcccgctttagggcatatattcccattttcagttataaaacactaaaggaatttcagagaatcgttaagccaatgtcttttttgttattgttttctattatttatctacatagcccagcaattattattggtagagttttaaaatgcaatacgaatttgataaaaattaatataatttatcaaaattctatttttttattttacgagtaaaaagcatcataaaagattcattttcgagattataggtggtaaaaacaaagatcatttcgctgaaaaagagaaatgttttgctattttcaaaatcaaacaaatg

SEQ ID NO: 101664 - DNA, 695 bp, Heterodera glycines
  Promoter: Source sequence=SeqID_33757; Location=1..695; Strand=+; Gene=SeqID_63723
gtataaattataactaaatttgagatttttatgtgccaattgctctgaaatatgtaatataaaatatgcaaaaaatgctgaaatatgtgctaaaaccaaaaaaatgcaaataaatgtgctaaaatatgattgaaaactagaaaaaatagccaaaatatttacgatatgtttcggagaaaatgatatttttggcttctctcgatctctttttttccctttactccgctcaaaatttttccatcctatttgttaaataaaaattctatttttatcttattatagacttgacagatttagtcatattttgacatttttctttttttttagtccgtactgtaatttttttttaaattgagcccccggggctctatttttgaaccccatcccccaccttaagggaggaaggctttaatggagggggtctattttaggggaaggagctatgttttcgtaaattaggtattaaattttttgcgtttttaaatacacgcaaattgacgcacaaagaattcaaattgcacatattttaacatttttggtgaatgagcacatattttggtgacattttttggcccgtaataattctaacgccaattatgccactccaaaacacttttggcaccctaattacccgcttccccagaccttaattagtgcaactgtttctctaatcacagactgccgatgataatatg

SEQ ID NO: 101665 - DNA, 79 bp, Heterodera glycines
  Promoter: Source sequence=SeqID_28817; Location=304..382; Strand=+; Gene=SeqID_59390
ttggtgtatcagaaagacccttttctgaatttaggcggcgtcgggtgcgtttcgacttggctctgagtggcgcagaatg

SEQ ID NO: 101666 - DNA, 818 bp, Heterodera glycines
  Promoter: Source sequence=SeqID_3075; Location=1814..2631; Strand=+; Gene=SeqID_83093
atcggcaatttttaataaatgaaatttatcttgtgaaataatattttaattattatataaacgttatcaatgtaatcagcccattttatttaattaaactttattttacaacttttatattttaaactatttttataataacgatttttatttcttttcttgaaaaggttttctaagtgcattatgatatttatgttgtttaatttaatgttttataatttctttatcgagcaaaaatgagaaaagcttcagaaatgatcttaaacatggatgttttttcttgtcattgctatcttgtttcaatgaaaaataaagattataaaatttaattttgttaattaaatttttgttaaaatttaattgaatttttttttcttttcttgctttggtacaaataaaaaaagatttttaattgctttttatcatatttttgaaactttgtgtttaatagaattaaaattgtttcaactattccagatgaggctatcgaaaataatcctcttctttgtttagtaaacatgaagtaataataaataaaagatgaatctaatcaatgaatatgttcactattttagatcaaatattattttaatatataaaatttattgatcctttgtccttgggtccttttgtttgtggaatcttattagaattaaaaattcacggcactgagctagctataatacattaaaagcattaaaaacccgtctcggaaaaaaagacgggaaacttaccgtggttttccttaggaatccgttctcgcatacaaatttaaaaaagttaagaaatataaaaaataaataaatacaataaaaatg

SEQ ID NO: 101667 - DNA, 1003 bp, Heterodera glycines
  Promoter: Source sequence=SeqID_7795; Location=352..1354; Strand=+; Gene=SeqID_65996
ttaaagggaaaacgatatggccaagaaaaactcgtctattaaatttagctggacgttgtgcgttttttgctctctaacggtgcgcgtgtcgacgaaaggaataaatacggtaaagcgagcaaaagggacgattaaaaaggcactcaatcagactcacccgcaaattgttgcattcagaatcagctttttagtgctaatttaaaatattttcggtttttttgaataggcttttgatccattctcagttctgttttcatcttagcctcaacatatataagtaatacgtttaattgttaatgtttttatgtccaataattaaggcaaaactgcgctggattttgcttttaaatacggacactcagaaattgttcactttttacaagccgaacaaaagaaaattgcaaggcaaataagaactaattatgattatattataataattcattaagacaatacttttgattagatggctttttagacacagcgatttgtgagagggaattgccattcaaaatctggtggatctctgcagattataaaatgatttatcatcatttaaaatatttattgtaccatttacacttatttggttcgcatttatgggtcagaaataaaatttacttgaaaataaactgaagtgtgtcaattcgaatacgctgtagtcactaagtaaggaaagttatcccaaaaagaaatttttaaattcaaatgcgggttaatcccgcgggatcccgtctcctgagagaattttgaatttcaattatgtagtgggatctgcaaatttaaaaattgccgggcccctcctcctccccctcccccgttcacttctcacatcctctaattttccttcattcattttcatttggatattccctcttaatgtgcaaaattgcttattcctccttttattgatctcccccttcttatcaaattaacatgccaccattttttagttttctaatccaatttaatttacaaattacataacaaatatttccaaatg

SEQ ID NO: 101668 - DNA, 161 bp, Heterodera glycines
  Promoter: Source sequence=SeqID_3914; Location=2066..2226; Strand=+; Gene=SeqID_52411
tttgcaaattgttattggaagcatatttaagtgagtccaattaatccatgacattcaattaattcacccagtgggggggggggggggtgattaattaattaaatggtgtgtacccatgcattttggcttcaatttgatgcatttattaaatttcaaaaatg

SEQ ID NO: 101669 - DNA, 174 bp, Heterodera glycines
  Promoter: Source sequence=SeqID_32070; Location=1..174; Strand=+; Gene=SeqID_62383
tcagcatcaacaaaccccttttacaaatttttcagtcgtttgcaggaatggggattgcaagtcaaattcgagaagtgtaaatttctctgcaccgaactgaagttcctgggtcacatcatctcagcggaaagcattcgaccggaccccgaccgatcgcggacgatcaacgagatg

SEQ ID NO: 101670 - DNA, 425 bp, Heterodera glycines
  Promoter: Source sequence=SeqID_5211; Location=843..1267; Strand=-; Gene=SeqID_57278
ttttcaatcaaatctgaaaaatttgacgaaaaatggcaaaatatgcaaaaaaaatctgaaaatatgtatagaaaatggtaaaatatgcattaaatataaagaaaaactcaaaatatgcaaataagtcccgatttttatacgcaaacacaaaaaagaaagtgtttttcctactatttagagcttggagaagccaagaaaaaaatatgcatttgcatattttttgcagccctgctaatgatagcccatttccggtcctcaaatgaaatatctaaccggaaaaatggtagttttagtcccattggtcccatccatcgtcaagttccagtccgtttgtttcaaaatccggtctctatatacaaaattcgaggtgtccatattctccaatcttttagctaatatttgtttcaatatcaattcaaacaatg

SEQ ID NO: 101671 - DNA, 316 bp, Heterodera glycines
  Promoter: Source sequence=SeqID_20375; Location=692..1007; Strand=-; Gene=SeqID_50896
ttttgagctttttcgtccatatttcgggcttttttagtccataaaatttataacctaataataataaaatgtcacgtaaaatcaaaatgttaattaaatcaaatatgcaaagcatacatttcaactagagtagaacgggaccgggacttttcgggttaaaaccgggactttttggctgggaaaccgggattttcccggtcccggtcaaaacaggccaaaacctggacttaggtactcattttgatggctataatataaatttatttaaataatttttttttattaaattattttttagagtgttcgtattaatatg

SEQ ID NO: 101672 - DNA, 720 bp, Heterodera glycines
  Promoter: Source sequence=SeqID_14376; Location=682..1401; Strand=-; Gene=SeqID_78413
aacatcctgtagaaattataaaataaaattttttattttcatttttgctaaatgcaccggagtctttcataaaaccagtgcaaactatcactaaaatatggactaaaaacagttttctttcacggaaagtttacctttaagtgggattttttttaactgtcactcatttgaatgaagttgcattttcaattgaccaaaaattaataaatgttgataagttagtttgtcatccactccattctataatagcttaaaccaattgcaacaacaccaaaaaattgcgccaaaatttcgagcggcgcggcatatggccaatcaaaccaaagggatgcgacggcgagtggccaaggcagcagaagcaaaaagggggcggagtgtggaggaccgttaattgctaatcttttgatgctcggcttctagccaagggaatttagccagataatcgttttggcgagtgaatggaggaggcggtgggtgaatcagttctcaaattgtcgaataaaaaaacacttcattaaaaatcatttttaaagatacattaaaaatcatttttaaagatatacaataatatttatttatttaatcccaaattataatggttttatttttatgtattttgatgctaaaaatacattaaaatattttttagcaataaattttatcgtgcgcaaatgtgccaataccaaatgccaatgttcttgcaatggtattgccccaatg

SEQ ID NO: 101673 - DNA, 64 bp, Heterodera glycines
  Promoter: Source sequence=SeqID_30966; Location=1494..1557; Strand=-; Gene=SeqID_61326
gttccaacgcgtagtcgccgtactgctctgcagcctgttgaacgtatacgtgtaaggcgaaatg

SEQ ID NO: 101674 - DNA, 589 bp, Heterodera glycines
  Promoter: Source sequence=SeqID_34724; Location=282..870; Strand=-; Gene=SeqID_64445
ttttctattaaatcaaattatacggatgaatggactgttgaggcaatcattttgaaattaaaatacctctttggtagtagtaatttacgaataaaaaaaggtgtaatgagaaatgggctgaaaaaacaacggaacgaacgaattgaacgaaatattggaacaaaaagagagagcaaaggcaaagggagaacagaaacagggagcgaaaaaagcacgtgcgatcggcgcgtggaggaaaggcaaacaaaaagtgaacatgacgagacacaacaacgaaattcgatccgtcgcgttttgtgcggcgtacgccgacaaaaaacaggtaattcgtaatttgtgcaatttggcactcgcactttggcttttcgtttccaaattgtgcattgctttcttttccttttcccctccaaaattccaaatgctttttgttttcgtttcttcttttataaagagttgttttggccgtttaaacgtgaataggtaataaatacctaattgttgacctcgatttcccgattagttcgtgaatttaattgcttttcctattttttccgcccttttaatttattttcctcacattttcagtatg

SEQ ID NO: 101675 - DNA, 87 bp, Heterodera glycines
  misc_feature (11)..(11): n is a, c, g, or t
  Promoter: Source sequence=SeqID_28163; Location=1260..1346; Strand=-; Gene=SeqID_58812
gtctgacaaanttgtgccaccacaggacaacaactccaacagcagcaaaatagacaacaaaatagtgcgggaaatgaagaagaaatg

SEQ ID NO: 101676 - DNA, 154 bp, Heterodera glycines
  Promoter: Source sequence=SeqID_2473; Location=552..705; Strand=+; Gene=SeqID_79896
agtaattttcatttaattttttgatggaaaattgtatattataatttctataattttgaggtctgtattttttgggcaattttgctcaatgtaccagcgcgcttgcgccgcatcgagcgccttcgtccgcgtcgtccgcctgtttacaacaatg

SEQ ID NO: 101677 - DNA, 112 bp, Heterodera glycines
  Promoter: Source sequence=SeqID_126; Location=5580..5691; Strand=-; Gene=SeqID_46855
acaccttgaacgcgaaagtctataaataggtaaagaattttgcaaaatcatacatttaggaactcatcatcatcatatagcagtactaaatattccttattgattaatcatg

SEQ ID NO: 101678 - DNA, 59 bp, Heterodera glycines
  Promoter: Source sequence=SeqID_9485; Location=540..598; Strand=+; Gene=SeqID_71592
tgcgccactgcgtgtgagttgcgtcgtgttggatggacacgcgcgtgccggtcagaatg

SEQ ID NO: 101679 - DNA, 860 bp, Heterodera glycines
  Promoter: Source sequence=SeqID_2937; Location=1865..2724; Strand=+; Gene=SeqID_82433
actgcgcgacatttttgtggaacaccgacaaaaattgggtggccatttcgcactgattgacccatttgagaagcaaaaagagcggcgacgactgatcgacgcttattcggcactgaaaggcatcgacgcctttccctcttcgaatgcgcttttgcaacttggcgaatattttccgaagcaacaaccggggacggcacagccccaatttgggatgagtaagtattttaagagccttttgtttaacttattcttggctcatccccccagtcacaatactgaagtccatttctccccttttagctcagttcggtcagccctctgttggtggtggcctttttagtgcctcaaaagcgcccgccttcagtttcgccccctccgctcaacagtcctccaccaatctcttcggcacaccaaaaccaacgccttttggtatgccaaccacaactgccaccgcgccaagtcctttcggtgctgcggcagcagtcattccaacttcggctggcggtgggttttcacgggttggcgttttgtttgcccccccccccctcattcggtgcaaatatttgcgtatatacccacccatgggttttttggcgaaaaacggcgaaaaattttgtaaaatagaccccataattcgggatttcaaaaaaccaaaaatacacccctaaaaatcgacttaaaaaagaaaaatacacccctaaaaatagaatttttgacttcagcccccccccccaaagccaagggtctggctacgcccttgaatggttataatactttaatctttcgaaaaacctgatttaattcactaattcctcctttgagagttttttctaacaaaacaaacttaatattaaaaaatg

SEQ ID NO: 101680 - DNA, 594 bp, Heterodera glycines
  Promoter: Source sequence=SeqID_6618; Location=799..1392; Strand=-; Gene=SeqID_62222
aaaatattgaaaaatataattgtttaagatgggaattgataactaggctgggaatttaagtcgtgagcttggaagtttgaaaagcagattttcttattcaatttaagttgttaaatgacttgaaattttgcagataaatactttaatataagggccaggatgacattccgaggccccaaaaattttcggaaatcggaattccgagggtcaaaaatttttaccgattttgagcaaatttctcaagaaaaataaagatttttagggtccggcggtgccgaaaggcgccgccgagaaagttttgaaaattcagtgcaatttattaacagaaatgtacaaaaattgataattttttgaaaaaaaaattcaaaagctttttatcaaaaatttcggaaatcggaattccgtaccatccctaattttttgtaagaaaatctgcttttttaaatgcagtttcagaattttaccaaaaatacattaataaatgggtaactcggatggaaatgaaccctcgctaaagtccgaggctcagattttatataacaagatctaagcaacagttccatcacttcacaggacgatcaaatcttttcgatg

SEQ ID NO: 101681 - DNA, 497 bp, Heterodera glycines
  Promoter: Source sequence=SeqID_39977; Location=1..497; Strand=+; Gene=SeqID_68422
catatttttaatataaaagcaataattaaatagcttatagtgtaatttattacatatttggttttataatcattagcgttgtgcgtttgtatgcttaaaaaatgccaaaattataaaaaatatgccccaaaaatttaaaaaatggatttaaacaaaaaaactgcagctgtataaattcaaaattgacctgaataaaaaaatcacaaaaatttttttattttataaattaacgtatgaaaagtttgaatgtttttaaatttgtatttaattatctggcaaatgcaattatattgccaaattgagaaagactttcttccgttaaataattttacgagttttttggagcagatttttgaaaattccataacccgaacgaatggaggggcaccgtatccaaaccgaatcgagaaatttcaagttttccattttaaagtttcggtttaccgaccccttgaccggtctatattattaatgacactaattaattataggaaatg

SEQ ID NO: 101682 - DNA, 875 bp, Heterodera glycines
  misc_feature (18)..(18): n is a, c, g, or t
  Promoter: Source sequence=SeqID_11329; Location=2325..3199; Strand=-; Gene=SeqID_74714
tttagaattattcattantgcatttttggtaaaatatttacaatgattctttgaatagagaaatattataatatttttgaaacttcttctttaaccttaaatttgaaaaatataattatagttataaattaattgcttattcatttttttatttaagaatgtttttatttcaataattaatccatccctctttaaatctgctatgcaaaagtgttatttcacttttaaaaaatacattgagttaaaaaatatatttttgaatgttgataagcactaataaacagggctgcaaaaaatatgcaaatgcatattctcacgttattgtgacgaatagggtttgagcttcaattttcatttgacagctttaagtgacagcaggcccgtatccagaaaaaaatttcgggggggggggggcacccgaagagctttttttttttgctcttcgggctatatatttttttaccagtgttgtttttcaaaaaatttcagcgccggagccacaaaaaacagaatttgtgtcaaatgctaaaaaaatattggtaaacttgagtccggcggtgccgataggcgccgccgggaaaaatttttggactttttaatcaattatgttaagaaaaaagtgcaaaatttttttcaaaaatattgaccatttttgcttcaagcatggcagagtgaatacatactctgtatacgaacaagaaataataataaatataaatcagaaatttacataaaaatgcatgtataatgaatgataagtcttaatagtacttaaaacatttaaaaaaacaatcttgaaaaagaagccaaacatttttaagaaaattttaatttcatattcacgcgatttttggccaaatatttgcagactaatg

SEQ ID NO: 101683 - DNA, 252 bp, Heterodera glycines
  Promoter: Source sequence=SeqID_27339; Location=1594..1845; Strand=-; Gene=SeqID_58029
tgtttctccgagatttttttttagatttagggatttgtcattttcaaagcaaaacgaaaagcaatgaattttgattgtatggtgaattaaatcaatttccctctccaaatatgaacactcattttattgcctgatgcgattcatttgttttgataaatttatcaaaaaaagtattgtttatgttttctttgtcttgttttcaactacttttaatttgtacattgttcaactctactgtttaattgggtcatg

SEQ ID NO: 101684 - DNA, 142 bp, Heterodera glycines
  Promoter: Source sequence=SeqID_2255; Location=1490..1631; Strand=+; Gene=SeqID_78756
taagccagtacaacaatatcaaatagtttaatccattagccctggtctggcaagcggttaggctttgccggacttgacaaccatttaatgatgtgatgacccccggggggagcttttttttattagttgtcaaccgaccatg

SEQ ID NO: 101685 - DNA, 750 bp, Heterodera glycines
  Promoter: Source sequence=SeqID_10014; Location=891..1640; Strand=+; Gene=SeqID_73066
agttggcgagaggcgagaggacgagaggcgagagtttttcaatttttttctgtagccttattttttaatttaaaaaacttcaaaatcgtatattaaattaggggtacgggcctgggtatttgggcaaataccgggtcagggtattgccgggtacagaaagccgggtcagagttctagtttttaaaccgagtccaagtcatgaaaaatccaaacaaaaatctttaaaaatttttcatgaaaattaaaaaatattttcatgaaatatatttattttagaaacaaaatttattatttgtccattttttccacctttttttgcggtgcgttttttaaaacttcggggacagttggggtcgggcggtgccggtaggcgccgccgaaaaaattttgaaaattgtcttcggatttgttaacagattttattcaaaaaatgaccaaaacttgttttttaaattttttgtttttaagtcgctttttttgtggcgctgttttttcaaaaaaacttttttggaacattgggtgcggggtccggcggtgccgaatcggcaccgccaataggcgccgccggaaaaattctaaaattttgagtgtaatatattaacagaagttgtcaaaaaatgatcaaagttttggttaaatttgcagttttaggctgtgtaaaaaagaaaaaataataatttttaattgaaaaattttttattaattaaaatttcgattgaaaaataatttatagaaattatttaaaaaatg

SEQ ID NO: 101686 - DNA, 459 bp, Heterodera glycines
  Promoter: Source sequence=SeqID_34658; Location=190..648; Strand=+; Gene=SeqID_64390
taatatctgtggcatggaataaattttggaactgcgctgcctaacggcggtgcttaaagtgcgctaaaaatgatcaaatgattatcaatttttatttttcttaattccaaaatgaattgaaacgcaaaaatttaatcataattcatgtggtaaaaaatgcatttaaaaataaaaaaattcttgaatttgcttctgaattttttaattttaaatagaaaattactttttcgaaaattttgcacaaataagaggcggagaaattcaacgaaatttttattaggattttgatttaaaatgttgagaggtttaacaaatttgtacactgaatgttggatcgtcaacaccaatgagaaatgactaacagaaaagagggagaaaagggcgttggcttaggaaaatagcttataataaaggagagacgagcagacgatgagtgagagaaaaatagtggtaaaaatg

SEQ ID NO: 101687 - DNA, 542 bp, Heterodera glycines
  Promoter: Source sequence=SeqID_10846; Location=232..773; Strand=-; Gene=SeqID_74117
acttaattcaagccctgaattttgtcgggaccctgccctaatttctcaaatttacaagctccttttcgaaattatggctttataatttgtttataaatagcaatttttggcgctatattgaaagttaccctttttgaaaattttttcaaaaggggggacccttttgttttgcaaaattttttttgtgatagtcataaaaatttattctctggggtttttggggtccccgatcacgaatccttcaattattttgatcaattccgatttcctaatctaaatttgaacaaaaaatcataattatgaaaaattcaaaatttcgatttttattccagttcgggttagggattagaaattattcaaaatacatgacagatgcgtgattaacgaccttaaaaacccagaagaaacaatatatgcactcgtgtgtgttaatctgaccgtgactgagcactgcccaaggctctgattgttaagccaaggaaacttgattaagcgcgggtaagcggcggcagtaactatgactctcttaagggagccaaatg

SEQ ID NO: 101688 - DNA, 51 bp, Heterodera glycines; identical to SEQ ID NO: 99312
  Promoter: Source sequence=SeqID_757; Location=267..317; Strand=+; Gene=SeqID_60559

SEQ ID NO: 101689 - DNA, 1003 bp, Heterodera glycines
  Promoter: Source sequence=SeqID_16676; Location=2636..3638; Strand=-; Gene=SeqID_81075
tcatgggaattatgtatgcctgaagggtaaagacaatcacataatataaaataaaattatacaatttttaagtgtcacattagtaaaataattaatttttttgctcatttctcaataatcagaagtgatcagaacaacagcaacaattcgtcccaatcccaaattctaatcacacgtcgtattttcaagtcgttaataatttagtgtttttaaacagtttgtgaaaagcgtttgattgacatcaccgaataaatgaaatggtacggatcaaaatcgccaattttggcataaattttgtcctggacaagaatgtttgttatgagcaaccacgtcccgctggtggaccatatcggacgggtgcgcatgattccactgttccaagcaccccaccgaaagttgaacgaaataaccaaaatataaggaaaaattttttaaaaatttttattcttcacctgttagagaaggaagtaattattgattaggtgtatgaccccacgccacttcgccatcttccccctcccattcccctcattcagttggttattgtgcccaccaattttgacctcccaatttatttctctgcatttttattattttattttcttcggcaaataaacttatttaatttgttatcttcggacataacaaattttggcgcagtcagcaactcaacgacagcgtttattttccaagctttatctcgtgctgatattgcttgtggtgattcatcataaaccgatctttgccatattttacggcacggtttatcaacaatctgtgcaactaaaccgcatctttgccatatcttacggcacggtttatcaacaatttgtgcgacataaaccgaatctttgccgtatctcaaggcacggtttcatcttcgacaagaaccgatttttgccaaatctcgaggcacggttatcgtctatttcaagccaattttacggcacatcatttctccgatttcggcaaattaaagggatttataagccattggaccatg

SEQ ID NO: 101690 - DNA, 152 bp, Heterodera glycines
  Promoter: Source sequence=SeqID_24315; Location=345..496; Strand=-; Gene=SeqID_55038
aaatttccatgtttgagttggtgggcccttgccaaatcgttatttgttatgtttttttcaacaatatttcattcgggtatgcccttaggtatcaccacaaaaattctcaaaatcgtttttatttgacggaaatggagttttcaaccgaaatg

SEQ ID NO: 101691 - DNA, 193 bp, Heterodera glycines
  Promoter: Source sequence=SeqID_21284; Location=575..767; Strand=-; Gene=SeqID_51880
tttctctataaatttaaaaattttagaaactaaaaaagttagatttttgatatttttaacgggattttatacgtttaaaatttcttatttttaatgtttccggtttcgtccagcccgacattttcattaaatcgggattttatacatttaaaaaaaacaaaaattttggcaaacgatacaccttaaacacatg

SEQ ID NO: 101692 - DNA, 298 bp, Heterodera glycines
  misc_feature (8)..(9): n is a, c, g, or t
  Promoter: Source sequence=SeqID_36181; Location=1..298; Strand=+; Gene=SeqID_65568
ttaatacnncgcggccaccacaaatcatttcgtaagttcaataataattatagaaactagaatggtccaaattttttctgttaaaaattttaattgcaattcatttctgtattcaataaattaaaaaaacaagaattaaatacgaatgtaaaaaatttctgaagagaaaaaatttaaaagattttttaagcaataacttcatacgggcttcatcatcagagaatctatcttatgtatgttttgtttgtttatacgtattgtaaaaaattgtatttaaattatttttaggataatgatg

SEQ ID NO: 101693 - DNA, 263 bp, Heterodera glycines
  misc_feature (24)..(25): n is a, c, g, or t
  misc_feature (65)..(65): n is a, c, g, or t
  Promoter: Source sequence=SeqID_41879; Location=749..1011; Strand=-; Gene=SeqID_69917
aaatttataaatattttaggtgcnngagaaattaagcaaaatgcagaaaatgaaataaaggaaanaattttcgtaaaaattcattctccaacacaactcaaatttggtgaggaaacattcaccaatgagcaaatcagaaaaaaatttgatgttttatttgaaagtaaacacaaaattttctttgccaatgaaagcgacgaaaataaatttttggtaaaaataataatgtttcaataaaaatataatatataaattttaaaatg

SEQ ID NO: 101694 - DNA, 118 bp, Heterodera glycines
  Promoter: Source sequence=SeqID_27511; Location=804..921; Strand=-; Gene=SeqID_58200
aatttatatttcaataattaatttttgtttttttaatcaaattattgagtggttttgtaattttaaaactattgcgaaaaattaaaattgaaggttaattttaattggtttgaagatg

SEQ ID NO: 101695 - DNA, 221 bp, Heterodera glycines
  misc_feature (125)..(125): n is a, c, g, or t
  misc_feature (127)..(127): n is a, c, g, or t
  Promoter: Source sequence=SeqID_33209; Location=1..221; Strand=+; Gene=SeqID_63339
aatgtggcccaaattttagccccccagccacagccccttggttctcccagttttagttctggatttgtcaaataaattcaagacttccaattaatatcaaaatttctcttaaaattttttgaacncnaatcaaaaaaggaaaaaaatttgcagtcaaaaaattattcgaatttctccaattttgtttccataatttccgaaagttattcggtatcataatg

SEQ ID NO: 101696 - DNA, 477 bp, Heterodera glycines
  Promoter: Source sequence=SeqID_44533; Location=1..477; Strand=+; Gene=SeqID_72017
cagaattttgaaaattttttataaaaactgatgacaagctaatgtgataaaacaggttaattcttttcctttcagtatccctgcaaagtttggggcgcttctgataagtttctgaaaaaaaagttaagcctacattttttggcatatttaaaaagcaattaaaaaatttttaaaatttaataattttcctgcaccgaaggtactcactcggcctcttcgcggcctcgtggggggcctttttcccggccgtgacactaagttatgaaaattttaagggatcagtgagctacgaaaaattaaccatcttattataatgagaactttttgacatctgtatgcatgttcggatctcactttatccattttataaaccctcaactttttcgaaaaaatgaattttcgtttttcaggaaataaataaaaatgtacaaattttggcttacatatactttttttcagcaagtggtggaggacatg

SEQ ID NO: 101697 - DNA, 68 bp, Heterodera glycines
  Promoter: Source sequence=SeqID_27196; Location=1..68; Strand=+; Gene= SeqID_57884
cttttcctgctccaccacctcctcctgcgcaatttgaacatggagaggcaactcgagttgaaaaaatg

SEQ ID NO: 101698 - DNA, 354 bp, Heterodera glycines
  Promoter: Source sequence=SeqID_29302; Location=1..354; Strand=+; Gene=SeqID_59815
aaatttgattaaaatttgttgacagattttcactaaaaaatgatcaaattttgtgatttttatataatttttctaaggagaaataagagttttggcgcgccgttgagaacagtttttcatcaaattaccaaattttgcgattttgggccattttctaagaaaaaataggagttttgggggcgcggcggtgccgataggcgccgccggggaaaaaaattggaaattttgatcatttataaacagtttttcactgaaaattagccaatttataggtaaaattttgaaaaattttatgggaattttatccaattcttaggggtgtaaaagtcgcttttcgcgccaaaaagcgaaatg

SEQ ID NO: 101699 - DNA, 733 bp, Heterodera glycines
  Promoter: Source sequence=SeqID_4837; Location=504..1236; Strand=+; Gene=SeqID_55897
gctataatatgagaaaactaggaaaattatagtaataacctaaaaaaaaaagaattttattaccagggcttctttttttatgtaaatacatcttttttcctggattctctatagcctaattagtaggaaaaacactttattttttgtgtttgcgaacaaaaaccaggacttttatttacatattttgcgatttttctacatatttttatacatattttggactttttcgcatttttcgtacatattttgcaatttttaaggaattttttattaaatgcccaaaaaaaaatctaaaagtacacaatttttttcaaaaattttgagaatttatagaaatttcttgcgaaaatttaaaattttttcttgaaaatgttcccaaaaaaatatttttcaaaattctgataccaaaaattaatttttaaaataataaatgttgatttctaagcctatttattaggtcatttttatggcattttatgcgtatttactctttacgaagaattttttttcaaaaaaataacctttaaaagattttatttacatattacatatttggggatttttgtacatatttaatacatattttagcatttcttatacatattttatttacatatttcgcgatttttcttacataaaaaagaagccatgtttattactaacttttgaggataattttttttttttttttgtataaattttgtttgattgcagctgcgcagacagctttatg

SEQ ID NO: 101700 - DNA, 242 bp, Heterodera glycines
  Promoter: Source sequence=SeqID_37148; Location=1..242; Strand=+; Gene=SeqID_66298
cgaaaaagcggaaaattttaaaactccttaagtttctgaatgttaaattgcattaggtttgtggttcactttatattcctgctaaattcagaagaaaaaaataagtaaatttcctaggggattgtgcttatttttaagaacggaattccacgttttgtcggccttaaacttgacaaaatgggaattgaataatttttattttttggcgtattgtttatttttagaaatttaattctgaaatg

SEQ ID NO: 101701 - DNA, 149 bp, Heterodera glycines
  Promoter: Source sequence=SeqID_42846; Location=868..1016; Strand=-; Gene=SeqID_70654
agcagcggcatcagtcatgagcagcgaatgttttgtattttgtatatttttctcgcctacgcatcaatgaagttttgtagacatttttttgtgtttttattggttttaaatgaaatgaatgatattagtgatggtaatgagtaattatg

SEQ ID NO: 101702 - DNA, 124 bp, Heterodera glycines
  Promoter: Source sequence=SeqID_22143; Location=1819..1942; Strand=-; Gene=SeqID_52795
tgctttgatagacagacttattagtgcgggaggaagcatatgagtacttttttaaatacataatatctaatacatactacgtacaaattttaaaaattttaggcttttggcccgttataaaatg

SEQ ID NO: 101703 - DNA, 319 bp, Heterodera glycines
  misc_feature (234)..(234): n is a, c, g, or t
  misc_feature (245)..(245): n is a, c, g, or t
  misc_feature (257)..(257): n is a, c, g, or t
  Promoter: Source sequence=SeqID_27374; Location=1008..1326; Strand=+; Gene=SeqID_58070
ttggtacggtaacccgcgttgattaaattacagtattcaaattggatgccatttttttttttttgaaaattttggcaatttataacagggcattttttaggaaattcatcgattaaaaatcaaaattttttgtacaaatttaaggcgaatcaaccgatcgcgaaaagaacaacaatctgtggacagaatggacggaatggacacagtaaaaaaatgcaataaaattataattanaaacaaataanaatcaaaattanaatgtgtttgatttgtcattttttgccagttgttcccgcagttgtggtggaggagacagatg

SEQ ID NO: 101704 - DNA, 166 bp, Heterodera glycines
  Promoter: Source sequence=SeqID_7294; Location=1433..1598; Strand=-; Gene=SeqID_64378
ggtgagcttccgccaggcgcggtttattcatcataaaaaaaccaagatacccaggtggttgcggtttccgccaggtgcggtttactcaacaaagacaaggaaattcaccgaaaattgatcaacaaaaattgcgcaaaatccgacaatcgatcagctagtgaaaatg

SEQ ID NO: 101705 - DNA, 312 bp, Heterodera glycines
  misc_feature (21)..(21): n is a, c, g, or t
  Promoter: Source sequence=SeqID_20148; Location=1..312; Strand=+; Gene=SeqID_84938
tcattgggacgctaaagcaanaggagactgggaaatcacaaactatgaatctacaaaccggaccgggaatcaaggcaaaatcccgacagtgccacaaacatacatttcagatcttttgctgtgtaaagacattttttttttaattttgaattggcataaaaaaaaattttgaatttgaatttaaatttgcttaacggtgtgagagttcggcggaactgtaactgctgattttgcttaccaaattacctactctttgattttgtcaaattttaattttcttaagttatacatataattaggttatttaaaatg

SEQ ID NO: 101706 - DNA, 96 bp, Heterodera glycines
  Promoter: Source sequence=SeqID_21192; Location=439..534; Strand=+; Gene=SeqID_51781
tattccaaaaggggtcgaaggagacgaactttttggtctaaaaaacaaattgcgaaattttgtgacgattggccgaacatttgacagaatcaaatg

SEQ ID NO: 101707 - DNA, 802 bp, Heterodera glycines
  Promoter: Source sequence=SeqID_25475; Location=899..1700; Strand=-; Gene=SeqID_56210
cccccattctttaggaatgtcctaaattgggtatttttatgcaatatttaagacgagattaataaaagcatccaaattaattgttaattaagatctattgaaagccgttcatccgaattttcgtcagaatttcgttgaggtaaaaaataatatttaattatggaatttatacaaaattctaaattcactgaatttttcaaattcgccgccaaaaaattgttgggatgccaacgcttgtgacaatcagctcagaatcattgatgacaaatgtttgactgtcagttggtggtcagaggaagaaggtgaattatcttttataattagggatgtgaattttatgtaagaaaatttgcaaaatagtaaaaatatatatattaaaacagagagaaatatgtaagtaatatttagaaaaacccaaaatatgtaaataaaatatgcgaataaaattttcacctattttttagaaatatattttccaaagtaatttattttatttttcacaagaattttttttataaattctctaaatatgtataatatatatatatatatatatttaaatttgtacaaaattttttattaattaattaattattttgtcaaaaaggatgctcatctgtcttcgcaaaacacccattcccgacctgttcttccggcattttttattatgaaaccaaaatcttaaggatgttagggtataatgtttcttaaaaaggaaattacattttgcaattaaattatttaatttgtgtgccattattagaaataccatttttccattggaatcgcctccaaagcgatg

SEQ ID NO: 101708 - DNA, 451 bp, Heterodera glycines
  Promoter: Source sequence=SeqID_31204; Location=1..451; Strand=+; Gene=SeqID_61576
tcccctcgatgttttaagtgataaaatttaggtataactccaccccgagaaatttgaatggacttaaaaaattgtaggaaaaaaatttattgtttatagataagccaacaattaaaattaatgaaaattttcgatgacaagagttataaaaacttgtcttcaaaaatttaagacacaatttctatggactcaaaaatttagtaagaaaaaaaaaataataatttttgcttcgattttgaaagccgacgatttatctgaaataaaatttttgattttatacatattttctattggaattttgaacaaattgctcatattttttaccattaaatacaaatttggatatgaaaaaaaaaaatttttttttgtttgtaagtttttactttattttgtctaaaattttcaaaaattcaatttctaatttttaattatttggattatattcatcatg

SEQ ID NO: 101709 - DNA, 209 bp, Heterodera glycines
  misc_feature (49)..(49): n is a, c, g, or t
  misc_feature (51)..(51): n is a, c, g, or t
  misc_feature (58)..(58): n is a, c, g, or t
  misc_feature (64)..(64): n is a, c, g, or t
  misc_feature (66)..(66): n is a, c, g, or t
  misc_feature (95)..(95): n is a, c, g, or t
  misc_feature (100)..(101): n is a, c, g, or t
  misc_feature (103)..(103): n is a, c, g, or t
  misc_feature (127)..(127): n is a, c, g, or t
  misc_feature (169)..(169): n is a, c, g, or t
  misc_feature (181)..(181): n is a, c, g, or t
  Promoter: Source sequence=SeqID_7135; Location=3840..4048; Strand=-; Gene=SeqID_63941
ataattgtcatatgacatcatctaatctatgattttttcatcaaagtgngncatgggnaaaagnanagggagaaaaaacgctttatggggggaanggggnngngaaaaagaaagagaggaaagaagnggaggaagaagaaaagggagaagaagaactaaaatagaaagnggagattttaangaatttagaatttttagtgttaaaaatg

SEQ ID NO: 101710 - DNA, 1003 bp, Heterodera glycines
  Promoter: Source sequence=SeqID_20789; Location=153..1155; Strand=+; Gene=SeqID_51363
ccgctcgctagcggccatcgtgacaaaagcaataatatgtatatatgtttcgaataaatgctaaatgtaaaatatgatctaaaaacagcaaatctctcataatgctagcaaaaaatcgattgatcaaagcatttttgatcaatcgataaaaggggagagaaagagatgaagcgttggcaagaggaaatgaatgatcaatttgaacagctgaatttttattttaccggaatatcataattgataaatttatgattattattggaaccccctcatccacttcatgcccctcacccatccccattagtccccactcactccctccccctcctgcctccctcatcccatccctcccacctccccttctcccggtctccctcattccctccctttccctatcccacatttcctccgttcatcctctcctctcgcctcttctctctcccctttttcttcctcctccttccatactttccctttatcaatatcatccactcttattgttagctttatttcccattcccgcttcttctcctcatcccttccgccgtcgtcttctcccttgggatttagagatttccccttccctcgcttttccgcttttcactccttccaatttgctcatcccaaattcggacaatttttccatctgtcctattcattattactttgtacgaatgctttcacttctgttcattcaggctactaaatcaaaacaaaccaaagtattgagaaaaaggtgtgtaatccttcggggcatttctcaaattccctctcaaatgtcctccgctactctctttttttttatcaatttcattgcttattctttttcccattggttttcgcttttcaatttcccttccctttcagtaaaaagttttcttcctcctcttcttcctcctgtttctctttctcttcctcctcttcctatttttcttcctcttccgtttgccttcctcctccttcttctcttcattcttcttcttcttcttcttctcttccaatg

SEQ ID NO: 101711 - DNA, 1003 bp, Heterodera glycines
  Promoter: Source sequence=SeqID_1718; Location=1003..2005; Strand=-; Gene=SeqID_75500
ttttatcggtgaaaattaatgaaaaataatcaaacaactgtttcgttattttcttatacatatagtaaagtaattgaaaaagtgaatgattaaatagacacatgatcaaacacacacaaatattcaaactacaattcaaaaattttcttttcattcagcggaattaacgaaaaattagtcaatttgttctcttcttataaaacaaatttcaaactataaattcagaaaagaatttttgaatcgacttattttaattctacagaactctgaaaccggaatttaaattaaaaaacgtcaaaattaaattttattttggtgggtctttttttaattgaatgaaatttcaataaattttcttaactggttttgtaccaacaaaatgacaagccgctactcggaacctgtcagagtgctgccgcaaaatgcgtcagtgataaaaattttgtagcattaagcaatacaaaaagctcataattgcataagaaaatcgttctgaattcgtcaatcatttccttagagtttgaaaaaccgacttttctcgactacattgacaaaatatttcaaaataaaacatttaaaaaatctccttatttcaaaattttcaacgtaaagctggatatttcttttccttttcttttttagcttttaattttgtgcccaatatattttcatcaataaacatcgattttgaataactaaagaaaaatgctatcattacacataactaaatttatacaaatgctcattaccagccaattttaaaagtaataatttaaattaaatatttcttttctttatggtaaaaatggaagaaaaaaatagtttcaaatacattttcaagcagtgattattcttggcccgatcccgtcactacttaaaaatctgcggccattgacttcagcttttaaaactgagatcaggatcggacaggtgctgaataaccgagcattgctggaccagtactggtcggtgttctgctgctgatcccgctttacacaagatg

SEQ ID NO: 101712 - DNA, 118 bp, Heterodera glycines
  Promoter: Source sequence=SeqID_11027; Location=2921..3038; Strand=-; Gene=SeqID_74354
cctcaaaagaaattgagcatttgccgaagcgttaacaaaattcaaaaataaacctcctctaacacaattaaattcctttgtttttctcccctcggtttctgtgttcaactaacccatg

SEQ ID NO: 101713 - DNA, 434 bp, Heterodera glycines
  Promoter: Source sequence=SeqID_9002; Location=391..824; Strand=+; Gene=SeqID_69964
atcaattaccaccacccagcgctctacactatcctgctgcgttaatagtgaaccgagaccctcacaacaaagaaggctcccattggtgtgccatttacgccaagggtttggatgtgccagttatttattttgatagcctatttcatcgtcttttttaattaaatttccaaacgggacaaaaaagaatgctcatccttatcaatcacctctgacctctacatgtgcccaccactgcattgtgtttctataccacatgtcgattggagatacatttgatcaatatttacgcattcttgactctaacgcatcaccagatttatttgtgactgtaatgatgaataaaattgtcggaaattacaaattgtaggcggagcttgggtgaccgagtataaaagccttcccgttcatcagatgatttcattctgtcaaaaatg

SEQ ID NO: 101714 - DNA, 669 bp, Heterodera glycines
  Promoter: Source sequence=SeqID_6815; Location=1..669; Strand=+; Gene= SeqID_62975
aaatatatatatatatatatatatatacatatatatatatatatataaataaataatttatatttgatttaattttaatcatttgacggggcggagtcgttatttaaaaaacatcacaaagggcgttatttaaaaaaccatcattatgaaaatttttgtcgaaaaattatttataattttgctccaaagcagccaatttttaattcttgatatcattcgatagccctaagtgttctctatcagtctgcaaaatttcaaaaaatttcttaaagtttcaaaaaagttatagctcgaggaactcaaaaaaccgtggttttcgaacatttttggccataacttattttaaagttaatagattttttttgaaattttgcaagctcataaagaacacttagttctatcgaatgatatcaaggattaaaaatttggttgttttagagcaaagttatacgcaaaaatttttattttgatggttttttaaataacgcgcataatgatggtttttaaataatgacatagcaccatttgcacagtcaatttgctcatttcgttgtcgctggcattcaattcgaaaagtccgtcactttgttcatctctccgctcatttttttgctgttcatcaaagacgaatcgtcacaagaacaatggcgaaatgttttccttggaatg

SEQ ID NO: 101715 - DNA, 104 bp, Heterodera glycines
  Promoter: Source sequence=SeqID_35143; Location=1330..1433; Strand=-; Gene=SeqID_64773
tgagagtgtgtgtggcataattgcctaattggcgcgctaattggcaccattttaaggctgaaaatgtccagcccagtgattctgattttgtttggcataaaatg

SEQ ID NO: 101716 - DNA, 611 bp, Heterodera glycines
  Promoter: Source sequence=SeqID_237; Location=1..611; Strand=+; Gene =SeqID_79390
acagtatctcttcttttatttactgtatcatttaaataatacaacaaaaataaataataataataaaaatcaaaataataaataacaaaataaataaaaataacaataataaaaataaaacgaagtgtaaagtacaacaatttcttttctcataatcctgtgttttctccgacattctctaatggtgtaacattggtgaccgatgacttttgtaactgtgtacactaatgcttactgtaatcagcggtcctttcccacgctaatgcatttcggatcgcaattgcttatgttattaacgcaaagctttctcaaacattaaacacactctcgaatattcttgtcacactttctcattcataagccgagtccatccaatcaaaggcatcattcatcatttaatttgtcaatagcctttcatctccttcattgactattgtgtcttcaattcaatgctcattgtttaattagtctttcactttcacaaattaatataatgtactcattcatcttctatttattctttatcatcattcagctattccaaatcccaaatcattcccaaatccattccaattgtcttttcctctcattgtttgttgcccacacctatg

SEQ ID NO: 101717 - DNA, 1003 bp, Heterodera glycines
  Promoter: Source sequence=SeqID_3807; Location=2839..3841; Strand=+; Gene=SeqID_51959
gtattttaaccggttttgaaaaaaatattctttatataacaatgatcagacattttctttatcaatatatcattttattttcttctaaaaatgggaattattttctatgatatttttttttattcaaaaatttttgttaaaaataataccaaaaaaaaccaaattatttattatgataattaataatttgtcgacaaacacactatttttgataaagtataaactttttatataaattaaaaaaaaatattattgaaaagtcacataattatacctcagcagcagaaaaatcatttgtgaaaacacacattataagaaagttcagaaaattttttgcacaataatattaatgaatataaataatatttaattaaattttgattcatttaattttctcatggcaatcatttcaattaataaaattattaataattgtaaatttttttacattttccttccgctgttttcttcataaaaaagacccaaatattttggcagttagtttagcataaataactaaaattataataaaattaatcataaaattttataaataatgaaattttatgttatatttcttcttttattattcataatgaatttactaataagtgaaaagaatgaaggaaaaataaggccaacctttgaagaaatatttggccaagaatgggaaaatgacaaaacaattgaaagcgaaattaatcaaaacttaaataatcaaaatgatttgaatttggctgattcaattcgtaatatcagaatgatgaattcagagatcaacaaaaatgcaaaattattcacaaatttcatgcaataaaagaaggaattaagaaacggggaaaatattcggcaaaattttagggttaaaaccgagcaaaaaattgcgaaaaaattgggaattaatcgaccaaaaatttacgaatggaaaaaagaatttgaaatttattattataaaaagaaaaaacaggaatttattgaacgaattgatgaatttaaaagaatg

SEQ ID NO: 101718 - DNA, 809 bp, Heterodera glycines
  Promoter: Source sequence=SeqID_6670; Location=4752..5560; Strand=-; Gene=SeqID_62427
taagaaaagagacagagaaggagagagagagagatagaaatttatacaattttattaaaatatttttcgtttcggacaattttatatattgattaatgaagcccgaaagaaatgatgggatttcctttccttatttacgtaaaaaaaatattaaaaccacaaaaaactatattttgtatgcaaaattaatttaaaaataaaaataaataattctcgctactcattcatttccttaaaaaaataaaacccaaaataatatttattatttttgtattacaaaattcatttgcttttgttgaagaaaatgaaattttatcatttaatttctgtgctattattatgcacaatcaatttaaatgacaaaacgttgactgttaatattttgtgtgaaaagaatgggaaaattcggccaaattttgatgaaatatttggcaaagaatgggaaaatgaaaattcggaaaattcaaattggcaaagggaacaaaatgcaaattattatcaaaataatcaaaatgaattaaattattcaattgccagtgatttgaatgaccacaaaaaacacgaaattgtccacaaatttcacgctataaaagaaggtattaataaaagaggaaaatattcggaaaaaaacagaaataaaattgaacaaaaaattggcgtaaaattgggaatttctcgaaagaatatttacatatggaaaaaagaatttggaatttatgaaaagaattttaatgaaaagaattattacgaaaagaaaaagcaggaatttattgaaagaattgatgaatttaaaagaatgtccaaaaatg

SEQ ID NO: 101719 - DNA, 51 bp, Heterodera glycines
  Promoter: Source sequence=SeqID_7641; Location=1100..1150; Strand=+; Gene=SeqID_65499
aggtaaatgagaaattttttttcaaacgactaattttcagctacacacatg

SEQ ID NO: 101720 - DNA, 670 bp, Heterodera glycines
  Promoter: Source sequence=SeqID_43985; Location=140..809; Strand=+; Gene=SeqID_71539
aatttaatcttttttcatttttaaattaaaaaaataaatatccctctaggttttcgtgaaattttttataatttgtgaaaattatcgcggtactaattactaatctccataatctttatcataaacatggccatcagctatacatttagaaatgcaatttccgattttaggcattttgaatttaatttcacagtttacgatttcggtgggcgtcaatggcatctcctaattgtgccctatgcattaaaaagtgccataactttttcacggttattcaatttgccattctcttaaattaaatgaaaattcattttgattgacattatcgtgagaaagacaaatttttgtcggttttgcgtttcttgccttgggaaattttcggtctcgagcagaatgtattattcatttttgggccttccgtttcagcggcaccattttttttttctaaattatgggaaaattttcttttttaattcattttcaatgcgatttctcagaaattctcatgctattttaaaaagctcttttccattcattcatttgacgaaatggcaaaatttgcaatcaagctttacgtttcataagcacaaagaatttaaaatgaaatttagagaaaataataattcattttaaaagcaccaaatatttctcttggatttaaaagataatg

SEQ ID NO: 101721 - DNA, 1003 bp, Heterodera glycines
  Promoter: Source sequence=SeqID_1529; Location=758..1760; Strand=+; Gene=SeqID_74263
tccgggtccgggcttatgattgaccgggccgcctagtaaaaaggcccatttgaccgcgcggggggaattttgggcaccgggaagtttgggcaccaaattgagaaattagaaaaataaaaatattttaattgtctataaattgcaaccatctaattaaaagcatagtaaattttaatcaagttaggaatcgaaagtttttgaatgaataatccgctcaattagccattcttaatttgctactcattaccattcattctatatcaatataataaatatgtattgtggtgtatcataacaaggctcggtctgttcaaaacttagttttatgagtttaaactagggttcggaccccgcccccgcccccgggggcgggacaggtttttggggctcacccccgtccccgcccccgtgactctgacccccgcatcccccgcccccgcgaccttcgcccccgcgggggcacgggggtgaaaaacacacccctaagaatggcatattcgtggaattaaaggcaaaaatttatacaatttagaattttttaaccatcttttacaaatttttatgaaataaagtaaatttgcttatattttttaaaatatttgtggtttagtggttagtgcttcaacattaacaaactttttgctaagaaatgttctggttttggggtagtaccttattttcatctaaaaaagggaaatttctaaaaaatttggctaatttctaacaaaattcatatagacttaaaaaattttccgcttgcggcgccaatcggcaccaccggacctctcccctcgcacattcaccaagtttttttgaagcgttccaaattttttttttttttttttttgacacgtagttgtccaataagtttgagatcaaaatggattcaatttcccgccgcagaccctccgtcattacccccccccccccaattaactccaaaaaacagcgaattgtgcagcaattggacaatgccgcctcagctatcgaacaattccacatg

SEQ ID NO: 101722 - DNA, 88 bp, Heterodera glycines
  Promoter: Source sequence=SeqID_10890; Location=2403..2490; Strand=-; Gene=SeqID_74172
ttcagtgtcatcaatgctttccccgcttttcaccatttcatcggtggaaaatgttgcgctcagcgacaaaaaattggtgagaacaatg

SEQ ID NO: 101723 - DNA, 89 bp, Heterodera glycines
  Promoter: Source sequence=SeqID_29617; Location=927..1015; Strand=-; Gene=SeqID_60088
tgttaaagcaacagttttgatgggttttttaagataaacaatcctgatgagcgcagctattgttattttatgccttacaagcaacaatg

SEQ ID NO: 101724 - DNA, 71 bp, Heterodera glycines
  Promoter: Source sequence=SeqID_31347; Location=40..110; Strand=+; Gene=SeqID_46256
ggtcatttcaaaagtgtagagaaccagcgaagcttgtgtgttcagatttgatggtgcgcattgaggaaatg

SEQ ID NO: 101725 - DNA, 74 bp, Heterodera glycines
  Promoter: Source sequence=SeqID_33; Location=1345..1418; Strand=-; Gene=SeqID_50796
ctgcgccgacatcccagcgtgatttctcgctattacattttagcaaattgtaattaacaatttgtacaaggatg

SEQ ID NO: 101726 - DNA, 224 bp, Heterodera glycines
  Promoter: Source sequence=SeqID_817; Location=1453..1676; Strand=-; Gene=SeqID_61942
aaaactcaattttaattataggaaatattctgaaaaaattactgcttgctaacttttgatgctgatcaaaaaagaaagagcactgaattgtctaccgaattgatttttgaatgttcggtctacgacttatacccgctgaggatgggcacttcaatttcggtgtctacaaaaagtactgtatttcttaaggaaatagtgcattttacagataaatgatcagcatg

SEQ ID NO: 101727 - DNA, 371 bp, Heterodera glycines
  Promoter: Source sequence=SeqID_42846; Location=1..371; Strand=+; Gene=SeqID_70655
ggtaattgtctaattgccaagcaatagtttagaaacagcttctaaacatgtaaaaaaaatgcatttcaattatatcttcttttaccccatatatttgaaattttcaattattaaactacatattaaaccaaaaatatgtgctgcttctatcccattagtgtactttgggccgttcaaaatatcaacaaattacgttttgttttcgatttcttccaaatattctgccgctacacaaatatttttcttcataatacaataaaaacaaaaaacaaatattttatgcaaaatttatttttgattcaatttaatttaaaattagggtcatgaattgattttatatctttattggcaaaaaaataatattgaaaatg

SEQ ID NO: 101728 - DNA, 479 bp, Heterodera glycines
  Promoter: Source sequence=SeqID_2146; Location=1022..1500; Strand=-; Gene=SeqID_78073
gcttaatttgcaaataaaaataattgccaagcaatttattggttttacacaaaaatatattttatattccattagatattgaataagacataaatggggctctcaaaaataatgcacaaaatatgtaccaaatttataacaatatgtaaaaatcacaaaatatgtaaataaaagtgccgatttttgttagtaaatacaaaaaagaaaatgattttcctattatttagagcataaagaagccatgaaaaattgtatttacattaaattgatagccccagcataactttaagatggcattttagcttatttttccgtaattctcttcacatttttgatcagtcacgagaccgtctcggccccacccattctcacattacggtattattgtatggtatcattgtattgccataatcagcaacagatcactcactactcacctgtaatgcgtcttcaaatgtctcaaattgggcataaaaatg

SEQ ID NO: 101729 - DNA, 97 bp, Heterodera glycines
  Promoter: Source sequence=SeqID_480; Location=1404..1500; Strand=+; Gene=SeqID_53917
agtaagacaacactcaaatttggtttgcgttatgtcgaaaatgtttttttagtctccttactcctcttcaccgccaccagttccgccatccatcatg

SEQ ID NO: 101730 - DNA, 422 bp, Heterodera glycines
  Promoter: Source sequence=SeqID_31519; Location=664..1085; Strand=-; Gene=SeqID_61842
ttgggagtgcattttgacacaatttcaaggcccaaaacagaaaatattgaaattcgagaggaaaacaaattggtaagaattatttgactatatttcacggtgatttgtgttctgtgacatgggtttgagttgtcacttttgctttagcaaatgaatcggagttcgctgtcccctcgtcaacagagtgctccgattgcaattccctccaattcgcattccatcgcgatggacccgatcgagtcccttggttcaaatcagttcagcacccccgacgacactttcggcagtttgggctcaacttgcgggggtcgttttgtaaatgtgaaacaggcaatttcatttttccctcatttttattggctttttcatttattaagtttctccagccaaattcatccaaaattgttagacccaaaacaatg

SEQ ID NO: 101731 - DNA, 144 bp, Heterodera glycines
  Promoter: Source sequence=SeqID_38430; Location=1..144; Strand=+; Gene=SeqID_67244
acttttagaaatcataaaagaaatacggaggaatttaaggtttaaaattaaattaatttatgattagggcgtgaatttatatggacaacaaatcgcgaaatatggacataaaattgcgaaaatctcaaatatggacataaaatg

SEQ ID NO: 101732 - DNA, 400 bp, Heterodera glycines
  Promoter: Source sequence=SeqID_11153; Location=1690..2089; Strand=-; Gene=SeqID_74505
gtttattcctctttttatcagtcagcaatgcttttcttctacatattaaacgattataaattaatttgggtaattacttaaatcaatcaaatgccaaagaaacaacaaatcaacttataaattattgcattattattagagctgggtttttatgttgttacactttttttacgcggcttagttatgtcaagagaagcccaaaaatagttttgacctaacaatttttgatttagtgcacttataaaaacataaaatacatattttggagtttggcacatattttggcattttgagaaaaactgtaagaaacacacaaaaaattgaaaaatacacccctaaaaatcaaaatttcttaccatttcttatagaattttcaaaatttcttaatttgtttcgaatg

SEQ ID NO: 101733 - DNA, 159 bp, Heterodera glycines
  Promoter: Source sequence=SeqID_4618; Location=972..1130; Strand=-; Gene=SeqID_55112
ggtgggtcggtgacgccaaatgcgttttgccatgggactaacccttccagcaggaatgactttttgggggtttaaagccttaattcccctcttatttcctaatacccccttttgttgttgtgattggccttcttcctcttcagcatttgcatgggcatg

SEQ ID NO: 101734 - DNA, 54 bp, Heterodera glycines
  Promoter: Source sequence=SeqID_23565; Location=1..54; Strand=+; Gene= SeqID_54254
tttatgaagatattccggacaaaatttttgaaggagaggcacattccgattatg

SEQ ID NO: 101735 - DNA, 368 bp, Heterodera glycines
  Promoter: Source sequence=SeqID_29760; Location=572..939; Strand=-; Gene=SeqID_60223
caacacttaaaataaaaatattaattaaatgataaaagaacacacaaatttaggcgttttgttgcaaattggtgcaccgccaataaagtgcacaagctattcatgaacgaacataacatgaatgaagtcgcacacacataatagtgatgattttttatggaaaacaattgatttttaatttattttgtctagtgataaatgtgcaaagaattttttaattagcaaagtataaataatatgtacaggtacgatcgatcagcgggccgtgttttaaaaaaatttttgttaatcataaaattattgcatttttttgttcgataaattttgaacttttaaaaccaacatattttaagaggtttataattatg

SEQ ID NO: 101736 - DNA, 760 bp, Heterodera glycines
  Promoter: Source sequence=SeqID_3248; Location=1..760; Strand=+; Gene= SeqID_83898
atgacattttctggtttttaatgagtttgtgactaattttagcttgttttaatcaatttaggaacaaaactgagaattttgaaaaatttgaattttcgactttttgttcgaattcgggtccgggattcaaaattgagcgaaatggataccagaatcttgatcaacgacaacccggaaacccctagaaacgtgtcttgaatgactttaaattttaaaaatttccaccaaaaaataggggcaaccatcttaactattaccaaaatctctaccgaagtgaatgtgcaaaaattaagtaacataataatattctattttcgccggtagagaattttgtgctctttctgataggcttactaatttttcaaagaaaacttttcgcaccctttatggttttttgaaatttttaaaatttaattgataaaattggcattatgtatataatattgttttgcttgtttttgcatgtcgctgacctcatctcactgttttgtgtttgaacttgcgaaaataatagaagtgttttgtgtttgttgtttgttagagttagtttcgctggaaaaggacaaaattataaatctgctgactttcataaaagcattaagtaatttgaaaaagctaaagttaaaaagtggcaaaaaataaattgtaggtttaataaaattggaaaacagtaaaagccaagtcgttcaacaattacatcttgagttctgcctgctgattctccacacttttgctaattgattcctttcgaatgatgatg

SEQ ID NO: 101737 - DNA, 685 bp, Heterodera glycines
  Promoter: Source sequence=SeqID_16528; Location=67..751; Strand=-; Gene=SeqID_80933
ggtcggatccctccgacctcatttgtccggtctctagtaaacagtattattttttttaaaataaatatattcattttttgttcatgtgattatttattatttttcgcttttattattttttataaaatattttaaagagcaaaagttaatgaaaacatttgtttatatatggtgagcattctttttttatcagtagcgaaatgagaaaatgagaataggctctctcaaatgcagcagaaaggaatttaacattatttaatttatataaattaaatgaataaaaaatgaggagaaaacaaaacaaaaaaagcaaaagcaggaaaaataaacgagtgataaattcaaatgatatcttaattagctggataagtaatatatatccgctgtccgattccgattcgctgatcatttcctccaatatttcatccttggcatgggtgttgaaatagtgacaatctcacacacagaccaatgagacaaatatgcaacatcagacagtttttgtatcaataagataaataacgaaaaaagttcgaaaaaatccttcccatcatgacatggctcaaaaatgccgtaattcccgtgccgaattccgatctcttccgcccctttcgcacattgaaattttctggcatttctgattaataatagtttttttttacttttcccattaacagcagtaatg

SEQ ID NO: 101738 - DNA, 942 bp, Heterodera glycines
  Promoter: Source sequence=SeqID_10223; Location=617..1558; Strand=+; Gene=SeqID_73369
ttgtccaaaaaaaaaagaaaccaaaaagggcattcgatacaaaaacgaaatacgaaagaaaaagaaaaatttgaaaaccgaaaactaaacaaaaaaaactttcgtggacgaaaatgaaacacgaaaacgaaattaacatgggccgaaaatgaaggccaaaacgaaaacgaaatgaaagggtccgagtctaggaaccacaaacattgttgacaagcataccatctccacactaccgtaaaatacatatataaataaatactgtataattgattaattatttggccttttgatctcgtcatcccaacttatttcatattttcttaaagattctctcgaaattacacaaaagacgctgtttttcaaataaaataaataacaataatttttcgatttcggtacaacaaaatgaattgacaatttttggcagttttttcggtgactttttcaccaaaaaaaataataaattcttctttaatatgagcattttctgattttttggttaaaattataggcatttttatccaaaaaagttttttttatttgtttttaattttgttaaatataggtttaccttttttctctttatttcatttcgttcttttcaatttacaatttattttaatttctttttttttacttataattttcgtatagtacaaaattatttttatgattaaataaatttattccattctgtttgtttggttgatgatttggctttcataaatgggatagcgatggcttttcacatttactgataatccgatagaaccatttaaaatggaattcgaatgaatcataatgggaatggagagaacaaattgggacagaattcgctcattattaaaattgacgatcaactacaattttaatcatttagcttcaattttgaaaattaaaataatctttccctaaattttgccaggaattgccctgaacatg

SEQ ID NO: 101739 - DNA, 833 bp, Heterodera glycines
  Promoter: Source sequence=SeqID_21690; Location=1..833; Strand=+; Gene=SeqID_52302
ccactatgtccttgcaaatcggcatacccgtccttggaaacggagcatggacgatgggagccctgcgatataccaatgtgcacttttgaacaaatacaaaagtaaattgttttaaaaaataaaaggccggatttaaaagcaattaaagacaattatctgctttcttttaagcaatagcgatcttttagcacataaaaaatttctggcttttgattcataaaaaatgcttggagttttggcagttttttttgcagatatttgcttttttaaaaataattcttttttccaaaataatagctttttggcactaaattcatgacaaattagcataaatgatcaaatttctctcaggctcctttgagcattgtagcatattattattaaaaataaatgtgtatgtgagtcagtccttatacttaattattattcttactattttccgacaaaagaaaatagttttaaccaaaaagcagcaaagttatttttgttagcaaattgtgttagcaaatttatttgaataattgttaattggatattatgtaaatattaaacagcgtttttttcatttttgaaacataatttagcttataatcgtttatcaaatttttattaaaaaattttttttttcgtgtaaattgattttcaattaaaatattttttttgttacctgtttttttcctacattcttaaaaatatttataaaaatataaaaccgaaacattaaatctattaaaaaatcagattgcgcgaaaccaatggccgttgtgcaaaatgcggcgacccgcactcttatttttgcgtaatttgctgtggctttttttcattcaacaatg

SEQ ID NO: 101740 - DNA, 133 bp, Heterodera glycines
  Promoter: Source sequence=SeqID_20335; Location=963..1095; Strand=+; Gene=SeqID_50851
aaatacataatatttatttttttattttaaacattattttaaaatataattatttttaataatattttaattaaaaaaggtgtcgccttatgaccaaaatttcgcaacattgccaaatggaagtttcacaatg

SEQ ID NO: 101741 - DNA, 338 bp, Heterodera glycines
  Promoter: Source sequence=SeqID_23745; Location=515..852; Strand=-; Gene=SeqID_54443
aaaaaaattctaacatttaaaattttgggactgggattttaaatttttataaaaataaaattgaaaaattttgcagttatgtaaaatcaaatttaatttttcaaatatttgaatgaattcaattaaaaatatgagtaaattcttataataggtaaatgtttgagtcaatgtttaatagatagcaaattgttttgcagtaagtgtaaaaagtttgttcaaatgtttgtaaattgtaagataaaatgtttggcacaaatgttttgcagtaattgtaaaatgtttgtctaatgttggcttgtaaattgtaagataaaatgttttgcagtaattgtaaaatg

SEQ ID NO: 101742 - DNA, 76 bp, Heterodera glycines
  Promoter: Source sequence=SeqID_15670; Location=1286..1361; Strand=-; Gene=SeqID_79976
agagcgaagagcagaagagtgaatacattgaggagtgctgggggaattgcaaattaaactcgacaaagaaaagatg

SEQ ID NO: 101743 - DNA, 191 bp, Heterodera glycines
  Promoter: Source sequence=SeqID_25062; Location=1427..1617; Strand=-; Gene=SeqID_55793
tttcttagggtttctgaaaaaattgatttttaaaattagaaatttatgataataacctaaaatgggaaaatataatctacttcaaatttttcagagctggtttgttaaacatgttaaaaaaattccaaaaaatgtcgtccaattaattcatattttaatcattttaattccccttcgtatctgaagccatg

SEQ ID NO: 101744 - DNA, 818 bp, Heterodera glycines
  Promoter: Source sequence=SeqID_29864; Location=1..818; Strand=+; Gene=SeqID_60332
tgttcgggtggaacccgagagacatttatttaatttgattattgtcatttatgtttatttgttgtgtctgaccttttacagacagacacattccttattgatattgtgaccatttgccctcccctcttttcattcattcagtttatgatatttgtgttcacattttccaattgtctcctccgccgtcctccgacatatttatttgttattttaatttgtcttcaataaatatttatttgttcgtccattcgacatttcggggaccgaacactccatttgctttgttttttttcttcagcttattatacccattgctggcaacgttttacttgcttaaaaaatcctattaattcttagtggattagtcagtatatgtaaaatgttttcgttttattagattttttcatgtattctttagataaataaaataacatttttttaccgtgtcaatttattgtattatttttttaataattaaaattttcataaaatcaaattattgattatttttgttatatcatttaaatagttgcactgagagtgtaatttttattatcgtccagatcttaattaagtcattcaattaaagaattatataagaatatttgttttcaacttatcccattaacggtgtgaagaaaatttaggaagaagtaaaaaatgtttgacatgacaaaaactaaaattttaattaaaaaaaggatcaaagaaaccaatgtatttaaattttttacattttttatataaatgaatgcaaatgcaatgaactacttagaaacaatctgttgtgactgaggcatagacaatttggccaaatg

SEQ ID NO: 101745 - DNA, 94 bp, Heterodera glycines
  Promoter: Source sequence=SeqID_40393; Location=1..94; Strand=+; Gene= SeqID_68745
aattggatgaggactacgacggcgcgccggtgaatcgcgaaatggcggctcgtaaggaacccattcatggcgctgccgccggtaatgagcaatg

SEQ ID NO: 101746 - DNA, 524 bp, Heterodera glycines
  Promoter: Source sequence=SeqID_42123; Location=391..914; Strand=-; Gene=SeqID_46694
aaaaaaaaaattttttttttgataagcgccggctgcaaaaaagtattgtgaccaataaaaccccccaattttatgaattgttttaacgaaaattccaagaatccagcaatcctgcatgggtcccgcaaattttaaatgcctattaatgctactgggtctcgtcccgcaaaaacattttggtactttcctgttttgaagggaaaaacaattttcaaaatatgtggactcctatttatgtgtttgttttgcgcgaggattgtaagcgaggtaacgtcgatgcatttgaggaaatttttggataaattgttgcttttatcttatataataaagttgagtgtttgtatctgacattgtttgaaagtgcctcaaaaaagtctattccgggttttgttcttttctttttttataatattttggcgttatgttttttcaaaaggaagtttacaaaaggatgagaatttaattattcttcccggttatttttagtaatccaatttttaaaattgtataagctttttaagatg

SEQ ID NO: 101747 - DNA, 513 bp, Heterodera glycines
  Promoter: Source sequence=SeqID_12114; Location=1..513; Strand=+; Gene=SeqID_75682
atcttgttgttaccaaaattttgattgaattctccaaaaaaaacttcatcaaaaaatgctataaaaacggaaaaataaattaagaatcgatataaaaatatttaaatttagcccatttcacctcacatttctattggtttctttctcaacagtggagaaaaattatttttgttacttcaaattacattaaaaataacttaaataaatagaatttattaattaagatgaacttaataacaaatggacgaacaaaaacaaaaacattgccgatagcgagaacaacagcaacgttaattaataaaatgatggcaaatttgattcatatcaacaagcacaaccaattaaattatggctaattggttgagtgaaataaatgttttaatattatttgtctaatttaataaaaatgaataaaacttttttttggtactatacgagaaaaatttttggcgcccctacaaagtgtccaagcctcgaaatgtccaagcctcgaaatgtacaagccacgaaatg

SEQ ID NO: 101748 - DNA, 574 bp, Heterodera glycines
  misc_feature (89)..(89): n is a, c, g, or t
  misc_feature (464)..(464): n is a, c, g, or t
  Promoter: Source sequence=SeqID_15330; Location=1..574; Strand=+; Gene=SeqID_79572
ttttgggacggaagggtccgaaatgcggattgctgattctttcaagcgccgcaatggggattgcgcgtaatcagaactcggttggtgcncagccctggtccgatccctaatgacaattactgtggatgagcttcacacattcaaaaagctaatattgcttaaattcatataaaaataaaaaagctaatatttcttaaaattcgtaaaaagcccattttctgcttacttatgcaaaatcgatgcttctctagatattctttgttttccatttaatagcgttgacagcaatggcaaaagatgtggtgatgtatttgaaacaaagaaatgaattttgcaaaaaataaaaagggcactcactaatgcccatgtttgggcatgacaataaaaatgtcatttaatatttggcatcatgcgaatgccacacgtaaccgagcgaatgtgggagggggggggggaggcgttgnccgtttgagcgtgtctctttaagcgaagaattagccaccaatccatcgaagacattcagaatttttcaatagcttcattattgcaaataaagctaaagaaaatcggaatg

SEQ ID NO: 101749 - DNA, 1003 bp, Heterodera glycines
  Promoter: Source sequence=SeqID_10514; Location=1150..2152; Strand=-; Gene=SeqID_73741
aaatagtagttaatttcttaaaaaatctctttttatccatttcgctagcacaatgctaatcaaaagtatttcaatgttttttggatacatttttttctcgctctctaagattgacatatttttcggaattttcttcatttcacaaaaaaaaaattcaatttttgcctttaaatgagaaaaaaatcatctaaaaggtcaaaaaaattaataaaataagaaaattgaaattacattttgccaaattccaaattttttgcataatgtaaattttcctattttctccccatctaattctaaaccctctattaaaataaaggtaattcgtaatgcttaaagcattaaatccggggacccatttcaagccattttgaggttttcagatcaccccgaaggagtgatctgatcacggtagaacaaaggacttttttgatcagcatgaaaagttaggcttaaatgaattttttagattttttcttaccctatagaaaaattacatgtcttcaagttttgagtttataattttggaacggaacataattgcactgactcatcaaaaatgctctgagattttttgatccaaacttatatccatttttaatttacaaatttttttcaatgatttccttacaataaatcctttcattaaaataatggtaatttgaaaggcttaaagccttaaactcggggacacaacaacaatcctgtttaaaattacatatacatttgctaattataagcaagtccagtgttatgataactaaaagcttgacaaattccttactgtagttgcgctttattttgttagatggttccaatcgcgcattgacctgcgaatgttgcggcgaagaaatggctgctctgtgtgcaaaattaagtgttccaattattaattattattacaattgtttttatttaataatgtaaaaattaatgtttaattaaaagaaaaaaaataaattaacgatttaaaaagtcttttctttagaaagagaccatggaaatg

SEQ ID NO: 101750 - DNA, 355 bp, Heterodera glycines
  Promoter: Source sequence=SeqID_44163; Location=665..1019; Strand=-; Gene=SeqID_71695
caacaaagatgctgttttgaacgaataaagatcataggttattttgaagaagtgtcaaagaacatgcagcaataagcctgcagaatctaataagtggaaaatacatgagtatagaatttattttcagaaagtgtcaacagacttttggaatatatatttgcaatttatcaacaattttgagaagtgagttagaaatgataatcttcacgattcaaaccaattttcgttgctctaattaaccgcgataaagacattcgaatcaattaaatagcttctgagataataaggtttatcataaaatttcatttaaaaataaaccctcaattattggtatgaacgatactttccaaacatg

SEQ ID NO: 101751 - DNA, 249 bp, Heterodera glycines
  Promoter: Source sequence=SeqID_29795; Location=1254..1502; Strand=-; Gene=SeqID_60256
attattatatttactaatatatgttatgcatgtaaaattactaagggtgttcttaagaatttgaaaaaagtccttgaaaatttttaaattttatttaaatttacgacattagtcagctgatttaaaaaagttaaaactcttaattttgggttcacaaaaaacatttctatcccatctgaacagggctggacataattcatcatattattaagacccccgtaattatggctgattcgtttgaaaataatg

SEQ ID NO: 101752 - DNA, 1003 bp, Heterodera glycines
  Promoter: Source sequence=SeqID_4912; Location=617..1619; Strand=-; Gene=SeqID_56176
tgttgtttttttttctttattcagtgtgaggctttttcaacatctgttgttgttaatttaataaatatgatttatgacaaaaatgacgcaaaaaaacaaaatgttgttcaattgcaaattcaaagtacaataaaagccttttatttaatataagtttgtttatatacatttacgtcaactttggaattcagcaagaaagaatttaaataaaatattgtgcttatttctgcaatttctaagaaaatagaggtcaattaattaattggtttctattacactttatgagcccaatcaactatcaactatgatttattgaaccaaaacttttctcatattcgaactcaccgtactttttggagtttgaaatcgcaaagtctaacaaagttaaaatatataaaatcacagtgtttaggcaactgattaaaaatttgccctaatttaaaaaaatacaaattctaaaaaagcatagaaatttggcgctagttaaaaagtgacttttttgaattttattaaaagtcgaagaagggtcgcgagtacgggaatgtcagggtcagggaaaatcaacaattaatttttatacccaaaaaataattaaatgtaaaaatgatccatctcatttttcgttaatgaatattttaagcaccaatcagagtatttattagctttacttttttttctcagcttggattaaaaatctttcactcatatcattttgctcaataacttaagccaaaaatggattaattatttatttgaaagagactatttaattgattgataggtcaaataattttgcctaattactttttgtctactaatgccaccaatataaaaggcgaacattttcagctcaaaacagcaaatattcattcatttatatgcaacctgaccaatttaatttgctttaaatttgcatatttttaatataaataaatcaatttcataaatttttttttaatatatattcgatagcagaatacattttctttaatttgaataaatg

SEQ ID NO: 101753 - DNA, 1003 bp, Heterodera glycines
  Promoter: Source sequence=SeqID_2307; Location=399..1401; Strand=+; Gene=SeqID_79007
attaacgagttttccgagcaaatattttcattttttttcttcaaattcaataaaatttttctattttatttttaaaatgcattaaatttttgaggaatttccaaaattttgaactttttgctattattttcaggaatttaaattaaaaaaaaatgaccttttaatgatgaatttcacctattgaagcattgagtttaaaaagtttcaattcatccattttgagaatttaaaatttaaaagattggtctgttatttcttttttcagctaattttctttttatgatttttttttgcccaaataaattaaaactaattaatgaacttcacgaactaagaaaataattgtatatttttaaattttactaatttttaaattttgtctcaattttatattttctattttgtgtttaaagatggcgaaataattgtgtgttttttcattccatctccctcataaaatcaaaataaattggtctctctctctctttggcggcagcaataaaaacaagaaatgatcaaaataaagtgattcaatttccccattaatgggacgatataaaagagtccccattttggaccgtaatgttgttcttcattttattttttcatgcaaaaaactatattaatcaaaacaaaatctttttcttttattaataaaaataaaattattttaatttataaatcattttaataatattttaattaaattttttagtcctaattttttcaaataaacattaaattaccatatttcctataatatagcctcctcccctgaaataaagcccccgttttgaggaggggggttgaaaaatagaccccgacccccaaggggctctatttcaacccttggggctctatttcaagaaactcagtacatttatctttattgtctgaaaatattatacattttttggaaatttaattcttttaaatttcattaattttcaagttcaaaatattttattaaaaaaataattgttcagccaaaagccctaaaatg

SEQ ID NO: 101754 - DNA, 858 bp, Heterodera glycines
  Promoter: Source sequence=SeqID_7601; Location=1005..1862; Strand=+; Gene=SeqID_65363
ataaaattgtaacacaatgttctatcgaaggaggcattttttcgtcagatcatttagcccaattttttatattaactgttccggaattaattcctaaatcaaaaacataaatattaggcgatttactccatcaaatgtgtcacttttcaatgtagttattgcctcaaggcttagagctttatcatgtggaataatcagagtaaatgaaaaatatgtatcttataacaatgcatagatatattgttatgagcagtgtattggaaaaattcagcaataattttattatttactgtatttaccgtaattattttgacaattatttcaattttatatttaaagttttcaccaatcggaagaggatacaaattaataagccgaaatttaattacaattattatttcttttttattaattaatgacaaaattttctcggcgagagggtcacataaatgtgacaaaaattcatatgaaatttctgatcagcaaacgccaaaatttaatgaatcacaaaatattattgttcataaaatcacaaataaaatgactaagatttttgcaaggaacattttgcaaataaaaattaaagatcagaatttaaaaaattattcaaggcttattagggcacattttaaatcatatgaactgactaaattatgtcgacatttgaacaagaaatgcttacggcacaagaaatgtgttcaaataaacaaaatgagaaataaattaaagaatatgaaacaaagatcaagaatatttatgtataaaagcaaaaataaaataaaatttaaacacattaaaaacaaaataattttaaaattaattttaaattcactattttcaattaagcttttcaaaatg

SEQ ID NO: 101755 - DNA, 96 bp, Heterodera glycines
  Promoter: Source sequence=SeqID_18651; Location=2418..2513; Strand=-; Gene=SeqID_83307
atcagtgcttttcaggttttttctagatttattcaaaatttgattctgaattaagtgtcgtaccacagcaatttttgtgtcaattttttagaaatg

SEQ ID NO: 101756 - DNA, 557 bp, Heterodera glycines
  Promoter: Source sequence=SeqID_3001; Location=1..557; Strand=+; Gene= SeqID_82708
actagaataaaatatactagagttgtccacccaccttaactttgtactacatattattaaattattagcacacttaaactggtacaaattgaaaattttgaacaatgcaattattatttttatggatttcctttttcttcaatgatgagaagcgtccatttataaagcagtgaatcccccgccaaaacagaggagaaaaggacggggcgggggtaccaatgggacggggacgacggcgaatgggacacattttgcagcagatttgggaccccggtttctgctgcttttggtgcagatggcgccgccaccgccattgccgggggcgatggaagtgtgtgtgccgaaaatgcggctaagcatgtgcccgccgccggaggggaagaaaatgctttttggggtgggcgctttgcggatgggcgaggggcattggaggggtgtggcgattggtagcgctctgttgcccccgcgggggttcaaaagagaacggtgacggggccggggagggcgggggggggggcggagggggggggggtggactggatggcgaagaagacatg

SEQ ID NO: 101757 - DNA, 193 bp, Heterodera glycines
  misc_feature (127)..(127): n is a, c, g, or t
  misc_feature (142)..(142): n is a, c, g, or t
  Promoter: Source sequence=SeqID_32801; Location=792..984; Strand=-; Gene=SeqID_63041
cctaaaatgacaaaatttgccatttggcgttaaccgccacaaattcctattttttcgctttggcgctgaaattgaaaaaatacactgggcatggacctgctcccatcctttttatgtttcttttttntcattttatttgttnaatattaatataagtgattaacacacatctccttcccgtttgttcagaatg

SEQ ID NO: 101758 - DNA, 643 bp, Heterodera glycines
  Promoter: Source sequence=SeqID_9073; Location=1344..1986; Strand=+; Gene=SeqID_70160
ttccttaatattctagagcattttaatttcttcaaatttttgcccaaatccatttatgaataatttaatgcaataaaatattttaattgattctttttatcattttatttgttttttatgtggcaaatccaataaactttttttttattaaagccattttccaatttaaattaaaaaaaagaaattaaatgagaatgaaagcatataaaagcttggagaattgtgaatgtgttcatattttataaatttgaaaccgaaaatgaatggttattattgttttcacattttcacgttttttgcgcttattttctccactcaaatggtaattcaaaattaattaatatataaacacaattattattttaaacatttggaggtcaatgctcagcagaaagaaaacggtttgaaaataaataattaataatcatatacataggaattaaaaaactattatcattaaaaacgaagtaaaatttataattttaacaaaaaacaatttaaaaagcgaaaaattcatttttttctatttaaatttaccagttttttaaaagggtaaaccgaaaatatcgataattttccattttttccgaaaattttctcgatctaaaatattcatttttagtttctcaacccgtgacagatg

SEQ ID NO: 101759 - DNA, 111 bp, Heterodera glycines
  Promoter: Source sequence=SeqID_3371; Location=3346..3456; Strand=-; Gene=SeqID_84418
gccatattttcgtcaattcgtttttattttaccaattttgtttagacatttctccgtgccaccacttctgtctgttacaatattcaactttttttttgtgtggacacaatg

SEQ ID NO: 101760 - DNA, 1003 bp, Heterodera glycines
  Promoter: Source sequence=SeqID_660; Location=504..1506; Strand=-; Gene=SeqID_58386
tagtccaaaatgattaattgtttgaaataactgaagtaaattcgtttaaaaatttcattaatttaatttagctttaacttttagattttataaaataaatagcaaaataaaaattaattttgtgttattttcacttgaaataaattaaaatttgattttttttttgaatttaaaaattcccggaaaaccaaggtcccgtcccggcttctcaggtcccggtcccggttttgcccaacattcccggtccgctcaactctacggtagtaccataaaaataaagtttccaacgcaattaattctctgcaatttgtgttatgtgccaaaaaacccccaaaatatgtgctaaaacccaaaaaaaaggccaaaatatgtgccaaaaattgaaaaaaactgctcaaaaaataagttaatttctcaaaaaagtctcattttttatcaatttcgctagcttaatgtaatgctttttggcgtaaattttttttcgctctcaaagatttactcatttttcggaatttcttcgctaaaaatcaaattttgctttaaaagtgaaaaagtcatgaaaagggtcaaaaaaatacaaaaaaaagaaaattttgaaaaattattgggcatttatttgaccacgaatttgagtgccaaaaaagacatttttgtaaaaaaaacctaatttttccaaaaaatcgccaaaatatgtgtcaaaaactgccgaaaccccaaaatatgtttttattcctaaaaagtccaaaatatgttttttatatgtgctaaaaactcgctctgattgaaaggaaaacaggtaaaaatgctatttttgagattttcatgcgatagcatatgcgcaaaaaaaaagtaaaaacatataaatccgttccctgataatatacgtcaagaaataggaaaaccctaaaaatccaagctttacccaactcaattaattcttctgctatatattgtgtgacatcattcagaatttggccaaattgtgctaattgcctcaaaaatg

SEQ ID NO: 101761 - DNA, 77 bp, Heterodera glycines
  Promoter: Source sequence=SeqID_24000; Location=1049..1125; Strand=-; Gene=SeqID_54704
aaaaaaatactcatgaaattcaaaaaattaaattatacgaatttgtactaaattggatatttttttttgaaaaaatg

SEQ ID NO: 101762 - DNA, 86 bp, Heterodera glycines
  misc_feature (17)..(17): n is a, c, g, or t
  Promoter: Source sequence=SeqID_30179; Location=1..86; Strand=+; Gene= SeqID_60616
aggtagatggggtcganctcgttgaagtggttgaactactcggagttgatgaggttgaagttgacgctgtcgaacttgtagaaatg

SEQ ID NO: 101763 - DNA, 51 bp, Heterodera glycines
  Promoter: Source sequence=SeqID_7422; Location=2309..2359; Strand=-; Gene=SeqID_46415
taaacgtgtcaatttccggtgtcgaatctatgatttctggtatttactatg

SEQ ID NO: 101764 - DNA, 161 bp, Heterodera glycines
  misc_feature (42)..(42): n is a, c, g, or t
  Promoter: Source sequence=SeqID_12699; Location=1..161; Strand=+; Gene=SeqID_76380
tttttgcactggattagttccctattctgttaaggacatcanaattagtcttatattaaaacgcttaaaattttagtttaaacgattaacttcaacaaaatcctctcatctaaatttagcattttttccaacgctgatcgatttgaagtgaaaaccgaatg

SEQ ID NO: 101765 - DNA, 1003 bp, Heterodera glycines
  Promoter: Source sequence=SeqID_23118; Location=705..1707; Strand=-; Gene=SeqID_53825
tgccgcggtcgtggatcgcggtcgcgctccactcctgacctctactaaccacctctaggccattataacaacaaaagaaatgctttttcctaaatttaagctcattgtcagaccaagtcttagaaatgtgtgttattttcaatctatagttcccattcggatttaaaagtcaagatcgagattggagttttgaaaaccggtgtcgaaatcgagatctgcttccgaaaaagtcgggattccgaccaaaaatcagtcgggatctcaatgccgtgcaactccactaaaaatcaaccgtaaaaaataacagcataactgtttgagtgaaaaaaattattttaaaaaataagataatgttcccgggttattttaattttttttccaatttgctattaaaaaaataattattttgctgctcgtggctgtgcaaagaaagaactgggaaaacactaataagcccaaccttatcaccagacaatgaaaggaagaaataatttaattcacattttaatttaaattgtattttataatataattttaattttataatattattcgcttatttccttcataaccattctacgattaacaatttaaaaatctttgttaattaattgtattcccttttaattttcgtttgttttttagctcccttactaaataatttttcttaaaaacatggcaattaattgtgctcctctcacccgttttccctatgacataatgatgtttttcataagacatttaataaatcataactaattggactaaagaacaagtttaatttgtgtcaaatcattccatataaatgcattatttgtcgtcattattttattctgcacattttattcttttgaatgtcgctatttaaataatccatttcaatttaaactttaatagctaattaatttatttttaatgtttcagttaaaatgagcaacatcccttttttataaaaaaaaataataaattcaataaattaacaaattttagtgccccgaaaatg

SEQ ID NO: 101766 - DNA, 497 bp, Heterodera glycines
  Promoter: Source sequence=SeqID_5662; Location=476..972; Strand=+; Gene=SeqID_58826
tttggcattctatgtgcctgcaaatttgaataatttgcgcaatttcgtttcgcctacaattctcactgatctcccgcagctgaactcgatcagttccttcgtctgttccccgctccaattgcttttgatggtaggaatgcaactgctggcgaggctttatccaaatggttgcacacgccgaccaccgatggacagccgaagcatttgcgttgccgattttcaagcacttatgcatcaaagggcaaagaattggtcaacaagttcaaggaggtcgtcaaatcatttttaatttcgggggaggaaggggaaggagttcgaccgcgattttcgacatttttttccgcgtttcacgaccgcggcaatttgaatccgcaaacgcgggattcatcgatattttaatttcaaatttttatatgtattaggcattccatcgtgcctccaccaccacttcggcctgctacaatattgaaattttgttggacgcggcctcgtcaatg

SEQ ID NO: 101767 - DNA, 361 bp, Heterodera glycines
  Promoter: Source sequence=SeqID_13818; Location=113..473; Strand=-; Gene=SeqID_77753
tgatattaccaaaacagtaccattcattggatgacaaatttggcacatataattgtgactaaaatgattatttgttcataaatatgtataacattttttgccatttacaataaaaacgaattatttcgaattatttgacatgaataaatatggataacttaaaaggtttttttatttattgataaaaatggaatgatgtcaaacacaacttggaacttttcgtaggttcgagttgttcggatatctgtattagtgttggggcggccaaaagaaaatttcggtggaattcgggactataaaaattgttcggtttcgggttaggacggccaaaaaattcaattaggattcgggacaaaaaatg

SEQ ID NO: 101768 - DNA, 87 bp, Heterodera glycines
  Promoter: Source sequence=SeqID_32905; Location=1..87; Strand=+; Gene= SeqID_63129
ctctcgaacatgaaacgaagtgcggtgcgccatggccattttatttttcaaataatttttatatttaatagatattccagaaaaatg

SEQ ID NO: 101769 - DNA, 70 bp, Heterodera glycines
  Promoter: Source sequence=SeqID_6271; Location=1..70; Strand=+; Gene =SeqID_60974
cattccaattacttggactcaacccaccaccattctaatcactgggactcaattcatcagcattgcaatg

SEQ ID NO: 101770 - DNA, 227 bp, Heterodera glycines
  Promoter: Source sequence=SeqID_1270; Location=1..227; Strand=+; Gene= SeqID_71092
atggtcattattcggcggtaggcccttcgccttgatcatttccacacagcgtgccctcctcctcttctgccgtgtgcggtgccggtggtgaactccaacaacaacttttaatttccgccgcacctccccttccttcggcgtccaaaacgctctcagccgagtcgctgtcttccccaacaaaacgcggtggtcgttcgagggcggttgggtcgacaaggacaaaaatg

SEQ ID NO: 101771 - DNA, 936 bp, Heterodera glycines
  Promoter: Source sequence=SeqID_3116; Location=362..1297; Strand=+; Gene=SeqID_83278
tttgggcagcacgacaaattgttttgggtctgattggtgctgagctaaaaaagccataaaagggcgctataaaaaaaagctagagtgtagcgggaccgggacctggacagtagttacccccccagattttgggggtgacaattcagtcccgtcgtttcagtcccaggcaattcagtcccgtagttttagtcccaggcaagtcagtgccagaccaattaagtccgacccatgcctattagagttttttttctgttttgcatgactgagctagtagtacatcaaaatgttacgcttgactgatttcataacaattagctcctgcctattattaaatttacacatgtgtatttgtagtaattatctctcgtacattatgcatgaccaattttatgaaaattattcaaaatgttatgcttcggtgatttcatagtaattatttatgttacaattgctctcaaattccattttttacagtgacctattttgctctggttaccgtcatcaaaataattattgctgccctctattgagagtataaatagacgacattcccaaccaaaagtccatttctcccattcattcaaaaaaaaaaattttcaatcccactccactttacattattctctgaaaacaaaaataaatttgagtatttaaatacaaaataattccattacttttacaattctatcattaaaaataaataaatataaataaaaatgaaacgaacttctgacgaccaagttccttcattccctaaaaagacccaatcaaataaatgcattagaaaaattgacaattttacatcaaagagccgaaaacaccaacttttccgctccaaatctaaatttgtcgtcgaggaaattgagacatgtgctgaccctacggcggaactccgttcttgtatacaccattcaattgaagaagcagtcttagatg

SEQ ID NO: 101772 - DNA, 145 bp, Heterodera glycines
  Promoter: Source sequence=SeqID_19713; Location=1..145; Strand=+; Gene=SeqID_84458
gttataagcattaggaatctgtgaattcttgataatttataattgtttgcttttatagggattggagcgcaagcccaacaattcatgggggaacacaatggaggtcagggttttccggataagctcattttgtttacttaacatg

SEQ ID NO: 101773 - DNA, 952 bp, Heterodera glycines
  Promoter: Source sequence=SeqID_3697; Location=4386..5337; Strand=+; Gene=SeqID_51508
gaaccggaataaaggccctaaaatgcttcagaatacggttagccaaattttggattttatttttaaaattttcaatgatctcctcattagaatgcctatgatttcaatcagtttttattatcccaatttacatagagcggataagcggcggtcttttcatcgtgtgtcatcttaatgaaattcattaatcaaatttcctaattaaaaaaaaattacttcctgggcccacagaaactcatggtctgcagcgtaacatttgtggactttagttccattggcggaaacaggtgaaaacaggtgaaaataggtgaaatttcacctaaaaatatataggggcgtgtatttaatggggcatattagagaatgtctcaactagtatcaataaaaagtgccaaaggaaaattttgtgatggttatcgctattacaaacataaaacgaccaagttcaaactttggtggaaatgtgaacttaattcacatgggtgccagggctggggttttgaaaaggaagggttttttacaatgacgcgccgacacaatcatcatcctgacactatattgattgaaatcgaagaggacataaaatatcataatttttctgcgggggcaaaatgttttttgggtgacaacaagaattagttgatgatgctaagaaaaatgcgagactccaaactgaatttggagatgaatttattgtttgtaaactataaataggatcaagaaaaaaaataccaattaaataaaaatgaattctgaaaaatcagaaaaagctaattccatattattggaagctgcaaaaaaagagacagaaagagcatgacgggatgtagctgcgctaacggatgaagtaagcgattttgccaaatcttctcgcgaaacacttaatcgtgcaataaaatctagagaaaaggctccttacgctaatagtattcgagaattatatcttaaaatg

SEQ ID NO: 101774 - DNA, 252 bp, Heterodera glycines
  Promoter: Source sequence=SeqID_906; Location=2819..3070; Strand=-; Gene=SeqID_63691
tttagagttcaataatattttcacgtttcataaaagaaatagttataaagtgcgggcggacggcaataacaagagaaatgggcggctggcaataacaagagaggcggacggctggcaataacaagagaggcggacggctggcaaaaagaggaaaatagcgggaaatgaaaagaaaaacaccgtttttatgtagaatttttacgattttatttgaatattttttaccaacccacttataaatattatagaatg

SEQ ID NO: 101775 - DNA, 108 bp, Heterodera glycines
  Promoter: Source sequence=SeqID_20800; Location=292..399; Strand=+; Gene=SeqID_51379
ggtcaaccccaaaattttgcttattgatacagacatttttaggcgccagatgtctgttggaacgcgcccttcaaagaagcgattcggaagctgtacaacgattggatg

SEQ ID NO: 101776 - DNA, 385 bp, Heterodera glycines
  Promoter: Source sequence=SeqID_27350; Location=213..597; Strand=+; Gene=SeqID_58043
tgtattattttccctcacttttctccgccactattttaatgttaataaataaaaattaagaataatttactttatttaaaataaattttaagaaatatattcgattaaaggtaagattgatttagtcagtgataatatgatattttatacaaaattaattttaattattttataaattaaatgataaaatcaccggaaactgattcaaaattgactccaaataataaaatatttgaaaatagcacgccacaaaaaaaagaactatgaagagcaaaaaaattctggatatattttttaaataaattttcaaagtaaaaaatatttattaaaattatatttttttttgcctaagttctaagaatttaggtcttttttgaggaaaatg

SEQ ID NO: 101777 - DNA, 828 bp, Heterodera glycines
  Promoter: Source sequence=SeqID_3596; Location=2420..3247; Strand=-; Gene=SeqID_45584
ttttttcaataaatcctctattaaacggccccctctattaaagcggccatttgggctctaatgaccgaaaatttttcaaaaaaaatcacatttttgggtatattttctggtaaaaaagtaactttttaaaaaattggaactttatgccaaaaatagtcagaaaaatagaaaattctccattttttgcgcaattttcttcaaaataaataaatattacttttttggttccaaaataatcattcatactatttttagctattttcgggatttttatgcttacatttaacaaacttgaagaaatttgaaaatttgccctcaatttggaaaaatttatgtgcatatttttctttttatgtgcatatttcgcgatttttggtgcatattttatgcgcatattttgcgattttatgtacatatttttggactccctattcattattattaaaataaatttaaaaaaaaaattcgagcaaaaaaaagtgcaaaaaaaaaaaattcaaaaaggccctctttttaaatagcgccaaaaattttactcctgcaaaattatatcaaaaaatacaactttctgacgctcaatttcaagaatggttaacttctctgcatctccttcatgcaaagcgaacttgtgtctgtggctcagaaatgcggtggcataaactttggaaggcgaataattaaaaaaaaaaaatttgggagcgtataaactggaagcttcggggtgtataaactggaaaagtgccctaaatcctaccttttggcagtttttagctcctaaaaaaactaaccctactcatcgctcacttttgttttgattcgctaacaatg

SEQ ID NO: 101778 - DNA, 1003 bp, Heterodera glycines
  Promoter: Source sequence=SeqID_14056; Location=82..1084; Strand=+; Gene=SeqID_78028
ttgaaaaattatgtaaaagatcaaaaaaattatggccagaacaactcaaaaaaaaacagattttccaacttttatggccataaatttgttcaaaattgacgaatttttttggaaatttgcaggctaatatgtagagcatctgaagggatttcgaatgataccaaaatgtttgatttggatgacaaagaaaaaagttatagtccaaaaacatgctggggcccaactgacgtagaccgtctccgagacaaagacgagtccttcggaattttgcaaaaccttaataatttcgtatgaaaatagttagcaaagcacattttcacgaataattttcaattttaagcgacaattacataaaatttctctgagatttttaagcatccataattcagctttttaaactttaatttcaattaattcaattttattttattttattcatattttaataaaacaaatgccatgaaaagttcttacactttttaccttattcatctgttgctcaattttccactaattcactgattttttgtttccatacaatttaattaacgcattaattgcccattaatactaatggcaatttcattgatcagagacgcggctttacccatgcgattagccaatttgcgcaactcttttgctgatcactcaatttgttttcatgttccattggttttccgctgctgaagcgaaagggatgatttgatctgccgctgtttctgctgggctttttcatccccaattgtttttctcgtctctccgtcattctcgaccactccaaaaagtaattaatgcccaccattaataaattaataattgtgctcttgtttttggctgaaggaattgccaaactttggaatgggtggcactttttgcaggacccacgcgggcattgctcatttgatcacgaagttggcattatcagccgaaactgaaaattggtgccctcaaatgtctttagacacggaaaattcgctgcaaaagagtcggcttccccatgatg

SEQ ID NO: 101779 - DNA, 138 bp, Heterodera glycines
  Promoter: Source sequence=SeqID_43577; Location=1..138; Strand=+; Gene=SeqID_71218
ccccccctcataacgaaatttctatgtctaacgttgttttctaattcaatttttatccaaacatttagtgccaatcaccttccaattttgcttctcattcttttcaaatcttccggttctaaatactgacaataaatg

SEQ ID NO: 101780 - DNA, 1003 bp, Heterodera glycines
  Promoter: Source sequence=SeqID_18651; Location=289..1291; Strand=-; Gene=SeqID_83308
cccatgactatcagtgcaacggcacgccgccacaaatttggcggactgagcaaacaaaagaaaccgagggaataatgagaagaagcgagcagcaaatcttagcctcaaaagtcagacctactcaaaactctgaacgtaaaatttttttgcatttgtctaataatttttgaaaaaaatctttaataattatgttttaaaatgttttctttaatattaatttcatgattctttctcaattttaaagttctcttcatttgcgcagactaataggcttaattgtcccccgccggagatcggcactgaaagaagcgaatttgagtaaccgttcaattattatccttcgctttttgccgtttctcggctcggcttctccaccgataatccgtccctccgtctgctaatgtttgtctgtccctcaaatgctttatcccctcccctttcacgccttcgcttttccgttatagcgcagtgaatgaattcttaacacttttaagtgcattttattttattttttctaaatttgctatgcttttatccttgtataattttctattcgttttgcccccgtccccaatgattttgggccataaaatttgagttagggccaaaagtagtggcccattattacccatcgttttttgggttttttcttccattttgttatataaataaaatattttttaatttaatattacttaaaaaataattcatgcacatatttcaggacctttttgctgcactcacttaattcattttgatttttttctaaaaagcaaaaaatgattggcgtgatcggtgctgatgttgtggttattgttgtgtggttgtgtgatttaatgacgtccgccaatcgggattaggacggaagtttcaatttgttctcgaattgtccctcccaaaatatgcaaaacatttaattccaaaaaatggcagcacataaataaattccgcaaacttttgaaggttcatttggaaatataaataaataaaaaagcactctatg

SEQ ID NO: 101781 - DNA, 144 bp, Heterodera glycines
  Promoter: Source sequence=SeqID_6580; Location=332..475; Strand=-; Gene=SeqID_62073
ctgctgacaaagtgtcccctccttccgctaacactttgtcttcttcgtccgtcccttctcttctgaattgccaattttgcggtgctcagttggcggatgtccaagctctccaagtcagtcgatcaatgattaaatttccaaatg

SEQ ID NO: 101782 - DNA, 1003 bp, Heterodera glycines
  Promoter: Source sequence=SeqID_583; Location=5249..6251; Strand=-; Gene=SeqID_56755
caaaattcaaacgaattctcatctgaaatattaataaatcacatttaactgtttaataaacatttgtaccattgtggcaaaattgcagtgtcgtttgttgcgtaaaaattcaaaaaatcgattaatgaccgcaataccagttggtggccgtttgcttcctaatttttcaataaaaatttaaaagtcagaattcgagaacctggtttgcatgaaatgccgccaaacaaatgcatcattggtacaaaatcgatcatttcccaaattaactctgtcggcagttgtttatgcaatttggctttttttgccagtgaaatgttgttgttgccttggcttctcttgcctgccattttggcaaatcagtattatttgggaatcgcaaaatgaaatgagtacagctcatgttagggtatcgcatggatgctgtagtgcaagcacccggcgacctccatacgatttggcactaattgagtttcaattgggcgtggtctaagccatttcgatggcctttcgtgcagccggtcattcattttaaaaatttgcttcgctcattctcgctcatctgcccctcctccctccttccattgtcccttaatttgaataatcggggtcataaaatcttgaataaagctagggatcatctcattaaaaggcttttttcggggacaatcttattcgaatttatttctaatgttaaccagggcggttgatgtcaaagctccgtttatcctgtcaacaaacttttagctcttcaatggtcgttgaaaattcttttaataattttatgagtagtttagttgccctgtcgtcttgtgcttcatgggtggcagtgcgctgctcgtcaggccaagattggtttaaaacatcagtttttttaaattattctcattctattcttactcattgctcacaattttgattttttatcacaatttttgaaagctcagatttatttgaaatttaaataacatttattcattgatttaattcattagatttaaaaatg

SEQ ID NO: 101783 - DNA, 423 bp, Heterodera glycines
  Promoter: Source sequence=SeqID_24326; Location=1239..1661; Strand=-; Gene=SeqID_55050
aaactgaaaactcagaaatgccattttttggcattatacctttaaacaagcgtaggctttagaatggcatttcctgcaaatttaaggggggggggggcatttgcctgctcaattgccttattttgttggcaaattgattgcccaaattggctcgtaatcttatattttccaaacctcatttttcataggcatttaataaaaaataaaatatattattgtcctatcacagagagagagagtcattttaaaaaagaatttctgatttttttgcttataaatttaatgataggaaattttgatttccttacatgtaaaaactcttgaatgaattttattcatgcgtttttcactaagtcaaaaaagtgaacagtattcgatttcaaaaccctataaaatattcctcaaaaattgtttacagatatg

SEQ ID NO: 101784 - DNA, 269 bp, Heterodera glycines
  misc_feature (33)..(33): n is a, c, g, or t
  Promoter: Source sequence=SeqID_8153; Location=1169..1437; Strand=-; Gene=SeqID_46554
atcaggtgcaggggctgcactttaccccctccnccccccccccccgagagattattttaaaatctatcaaacttaaaatttcatagaaaatttgttaaattttttcaatatttaagccaaaagccctaattttttaaacatttaaaaaccaaaatttcgaaaattttagagttttcttgctttttaataattctacgaaattttctgcgtttttttaaatttttattttggtataattcacggcatgaacgacctgctccaaagtgatg

SEQ ID NO: 101785 - DNA, 147 bp, Heterodera glycines
  Promoter: Source sequence=SeqID_5842; Location=1..147; Strand=+; Gene= SeqID_59421
caaagggaagggattaagcaaaaacaattaattaatcgattaaccatcaaaagacgtttatttgaacattgcttttaattgtgtttatttatccttttcagatcagcatcaatgcccccggggttggcccgcggcgggtgatcaatg

SEQ ID NO: 101786 - DNA, 99 bp, Heterodera glycines
  Promoter: Source sequence=SeqID_2573; Location=3681..3779; Strand=-; Gene=SeqID_80483
ttcattaattctttttctctcaattaatgcgtaatgggattaccaattttttagcaaaataaaatcaaaatcttattacgaaccgaacgactacgaatg

SEQ ID NO: 101787 - DNA, 248 bp, Heterodera glycines
  Promoter: Source sequence=SeqID_21018; Location=1080..1327; Strand=+; Gene=SeqID_51597
taaatttcctcaaaacaaagggaaacacatcgctagaaaaagcgcatgtgcatatcaacataattagcactagcacggtatgtatttgattaattaacaaatgggtggagattccgcaccacatccgaaatgaaattccttaggaaatgggttatttttaaatttaactaagtcccagtcccggttgtgcccaaaatttccggtcccgacctaccctaattttaacgcattttaatttaagaaaaatg

SEQ ID NO: 101788 - DNA, 66 bp, Heterodera glycines
  Promoter: Source sequence=SeqID_3511; Location=596..661; Strand=+; Gene=SeqID_84976
ggtgccatatgcagaaattcctccgttttggcaccaaaaaagaacaaactcatcaaaaacgccatg

SEQ ID NO: 101789 - DNA, 487 bp, Heterodera glycines
  Promoter: Source sequence=SeqID_11682; Location=1445..1931; Strand=-; Gene=SeqID_75156
ttttcggccaaaatccgcgagtcgcaaatgtccatcctacgacccctctctggactttgttcgtatcgaaaagggtcgacccgattttctactgtttatctattatccttcgtcttacacttgatttactaatggcgggggtggggggggggacaaccggtacatataaaacgagcgaggaatggaaattgaatgaaatttgaataattttcaacaaatttttagtttattttcataaatttggcatcagtggtctcaaaactgtgtgctaattttttctttaaaatgaataaaaccttgcaatttatggtgtttaagacaaattctgttggcatatttacattattaaatttcgcgtttcattatgcagcatcgccagaaaaaactccactcccaccccattttaggcctggaggctacgcataaaaaaaattaaaaaatttatttttttacgcttttcttttcagttgtgcaatttttgtccatg

SEQ ID NO: 101790 - DNA, 804 bp, Heterodera glycines
  misc_feature (18)..(18): n is a, c, g, or t
  misc_feature (28)..(28): n is a, c, g, or t
  misc_feature (39)..(39): n is a, c, g, or t
  misc_feature (198)..(198): n is a, c, g, or t
  Promoter: Source sequence=SeqID_19222; Location=1..804; Strand=+; Gene=SeqID_47572
ttttcgtcaaaatcattnaatttattgnaatgtatcatntaatgtaagtagcacagttaatccgaggctagacaatgagtgtttttaataaagaagttctaggaaatcacacattttgatacctattgaattcaacaaactaatgacattttttcatctatttgttaaagaaagtaatatttaattatgttttaaatntaataaaattctagccaccatgatatatgaacatattgaaaaaagtcaatttattacgtacaccgcctaacaatttttttttattaattagttttatggccgcacaaatttaatttcttcgaaaagacaccaatttattaatgttaaatgtttgaaagaaatattgtttatttaattgatctttaaataaatacggtaaatcattttctttgttattatgataaacatgaatttgattaaataaaatatcataaaaccaaattataagagtaagaaagttcatattgttaaaaaattaatcttgtttgaccaaccaacataaaaataaaatttaattagttgagattttgggtataaaaaagatgggaaattcatttaaaatttaatttgactgctctatcctaaagcattaatttttaaaaacttttttaagaaaataacgaatgaaatttgatgcgattttatcccatattaaaacaaaaatcgcaaaaaattaattgatcccaagtgattttttctcacaaatgattataagcaattaggaattttcttttttaattttcgcttaatttatatttttttcaatttcaaaaattttcaagcatg

SEQ ID NO: 101791 - DNA, 172 bp, Heterodera glycines
  misc_feature (15)..(15): n is a, c, g, or t
  misc_feature (38)..(38): n is a, c, g, or t
  Promoter: Source sequence=SeqID_40131; Location=731..902; Strand=-; Gene=SeqID_68554
tttttattgacacanaatttgaatttttttcattattntaattaataattaattaatggtccccgattttatcgccttctttaaaaaagtccagtcataataatatccattttaattaattaattcatgcattaattaattatccctgattttagcgcactcattaaaaatg

SEQ ID NO: 101792 - DNA, 1003 bp, Heterodera glycines
  Promoter: Source sequence=SeqID_6893; Location=774..1776; Strand=+; Gene=SeqID_63223
ttcttctatttaattcaataaaaatttcgaattaaaaaggaaaaaattttttgcattaatcaggtaggaatttatatttgtaagaaatccactgttgtagaattttaattataatgactcattagtgttaattaaatttggcataatgtcttttttcgcgtttttctcacttaaaattgtattctttgtttttttccatctttcattccaatttttattatctggtaatttttattgttttgtgccgtccaattcttctgactttaaaattgatatttgtcaaattgtttctcatcggtatttgtcttttggaattaaagtgtttggatttgacagtggcctactctgtgtttggtataattgcgtccctgtcttaagtcagtagcaaaagtacaatttggcgctcccgaggaaacaggtacaaaagcggcgatttttaaagagtttgagggtgagatcgggaataaaaaaatttttcggacgggttttaatttggagtgtattaagtatcagtccggaccggacgatatttaagttgtgaagtggaaattgactattccggatcggaaagttaaaaaaagcgaaaaaaaaactccagcgcaccgaaaaatttattgtttatcataaaatttgagttcgggccgaaccttttttttctgtctacatcgccgtataaactattgacaccgggtcggtgcttagtttttctccgtcttctcgccgaatttttacatttgacttcgctggatggtcatcacacgcagtccgattttgacactggtaactgagcgattgaattctagagattgccgttgacagaaatggacatcagattaatgtcggtggaaatcagcagaactcgctgcaacgccaaaatcacagtgctggagaaagttttccccaaaatcagcaaattgaaaactcgccaatctcacccactgaactcgcgggctttaatggggaaaatggtgatgacagttctcttgttttagaaccaaatatg

SEQ ID NO: 101793 - DNA, 655 bp, Heterodera glycines
  Promoter: Source sequence=SeqID_18106; Location=445..1099; Strand=+; Gene=SeqID_82687
tttagaaaaataatttgtaatttagtagcctaaaataatgaaattttgaaaaaattaaaacaaaaattgggcgtaaagaataaatgaatcgcaaaattccattttttctgtcaattatgtattatgatgatttagaattttcggatggaaaggaagtgctctctgttttcatttatttatccaattagaacccccgggggttctattgttcaaccttattttttcacaaacgcaaaaaaatggcgatttttttaaacttttcgtcaaaaaattgtaaattcatctgtcttttagtcattactccttatttttaatcttttacgaatgacggacgagcggaacttattagcatcgttaaagtttaaagaaagtaggaaacaattcaaattttactcaaaatcatttaaaattttaggatggaaattttctgtttttgcatactgaaggccattggtcgattttaatacatttataaagagagagaaagagtaaagatttaagcatttgcttctacgttttcattttcgtttttcgtgactataaaaatgtttgttttttcgattggtttctcattgtgtaaaaatatttctaacataattattattgtgccccctttgtgacgtccttcgtaattgtgctaatttccaacaaaatg

SEQ ID NO: 101794 - DNA, 228 bp, Heterodera glycines
  Promoter: Source sequence=SeqID_25309; Location=1..228; Strand=+; Gene=SeqID_56059
aggtcaatgggcccggctaatcaattaatgccatttttccaaagaaaaaattccctttctgtcgtgggaggatcccttttagccggcacgcgcgtcatcatcccaccgctgcttcgacaaagagtgctgacaacacttcactttgctcatcctggcattgtgagaatgaaagagttggcccgtcgacatgtattttggcctggtcttgacaaggacattgagaacatg

SEQ ID NO: 101795 - DNA, 114 bp, Heterodera glycines
  misc_feature (12)..(13): n is a, c, g, or t
  misc_feature (103)..(103): n is a, c, g, or t
  Promoter: Source sequence=SeqID_4631; Location=4497..4610; Strand=-; Gene=SeqID_55166
tgggacgacgcnnttccttcgttatgtttcttatacaccactccatctgaagtcactgggtactcaccctttcacctgatgttcgggaaatttgccgatttcncaggagaaatg

SEQ ID NO: 101796 - DNA, 104 bp, Heterodera glycines
  Promoter: Source sequence=SeqID_3568; Location=1..104; Strand=+; Gene= SeqID_50890
acctccggatttgccgggttaaatttcagcagcaagtcgagcaccagcgcgtcaagtttgttgtgggcatgctcagagaagtgggtggtgttgggatggacatg

SEQ ID NO: 101797 - DNA, 216 bp, Heterodera glycines
  Promoter: Source sequence=SeqID_7322; Location=1..216; Strand=+; Gene= SeqID_64467
agaattacattgggccataatcagaagaatcccttctattttaaccaccacaacgtgagtgccaaatggtaactgtttatgaatcagattattcaggtgcgcgacattgagcttacggcctctggcaggacatatccccagtacccgtacaacctggactacaagaacaacaggtatgcaagggcttatcacgatgcccaagagcacctcggcatg

SEQ ID NO: 101798 - DNA, 560 bp, Heterodera glycines
  Promoter: Source sequence=SeqID_10679; Location=1..560; Strand=+; Gene=SeqID_73927
ggatttgcataacaacaaaaaaaagttatcgcccaaaaacttgggctggcgccaaaaagtcggcgccaaaacgatacggaccccatacaaacactcaattttaatatataggattttttaatacataaatacatttatatttagtaattttgatttataactttaaagttaacttatgaaatattttaaaatttctgtaaaatttttcaaaaattccgagttccgaccttttttgggtcggagttccgacttccgaaaatttttggggcctcggaattccgagttccgacttccgaaaatttttggggcctcggaattccgagttccgacttccgaaaatttttggggcctcggaattccgagttccgacttccgaaaatttttagtgcctcggaactccatccctgatgtacacattttgccaattttcttaaataaaattgccagccctaataattacatttttgctaaagggttttccattaaaatttagtatacttttttttttctaatttggcgtttattttgtaggcccattcgacttgaaattcaaggaaatg

SEQ ID NO: 101799 - DNA, 533 bp, Heterodera glycines
  Promoter: Source sequence=SeqID_24361; Location=777..1309; Strand=+; Gene=SeqID_55084
tgttcgcaaaataaggtcactgttaatgcgatcgcggatcaattttgttcctggaggctgtctaaattgtggaattcgtcccgctctgcgttctataatatagtcgagagcttgggcgacactactgtccgttattgggtttcctgcattatttaaaacggtgtcaccgtgaacaccgtacttgacggggttacgattaaacacgaactgaagccgtcttctcttttgctcattggtaagttgcgaatttggaatggtgaaaaggtgctgatcctccgcaaactgatgacgctgctcttcggaaagtacttcgccgaccgggttcttttgtctttttggctgatttttggtaacatttggtgaagacaatctttttcgagtgccaattcttgttctttttctttcgttgtcttcttcaactttgttgcttttccgctttttcgttttactaggcaacggaggtcccggtggatggacctgagccgaggtccccgattgttgtgagagttcaaagtcatcatcaaccggtaatg

SEQ ID NO: 101800 - DNA, 237 bp, Heterodera glycines
  Promoter: Source sequence=SeqID_5198; Location=1689..1925; Strand=-; Gene=SeqID_57239
aacgcactccaaacgaagaagcgagaaaccatttacgaaaaggcatgacattttactatttttgtttactttaatgaaaagaaaagaggtgagggtaatactattgatggtacccctcattttcgaaaaaatatcgggaagaacggtttccagcttttcaaaatcctggttccgactaatatgcaatataaaattctgtgaataggtccagcaagacctctaactttgtctgacatg

SEQ ID NO: 101801 - DNA, 142 bp, Heterodera glycines
  misc_feature (50)..(50): n is a, c, g, or t
  misc_feature (53)..(53): n is a, c, g, or t
  misc_feature (59)..(59): n is a, c, g, or t
  misc_feature (68)..(68): n is a, c, g, or t
  misc_feature (72)..(72): n is a, c, g, or t
  misc_feature (77)..(77): n is a, c, g, or t
  misc_feature (93)..(93): n is a, c, g, or t
  misc_feature (100)..(101): n is a, c, g, or t
  Promoter: Source sequence=SeqID_1760; Location=3778..3919; Strand=-; Gene=SeqID_75761
ccgcatttaaatgctggaatgtgacaacagtcacatgtccctttaagggntcnccgaancatgactcngganctccngaccttaaaaagaagncgaagcnncagtcgaggactgccaggcctcaatacaccattcaccgatg

SEQ ID NO: 101802 - DNA, 476 bp, Heterodera glycines
  misc_feature (74)..(74): n is a, c, g, or t
  Promoter: Source sequence=SeqID_31763; Location=1..476; Strand=+; Gene=SeqID_62068
cgatgttattgcatatgcgaaattgggaaattttcattaatataaatgtagatttatgcgtaaattgtttcatntaaattatgaaaggagtgcagaaaatattttcattttccaatttttgtcaaaaaagttaatttttttattttcaaagaaaaaataataattattattaaaaatgtgccactgcttcttcatttttgcaatcggagcagctcttttgacgaaagttcgtttttctattaaataattttaggaatcgcagccctttttcattttattttttggacatttagtagtaaatttaattgatagcattcatttgtcggtaatacgttttgtttgttatttcggctaagatccccagggttttcggaaatctttggcgcttcgtcggaactgagtcgggcattgtttttcatccgcttttaacttcacttggcattggcacatttcagtgccaagctcagcaaacaatg

SEQ ID NO: 101803 - DNA, 111 bp, Heterodera glycines
  Promoter: Source sequence=SeqID_3341; Location=1250..1360; Strand=-; Gene=SeqID_84281
tttttttgaccaaatctgttcaaaagacgaacaaatttttcaaaattttgccggaggcgcctatcttccccgccagacccctcggtttcagaatttttttaaaaaataatg

SEQ ID NO: 101804 - DNA, 154 bp, Heterodera glycines
  Promoter: Source sequence=SeqID_6837; Location=1..154; Strand=+; Gene= SeqID_63049
ttgtaataaatatcataatgtaggatgggatcagcattctgggagtttactgtcgggaattaacggcccaaaaagtctgggatttggagatagaggaaaggcgtgggattagtgatatcgtggaccaattccaagtgttggcatgttggggatg

SEQ ID NO: 101805 - DNA, 93 bp, Heterodera glycines
  Promoter: Source sequence=SeqID_5034; Location=2976..3068; Strand=+; Gene=SeqID_56660
tttttcagtttaacttctatatcattacaaatgttgaccttgtcaattgcgtgcatacagtccaattggattacattttgtctacctaaaatg

SEQ ID NO: 101806 - DNA, 236 bp, Heterodera glycines
  Promoter: Source sequence=SeqID_13689; Location=1..236; Strand=+; Gene=SeqID_47150
ttctaaaaatttgaattttcgaactttttttccaattcaggtccgggattcgaaattggtcgaaatagatgccgggttcgtgatcagcgacaccgaaaaccataggaaacatgctttcatgtcttttgtaaagtgcattagtaccggaatttcttcggtaaaatacatggtttttaaaatttttagcaacaaattacacttcctttcctttttattcttttcaaaatcaaataatg

SEQ ID NO: 101807 - DNA, 1003 bp, Heterodera glycines
  Promoter: Source sequence=SeqID_3841; Location=1176..2178; Strand=+; Gene=SeqID_52095
agcttttttttattttggcattttttccagaaaaacgattgtttggcttttaaatcccgacaacgaacagtcccataaatccataaatattttcaaaatattactcatcaattattcacataataaatttccttcttccgctgcttaagacaatttggtcttgtgccagcaaacccttcgtttttctgcgcctaatcggcgtaattgtgccgccttgggttattctgtggatcagtgccgaacgtttcatggccgttttgacaccaaaaatttattgtcggcacatttttaaacggtaagtaaaaaatgattaaaaatgccttttttttttgttttggattttcacgatttgtgatgccaatcattcttacatatgcctttttctcgctgctttttgtttattccatcgcttggacaaaacgaaacgaaccggtggaagcgtattgcggacggagggttcgaaattttgaaaaattcaaaaataaatatttatttattttattttaaagaaagttttcaccaaatactactcaatttacacttttatggtggacatattttcttattcaattgcgtaagtgttcagcaggaaatgggaattattagtctcataaattgaatttggggcgcaattattattataatacggacgcgcatttgtatttaaaattagattagcatttatcactttgaaaaacggatttgcgattaagaagcctccataatatttatcgtatggagcccatgcttctcataattttgaattcttggaaaaggtgaaaaattagacaaggggagggaatcgccagtaattttgaactttatgtcattttaatttaattagattaatttatctcttcttttcataacatttttcaaatttatgtccattttgccaagtttggccattaattgtgccaccgccctccgtttggcgcgccttcggtcgcacctcaaaagtcgcgggcacattcagcggcagctgaaccgcgtgcattacatg

SEQ ID NO: 101808 - DNA, 155 bp, Heterodera glycines
  Promoter: Source sequence=SeqID_18158; Location=2336..2490; Strand=+; Gene=SeqID_82743
aaattttttatgtgatttttcattaaaataaaaatgacaataattgtattaattttggattttttttttgaatcaggcaacaccgcaactggacgacaattgcccgggggaccaccggcacccatcacagaccctgttggagcagcagaacaatg

SEQ ID NO: 101809 - DNA, 981 bp, Heterodera glycines
  Promoter: Source sequence=SeqID_23018; Location=1..981; Strand=+; Gene=SeqID_53718
cactttttactttgtccctttctctttctctctctctcacatgtctctctcccctctccctctttcttcactctcttctctttccctctctttttctctctcattgtctctccatttctctgtccctctctctctttctctctccaccctaaatatctctccatttctctgtctcttcccaaatgcttttgctggtgccctgagggcacaacagttcgagcagcggcagcttttgctcggccctttcgttttgccaaaattttgcttttcttcttccttcccttaattttatttagcacaaaaaatatttatttttggcattgtaaaaaatcataaatcaaattaaattcgatttaaaaaaaaacaatttatgtcaatatttttttgatatatttaaaaaatttgaataaaattaattctaaaaatatttccttgctaaaaataatgaatttttttttggaaactattggactattttatatttttaaatattaattaaaatgcaaattttattttttaattaaatcattaaatttaataattattttttcgcattgattgctttgcgcaatttttagattttcttttaattactttcgcgaattcatatgaacacaatgaattgacgacatccaacgagcactactgaatttctattcttatattgtaattgcttttgggcttttcaaaaatctcaaataaatttttaaattaattaatataattttaaataaaaaattttttacaaaaattaattccaaaaatgaatttatattaaaaaataattaaaacaagagcaaattaaaataaaaaaataaattaatggttaaacacaaacgttaaaataattaattttatattaaataatattttctgtttcaatttttaaattttgcattttatttatttttaataaataaataaatattttttttaaataattaatctaatcaatttataatcaaattcccagaaaatatg

SEQ ID NO: 101810 - DNA, 1003 bp, Heterodera glycines
  Promoter: Source sequence=SeqID_7668; Location=112..1114; Strand=+; Gene=SeqID_65569
attcacaatgctttttttttttttgcggtgcgctattcaaacagttttgaggaatgcgatttgttaacggattttgccgaaaaataaccaaatttggcacttttttactttagacaccccgaaaaatactgaaaattttattaaagtgctcataattttgtgattttaagccaatttcttaagagaaattttatagatttttacatacattttaatcaattttatcaaaaattgctatttatgcgaaatttttatttaggtggatttgtgatctttttaatgcaaatttttaaaaaatcccgaagttctaacttcaaaattttgagctaaagacatttcgccaaataattattagatttttcaaaatttgtggcagtttcactggtgaaatttaaacccgttttagcccggtcaaaaaaggtccattttaccgggcggcccggtcccggtggtttgtcaaaaaaaacgggaccgggacaaggccgcccggtaaaagcccgccggacacccggacccgttcggactctagttaatataatcttcaaattatgttcggtgtaaattttgaagtgagtaccgaaatttttcaaaattccaggttcttgatttttgacgaaattattagtttttttttgtggtttcgcttaaaatatgattcaaataaagtgagcagaaaattattatatattatcattattatttttgataataatttctattaatattattaaggtccgctggatttcgcaaaatgatttctatggtaagcaatcaatactgttcggcaaaacattttcaaaccccctttaattaaagttaatcaggcccaaaaattatttttttccaaatttatgttgaatattacatacagtatgcgacattccggattttggtcatattcggaagtctttaagtttaataaaatattgaaaataaaaaataatagtcttaagtagtaattaaattaattttttttttattaggtgttgggtttgacagtatg

SEQ ID NO: 101811 - DNA, 68 bp, Heterodera glycines
  Promoter: Source sequence=SeqID_43996; Location=1173..1240; Strand=-; Gene=SeqID_71553
gtcaaaaaattattcgaatttctccaatttgtttcccatatttccgaaagttattcggtatcataatg

SEQ ID NO: 101812 - DNA, 305 bp, Heterodera glycines
  Promoter: Source sequence=SeqID_23424; Location=1..305; Strand=+; Gene=SeqID_54133
ttgtattattttcacttgatataaattaaaatttgaatttttttttaaatttttaaaatttttttgaatttttaaaatttcccggttggtcccggttcccggtttttcttgcggtcccggtcccgaaaaaaaatcgaggtcccggtcccggtcccggcttatcaggtcccggcaagtcccggtcccggttttggcaaaaattcccggtcccgtggcactctagttttaagtgcttgattatattcgaactatggcataatgtcaatttctaaatataatatttatttgtttagtgccaaaggatg

SEQ ID NO: 101813 - DNA, 114 bp, Heterodera glycines
  Promoter: Source sequence=SeqID_30423; Location=1163..1276; Strand=-; Gene=SeqID_60831
attataaaagtaacggcggaataaattaattgtttttaagtgatgactgatgactcatcctaatttattttccattttctttcccttttttaagaagcgcgtgctttttcaatg

SEQ ID NO: 101814 - DNA, 580 bp, Heterodera glycines
  Promoter: Source sequence=SeqID_24508; Location=404..983; Strand=+; Gene=SeqID_55239
aaaggtgcctgacaagctttattattctcaaaaaattcaaaatttttcaatggatacaaaaaaaatcggccaaaaattaaaaaaaattaatcccatcttattaataagtaataaaatatttattatcgctcaacaatttgtttgtggaaactgaatatcaaccaaccggaaacattggcatgagaaaatgttttaaccatatttggtgccaaatattttgattaaatttattttggcatattaaagagagagagagtgccttaggcaaagaaatgaattcaaagaattagcccgaggcacatcaaaccaaattctttaaactctcacgcacagccaacgcttttcttcacaatgaaactcaaacaaaatgccaaacaaaaattttctaattttggattttgtgccggaaatgtttatgtgaacaattttacaaaaaaaaacaatgagaaatattccaaaaataataggcattttcatgaaattacaaatgtaaaatttagagattttcgaaattttaaaagccaatatttttgatcaattgattaatcagtcaatgaacaacactatgaatgccacaatg

SEQ ID NO: 101815 - DNA, 1003 bp, Heterodera glycines
  Promoter: Source sequence=SeqID_16972; Location=2232..3234; Strand=-; Gene=SeqID_81397
ttcatcaaagatatgaaaaaatgattaagaatgcaaactaacaaaaaactgaaaaaaagaattttctgtagaaaccccaattatttttttgcttcgataattaattttctcaataagttattttcatcgattttaatttaatttcattgaaaaaacgcactgattttcaaattttcgctcctattttaccatttttcgcattatttcgcaatttttatgcccttatttatttacctattttttttcgcttaaaatccgccgcttaatgatcaggcaatacgaaggcttgttatcgcatatggtcccaatgaaaaccaaaatgatcaagatttgatcaatcattacgtgcacttcaatatggaattgacatgaaaggcttcgaaaaaggaattaataatgaatatctatcaattcttattctataaagcacataaatttattttaatcagagcgcaaatgtcttttttcgctgtacggcgcaaatgtcgcggcgcaaatggcacggcgcaaatgtccgcggcgcaagagtcttttttgctgagcggcgcaagtgtcgcggcgcaaaagtcggctaaccatttataatgcattttcttttggtattttgtttatcataaaatagaaaaacttttttttgaaattttatgagggcaaatttacaaaagggtcaccccatcgaatatatattccatgtcaattcataaaagccgtcattaggccaattcggtgacacgttgtgtgtctataaccaattaaccaatgttggaaggcattgaagaaaaatttatttaatttattttatggcacaatttcgcaacacagaataatggcacttggataattggatttttaaaaattaaacaaattctgggatagaaaaaaatgtgataaaagataagaaaatgatcagcattaaattgctcatgatcagagaaacaattaagaaaggactgatcaaaaattgtacgcaattttcctgatcaaaattgcttatgggacaatg

SEQ ID NO: 101816 - DNA, 315 bp, Heterodera glycines
  Promoter: Source sequence=SeqID_73; Location=1215..1529; Strand=-; Gene=SeqID_62110
tgtaagcaataaataaaggctatttgtcgaaatatgtatagaaaaatcaataagtggtagcttaatattataacttgccatgtatttgaatttctttgcaattcctatataatttttatgttgaaaaattttgttttaaaaattttggtttaaaaaatataaaaaattttgtgtacgagttgagttgcctattttactaattttaagacatcaaatttcatacctttattgtctgcacctcacataaaaccgagtaaacaaagtgattggcacatacagtatgaacaatttacaattatacatacagtacatatg

SEQ ID NO: 101817 - DNA, 532 bp, Heterodera glycines
  Promoter: Source sequence=SeqID_12017; Location=2140..2671; Strand=-; Gene=SeqID_75542
accccgtgccaaggaaaaagtttaataaataccaatggaaaattctaataatccggatcaaaaattatcgaaccgaatttcaggttatatgtttttgggggataaactcaaatagagcctgcatacaacattttataatagcaaattgcagaggcaccaaaggcccttttaattctgcaaattattgggctccacaacgccttgtccttccgatgaacaaagggaggggggttaaccaaaatttttgctaaaatctctggaaagagggggtcgacaggggattatcttccttaagcatcctcggcggtcacttctgctcggctctttggacaattttggcaacgatgattcggaagtgcaaagggtgaaccccccctcctcgtcgccctttttcacgaacaatcacaattttgacggacgagcgaatggaaagaaacgaggcggggcacgcgcttttattggggaaaagggtgcttcgataaatgctctgaatttggagaagcgaggcggtggacggaattttaacgaaatg

SEQ ID NO: 101818 - DNA, 392 bp, Heterodera glycines
  Promoter: Source sequence=SeqID_2872; Location=546..937; Strand=-; Gene=SeqID_82067
atttttatgtgtacgaataaaaggcacttgtacataattaacgtaattaagtgatcgaagttgaaaggcacaaaaataatgaaaataaagtatttgcaatgcaaaacaacttttgtaaattgaactgcaatttaattcggtcattcttttaaattattaccgtatcacttggaagaaagggaaagagagagggatatttgttctgtttttaaatattaaaattattgacattatattttttgccaatttctccccctcccccgattttatttcttgcgttcatttcaccaatttgaaagaagacaaaattcatgttggccaattttcgcaactgtccgggcaccacccgggcggaatggaacaaatggggcgaattggcatttgacgagatg

SEQ ID NO: 101819 - DNA, 543 bp, Heterodera glycines
  Promoter: Source sequence=SeqID_2178; Location=2031..2573; Strand=-; Gene=SeqID_78296
tgttttttacattttcacaaaaattgtttaatccacaaaattggcaaagacttatttattaaaatttcgcccatttaaaacatttattttatgtttattttccccataaatatttatttgtccacttttttcatcccatttttgtcaatgttacttcttcaccttttcttgtcattctcgagaaggaatcgagaaatcaattttattccctcagttttgttaatttatttttttattttccttttaaaattattattattttcattctattttccccattttgattttatttttttatatgtatgtattgtttaacaatttttcgacccgtttttataccatttattgtccaattatgtattttgtcctaaatattttcccgttttttctcccctttttttccccatttaaaatcattcggaaaaaaacgttaaaatttaaacccaaccttttcaaacaacagcaagtggaatggatcaatgttgctgatttgcgacgtgagaagccatttttgaagttgcagaaacggcacgccaaggaatg

SEQ ID NO: 101820 - DNA, 90 bp, Heterodera glycines
  Promoter: Source sequence=SeqID_18938; Location=1..90; Strand=+; Gene= SeqID_83663
taaaacatttcgccaaaataattattaaattttttcaaatttgggcttgtttcactggtgaaatttagtcctgtttttacggtccaaatg

SEQ ID NO: 101821 - DNA, 207 bp, Heterodera glycines
  Promoter: Source sequence=SeqID_36293; Location=1..207; Strand=+; Gene=SeqID_65645
aatggattctcttttccctttcaatccattcacatatctttttgaacatttcgcctaagcaaaaattaatgtacttgcacgttcgcgggcgggcaaaaattgattttccccctctcatagttttttaataaaaagttaattaataattataattaaaattttctagatttaaaaaaatattaatttattagcaaaatttcgccaatg

SEQ ID NO: 101822 - DNA, 172 bp, Heterodera glycines
  Promoter: Source sequence=SeqID_2263; Location=2211..2382; Strand=+; Gene=SeqID_78780
gctctaatttaagcaaatcatattattgcaaaataaaatgatcaaatcaggaataaattaaaaataaaacgccagaaaatgcaaaaatttttatctttcgatatgcaaaatttggtgcaaattgtattttagttatttgttcaaaaataaaacaaaatacaggtacaacatg

SEQ ID NO: 101823 - DNA, 139 bp, Heterodera glycines
  Promoter: Source sequence=SeqID_21206; Location=3204..3342; Strand=-; Gene=SeqID_51796
atacgaaaaatttttggggaatgaattggaagaaaaatgcatttgctatttgaatgttgcggtttttgtcagaacaatttactcgaaattgaaatggatcagaaggaattgcaaaaacgaagagaacgaaaaaataatg

SEQ ID NO: 101824 - DNA, 144 bp, Heterodera glycines
  Promoter: Source sequence=SeqID_16758; Location=2337..2480; Strand=+; Gene=SeqID_81170
tttcatcggccgaagagttttcgccaaaaaatgcgcaaaactttgaggaggacaaagtgccaaacacagaaaggcattacatttttactcggtttttggtttataaaaacaatttaaattgtttttaaaattattgcccaaatg

SEQ ID NO: 101825 - DNA, 1003 bp, Heterodera glycines
  misc_feature (433)..(433): n is a, c, g, or t
  Promoter: Source sequence=SeqID_15570; Location=271..1273; Strand=-; Gene=SeqID_79854
aaatatatttttttttgttttactcatccgaaattaaaagacgaaaaatggaaacaattcatttaattgcgcaccaccaaaacacatcacacgaacgaaattgttgcacaaaaaagtatgaacagaaatgaagtggaaaattcgtcaattctccagaaagcacgttaaaatcttagtgtatttataggaaatgtgatgttgaattttccacaaagtcaccgaaaaaagtgcaaaatgtaaatttgtaataggacaacacttttgctcgcttaattagtgggcaaaaataattttgaaaaaagcaaaagaaaaagaaaagagagaaaaacagcgaaaaggagaaaggagagaataattggccttatttttgttgcttttggtccacagcagcacagaaacaaatggacaaaaaaatgacgacgaaacaaatgtnggagaagaagaagaagaagacggtggtggtgacggatctgaacaaaatggcaaatttatgttaccaaaaaagggataaaaaaagagattcgaatccaaacccgggctgacccggcactcaaatctatccggttaattcaatgttttcttctcccaaattttgcctattgtcgtaatcttacaactagcacaaatttcgaatttctaaaaatatttaagtcattctcgagaaatttttatgttcgagggcctcctgggcgacctgtgcgatattccctgccggaaaaatgcatctcatcataaaactcatcccgcataacaaatcgtgcctgggcttgagcatggggatgggtgtgtcggggcataccaaacggcaaaaaactttaaaaatatactttttctaaatttttaacaataagcttttctgtcgcgagagggggggggggaggggagtgggctgttcccgggtggcacagcattggcacatttgtggcaaatttaaattgatttgaattgaattcttcacattgccagtagtcattagcacggcttctcaaacgatgccacaatg

SEQ ID NO: 101826 - DNA, 354 bp, Heterodera glycines
  Promoter: Source sequence=SeqID_29771; Location=1..354; Strand=+; Gene=SeqID_46179
ttttctggtatggaaatgtcccatatatgttcgtgaggtagcggtggtaatgacacggttggtaaggcaacggttggtaaggaaacgtttggtaaggaaacggtggtaaggaaacggtggtaaggaaacggtggtaaggaaacaacaccaacccctttttgaaaaaaaacagaatgtcaaaaatagaattttttatttctctaagatgtaatgccaaatgcttttttcaaaattttcaaagaaagagaaagaaaaccggaaataagggactgtccccttgaaaaaatacactaccgaaatgacttttcaggtgcatttacatactctaatattattgcaagttttatggaaatg

SEQ ID NO: 101827 - DNA, 154 bp, Heterodera glycines
  Promoter: Source sequence=SeqID_13756; Location=1484..1637; Strand=+; Gene=SeqID_77677
taatttatggattaacctagatgatcaataactgaaagattgtttacccaaactatgtttttgatggcggtgaatttacatcaaaacaatttcttttgccattctttcttatttttcccaaatcaatttccccaaaaaattaaaattattaatg

SEQ ID NO: 101828 - DNA, 1003 bp, Heterodera glycines
  Promoter: Source sequence=SeqID_9454; Location=532..1534; Strand=+; Gene=SeqID_71475
gtaaatgtgataaattcatcacaatttaatatgtacgggaacctcttttggcattggaatttgctaattagggcctaattagggagtgggtgttcatttcctttttttccatttccatttcattttgcctttgcgaatggccaaagttttgcaaaggatgggaatgggaaaggtgccaagaaagggagcgcccaactgactactgtcccttccatttttgtccttgacaaaagcgggggggggggggggacgaggaatgtcgcattatgtgaacaaattatttcatcacgaggacagtttttgcaaaacggcaaaaattgggggggggggagacaatgcaaaatggggataaaagaaagaataacacaggaaagatagacggagaacgataaagataaagataaagcgagagagagaaagagagagaggaaaaagggggggggggagagacaatgcaaaatggggataaaagaaagaataacacaggaaagatagacggagaacgataaagataaagataaagcgagagagagaaagagagagagagagagagagaggaaaaggggggggggaatttgtggcatttggccaaaacaattagaaggaaggcgtaatatgattggttctaacatttccactgatttatttgtgccaaatttttcggaaattcagtctcaattttcaatgtcccgttgctttggggtattttttattttggtgtttaaagcccagggaaaaattgaaaaataaacgcggaaaatgggattaaaaacggaaaaggtgatcaaggcgaaagcatagggtaaagggccaaaactggggtcattttgggcaatgccatccttcattcattcgttggcaaagtgtcgggggaatgacccaaaaatgggacgcgaaataatcggcgggggaaggggagcgattggggtttgggcggaggggtcctcaccgcaccatcgccgtcgtcatatccgctgacccctcctccctcccagcccaaatg

SEQ ID NO: 101829 - DNA, 408 bp, Heterodera glycines
  Promoter: Source sequence=SeqID_28908; Location=1..408; Strand=+; Gene=SeqID_59475
cctctgatcaatcgatcagaaactcattcccctcaaaagacggccgaggggggggggggggcgccgaagagatcggagagacgggcaaaaggcgtctcaaagcaaaacaaaggcaaaattcgccttcagttttacggagcgaaatatcagctcaggaggaggaggaagaggagaatatttcattgtcatctgctatctgtttcatcacttcttctcccttttaatttaaagcaaaaataaaaaaatgccattgtgcaatggcacaatggcattttactatgtataatggatttttcatatttttaattggtcatagccttggcatttttgataatgccgaagaggaaagttcgaccaataaataattttaggcaagaatctccccgtttattttgtcacgacaaaatg

SEQ ID NO: 101830 - DNA, 210 bp, Heterodera glycines
  Promoter: Source sequence=SeqID_4029; Location=5854..6063; Strand=-; Gene=SeqID_52886
actttttttttgtttccttgaattttctcaataatttttttttattagacttattttttcgaattaggctaggtaagtaaattttgtgaataccttttctttgatttttttatgtaaattgaattttctcttcgttttatggccgtgcttttggtcgccacttcgttggccattttggcggtcgatttcacgctgttcccgcgccgtatg

SEQ ID NO: 101831 - DNA, 56 bp, Heterodera glycines
  Promoter: Source sequence=SeqID_14530; Location=2098..2153; Strand=-; Gene=SeqID_78583
ttcatttttatgattgccaaaatatttttccttatttacgtattcattgacagatg

SEQ ID NO: 101832 - DNA, 79 bp, Heterodera glycines
  misc_feature (15)..(16): n is a, c, g, or t
  misc_feature (55)..(55): n is a, c, g, or t
  Promoter: Source sequence=SeqID_21936; Location=1..79; Strand=+; Gene= SeqID_45685
ttttaaatcgtgtcnnggttcttctggcaatcagtccaaacttgtttttcacttnaaaaatgagttcccgagaaaaatg

SEQ ID NO: 101833 - DNA, 123 bp, Heterodera glycines
  Promoter: Source sequence=SeqID_40232; Location=1..123; Strand=+; Gene=SeqID_68635
catggcaattcactgaattcggacaaagaggaggagcagggaattgggtcgggaccgaacagcggcggtgaacagtcggcgaccgccgtcgccaccgccccaaaaagcgcttcgctttcaatg

SEQ ID NO: 101834 - DNA, 601 bp, Heterodera glycines
  Promoter: Source sequence=SeqID_29456; Location=1282..1882; Strand=-; Gene=SeqID_59954
aacatttttggtcgattcttaggggtgtatttttctgtattttttaggacctatttttaggggtgtattttccgtttatattgcatttttgttaacaaattttccaaaaaatggcaaaatatgcataaaaattcagaaaaacccaaaatatgcataaaagcccaaaatatgcaaataaaagtcccgatttttatacgcaaacacaaaaaagaaagtgtttttcctactatttagagcatggagaagccaggaaaaaatatgcatttgcatacttttggcagccctactaataacttgaaaagtagcttaacaaccacaaaaaaacatgcttttcgtttgttttagactatagggagctcaggaaaaacaggtaaaaacctaaaatcgtatctctagtaatcagcacattttttaccctggtaaagacaaaaataaaatttttaatttattttctgtcgggccgccattctgcagtattacctaatgtactattctcatgtgttcgttttatatgaatacgaactgtttaaccttgtgttatgttaagcatctccacttaaaaaaaatagtcgaatagtttaaacaacaaaattgtcaaatg

SEQ ID NO: 101835 - DNA, 902 bp, Heterodera glycines
  Promoter: Source sequence=SeqID_44311; Location=172..1073; Strand=+; Gene=SeqID_71807
ttttgggcacattttaagatttttggatttctaggtatatctgagctaattttagagcgtaattaaaacgcatatgtactcgttttgatagtgtacaagaaaattcacttttttttgacaagtatgataaaaaagacatctttcacatttactaattcagcgtaaaaatcaggaaaaaattgtgagcaaaagaaaatccgaccgggagattccgattctaaaccttaccaatgttgtatattatctacaatagttttacccaggttatcgtatttaattgttaaataaacacgataataggatttaattctgagtttattataatacaaatttttctaaatataattttattttaataatgtttgattgtttgtttataatatcactcaactatggtcaggaccatacgcgctcttagacttaaacctagcttcggcatagttttaatttaaagcctaggccgagtacggtacttccaatttttaaattttgtgtataatcatagatatacccatattaaaaaatggctttctcgtttccaaataaaatccacatataaacgcgattctgctggccaatttgctaacccaaaaaacgtctcagacgttaaggcattcaacggggcaggtgcatttattgtacatgcgcttataatcgacctacagtataaactgtatgaagtgagttttatctctgtaatgctacatgcatacattctgtattgtaaaccttaggcttgcccaaccgtagctaaaaatgggctattatgcaaccgtaagctgtccgaacagagactttgttcgagttgcggttttgctaccaaaaatccaacagatgctgttatccttcgacttgaacttcaagatctaatggataaagaatgccgccaaaatacaacaatg

SEQ ID NO: 101836 - DNA, 179 bp, Heterodera glycines
  Promoter: Source sequence=SeqID_17071; Location=89..267; Strand=+; Gene=SeqID_81498
tccgcaaatcaattaatatgggcgggcaattaattgcatcactaattcatttatttcatttaacaataatacataaattaataattatgccgtttagtagttttctcattaattagaaaatattacatttattcataattatttaatgattccatttaaaaaagaattactcaaaaatg

SEQ ID NO: 101837 - DNA, 241 bp, Heterodera glycines
  Promoter: Source sequence=SeqID_5690; Location=1213..1453; Strand=+; Gene=SeqID_58918
tccctattgtattcaaaactcttaaaaatattattaaatatttttaaagaaaaaattaaaacttagaccatcaatcggaaactttggctcacaatagaagacgaagaaaaaaccgcttcaacagcctccacaaaatttgcaacctgctgatttagaacagcgaaaattcaaattttgcacctttcttttcattgccactctcttcacactaaccccagtaatttacttcattaacaaaatg

SEQ ID NO: 101838 - DNA, 629 bp, Heterodera glycines
  misc_feature (29)..(29): n is a, c, g, or t
  misc_feature (36)..(36): n is a, c, g, or t
  misc_feature (82)..(82): n is a, c, g, or t
  Promoter: Source sequence=SeqID_15355; Location=2382..3010; Strand=-; Gene=SeqID_79614
ggtaaaagataaatttaatttaaaaatancttaagnaaattaacttattttttaaaactatggttggaaataattttacatnaagtgaaaattctataatttccctttatatttgccatttctcagctctatccactaatattaaaaattagctggaggaaacatggagaaattaattttattttcttttattgcattaattatttttacaaatgatgggcaattaaatttttgattttgttgcccaaaagggaaagaataattattttattgtgaagtcactaaacttgcgcaagtgattcactttcaccagcagcaagtttgaagaacaccttcgattaattgtacgacaaaattaaatttaataaacaaatatgtttcaccactgatttttgtgcgccgatttgccaattagcgctgattagtctccctaattaatttgtttgtcaaactgaaaaaaaatttactaaagaggaaagaaaaaaaaggaagaaaaactggcacaaaccgaagatcagtagcacattagcagaagaaggccacactataaaagagggtccccaaaactcacacagacataattgacttaattaccttttaataccctcgcactaattactctcaagatg

SEQ ID NO: 101839 - DNA, 188 bp, Heterodera glycines
  Promoter: Source sequence=SeqID_12241; Location=289..476; Strand=+; Gene=SeqID_75812
tttctaccagaaaacaaaaacacaatcagatccagaaataacaaacagaattaacggttcggaagttccgagaaattgcaataataacaaatgacatatttagtcattcgcgccatcgtatttatttacgataatcgctgataaaggatttaaacaataaattggtgacagaaatatatttaggtatg

SEQ ID NO: 101840 - DNA, 422 bp, Heterodera glycines
  Promoter: Source sequence=SeqID_36436; Location=1017..1438; Strand=+; Gene=SeqID_65746
tgttagccatgtttaagccctttgtttattcccattttggggataggggcccaacagttggcgaaaaaacatccgcccggaaataaagggctttctttacctgcaaaattttggtttaaacaaaatttgggtgaatttttcccaattttttagccaagttatcatttatttttaaaaaatgatataataaaaagggaaaattcggttccaataatttttaatttgttttttatttttatttccattttaatcttatatttatttattttttgaattcttaacttattttgattgagtttcatttgcttttcaacaaatttaacaattttggtaatatttttagctgaacgcttaattatatctatttagcttttatttaattattttcctttttaattcagctttatcattaaaataaaatg

SEQ ID NO: 101841 - DNA, 958 bp, Heterodera glycines
  misc_feature (861)..(861): n is a, c, g, or t
  Promoter: Source sequence=SeqID_42134; Location=1..958; Strand=+; Gene=SeqID_70103
ccggaatagcttcactatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttactccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccacataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcngtggatttttgctccccataaatgtttgagtaccccaaacggacacttgaaaaatcgatttttttggtttcataaatatttttttcagaaagtcatg

SEQ ID NO: 101842 - DNA, 210 bp, Heterodera glycines
  Promoter: Source sequence=SeqID_12132; Location=2570..2779; Strand=-; Gene=SeqID_75708
tttttcggtaaccgtcttggttcaattcaaatccaacaatgtctgcaatttcaacaaattcgcttctcagtctttgagcaaatcactcaaatggcgaagttatcctcagtctttgagcaacttcgacaaattctcgactaaattttcttttatttgcagcctcagtctttgagctccgtcgtcggcgttattcccggtctttaagcaatg

SEQ ID NO: 101843 - DNA, 140 bp, Heterodera glycines
  Promoter: Source sequence=SeqID_16335; Location=705..844; Strand=-; Gene=SeqID_80723
ctattttaagggcgttaaatttgaatttgaaaaatgtttgttatgaaaataaaataaatttgaataaaacgaatttgcttattggcatgggcatttggcatatgcttgttattttttttcttctttagatttataatatg

SEQ ID NO: 101844 - DNA, 404 bp, Heterodera glycines
  Promoter: Source sequence=SeqID_22777; Location=1..404; Strand=+; Gene=SeqID_53473
tttcttttttgtgtttgcgtacaaaagttggaacttttatttacatattttggaatttttctacatattacatatgtacatatttttatacatattatggaatttttagtacatgtttcgcaattttttcgtacatatttatttttacatattttgggaatttttgagaatttataaaaaatttcttaagaaaaatttaaaaaatttttttttgaaaatgtacccctaaaaatgggctttttccaaaaatcagattcaaaaattaatttttaaaatactaaaaagtgattctaagcctattttagtcctttttatggcattttctgattagttcactttttacgaagaattttttctagaaaaatgaccatttaaaaattatttacatattttagtacaatatg

SEQ ID NO: 101845 - DNA, 684 bp, Heterodera glycines
  misc_feature (100)..(100): n is a, c, g, or t
  Promoter: Source sequence=SeqID_4449; Location=1..684; Strand=+; Gene= SeqID_54489
aaaaaaaaaaaaaattcccccccgaaaaaaataatgaaaaaattaagcatcgctcgggaaaaattcgcaaaattttgtcattgcccacgcaaaaggcaanttgtatggcatttttgattaaatttccaattttttgatttctataaaactatacttcttaaatttttttatataaaaaattcttttattcgaactccagaaaaaaattgaaatttttttatattttttgtaaaaatagaaatttaaaagtttgattctacaaaaagactatttttattttgattctctttatttattcttttttgctgcacaattggtggaataattttttttcaaaatttcattttttttatttttcaaagtcgaggcctcttaatgtatggacacagtagagtaaaaaaattttttattttttaagaaaattggttgaggccatgtgttcagctctgtgatggtggtgctgagtaccaaaattgaggcgtgaaattcccagagcagataattagggattgaattttgcggggaaaaaaattcgcatcgaaattcggtggcattttgggaaaagaaaatagacctctaatggcagcacaatgtagagtaaaaaaaaaaaatttttttttcattttttttgttttttgaggaattggctggcgcaaatggattcagctctatgatgtggtgatg

SEQ ID NO: 101846 - DNA, 159 bp, Heterodera glycines
  Promoter: Source sequence=SeqID_15057; Location=1873..2031; Strand=+; Gene=SeqID_79229
attccatccacggcaattacggttgtgaagaaaattgaggacgaaaaagtaagagatgtgtcggaaaagacagtaaagaataaaaagagtgaggaagaatacagtcaggaagttgaagctaaggtcattgagagcttagctaatgatggcaatgaaatg

SEQ ID NO: 101847 - DNA, 688 bp, Heterodera glycines
  misc_feature (58)..(58): n is a, c, g, or t
  Promoter: Source sequence=SeqID_17308; Location=1..688; Strand=+; Gene=SeqID_81784
aaattatgagatttacatatcaaaaatagttctcgatattttcaatgaaaatcggggnaattctgtaaatttctcattagctttttggattttcccattttttgaattgtcacattggactttttttgtttttggttttctctgttggctttcggcattcgtttgttttttgtttcgttgtggtgaaattttgtaaaaaaataatcttctttacctgattaattttttttaattaaattaaaatataccaacaatcataaacacgaaaaaatatttttttaatggattttaacttttgagcttttctttatataaatctgagttgtgttgtgttgtgtttgttctttaatttaattggaaaattcttttaaagaaatttaatattcccttttttcaaatgaaaaaatgagtccattttatttttagagaaaaattatttatttatttattttcaattggcccaaaaagctttttcttaactgttttaaagccaaaagatgcaaaaaatcttttttgtttgatttgtaatttgagttgaatgagtgggcgaattttgtacaacaaaaagtcacaaaaccatcgcaattgtttcaacaatttgggcaattttcttttgccatttgtccaatttttgtcggtataaattaatttttaattctaatttaatcttcagacagtcataaaaatg

SEQ ID NO: 101848 - DNA, 1003 bp, Heterodera glycines
  Promoter: Source sequence=SeqID_15627; Location=1977..2979; Strand=+; Gene=SeqID_79918
atgaaaaggtgatgaattgaatgtacggattttcataattttttcaattactatgccaattagcacaggcttatcgatgggtagggttgttgatggttacaaaattttccccctttctacgggtcacaattgggacgagactgagttgtccgcccgatcagtgatcgtttcgctttgggtgggggttaagtgatcgcagcaccgatcggagagtgtcacacgacgtatgatcaaacggtcaatcgcgcggctgcaatgatcgggggtctccattcacccctccccctttcccccgcccgcctccgccggcgactgcgaccggcgctgacccgaaagtccgccgtggaattttgcgccgatggcggatcgagaaaagagtcgagaactgatcagcataattgggtcactgcgcccgccatctcttcgcttcaaaatgctctttcattcgcccgcattccccccccccccccataattcattcgctaccatatttatttgtgcggtgattgtgaattaattgaacagtgccacgccgccgaggcgacccttattttgatcaagtgaaaatgagggcagaaatttcacctgaaattgcttctactattttgatgagctaaaaaaggaagagactcaaagtgatcggaccaatccttcccactgatcagtccattcgtgcggttttggctaaagaatttttgctctggaatttccatctgctctttgttttcccccaattaactgatcataaatcttgagtaccagtttttgaataatgatgctcgaggccgattcaagatactcgaaactgagatctgactacgataaaaccagacaaatacacaattttaacgaaaaatccaaattttctcgaaattggaaagaacccgagattttttcttggtcgagaatcgagaccgtgaatctcgagcatccctattggagagagtgacttaatctttgctttgtgccattcccagcccattcattccttttttgggcgatg

SEQ ID NO: 101849 - DNA, 67 bp, Heterodera glycines
  Promoter: Source sequence=SeqID_11772; Location=1..67; Strand=+; Gene= SeqID_75268
catagccatttgatttttcaggccattcaatatctcgtgagtgcgctcaaacattcccccaacaatg

SEQ ID NO: 101850 - DNA, 398 bp, Heterodera glycines
  Promoter: Source sequence=SeqID_222; Location=3071..3468; Strand=-; Gene=SeqID_78403
agctaatcaccatcaatcgtccgcaatgacgttaaactagcctaagccatcaacaactgtccgaaacgctaatcacccggctgccacgagtccggaatgacgttaaactagcaaagcatcggccaacccacataacaatcgtccgcaatgacattaaactaaagaaccaacctaacaacaaatgtccgcaaagacattaaactagaaaagcaaacaacacatgtccgcaatgacgttaaactagagaaacaaaccacccaaagtccgcaatgacgttaaactagcaaagcatcaattgtccgcaatgacgttaaactagcaaagcaccggccaccaagcaaccattgtccgaaaatacgctaaactagcaatccatccgacggtcagggtccgaaatg

SEQ ID NO: 101851 - DNA, 504 bp, Heterodera glycines
  Promoter: Source sequence=SeqID_14708; Location=1..504; Strand=+; Gene=SeqID_78824
atatactaaaaacagtttgaaatcaccttttacatggtttttaatttttaaatgcgggatttgcgggattaatcccgcgggatcccgtcccgcaaaaaattttgagttccagtcccgcagcgggttccgcaaatttgaaatttccggtctctactaaagacaatacaaattaaatataatttacttagctcaagggcaactgaattttaacattattggtattgcgaaagccttgagttttctcaattaaaccgcaaatttaaaaatgatctaaaagaatcaaccaagttaaatctgtttgcttttaagtaaataaaaaaaagtgattttacggaaaactgctaaaataccaattttagaaacgcaccaacacagcatattgtacattttgttgttctttttttaaattaatttatgctaatttaagaaaatggaccggtgccaaaataaacaaaattttactcagtaaaaatattaaacatttcataaaatttacaggaaatg

SEQ ID NO: 101852 - DNA, 328 bp, Heterodera glycines
  Promoter: Source sequence=SeqID_4940; Location=1..328; Strand=+; Gene= SeqID_56296
agaagatgatttaacagatgattgagtgaaaataaagttttataaatttgaaactcattacatccattcttaaatacaaaaactcatcaatttaatcagttaatataaaataagaattaacaattaaaaaaattttttttattaattttcttaattatgattcgaattcgattagataatataaaaaaatgttctactaaaaaataagcagcggatttttgaatttttggaagataggtcaccaatatgttatatttttttgtaattttgccactgttatgtactgtactatactgtacttgttgtttagttccaactaccgtacatg

SEQ ID NO: 101853 - DNA, 302 bp, Heterodera glycines
  Promoter: Source sequence=SeqID_3812; Location=1..302; Strand=+; Gene= SeqID_51974
ggggtgaccggactagtaatcgtttttttttaaattttctattatctttaggctcgattcggtattcccgaagcagtttggggactgggcgaccggacactccgccgcttgatctcgctttcaaaggctatggctcgggcacggcaacctttgaaacaaactttggaagagatgaggaggaagaggatgacgatcacactgagtcttcgcgcattttgtctccggcgactcgttttgctcccacccatgggattggcccatacactaaaaaagcatcgcctgtggaaaatttcaaaaagatg

SEQ ID NO: 101854 - DNA, 109 bp, Heterodera glycines
  Promoter: Source sequence=SeqID_13525; Location=2939..3047; Strand=-; Gene=SeqID_77424
ttctttattccaatttcacatgcaaatccatcggtgagtttttacttgtcgaccaaatgttagggtatttaattaattggtctattttaattagatggacgacaatatg

SEQ ID NO: 101855 - DNA, 388 bp, Heterodera glycines
  Promoter: Source sequence=SeqID_20732; Location=1065..1452; Strand=+; Gene=SeqID_51293
tttttgctgaatatttaaatttaaggaaaattttttttttgagtgagagacaaaaacttattaaaaaaagactaatatttgcaaaatgcgtattaatttatgtaagcaatgcgcgttttccattttaaggacatcgtatgtgcatttatcaattatataattgattataactgctttttgatgttggattttgtctttaccatgggcataaacaatattaaaaaaattcattaaatcgtctcctctgaatccatttacctatctataataataattctccaaagctctaattattttttatatgacgcttaaaaatggaatatttttttattcgtgattactgatctgtagggctaggaattatatggatataaaatcgcaaaatatg

SEQ ID NO: 101856 - DNA, 359 bp, Heterodera glycines
  Promoter: Source sequence=SeqID_17513; Location=1..359; Strand=+; Gene=SeqID_82019
aaattcttttggtttattttttgtctttattaataatgagtttttttgtcttattacccgacctctctggagaagtgcgcaataaattggcacagattggcaaatgattttttaaaatataaagtgatgggcaatatatttaatgaatatttaaggaaataattattctagccaattttttgtttcttttaaaaagaggccgaaaagtggttctcaaattggaaaattgtgggatggccccgaaccctattcctgatattttttatttaagtcagtagaaataatgatctgatccagtttttccatttatttaggtttgccctaaatttcaggtcatttttcaggatagtttcacaatg

SEQ ID NO: 101857 - DNA, 1003 bp, Heterodera glycines
  Promoter: Source sequence=SeqID_16222; Location=68..1070; Strand=+; Gene=SeqID_80598
tcccccaaatatgccctaaaaacccgaaaaatacccaaatatgccttaaaaattatccaaaatggcttttaaaccctcaaaaaaatgccaaaattgtgtaaaaatacagaattgactttaaaaactacaaaacaatggccaaggagcttttttagacaattgcaaaaaattttgaatttcaaaattttatgcaatttcgaattttttaaatttttatcatatgataaaacaaaattacatttttcttatatcaacaatttttttttcaaaagttcttacaaaaaattcaaaatttttcgatttttaagggtatattttttaaattcccaaaaagatcgatccttaggggtgtatttttcatttttattgcatttttcttattaaaatttgccaaaaatgaccgaaatatgctctaaaaattcaaaaatggtaaaatatgcatttattctcgaaaacccccaaaatatgcttttatatgcactaaaaaccttcaccaaatcgaaaacgcagaaatgcaatttttgagcccctttcttaatagcatatgcgcagaaaaaatatgcaaaatcatacaatttataaccctaatgataattaatatagggctgccaaaaatatgtacataaatatgtaaaaaaaaatcccgaaatatgtacaaaacaatccaaatatgtactaaatatgtaaataaaattttaaaatggttttttttaattccccgtaaaggatgaaatatgcagaaaatgccataaaaatgactttaaataggcttataatcaccttttagtttttaaaaattactttttggtattttacaacggtgtgtacattttataaattattttttcactaaattctccaaatatattaaaaatgaaaatatgtacaaaaaattttccgaaatattggattttttgaggatttccaaaaatttccgtaaaaaatcctcaaaatatgtaaaaaaaaataaaataaaatatataagaaaaaagtccaaaatatg

SEQ ID NO: 101858 - DNA, 812 bp, Heterodera glycines
  misc_feature (49)..(49): n is a, c, g, or t
  misc_feature (72)..(72): n is a, c, g, or t
  misc_feature (116)..(116): n is a, c, g, or t
  Promoter: Source sequence=SeqID_15989; Location=1..812; Strand=+; Gene=SeqID_80347
taatttaaattacaaaagaaaccaaaacaaatattatgttaacaatgtntaataaatttaaattaagtgatntaattgataatttaccgtttatatatggttaagaactttttttntaatcgcattttgcagcattttccttgtcataatcgcaatggcacatttgcggacaatttcgggaaaaataaaaaagtttcttaaaaaaattatgattttttttccgaataaatgaattgagactgtaaaaaagcagcttaatattttactgaattaactccccgaaaagattttggagaattgcgaatgtcgaaactattgccgtcataatatgctgattacggctgtagtatctttgaattttgcacttaattgttaaagaatattgtgaaaattcgaaaattaaaaaattctaaatgttttatagatacctatatttaatttgtttctttacaatgttaaatcaatctttttcaggctcattaataaacattttttattgccaattttatattatggatttccttttttaaaacatatttttttatttattaaatatttattcactgatttaatttccttgtcatcttttgtgtttacgtgtctttagaaagaaggttagcattttgcctgatttgctcagctttgccaaacggtccttggcaaaaattggagcgaaaggatcgtctttttattttgctcataatatctttggttgttcaaagacgcaaaaaacaaatttttaataaattattatattattcttttcaaaactatttgtttatttaaaaaaaaatttagaataaacgacaatg

SEQ ID NO: 101859 - DNA, 110 bp, Heterodera glycines
  Promoter: Source sequence=SeqID_36720; Location=621..730; Strand=-; Gene=SeqID_65972
agaaattttctatgcaacaaacgctctcgaacatgaaacgaagtgcggtgcgccgtggccattttatttttcaaataatttttaaatttaatacatattccagaaaaatg

SEQ ID NO: 101860 - DNA, 157 bp, Heterodera glycines
  Promoter: Source sequence=SeqID_30190; Location=1285..1441; Strand=-; Gene=SeqID_60624
aaaagaggcgagttttgaagaatgaataattttattctatataattttaattaattttattttatgtattttattttttttctacattagttcctttaagcttgtgccagcacataaactcattttgaagcacgcgtccgaagtatttgaggcaatg

SEQ ID NO: 101861 - DNA, 281 bp, Heterodera glycines
  Promoter: Source sequence=SeqID_35888; Location=564..844; Strand=-; Gene=SeqID_65342
tttatttattattttttaattatatttaaataaaatcctttaaataattattttaattaattccatttttattttaaattatttcattttaaatttccattattttatttaggcttagtcatttgccggcccgcgactattcagacattttcagcgaaatcagcaaattgctgcacgaaccgttcagtttccgtttgatggaggcaattaaatttttaatttttaccaatttaattaattatttaaatttttttccccatttttcagattaatagcaaatg

SEQ ID NO: 101862 - DNA, 339 bp, Heterodera glycines
  Promoter: Source sequence=SeqID_29086; Location=977..1315; Strand=-; Gene=SeqID_59645
catcaattccctgggggacatcccccccccctttttttttcctttcgggtcaatacaaaagattacacccccagaaaaatgggggcccctttctaagaaaaaacattgaaggccttggtaattttccatgggtcgtcgatagtcgctgagtgctgggacgtcatggcatagttatccctttcacggtaggttgtcacggcacgagtagcctttccagggcgggatttgtatcagcgtctcaggccttccggaaaggattcaactagctgaactaccgacgctgcatactccagctccccaatttgctcaatcgtataggatcattgtcgcctcaatatg

SEQ ID NO: 101863 - DNA, 883 bp, Heterodera glycines
  Promoter: Source sequence=SeqID_12720; Location=1399..2281; Strand=-; Gene=SeqID_76413
attaaataattaagcaaattgaaaaacaaatgggaaaagggatttaataggccaccactgaaattgacaacagcgaaaagccaaaagagaataagcgaaacgacggcaacaacagaacaaagagagagcaccgacacaacgcaaaggacgacgaaacgaagtcatttattatttgattggaatggatttgtttgggaaattcatttttcatttctaatgcctccaaagattgtccaaatccgccggtgtgcctcagaaattgcggcattttcatcgacgaagacgggtgccaaagttgccaatgtctgtggatttcgaagggtaatgatgttgttaatgaatgccagtgcaaatatgtaaaattgaaatgccattgttgcttttgttagcctgtgataccgatttggactgtgcctttacggagggccaattttgtgatttgggccgttgcgaatgcgcggaggggtgggagcaggacattgccatgtcgggcatttgtcgcttcaaagaaagtgcaaaactcagaggtacgccgccaacagttttcaaattgaaatttaaattgccgaaaaaggggtgccaaatgtgcccggccctgatcagtccgcccaactgagtactgctacctctgcttcttctgatcagctcgctttttccctctccacttatccgactactttgtttttcgattccgacattttctcaccgtccattctcggcacatttaatggccaattgaaagtagcattaaactgattaataatatgcaattaaattggaaattattaaaataacgtatttcttattcccatttccgttgccttttcaccatcgattgtttgtgccgaatttggggccaaaactgagaaaaaagcggcaaatg

SEQ ID NO: 101864 - DNA, 353 bp, Heterodera glycines
  Promoter: Source sequence=SeqID_19965; Location=1394..1746; Strand=+; Gene=SeqID_84732
tccttcaattattaaatggctaattggctatttccagacaatttgcgctaaattattgaaacaataacaaaaaataaatttttttaatgtgaaaagataattaactaacgatttttcgacattcgaaaaaatcctggacctggatacaggaaaaagctagctacaaaactgcattcttaaaatgcctgtttctcgttttcagcaaaaaatatttttaatttacaacagaacgccaaataataatttaaaaatattttctataacttggtcaaacttctgctgctaattcaatttgcttgcagcttttgttttaaacctttcttcaattttagcactgtgtttttgtaacaatg

SEQ ID NO: 101865 - DNA, 145 bp, Heterodera glycines
  Promoter: Source sequence=SeqID_16831; Location=1344..1488; Strand=+; Gene=SeqID_81252
tgtgaaatttgaagaaaaaaataggacaaacaaattgctgaatacggaaattaaacaatgattagggctcgaaattatatggaataaaaaacataaaatatggactaagaaagaccgaaatacggacataaaaagcgcaaaaatg

SEQ ID NO: 101866 - DNA, 540 bp, Heterodera glycines
  Promoter: Source sequence=SeqID_38542; Location=807..1346; Strand=-; Gene=SeqID_67327
tatatatatatatatatatatatatatatatttcttcatttatttagatattttgtcccaacatattacacattttgattagcataggaatttctgttttttgtttcacattaactaaaagtggtggctgatttttatttatttttgcattcactgcttttggtttattaaatataaatcacaaaaatttccgtgcaattttcatttttaatcgaaagcacagaaagtgatgatgatttcatctttaatttttaaaaattaattaaaaaaaaagcgattttatgtttatacatattttgggatttacatatttttttttacattttttcgtacaaattttgcagtttttctttttatttatttttttttgggatttttaatgaaatttttcttaaatgcataaaaatagaaaatttcataattttttcgtaagttttgagatcttaaggaaagttcaaaagaatttaaaaaataaaatttttattttctttaaattttctcttaatatgaattggatgttaatttagaactaattatatg

SEQ ID NO: 101867 - DNA, 350 bp, Heterodera glycines
  Promoter: Source sequence=SeqID_13834; Location=1..350; Strand=+; Gene=SeqID_77774
gggagagagagaggagagaaaaagagggacagatagacgagagagagggcggaagaatgcgagagagaaagaaatgaaagaagagaaaactaaatgagaaaagtgattaatagagaccggacgggcccggcgagcttttaccgggcggcccggggcgcctggtaaaacgggctttttttgaacgggcgtcccggaccactgtaaatgtactttttgtaccttgtggttgctcgataaataaatatattcaaactcactttgcttttcccattttccttttctctcctcaggtggcactcgcctttcagctgaccctctcccagtcgggcgtcaacattttcgccaaaatg

SEQ ID NO: 101868 - DNA, 1003 bp, Heterodera glycines
  Promoter: Source sequence=SeqID_1936; Location=1301..2303; Strand=-; Gene=SeqID_76891
gcccaaaaaaatttttttgcgatgactcatagcttagggttacaaattttcaattttgtgtgcatgacatgacatgacgacaatattatctgaaatcaatttgccctgggataatcaatcacagcaccagcaaagaaatactaatagaggcacaatcagcgccacgtcagcgttggattaccctcctccttcggctgctgacaaataaatgatttgattgtgagtttctgcgattgcttttcccactgttttcattccttccaccaattttccctcccttcccttcacttaatgcttattcttccaacacgtcagctctacacatacacataattttcattcattcccctccctcctcccattttgtggtggtttctttctattcgtgtgcatacgttgcactatttcgtcaaatggtcgtctctccctcccgttttcatccatttcatcgctacccatcgaataaaaaacatatacataaaattaaagacggaaattaatttatgtatttatttgtttttgtgtgtttcccggtcattgaaaacggggctggttctgttcaacaacagccagtcagtcagccaaccagagcaaccacctgttcaagctgtccattcaatcaatcttttgttgttcatgtcatggctcccccccccccacctttccgtccgtccgcattctttgctgttcaaggtcatcaatactttaggagaggggtggagaaatttttttttgtttgttttttccgtcccaaaatacagggtacaaaaatagggaggagaaccgaccaaccgtggcggaaggaaggaaagaagagaggggaggctgacggactgtcaaactgtcagccactgattactgtcagtgtcagtttttattaaaccgaccgctgaccaaaaagtgtcgcatttccctgccccccgcccccattcatttgtgtttaaaaatgatcaaaaaactgatcaacaccccgggcaattaatactttaatacacccaaaatg

SEQ ID NO: 101869 - DNA, 1003 bp, Heterodera glycines
  Promoter: Source sequence=SeqID_3151; Location=160..1162; Strand=+; Gene=SeqID_83438
atgccaaaaacaaacaatgaacgggtccatccatccgtgacctttcttgaaggatttatgggcattaatttaaatattcaagaatgaatggatggcatggcttattttaggtagaagaagagagcatattttcatgatgaatagaaaaaaagaatgatattaaggacaaaagaaatcagagacataaaagaatttatgtacaaaagtggcttaatttttctcgtagagaaatttaaaatacggtatatatataatgtgttagattacggtataaaaaatatttacgcttactaatattccgattctagtctcataaaaataaccatttttatcttcataattcttaagagcgattctatcctcggcgggagggcataatgccaaacataaataaaaaaaattcgaattttgagtattttgttgcatttctgtctcccttcaattgctatggatccccggtaattgccccctaatttataattaattcgtccccatcatctcattataatttcctcccattgcccatttgaagggcgacccatcggcggcgggggatggacaacaaatatttaaatgcaaattaagcttggcgcttggaattggcgttgcgtcctattcatttttattggaaatgaaaattcaatgggccgattatatttgaaaattgtttcattgaaggaaatagaaacctcaccacatctcattgtgtaataattgttaaaatgattaaaatttaaacttagcatttaaattattattttttattattatttaaataaatttatttaccaaaattatttattgttggtaattccttaaattgataattaatggggaccgtatttttaatcagaaaaatgataattaagcataaaaaaatccctaaattaaacactgaaaagcataaaaatatggcaaatcgatgattaggcataaaattgccatgattttggtttattaaaaaaaaaaaattagaattacagaaaaaaatatgaaaaaaatg

SEQ ID NO: 101870 - DNA, 109 bp, Heterodera glycines
  Promoter: Source sequence=SeqID_39827; Location=1298..1406; Strand=-; Gene=SeqID_68312
tgcatttttgaaaaatatacaatactcggactagggcatcgggaaaatggaaaccgatcaacccgcaacctttaaccaagaattttgttttcagacacccgaggagatg

SEQ ID NO: 101871 - DNA, 110 bp, Heterodera glycines; identical to SEQ ID NO: 98226
  Promoter: Source sequence=SeqID_10216; Location=388..497; Strand=-; Gene=SeqID_73345

SEQ ID NO: 101872 - DNA, 117 bp, Heterodera glycines
  Promoter: Source sequence=SeqID_2545; Location=1..117; Strand=+; Gene= SeqID_80310
cacagctacagcaatttcatttgttcagatgaagtgccgccgcaatccatacgcactcgcccatttggatggagctgttgtgccggtgacgtgggatcacccgacagctcagtgatg

SEQ ID NO: 101873 - DNA, 160 bp, Heterodera glycines
  Promoter: Source sequence=SeqID_8623; Location=2009..2168; Strand=-; Gene=SeqID_68707
tacaccaacggtttccgaggggcattccctcctcttcccttcccccccttttttcccttccccccgtgccgacaacagccgccgacaactgcgccgcccgcccgttcgtgccgtcgactcttggccctgtccgttcgtgcgccgactgttctgtgccatg

SEQ ID NO: 101874 - DNA, 431 bp, Heterodera glycines
  Promoter: Source sequence=SeqID_6166; Location=955..1385; Strand=-; Gene=SeqID_60569
tttcgggttggcacttaaagaatcaatcgatacgattaacttaaaggcctaaaagcaaattgaattttggaaattaatttccgaagcgattgccttccccctcttttgattattgaaaattgagcgaaatgtgtggacgaaaaggaatggaaagtggtgaaagagtcgcagcacaaaactgcgctgacacaggaggaagtggcggccagaagaaagttggacgattgtgtggccacgttgggccatgaggtgccgggcaaagcgttggcctctgagaatcacccccaacccccccccccccgcaggcgatcgttgccgccgattcactgagccttcggccgacttttctccgttggcccctcctctcccacgacttatcctccgccgtcccggcaaatccattctcaaacattccctctaccagcacaatg

SEQ ID NO: 101875 - DNA, 1003 bp, Heterodera glycines
  Promoter: Source sequence=SeqID_11374; Location=706..1708; Strand=-; Gene=SeqID_74763
atacgaacatgaaacacgaaacgatcaacaccactggtttagaccagggatggaatccgaggcatcaaaaaattttcggaagttggaagtaggaataccgaccccaaaatgtcggaaatctcggaattccgtgccatccttggtttagacgttgatatcactaataaaaaaaatttaaaacatgtgattggcctaacaagaaatcattgtcttatttaaatatttatttttaagcttaaaatatattttattaacatcacagcatttggtatccgccgaaaattttcaacaaattattaatttatctgttaaaattaattttaaaaataaacaaaacatttagatttattctcatttaatattttttcttccgctaaatttaggtgaaattttatggaataatcattttagccgagaaaattttcattttaacgtaaaattgcataataaaaaacaatctatgcattaaaacattttttcaagttttaaatcaatattttgatatttttggggcttttgggaaaaaaacagaaaaacgaaaactattaatcaacatttttaaatattttaacatttttctctccatttcacaaccattaatataattgaaaactttattttattaaaaattggacagaattgaatttaaaaaaagaattctcgattttattttgagatggtatcttttattttatcataatttaacggatgcttcttgttgagttacctaatttatttttttaatttctagaaattaagtgaaatttatgataccttgttccttatctgaatttcaaatttttcttgagatatttgttggtccactttcacgtttttgcctctcaaatttttgcccaattttttttttgtaaaatttttcggtttctgttgaaattttcgggtcaagatgaaatatgagactctcgcacctctctaattgagtaatatgatgaaaaatttaaaaaatttacataaaaatattcagaaaagagaaaaatgaatg

SEQ ID NO: 101876 - DNA, 932 bp, Heterodera glycines
  misc_feature (22)..(22): n is a, c, g, or t
  Promoter: Source sequence=SeqID_9255; Location=1..932; Strand=+; Gene= SeqID_70767
ataaaaagtagaataatttaanttggaaagtaaaatttcatgctttttatagaaaacaaaatccaagccccacatcgcatggcttttttcgcgaccgatgggatttaaataccgaagccgacaaccaaacttataatccttatttcgtcattattttcgccacttggattttgagaaatttcttaacaaaatgtggtggaaacaaagtttaaattttctgtaaaaacagatataggtgtgagcgaaagtgcaaattggaaaagcagcagcgccgatttgcggggtcgacattttgatggatgttctgctgtttgactttttatcatggccaattatcattagggctgggaatttaagtcaaatgactttttttgatgactctaaatggccttaaaatgacttaaaaagtgttctaaactttgtttgaagcttctaacatgcatttttatgacttttttacactttttgggatttttataacttttttgagttttttttttgcgaattttccgtgattttttttaactttagcctaattttttaggacttttttgcattttatacgtgcttttttggggttttttttattttactttttggctattttttcaggacttttttcaatttttcatgccttttttatgcctttttggcgattttttatgacttttttagtcgactttttaagctttttcgtgccttttttccccagctctttagatgaaatgcaaaaaagaaagggaagcataaaacggtgaaggaaataaaaggacgcacaaatgcacacgtcacaacacactctctgctcactgtccgaggatggcactgacagtgggggagagacactcgtaaaaaggcaaccaaaaacaaactcaaccaaaccaccaaacgcaacagactgaggaggtcaaatcaatgccaagggacaaatg

SEQ ID NO: 101877 - DNA, 1003 bp, Heterodera glycines
  Promoter: Source sequence=SeqID_9053; Location=1576..2578; Strand=+; Gene=SeqID_70113
tttttttgtctcacttcttctctctctctctctcttttttttttgcttcacaatcgttcaagtatttttataaattagtccttattcatttgctaccaggactttttcttggttatttttggcttccttcactctcttttcctattctctctctctcctacaaataattgtcaaattttgtcaattttcgatgcagtaagcccctttagcatttggactagcccggggcaaatttcgttcttcttttttctgcatttttaaaatccctttagcttttcgctagcccggacaaatgttctcacctcttttctcttcgttttaatgtccctttagttttcgactagcccggacagaaatttaaaatgtcagacttctttacttgcgtgtacacgtctttgtttctagccctcaggccagggagatctcccacaaacttctgccggcttacccaattctcagcttcgtcgtcaatgatgtgtcgttgtttcccaaaatgggaaccatccggtgctaccagtgagggatgcgcactgtgcccccagaccaactatgcaccgtttatcccggatggagtttgggagggaatggggaaaagccaaggcgtctttgaccaagccccgaacccccaaacgactaattgactgttaaagatgtgtttattcattcgatgttggatttaaacgaagcgagaaatcggaataataattgaagtctgttccatcactactactgactaactgatcactggggaaagagaaatgcgaagagaatgggcggagaaacattacaatgagaaaaggaaaaacgtgtgaaaaggataaatgtgattgaattgataatggccaatgggaaataattaaatgagggaaatgcgtcgaataatccttacattattatattttttaccgattccgaaccatgaaataaagataatctttacggccaaacgatactcatcaatgaaattctgtccagaaaatgcgatgtaaacaaatagaaaatg

SEQ ID NO: 101878 - DNA, 54 bp, Heterodera glycines
  Promoter: Source sequence=SeqID_43588; Location=1039..1092; Strand=-; Gene=SeqID_71223
tggagcggccatatttgaagagaggcttaggcaagatccaattttgtattcatg

SEQ ID NO: 101879 - DNA, 556 bp, Heterodera glycines
  Promoter: Source sequence=SeqID_19345; Location=989..1544; Strand=+; Gene=SeqID_84079
ttcttaagggtgtatttattttcgtctttttcgtccaattttgctctgacgaaaacgaaacacgaaacgaaaaacaaaatttaaaaaccgaaaacgaaacacgaaacgaaaaacaaaattttgaaaaccgaaaacgaaacgaaaaaactttggtagacgaaaacgaaacacgaaaacgaaacacaaaaagtgccgaaaatgtaggacgaaacgaaatttcgtccatccctggttggcacataaaatgattatgggtcgcataaaatgattatgggacacgcataatatttcatgggacgcataaaaccgaccagaaccaaaaaactgtatagtacactttttgcatcaaaattcctaaaattttagcatttttaaaatacttggtgctatgtggaaaattaatttttacaaaatttgatttttgtacttcgaagaaaaaaaataataaaaatatatttaatattaaataaaacttttgggaagttgaatttgaattttattcaacctaaatcaatattattccattttggttatctcagggttgccatcgtccatg

SEQ ID NO: 101880 - DNA, 148 bp, Heterodera glycines
  Promoter: Source sequence=SeqID_7555; Location=3933..4080; Strand=-; Gene=SeqID_65197
agtcagtgcaattgcccgcgggggggggggggggggttgagaagagtggacttgggcatgggcagggaacggactttggcacgggaaaggaaagagttaaaccaggggccatggggacacagccaccttcaggatcatctcccaaatg

SEQ ID NO: 101881 - DNA, 240 bp, Heterodera glycines
  Promoter: Source sequence=SeqID_5441; Location=3725..3964; Strand=-; Gene=SeqID_58056
ttttcaacccccctcaaaagaagggctttattttttgggaggtggctataatttagaaggcttcatttcagggcgggactctaatttagggggggggggggggggagggtgctttattttttaaaatacttaattttacaaattcataaaaaaattttcaataggtagtctacgataacccattgtttgaacaaactcgagaccacaaattgtggcaaacggaagagtacccacaaaatg

SEQ ID NO: 101882 - DNA, 470 bp, Heterodera glycines
  Promoter: Source sequence=SeqID_2064; Location=440..909; Strand=+; Gene=SeqID_77631
ttataataataattgcagagaaatacaattgttgaatgattacagagagaatgaaaatgagtgttcattccgtctctatttataaaggcgtaaagacaaaaaatgggtaattaatcggcggcactaattgaaaattgcctgtttaattaatgcgttgggctgatcatttaagccttaaatgggagttaattaaggcgggtggtttgacgtttaacttaatgctatatcttgttaattttccggctaacactaattgacacgaatcgctttttttgttcaaaaaaaatgtcaaatacaaatttcagggaaaatttttttgtataaaaatggaaaattttatgcgttttcttcacttcaacaattccctattcttcacaacaattatttgttcgtctccaagtctcgtcaaacgtctgcatttattgttcatcaatccttcatcggttgccacccgcgcgcacttcaaaatg

SEQ ID NO: 101883 - DNA, 661 bp, Heterodera glycines
  Promoter: Source sequence=SeqID_21032; Location=688..1348; Strand=-; Gene=SeqID_51614
aataaaacatacaaaaaagagattgggaggggtccagggacggtcccaggatttcggctgcttggagggcgtacctccgggcgacgaccttctttttcttttttttgcttttcacaccacttttttttgcggcagtttttccaaaaacttttggggaacaggggtccgcggcggtgccgataggcgccgccgggaaaatgtttgcattttataatgcgatttgttaacgaattttgtccgaaaaaaattttgtgattttgagtagagtgccacgggaccgggaattttgggcaaacccgggaccgggaccctttcgggttgaaaaaccgggaatttttggctgggaaaaccgggaaaaaaccgggactagtcccggtcccggtcaaaaccgggacctcggtattcaaatatgtaagttatgacatgaggaactcaaaaaaacaagtttttttgaacatttttcgacattactttcttgaagcttaacgaaattttttgaaattttgcaggcatagaaaattcctaagggctattgaatgatatcaagaattttaatttttgttatagtgggcaaaaaagctaaagaatgattaattaaagcttttaaaatctataaaataacatataataattagttttttttaaatatgatttagtgatg

SEQ ID NO: 101884 - DNA, 80 bp, Heterodera glycines
  Promoter: Source sequence=SeqID_390; Location=1780..1859; Strand=+; Gene=SeqID_51213
gggtgctccattgggataattttaaaaaatcaatttgaatggggaagaacgaaaaatggcttttaaccgaagcaaaaatg

SEQ ID NO: 101885 - DNA, 1003 bp, Heterodera glycines
  Promoter: Source sequence=SeqID_13152; Location=71..1073; Strand=+; Gene=SeqID_76965
atcgcctaaaatcttatatttcattttgtggtttttcgataggtcaatgaggctaaatttacaaaatgaggctttgaggttttttgaggcttttgaggaaaatcgtcgtaatctgttaaatttatgattaatcgataaattggcataatgtatgagaatcatttaataatttgcggaaccctcagttcggccccacggttcggcaccacctcgtttttccacgatagcttttttatttggcatccaaatcaaacaatcttggtatcattcgaaagttcgtatcatgctctattagcctaacaaaaaataaaattcaagcctggaaaaaaaattattgagaaaaaacttgaatttttgacttttttgcagtttcatgttataactaatttggtaattgtctaatcgctaagcaatagcttagataaagcctctaaacatattaagctttcgaaagataccaacaacattggatttggttgacaaataaaaaagttatagaaagttatattggaaaaacatgctggggccgaaccgtgggggccgaactgacgtagaccgataatttgggtttttaatagagcatcaaaacgaaaatcacattcaaattttccaaaaaaaattgtttttcataaaaaccagaaaatagtcaatttttcccgaaaattctcaaaattaagaatattttcaatgaaaatatgctaatggtcaaaattcttaattttcgcaccctaaaaatgctcaaaatcgcaaaattttgccatttttttggacaactctgttaacgaatcgtattaaaaattacaaaaaatttttccggtgcgtgcctatcggcaccgccagccccctttccccctaaagttttttggaaaaagcgccgcaatcatgcttagatttcataaaaatcttatttttatataacaaatacattgaaaaagatataacatttgaaaattttaatgtgttttgaaaaatttataaaaattaggctttttgatccaaaatg

SEQ ID NO: 101886 - DNA, 171 bp, Heterodera glycines
  Promoter: Source sequence=SeqID_19235; Location=2119..2289; Strand=-; Gene=SeqID_83979
ggtattttactggcttttccttttcttttgggtcagtttgatacaaattaatacggaatttgtgaattataatacttattttatttgttgccacagaagtagattcattgtattcctatgttttctttcggattccctaaatcccgaattaatgcttaaaatacaataatg

SEQ ID NO: 101887 - DNA, 63 bp, Heterodera glycines
  Promoter: Source sequence=SeqID_11110; Location=1171..1233; Strand=+; Gene=SeqID_74450
cctttaaaaaaaattaaataaatatagttttttaattaattaagttgtttaattttagtgatg

SEQ ID NO: 101888 - DNA, 246 bp, Heterodera glycines
  Promoter: Source sequence=SeqID_4175; Location=1..246; Strand=+; Gene= SeqID_53469
tgaaattgaactatcgatttaatttactaatattttttgttttttaaaaagtttggaggtattcggccggtctccgtccctctaattgccgtgttaattaattattaattaattaattaatcacttcaattgtttctcttcctttgcaatgtgtttgattttatttgctcatttctttcttccttttgctccgtcattcttctttcattcatttcgaattattatttattttttgttgtgctaatg

SEQ ID NO: 101889 - DNA, 353 bp, Heterodera glycines
  Promoter: Source sequence=SeqID_19965; Location=1392..1744; Strand=-; Gene=SeqID_47622
ttgttacaaaaacacagtgctaaaattgaagaaaggtttaaaacaaaagctgcaagcaaattgaattagcagcagaagtttgaccaagttatagaaaatatttttaaattattatttggcgttctgttgtaaattaaaaatattttttgctgaaaacgagaaacaggcattttaagaatgcagttttgtagctagctttttcctgtatccaggtccaggattttttcgaatgtcgaaaaatcgttagttaattatcttttcacattaaaaaaatttattttttgttattgtttcaataatttagcgcaaattgtctggaaatagccaattagccatttaataattgaaggatg

SEQ ID NO: 101890 - DNA, 961 bp, Heterodera glycines
  Promoter: Source sequence=SeqID_18122; Location=1..961; Strand=+; Gene=SeqID_82702
tgcttgggaagcacttgatggaaaaaaccagggttgcgaccccgacgtcggggtaggaaaagtcggggttcggagttgtcggggttggaagcgtcggggttcggggttgggatgaccaaatcgttcggggtaggggttcggggttttttttttaccttatgccatatagtcaaaatttttttattattttttctgaaaaaatatttattaatttccatataaataattttatttgtttattttttatatttttttatcatgaagatttttgtataaaattatatttttcttgaaattttaaaattttttttttcggcgacgtttgtctttttggcggcgactttttgctgcatcgaatttctgcataatagatgaaattattataaaatgttatgatgacaaaaaaggcaatttcgagaaattatatttaaaaaaatgaatttatttaaaaaatgagcaaaaatttctgattacttttttgtttttcaaaacatgtttttttcgcggcgcgctttttctaaagaattttagggaaacgccgccggtattctaacatttttcaatttaaataaattttgtttttcttcgatattttgtcaaaatattattaaattttcatgatttgagttatgtaaaattgaatttttaatttcaactaaggatttagaaaattaagggttaatttgttaacaaattaagccaagaatggtcgatttttatgaatatttttgtttaaaaatcatattagtgaataaaaaaataaattaaaaaataccaaccggtatcgaactcatgacagaaagtaatgtcagtgtgaagaactaaccattacaccacattccgaataaacaaacaaacaaacaaacaagtaaaatagcaaatttacttgattaataaaaatttcgcaaaatggtttaaagaaattcaaaagcgtcggggtcggggttaaccccgaaaaatg

SEQ ID NO: 101891 - DNA, 799 bp, Heterodera glycines
  Promoter: Source sequence=SeqID_25320; Location=1..799; Strand=+; Gene=SeqID_56073
acccattcattcttaggcacgtattgaggctcggcaacacaaactaacgggtaattggaatgcaacttggaacctgaaatacgccgaactcaaaaggccgactcgagtgggctcaaatgggaaatttggttggcaattaaacataagaatgtccaaatgattccatttttaggcattaagctcaggctgaagaaggagaaaagggggtttttgtttttctcttccaaagatgccaatgtcaaaagcaaaattgtgcaattcggtgctgaacacgtcgcgcaacgagtgtttgagcacattcttcgcgcctggaaatacggtgtcgcggattaacgttattttgcgaatgaatcccactctctttctctcccttctttcgccttttttgcttttcaattctaatcaatgcttttgaactttgttctcttttttgatcacgggtttatgccttttgctttacattcttctcgctttttgcagaactttcatggactatatattcataaaacacattacgtatttatttattcatgaataaaaaaaaagttatcagaagggcaaaaccacttactctgacgactgttcagataatatgtcgtagagtaagtgataaatatatggatgaccaaaaataaaatcaaaatatattaataaaatgaggtcaaagtcaattgagatcgacagtataaatgccaaatcacttaaaaattaattctgtttttgcttttccgtttaggtaaataattaatacccttaaagaaatcgaatcatttattcattgagaagcttgtaaaaaatg

SEQ ID NO: 101892 - DNA, 263 bp, Heterodera glycines
  Promoter: Source sequence=SeqID_10297; Location=2313..2575; Strand=+; Gene=SeqID_73462
aaaagccaattttcatctttgtaattcattttgggtttttggaattaagatttgaaaagattgcatttttagtccaaaaataaggtaaatatgaaaatgagaaggaaaatgtgtaattaattacacagctgattattttgcataaaatgggaaaaattttgcttttcccgcgcccttttgttgttttttttcattttgagatgtaggaacaaaacagaaattacctataatttaaccaccttccatctttatgcagatgaatg

SEQ ID NO: 101893 - DNA, 96 bp, Heterodera glycines
  Promoter: Source sequence=SeqID_31054; Location=1597..1692; Strand=-; Gene=SeqID_61431
ttaaattattttaattcattttaaattataattatttcttattaattcaactattttttactgtgaataatattttattatttcagttccaaaatg

SEQ ID NO: 101894 - DNA, 220 bp, Heterodera glycines
  Promoter: Source sequence=SeqID_13042; Location=402..621; Strand=+; Gene=SeqID_76823
tttttggtgtcacctaaaaatcatttaaatgaaatcgaattttaggatgcattttgtgcgtttatcgacgcgacatgtaaaaacctataattgcataaaaacatatattaattatatataaattaaactaaatttaattttaattatacgaaaattttattacttttgaaatttattaattatatttatatatatatatttttttatgttaaaatcaatg

SEQ ID NO: 101895 - DNA, 319 bp, Heterodera glycines
  misc_feature (152)..(152): n is a, c, g, or t
  Promoter: Source sequence=SeqID_43731; Location=1..319; Strand=+; Gene=SeqID_71336
caaacggtgtaacagagcgcgttaatcagaccatactaggaatgctacgaaggtcgacttattcagctgggaatgggacgaaagactgccttttgtagtgtttgcctataattcgacaccatcagaagtcaccggcatttccccccaccatntaatgtttggcaaaccaataaacttcccattggaacatgaattgaaattcagcgtaaatccgctttacacaatagaccaaaattcgtatattcaactttttcgtgagtcactaatgcaattagtggacgaagcgcggaaaaattcccaaataagtcgtgcaaaaatg

SEQ ID NO: 101896 - DNA, 598 bp, Heterodera glycines
  Promoter: Source sequence=SeqID_18812; Location=2293..2890; Strand=+; Gene=SeqID_83495
tttgtccttaaaaacgatgttttctttctgcttgattttgtttgtccttttttagctgacatattcgtatataaacaaaattttagattaattttgatcatttcttattttctaatttgctcgtagattttcaaatttcccattttttgacattttgtacgtacctattttggtttttataatccgggctccaaaaaactatttggcttaattaggcaaaatccttggtcaaaattccataaatttcattttgttttttgcatttaagatgtacataatatattaaaatcgtccgtggtttttacggttggcttctccgttccttggattggattaaccggcaaattttacaccgactctctctgctcataatcgcgtaaattaattaactgattttttgttcattttaattttctgcatttaggaggacatgataatcgaaaagtttccagcagatcgtcaccctggactgctccagcgtttgaacgaattgaaacggagcgaaaccgtttacaacggcggagtgttcatcttgttcacaattccttatcggtagggcaaaaatgtgaatgttgatcattaattctattacccaatg

SEQ ID NO: 101897 - DNA, 168 bp, Heterodera glycines
  Promoter: Source sequence=SeqID_28500; Location=1589..1756; Strand=-; Gene=SeqID_59110
gttaaacaaataataaattgtataaaaacgagaaatcatgatcattttattcaacatttataattattttaataacattttaaactattcagacgatgatgagaagaagttaagaaatggacgccggagcaagtggttgaatgggaccagcgttgctatggaaaaatg

SEQ ID NO: 101898 - DNA, 144 bp, Heterodera glycines
  Promoter: Source sequence=SeqID_3234; Location=1636..1779; Strand=+; Gene=SeqID_83819
ttttgaccgctgcccacgcctttctccgcttcgatacgattgctttcgacaaatgtaagttagtgagtcggcccctttcagttttatgccatcttttcgcagtgtttacggttatcgcaacttcgagacgattcggcacggatg

SEQ ID NO: 101899 - DNA, 524 bp, Heterodera glycines
  Promoter: Source sequence=SeqID_45522; Location=828..1351; Strand=-; Gene=SeqID_72804
tttcgaattattagggcctattttctaggtttttatttttagtcttaaaaacctcaaaaaaaattttattaacctattttgatcttttttggcgttttgttcaaaatttattaacaaaaatgcaataaaacgaaaagaaaacatcccctaagaatcggccctaaaatttccagaaaaaatacaccccttaagaaatgaaaatttttccaattctcgaaaatttatttttattttgacaaaattttttatgtatcgcaagcttaattttgttcgctttttaaataaaattttgtcattttctaatcccctaaatttgagaatttttaaagcctattttctttttttaagtgcctattttttattttagagcctaaaacctaattattttggcaatttttagagcctaaaatataagccctaaacataataaattttttacaatttgtgccagtttttttaaatttagcaatttttttcatttttggtggctgttattgctcaacatcaatatcaatatcatcatg

SEQ ID NO: 101900 - DNA, 151 bp, Heterodera glycines
  misc_feature (15)..(15): n is a, c, g, or t
  Promoter: Source sequence=SeqID_21218; Location=1078..1228; Strand=-; Gene=SeqID_51807
ggtggtttctgcttntcgcattgtgaccagcgcataatttgccgttttctttcaggtaaaggtggcagactttggcctcgcattcaaaggaccgtcgaagccggtggaaacgggcaagccggtgccgatcagatggctgtcgccggagatg

SEQ ID NO: 101901 - DNA, 663 bp, Heterodera glycines
  Promoter: Source sequence=SeqID_15099; Location=2375..3037; Strand=-; Gene=SeqID_79277
gaaaatttgggtgcaatttgttaacagattttcaacaaaaaaggttggtttttgcgattattaagctcaattggtaggattttcatttaaaaaaggataaaatatgtatcaatttaaaaaaactatgagtaatcatattttctttataggaaacccacgagtatacaagaaaaaaaattgaaaataatctaatttctgtagagggattgaaccaggggaaagaagaagggacagtcaaggagactagccattaggccatttgcacacttgggcagtgttacttttaaagaattttagtaaggctaatagagcatatgaagagctttcgaatgataccaacaatcttggatttggatgccaaagaaaaaagttatagcgaaaaacataaaaatttttgaaaatctgcttgtttgtaatacattgtaaattgaaaaaatccgcttattgtaatacctggcatttaaaaaaacgcattagtatatttgaaagatggatacatcgattattgtaattacaactcgccttttgtccccttctccccttgctgcttttggtgtttttgttgtcccttcaattcaccgattcaatcaaaattgccttttcagtaataacttaaattggaacaaatcctattaatatttgacagtaattataataataatg

SEQ ID NO: 101902 - DNA, 543 bp, Heterodera glycines
  Promoter: Source sequence=SeqID_9053; Location=5443..5985; Strand=-; Gene=SeqID_70114
tttttgtgaaatttaattgtatatggaagcagaaaagcctgtgagaagcattgcgttgtcattttcagctaattgagtctcagccgtgggagtggggagggatgaaaatataattataattaaatttttttaaagtaaatgccaaattaaagtgatcactcaattgcaaattcaataattcactataactctgccaaatgaaagtgatcactcaattgccaattcaataattcactataactctgccaaatgaaagggatcacacaattggcaattcaataattcactataattatgcacaattaaagtgatcacgcaatttccaattaaataattcactataactctgccaaatgaagtgatcactcaattgccaattcaataattcactataattatgccaaattaaagtagtcaataagtaggattctccccataaaagggctgccttgatagtggtgaagtaatatattcaccacattcattcattcctaattgcacccttccattattttcaattgccagccaatttatcgcaaaatg

SEQ ID NO: 101903 - DNA, 1003 bp, Heterodera glycines
  Promoter: Source sequence=SeqID_336; Location=4116..5118; Strand=-; Gene=SeqID_83071
taggaattgcatatataaatttttaaaataaaatgatgttttacaattgtctaaaaagcttcctagccatattgttttgatgtttttaaagtcaattctgaatttttagataattattgcattttttgagagtaaaagccattttttgctgctctaaaggcatattttagtgcatatttggccattttttccccaatcagcatgaataatttttcgcaacaattttgtattccatcacaaccaccgtttcatcgacgaatatacctgatcttcaacaggaaatatttgatcaaaaaactggtgttcattttaaaaatttattttaaaattaaagaaaattattaaatacgcaacggaaaatgaaaaaaaaaattctgtttaataattaatgtatattatatttattttccaataaagttttcctcaaaacctaatacctaggcgttttgagcttttccaccggagttataaaattttttttactggattaatgtacggaggctgaaaacagcttatcatttttcgttccgacaaaaaaaatattttaaaaactttaaatcttttaatttacttaaaacattaagtttgagaatgaatcctttatgctacaagagttttctcttatttataaatcaacaagaaaaaaagattttaaaaattttataagtatttgttttatatattttctaacaaagtacccgcaaatgttatttaaaatttttttaaacatataaaactgggaaccctgctgagcaccaccactttcccaatgaatcacactcacagggtgctgtatgaacgaaaataatcactgacgaaagcattagccacgatcagcacacagtccatcaaatcatcattttttcatttcccaaaatccaataaaattaatttttgggtgcgttgattttcaaatgaattcatttttatttaggtttttttgctcaaataaagccaaaacttttgaccgacagataatcaaaaaacgaaaactcacaaaatg

SEQ ID NO: 101904 - DNA, 75 bp, Heterodera glycines
  Promoter: Source sequence=SeqID_6262; Location=725..799; Strand=+; Gene=SeqID_60915
ggtatttgcacggagcaaattattaaataaacattttaaatacatttaaattcaggggcaattgttccgacgatg

SEQ ID NO: 101905 - DNA, 82 bp, Heterodera glycines
  Promoter: Source sequence=SeqID_13708; Location=1503..1584; Strand=-; Gene=SeqID_77625
gaccaagcgtgacccggattttcatagcacatgcaacaaaaatgacactttcattggcgggactgaaaacattgaaaaaatg

SEQ ID NO: 101906 - DNA, 157 bp, Heterodera glycines
  misc_feature (41)..(41): n is a, c, g, or t
  misc_feature (71)..(72): n is a, c, g, or t
  misc_feature (100)..(100): n is a, c, g, or t
  Promoter: Source sequence=SeqID_40863; Location=1..157; Strand=+; Gene=SeqID_69103
acaaattatgtatatttatatatacaataggcatggatttntgatgcaaaaaaataaaaaataaataattnntaaacagcaaaatatttttatatattgncgcatagttactgtttttccacgcccaagtacaaatgaacgtttcaatttaaatatg

SEQ ID NO: 101907 - DNA, 1003 bp, Heterodera glycines
  Promoter: Source sequence=SeqID_22319; Location=149..1151; Strand=-; Gene=SeqID_52998
aaatttgcggatcccgctgcgggactggaactcaaaattttttgcgggacgggatcccgcggaattaatcccgcaaatcccgcatttaaaatttgcgggatcccgtgcgggattgcgagattttggaaaattcgaaaaaatttcaaaacatgaaaaatgttttggaaaaaatataaaaaatttcatggagggggagaaagccttagtgaaccctaacgacgcgacgcgttcaatggttgatgaagtgcgatcaaagggtttgatcacaaatttacctgaacttaccataggagcgaacagagcgccaatacgtgcctaaattttgggaatttttttaatggatttttgaaaatttaaatagaaaatgactgaccaccaacgagcacgaaccgactgaggaagctctgaaagaagggaaggagaagcaaaaggatgtttttgaaaatttttcaaagattttcaacagatttttgaatttaattttggtaaaatcacctgagcggagtaggcacagattcaactgaactaaatgcaaaaaatacaaataaatttgataagattgcttggcaattttttgtataacatattttctaaaagagagtcgccggttaaattaatttaataaaaaatcatcaagttgaggttccagacaggataatcagttacgctgatcgagagtcgtggtctcgagtcaatcaatgctcgaaaaaaggtcttggctttttgcggtattagtctcgggcctcgggaaatttggctctattgcacagtttacacgaccataaaaagataataaaatatttgacaacattaatgtaccttattttttgtagatttattatcaaaaatgttcagaaaaacccaaattttttcataactttttgctaataataaataaaaaatgaaaatttattatttcaatagtcgtcgaaaataaatttttttgaaaaataattttaatgagcacaattaaataataaaaaaataaaaatctaaggtaatg

SEQ ID NO: 101908 - DNA, 519 bp, Heterodera glycines
  Promoter: Source sequence=SeqID_631; Location=1..519; Strand=+; Gene =SeqID_57822
aaaatacgctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttgaaaaattttggacatttcgtgggtttttactcttttggacattccgtggcttggacactttgtgggggtgccataaaataaaataaaaaggtacatgcctcaaaatccggtcccttgttatgctgatcatcaaaataagtaaacaacacaaacaattttgaattagcgcgtctgaaatgcctttggcgttatgtttttatcttcagtggtttttgtaagatagtaaaggtaaaggggaaaaggcggagttcgagtccgttgcacaatattatattatttattattttttcggtctattaaaggcataaccgataaccctgtaaatgtcttcctatatg

SEQ ID NO: 101909 - DNA, 1003 bp, Heterodera glycines
  Promoter: Source sequence=SeqID_26492; Location=70..1072; Strand=+; Gene=SeqID_57226
agctggtcgcatttggggataaagacgaatgaatgggggggggggggggaattgtgacagcttttgcccgtccgtctcattattgtcaccaccaccccgtccgacttcatcatcatttgcgccgtccttttgctgttcgttcggacatcacacatttgtgcccattacccccccccccccgcctttcgccctcaaaacccattcaattgaaaatgacaacaaacaaacaaacagaaacggggggggggcatttgcgctttttcttttgctgctttttcgcctttggtccgacagatggccacggcaatgacaaaacgtttttattttgcgtcgttttttcaaatgatcggatcaatgaatatctttggatttgatcacttttccttcttggcaaattcccttcctattattaattcgttcgttcgttcatttttggtggtgaaacttcattcattaggccacaattaataattttaaatagggtaaaatttaaaaggaaaactaaaaaattaaattaaatgcttaattagcaacggttcattgtttgtgtttcgtttctcaattgtccaattagaagcaattagcattttcatggacagctgttcttcccctgctgctgctgatttatttacctccaaacaacaaaaaataaaatatgtcgcgataattgtcccattataattgtgcaaaatacggccaattttggcaaggaatttcgacggacgaagccgagagtcgccctaaggccccttcccttcccggggctttaattgttcatttgggcaccgttcagcgcattacgcaacggtgccggagggggggggggaaattaagtggcataacgcaatttgctggtgatggacgggaagcaatgaatgaacgaaaaatgaaaaaatttggcacgaaaataatatttcaaattattcgaagaaatgtaatattaagaaatttggaacaaacaattagaaattatcaaaaatgacatatttttgttttcagaatg

SEQ ID NO: 101910 - DNA, 1003 bp, Heterodera glycines
  misc_feature (285)..(285): n is a, c, g, or t
  misc_feature (425)..(425): n is a, c, g, or t
  Promoter: Source sequence=SeqID_9928; Location=3178..4180; Strand=+; Gene=SeqID_72963
cgataaaattctatcatcaaaaataaaaatgcggcaattttttaactggtttaaaaaatttcaataatatatcaaaattttagaaagttttatatgggtataaagattcgaaactaatgctttactgtgcagcagggatggtacggaattccgatttccggtttccgacatgtttggggccggaattccgatttccgaaaaaatttagggagtcagaattacgatttccaacattttggataaaaagtcggaaattttcggaaattttttttttgagtttttttncaaaatttaacaatttttgtacaattttacaaaagtgggcaactgatcattggacattacgacagtgaatgaatgtcaaaacctttttcgaaactgttaagataaatttttatttttggtcgcaatgtccactgtacatnttgtctactggacattttgtccatatctgtccaaattactcaatttacacatatctgttacaattttctttggtatctggccttgcttaaagcattcaagcatttacatattttaattggttactttttcactaattgttctattgtttttagctaaatttatttatttttatcctgtttatcctttcttttgcttttttttgataaatcttttactgggagtaaactctttaatgggttgtcgctcgaaaaggagaaatgtgattgagttttattataattaatttttattttttgagaaaattttttttaaagggataatttttaaaataagtggcggattattcccaaaatgagcaatttcgacgtcatgaggtcgcgcagaaaccaccttcattgaacagggagtgttctcagtcatcatcaagtctcactataaattgatctctcaatgatctttgagtaatttgtttagtataaaagggacaatcactcacctttcggaaccgaaataaaagtgcaatcaattaattaattgagtcaagactctcgagccaagggtgtaacactacaaaatg

SEQ ID NO: 101911 - DNA, 193 bp, Heterodera glycines
  Promoter: Source sequence=SeqID_7810; Location=2968..3160; Strand=-; Gene=SeqID_66034
tggggttgtttatcagtgaatttatctctattatatttactactttggatcatttttgaactgaaaaaccctaattacttaaaaccgaaaaatcaaacatgggtgaggcgcaaacaactcctattaatctctttggtttttgaaaagcattcatttattatacaatatttcttcaatcctgtgttgtcaaatg

SEQ ID NO: 101912 - DNA, 68 bp, Heterodera glycines
  Promoter: Source sequence=SeqID_12551; Location=1639..1706; Strand=-; Gene=SeqID_76202
ggttgattcgaatgaatactgtatcaagaatttaattttgcttttttttacagaatgccaagaccatg

SEQ ID NO: 101913 - DNA, 57 bp, Heterodera glycines
  Promoter: Source sequence=SeqID_5667; Location=2118..2174; Strand=-; Gene=SeqID_58839
tcttacggcgttgaagacccgggctacgcggttgttcagttggcacagacgacgatg

SEQ ID NO: 101914 - DNA, 659 bp, Heterodera glycines
  Promoter: Source sequence=SeqID_14790; Location=1535..2193; Strand=-; Gene=SeqID_78933
ggtgggataaatggcaaaaaaaaagaaactgaaaaatggtggggccaaaataagcaatagaaaacttagtaaaggcatggaaatttttaggaatgcttacgatgaatgaatccatccaaaaaaactcattttccgctacaacggctctctgaccacaccggactgcaatcaaattaatggtataattatgattgatcaattagaaatcactattttgctgttttgtcacataaaatagtgaaaattcacttttttggcgttttgtcactatttttcactttttatgtcaatttgaaaatccatgcaaaattcccgaaatccgtccgggtgtacttcccgggcctctactgcagtttaagcgtccaattgttcacataaatacgagtccaacatttttttaattggggtgaccttcaaaacaggaaagtaccaggaagcacaactcctcgcttagtttttgtgcaaattttttcaaatatttcctaattttagactaaattattgtttttttcaatagaaccatccgctgaaaaaaagaaaaagcattcctccgccgaccatcggcccatttattctgagcaattggtgaaaatcagcagcaatcgttggtttcagttgtgacatcacttggacaaagtgttcgcgtggccaccaaaatg

SEQ ID NO: 101915 - DNA, 374 bp, Heterodera glycines
  Promoter: Source sequence=SeqID_5079; Location=3669..4042; Strand=-; Gene=SeqID_56815
ttttcgtggaggaatcatccaaaactttgagtattgtcaaggggtagtgtttatcttccgggtatttaactcgacttatcattcagcacatgtacattggtttaccaatcgagtagagtgtagtaaaattaacgaaggggtagagagaaatgaagtcacatagaaattttttcattccgtcttcaaatccgctcatttatttgttgctcattaacattttcgcgatctcgcagcctaatacacttacaactggatggacaacttgacttcgtataaattcataacgttttacattcctctcccgcactttatcatttatttttttcaattagacattaatatacatcttctaggtagcgctaattgcaggcatg

SEQ ID NO: 101916 - DNA, 682 bp, Heterodera glycines
  Promoter: Source sequence=SeqID_25643; Location=900..1581; Strand=-; Gene=SeqID_56390
gcgtaatttgttaaaatatttcttaaaaatgaaaaatccttagttttatttcttctatttagggtgggcatctagggatacggtaaaatgaatctacggtaaagagaacgcgagagaggaagagagggagcgaccgaagtgatcagaccacttcttcatgatgatcgagattgatcaagatttttatgttcccattgccttaattttattacagagcatatgtatattaaaaagttttttggcatttttgatttttatcttttttaatattttgctaattgtaattaatttttatttattatttcctttcttagccctcgggcgatcgattggcccaattttgcggtgcacccattttcactcaacagttccaattcaatttaattgtgatttattgatgtctgcgcaacccatttttaaatttcttattttctcagaagttgaaaaaaataattttttcattcatttattcaatggatttacttaattattttatttttatgtttatttaattaacgcaaattcattaagacattgacgtcaatggggcggggggaagaatggcataattaaattagaaggtcaaatgatccaattaaatttgcccgaaatggacactgatttccttcctcctaatttgtccttccattccatttcaaattttttcgatttttaaacgatg

SEQ ID NO: 101917 - DNA, 660 bp, Heterodera glycines
  Promoter: Source sequence=SeqID_20319; Location=1..660; Strand=+; Gene=SeqID_50825
tccggtggctggtaatttcgacactgggtaaattcgacactgagtattttcgacactaagtaatttcgacactacgttttcgacatagagaaatttcgacactgaactatttcaaaaactctcactgttttccagcattttcgacactggaccatttcgacagtgagtaaattcgacactattgagaatttttaaaaattaataagaaattttggtgttagtattaggtattatgataaattttcctatttcattttctaattcgtactttttaaaaggttaggttggtataactagagttggtcgggaccgggaaatttgacaaaaaccgggaccgggacttaccgggaccagaaaagtcgggaccgggaccaacttttttgaccgggaccgggatcgggaccttgagaaaagccgggaccaaccgggaattttttcaagagaaaattttttttgaaaaattttgaaaatttgagtgcactttgttacgaaaattgccaatattcaaaaatgttcccataaatattgtagtttcgttttgggggacgaattcgaagaaaatttttaaaaattttcatttcgggggggggggaatcttggattttctgagtcccaaaattctggatttttataaattaattaaaaaattttgcgaaaatg

SEQ ID NO: 101918 - DNA, 266 bp, Heterodera glycines
  Promoter: Source sequence=SeqID_31369; Location=323..588; Strand=+; Gene=SeqID_61733
tttctaaaggcacgcgggccttgacttatgaggtggatacagtagggccttaccatatctcatctttaatgattactaaaaacactagattaaatctttatctcgcgagaaatgtccgtgcgattatgttgtaaagtccaaaggcaaaaaaaaaaggattttaatattccggcggaaaattttccgtttatccgttacgacaaattgctcatttccattttattttttatcaataaaatgtttaaatattttaataatttagaatg

SEQ ID NO: 101919 - DNA, 169 bp, Heterodera glycines
  Promoter: Source sequence=SeqID_30434; Location=1..169; Strand=+; Gene=SeqID_60839
ccacatattggtcgatgcttcaatcgaatcgtccccatacccaaaaaattcattttgcattgatcagacctgacataaatattattacaaagggactgacagtcattaatagcggctcgcctgcgcgtgccagaaacaaataaaagcggcagagggcaacccaaccatg

SEQ ID NO: 101920 - DNA, 63 bp, Heterodera glycines
  Promoter: Source sequence=SeqID_22512; Location=1255..1317; Strand=-; Gene=SeqID_53178
tttatattttcatagggaacatgtttcgcgcattggggcatagccagaaattatcaaaaaatg

SEQ ID NO: 101921 - DNA, 381 bp, Heterodera glycines
  Promoter: Source sequence=SeqID_110; Location=1359..1739; Strand=-; Gene=SeqID_70628
gcgctgtgctattggtcgctgtcggcacttgtttggcaccgactgcgctccattcctacgcaatttccgtggtgccgtacgacgcctcgtgggaatccattgactatgtaaaacaaagccaataatggcccaatcaaattgaaaagaatgttttcaaaaaaaattgccaaaagacaaacggatcactcccgacccactgattcttggccaaaaaccttggttgaagacattgatacacttatcaaccgatcggttagcaaatctctgactaaaaattaagtcgcttggcataaaatgtaaaccgagagagggagcgatctaaaaagttaaaagcgctattaataaaccatctctaaaattgatcattttcagctgttgatg

SEQ ID NO: 101922 - DNA, 393 bp, Heterodera glycines
  Promoter: Source sequence=SeqID_44974; Location=1..393; Strand=+; Gene=SeqID_72376
aataaataaaaatataaaagaaatccgacaaaaaataaataaaataaaatgaataaaacagttttcttaatactttttggtttggcaatcggccaagcaaatgctaattgttgttgtctatctaatgaagaaaaacagcaattgaatgctgcgagaaaaaccattgaaaaagcatttcgggatacgctcagattaaatactgaagcccgagatttcgcggctgcatctcatagggcaattacggaggcagaaaaaattaaagttcgtcatcccgaggcaccgggcatgaaaacatggttcggtaggttattggaaggggtgagaaaagtacaaggaatttctgaaaaaataaatgaagaaaggcagaaaatagaccatattagaaaagaaatg

SEQ ID NO: 101923 - DNA, 1003 bp, Heterodera glycines
  Promoter: Source sequence=SeqID_13454; Location=284..1286; Strand=-; Gene=SeqID_77342
ctttatttaaaattaaattaatataatttcatgaaataagacactaaatgtatagagaatgaattaacgtggtcgattggaataaatggaaaaaaaagcaaagtcaaaacacaaaaccttaaagcactagccgattgaaataaatggaaaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaaccttaaagcactagccgattgaaataaatggaaaaaaaagcaaagtcaaagacaaaataggaactttatacaaatttaaaaaagtaatattttgtatattgtatatgcatttaatcaaatttctactttctttataaatgttagctaattagtcagcgtctatttattttctgtaaaaatttgcctctttatttaaaattaaattaatataatttcatgaaataagacactaaatgtatagagaatgaattaacgtggtcgattggaataaatggaaaaaaaagcaaagtcaaagacaaaaccttaaagcactagccgattgaaataaatggaaaaaaaagcaaagtcaaaacacaaaaccttaaagcactagccgattgaaataaatggaaaaaaaagcaaagtcaaaacacaaaaccctaaagcactagccgattgaaataaatggaaaaaaaagcaaagtcaagaacttattctacctaatttcatggtgactgacgaggcatttgactcccttaagagagccttcccttctcatgtacttgtacctaaaatgttgttggcacaaaaagtaaagggggaaaaagaagacaaatcatccgatcaagggctaagtctcaacagatcgcagtgtaaaagctgctctactgctaacaaccccctgaccagtagtcaagtcgtatacaagtgattttgcgccccgacgttccaccatg

SEQ ID NO: 101924 - DNA, 51 bp, Heterodera glycines
  Promoter: Source sequence=SeqID_32336; Location=1067..1117; Strand=-; Gene=SeqID_62650
agtgggggataaacgcctgaataatgtccatgccatgcactgctatagatg

SEQ ID NO: 101925 - DNA, 57 bp, Heterodera glycines
  Promoter: Source sequence=SeqID_36304; Location=1..57; Strand=+; Gene= SeqID_65649
ataaaaagcaaaaaaccattatacccgaccattctctgatcatttttaagcgtcatg

SEQ ID NO: 101926 - DNA, 73 bp, Heterodera glycines
  Promoter: Source sequence=SeqID_44150; Location=1138..1210; Strand=-; Gene=SeqID_71676
ttaagaggaattgccgcaacttcctgtcactggtgttgtgttgccttttaacagcggagtgaaaccgaacatg

SEQ ID NO: 101927 - DNA, 155 bp, Heterodera glycines
  Promoter: Source sequence=SeqID_3314; Location=2379..2533; Strand=-; Gene=SeqID_84179
ttgataatatttttggggtcgttgaattttgcgccgccgcaaatgtccttttgactgggcgccgcaagtgtcggcgccgcaagtgtcggcgccgcaagtgtcggcgccgcaagtgtcggcgccgcaagtgtcgctttgactgggcgccgcaaatg

SEQ ID NO: 101928 - DNA, 622 bp, Heterodera glycines
  Promoter: Source sequence=SeqID_1061; Location=4953..5574; Strand=+; Gene=SeqID_46546
ttctctgctagtgtcaatttggcgagcacaataaaaaaggaaggctaaaaataaaaaaagaataaaatacattaaagcttattatatgtaatccaacaaatttgattaagctaaaaatgagattttttttacaaaatatgtaaaaagcagcaggagaactcctcttgcgacagtcctctattgttgtaatcgataaaaaataatcgctctaatgacaattttcgttaatttttttcaaaataatcatgaaatttatgaaaaattttggcacccccacaaagtgtccaagccacgaaatgtccaaaagagtaaaaacccacgaaatgtccaaaatgtttcaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtgggctggacattttgtgggtcagcgaaaattttatttgttacaacgtttctacttttacatctgaatctataagtactacttccctattttaaaataataattattaagtgaattttcgacttatctataaatg

SEQ ID NO: 101929 - DNA, 91 bp, Heterodera glycines
  Promoter: Source sequence=SeqID_230; Location=2785..2875; Strand=+; Gene=SeqID_78828
ataaaaaacaacaagcaaacattggacaattgattaaagaaaattgtgattggctttgtgccttggccaggactaaatccgcaaaaaaatg

SEQ ID NO: 101930 - DNA, 412 bp, Heterodera glycines
  Promoter: Source sequence=SeqID_6262; Location=3038..3449; Strand=-; Gene=SeqID_60916
tctgaaactattttctatttttaatccatcagcacgctttaacatccccttttatagatttaacacaaaatacaaactgggcaaaaaattcattccatttgctgggagggtaacaaaattgtggaatcaactcgataaagaactaataaaaacaaattctctaaatcaatttaaaataaaacttaaagttcactagggtaatatgtaagaccgggaaagcaagaatgtaacaaatttctaagtgatttggtatttcgacctcatttgactttgacctcaatttatttattatttattttcacatatttttgtctttttttaattcctgtgatcatccatatattttgtcacttactctacgacacatttaccggaatagtcgtcagagtaagtggttttcgcccttctgatg

SEQ ID NO: 101931 - DNA, 739 bp, Heterodera glycines
  Promoter: Source sequence=SeqID_17086; Location=1183..1921; Strand=-; Gene=SeqID_81516
ccaacaacaaaggacggcaagccgaagaaggagtcggccaaagcgcgcagggcacgcgaggcggccgagaaagcggcgctggaacaacagcgacaacagcacgaggcggctatggccgcgggtgcgaactctcaaataaaaaatcttaggaattcttaaagaaaaattcaatttcgaattttttaaataaattttcggggggtgaaacgtagtttggggcacggcagcaactcaccaagtgattggtgcatcgattatcgaaaacttttaagacctctctaaatttttcggcgaaaacccaaaaaatttattggtaaatgtcggaagattttgcgaaattaaacaaaaaaatcaaaatattataccaaaaagcgagaaatttttgtaaaaaaattctggcccctgatggggcgagggaggtggggggggggggctaacacttcaaatttttggggtatcgctaattttcagggctaactcacttaaattttatgggacaaaaattcataaatttgtcattatattttgggacctcgcaaattttgagattttgcgcccgactcgttttttagactttataaatttatttggtgtctaaatttaattgtgcgccgtctcactattttttgttttgtttgggggttcccggctttgatcccccggcacgctttccaaaccccaatttttggcatactcatttttgaatttttccgcattttcagcagctgctgccggcatg

SEQ ID NO: 101932 - DNA, 580 bp, Heterodera glycines
  Promoter: Source sequence=SeqID_7312; Location=247..826; Strand=+; Gene=SeqID_64426
tttcgttcacctataaatcgtgctttttacactttttggattaaataatggttaaatgaatttaagggaataaaaaaggtcaaaatcgaaagccatttcctttttcttgactaaaaaatttttaatttcctaattttttttttgcccaatttccatcggttaaaaaagggcctacgtaatttggcgcatcttttgccaacggaaggccaactcgcgctctgatgtcacgcggaaagttgagcgtgggaggatagtgccaatttagaaccggaatgttagacccttcaaaaagggttaacaaacctaaaaattatttaaaattgttacataacaaattaaataattgaatttgaacccaccagccatgtgcccatcggtctttgaccgtaccattgaaattcccttaagacgaaaaatgccgggcacgcccagcaacaattggcacagcgtttgcacctcactcaaacattgttcagactaaagaagcttaaaggaaattactttgaaaaatgattgaattatcaaaattccactaacaattcgcaattctcaccacaattttcattttctcgagccaatg

SEQ ID NO: 101933 - DNA, 341 bp, Heterodera glycines
  Promoter: Source sequence=SeqID_6070; Location=1785..2125; Strand=-; Gene=SeqID_60208
tatttttccatatttcgccatgtttgaaacttataggacaacttttttttgtccatattttccatataatccatatttttccatatttcactttttatttatatttttcccatatttcgctatgtttgaaacttctaggacaacttttttttgtccatattttccatataatccatatttccatatttcgccatgtttgaaacttctaggacaacttttttttgtccatattttccatataatccatatttttccatatttcactttttcgtccatatttgttccatattcgcaatttttagggaaacaaaatttatccaaatatttttagcaatataatg

SEQ ID NO: 101934 - DNA, 330 bp, Heterodera glycines
  Promoter: Source sequence=SeqID_22788; Location=1..330; Strand=+; Gene=SeqID_53485
ccttcaattcactcatattttgtcgtgatttgtgtgctatctgtattatatatatattatatatatataaataaatgcattataattaaacatttttcacctttcggtaaattttcgtttacaaattttttaagttccatttagaagaaacgactaaaagtgatagagtacttttgatcgcgtccagacatttgcggacaatttcgggaaaaataaaaaaaatttataaaaaaaattttttttaaatgcaatgcaaaatttggactcatcacagaacgtttcttctaattttagatataaaaaaatattttgaagatatgcttaatcatg

SEQ ID NO: 101935 - DNA, 422 bp, Heterodera glycines
  Promoter: Source sequence=SeqID_26914; Location=1..422; Strand=+; Gene=SeqID_57653
atccgaatgagaagccattgattggaaagatgagaaccgcttctcgtgtcacaagtgtggagaacaaggacacattgcgaagaattgccggcaatgagaaagagtaagtccgtggaaatgaatggttaagaatgagtatgaggcccggggacggtccctaaggggtattggaggagaatgaccataaagagtgctttaaaaaaatcttttgcagtgggctatggcccaatacgtattttgaggtcacctgcgttgtctttcttttctcaaaatcttatttttgtccactattgtacctaactgtcttcttccgctttattttctattgtaaaataatacatttaacttttcttaatatgaaataatgactagtgagctacggcccaaaagtattaaaaatgacgtcaaatatttcagcaatg

SEQ ID NO: 101936 - DNA, 389 bp, Heterodera glycines
  Promoter: Source sequence=SeqID_13288; Location=2015..2403; Strand=-; Gene=SeqID_47121
cccgaaatttttcaaaaatataccccttagaaatgaattttttttcaaaaattcatctccaaaatttatttatttactttcttgacaagaatttttaattttaaaaattatttaggtatctcaatattaatttgccataattctgtagcttttttgaataaattttgtcattttacacgctaaattgaaagtttttagcaactatttccccatttttagcaactattttgggggtttattttggcgctttttagcaactataaatcgaatccctaattatcacaagaaatttgtaaaccaagagagtagtcccttttggttttaaaaaacattcaaaatgatcatttgttaagtagcaccgcttttcttattaagcggagaaaataatg

SEQ ID NO: 101937 - DNA, 51 bp, Heterodera glycines
  Promoter: Source sequence=SeqID_19901; Location=2044..2094; Strand=-; Gene=SeqID_84663
gcgtcagtgaatgcattttgcgatgtttttccaactgtcagaccaaaaatg

SEQ ID NO: 101938 - DNA, 122 bp, Heterodera glycines
  misc_feature (101)..(101): n is a, c, g, or t
  misc_feature (108)..(108): n is a, c, g, or t
  Promoter: Source sequence=SeqID_39591; Location=829..950; Strand=-; Gene=SeqID_68122
actgaaataaataaaaaagtaattgattggatttattaacaagcataaaagacttaaccgtataatattttagtttacagcaaatatttttttaatttaanagttatnaataattatttatg

SEQ ID NO: 101939 - DNA, 169 bp, Heterodera glycines
  Promoter: Source sequence=SeqID_17324; Location=1363..1531; Strand=-; Gene=SeqID_81797
aaaatccaggttgctgaaaaatgtcctggacatgtcctggatccaggataaatccaggcctgcatccaggtccaggtcgatctctagttataagtcataagaaaaatgcatgggttcgggtcggggatgataaaacttttcggatcgggcattcgggcagacaatcatg

SEQ ID NO: 101940 - DNA, 63 bp, Heterodera glycines
  Promoter: Source sequence=SeqID_8110; Location=472..534; Strand=+; Gene=SeqID_66994
aaataaacacaaaaaacacaataaaattaataaaattttagcgaagtcgaagcaaaacttatg

SEQ ID NO: 101941 - DNA, 348 bp, Heterodera glycines
  Promoter: Source sequence=SeqID_15643; Location=4184..4531; Strand=-; Gene=SeqID_79939
tttcctggattaaatggcacctctccctttctgtcctccttttttgccattggacccattaaaatgcatttggcattcatttcccatttttcgccattcattctccgccgattgtccgtccccccgggggagagaatgaaagaatgaatcacagcaaaagttccgtcgctcgcctccccccacttccaaagaatgggaaaaaggactttacattcaaaaaaaattcccattattttctattgatccgttcaaaattgcaaatttaatagcaaattttttgattctaattctacaaatgaatggaattttcttaattgatcggtaaatgcccttcaattttcagagatg

SEQ ID NO: 101942 - DNA, 54 bp, Heterodera glycines
  Promoter: Source sequence=SeqID_12749; Location=2468..2521; Strand=-; Gene=SeqID_76456
ggtacagaaatgggatttgtcttataattttcgtccaatattaagaaaaatatg

SEQ ID NO: 101943 - DNA, 325 bp, Heterodera glycines
  Promoter: Source sequence=SeqID_1914; Location=6056..6380; Strand=-; Gene=SeqID_76760
gagtttacttactgtaatttgtatactgtaaaagccgtgtgcactcatcaaaattggcggtgctttcccgggatttttgaaatggaccaatcgcaattttaattatttattttccttctaagaattttgcttttttcatttttttttcaccggaatttattttcgaccatatttatccacaaaaaatatcttcttctgctgattcaatttttgagctccatcaatccatcaatggcacaagtacaattacattaaaaattaatttatattaattaattgattaattaattgcctaattaattaagttttctggcgcgtgttcatg

SEQ ID NO: 101944 - DNA, 453 bp, Heterodera glycines
  Promoter: Source sequence=SeqID_34442; Location=587..1039; Strand=-; Gene=SeqID_64235
ttccattttttcattgtcccatttttggccaaatatttcagcaaaagttggccttatttttccattcttttcacataaattattaactgataaagttttgtcagttgaattggttatgaatagggaccggatttatatgtacagaaaaatccaaaatatagattataatattgacgaaaaattcgcaaaatatggacgaaatatgggtaatacatgaattataaaatttgataattgaggcatcctatttttctttactaaaaaaattgaatttacttagaaaaaaaaacaaaaattagtaaatttttgcaaaaaatcaattttacacgaattgctaatgaaaaattttttgtgtaatttttggaaattttcccaaaatttttcgattttagggcgtattttccaaaaatttttccatctatgggtggtattttctgaatttttgtgaaaatg

SEQ ID NO: 101945 - DNA, 288 bp, Heterodera glycines
  Promoter: Source sequence=SeqID_23587; Location=890..1177; Strand=-; Gene=SeqID_54278
tgttcttactgtgcatgcccaatacatcgttataccgtatacaagattcttggtaaacccaaaaaaaaaaaccccctgcttcttttctatcactaaattgtatttctctgttttttccattttttctattccgtctgtataattccatttctacagtaccctttgcagccaaaaatggtaccctgtcacagaattttcccaattattgtgtctttttactgtacaatctcaattttaccatgtccttcccagcaacagttaataaaattcccttaattttgacagatg

SEQ ID NO: 101946 - DNA, 412 bp, Heterodera glycines
  misc_feature (17)..(17): n is a, c, g, or t
  Promoter: Source sequence=SeqID_18678; Location=1..412; Strand=+; Gene=SeqID_83342
cgaccctgggtaccccnttttttcattccaattatttttctgataactcgcgctgccagtgtccctgctcgaaatccgcccgaaataattgtccaatattttgtcaaaataaaaattattatgacgattaataagattagtggaataattattaataaaattgatagccattttaaataattcactgcgtcttgtgcctttttggaatatttttcattatgtcaatccaattacttgtttttcccaaaattacgctcaatgtctcatttgcttcttcattaattagtctaatgacttctgagacatttgtccaatgtacgacacgtaaagttgaggaaggcaaataggacgaaaagtttctaagttttttgtgagcttatctataatgtctttttcagtcgcgttaaaaatg

SEQ ID NO: 101947 - DNA, 508 bp, Heterodera glycines
  Promoter: Source sequence=SeqID_8493; Location=2281..2788; Strand=-; Gene=SeqID_68279
gcaaacaaattttagctttgaaacatttaaatgttcatttgtggcaaaatcagcttttaaacaaaataaaagattgacgcttttgaaaaattcggttcaaaaatgggaatgaaaatgccaaaaatggaaaatggaagtggcaacaaagaaaatgtggaggaggaaattagcattgacacaaaaaatttatgattaatttctatttatgagccttttattgaaagcgtgggatcaaacgcatttgaattctgtgaataatctcaagaaatgtgcacataaaacccggcaaaagccttctctgtgtgtgtgcgtaacggacaaaaatccgtgtgaaagtgccaaatccgcttttaataacctccggctgctgacgagcaaaaaaaatttttttttgatttgccgtcgtcataagatgcgcagccgccgtggccggccgatgcgataatggaaccacttcactaattgctgacgaggcgcggcaggcacgggtaaatgtgtgccgccaatg

SEQ ID NO: 101948 - DNA, 1003 bp, Heterodera glycines
  Promoter: Source sequence=SeqID_5903; Location=2475..3477; Strand=-; Gene=SeqID_59623
aacgctttgtcgcgcagtttttttgacggtttaggcgttttcagcacctaaaaaaacctataaaagtgtttttacgcaatttcgaatctgggacctatgatgaatatttaccaaatcctttaatacgttggtaaatagagtgaaaaattgattattatagaagtaaaagagaaaatatattaatatattgttaaaattataaaaatatttacgatggcaaaataaaaacgaaatcataggattattttcttagtttccttttacaattatttatttcgtttaaaaaatagaaaatataatttatagaaaaaaataacaattttaaagattcccccattatgtataatgttaagattaaatgttttaatacataggtaaatggttgtgaaaaatgtattattatagaaagtagaatagaaagtagaagagaacagaataaaaagcatagcaaaacgtgaataaaaatcacattgattaataattttttataaaaattctagctaattccattttatttaatttcggagcaggacaaaaccttgtcattcgaattattgccggacgagtttttggaccataagtttttggcaaaaagttcgaaaaactaagtttttgggttccttctggccataacttttttttctttctcaattaaattaaatattcttggtatattcgaaagcacttgagtaactaactctattagcctgcaaaaactgaaaaattattattcgcaaacaaaaagggcaaaaaaaaagttaaaaaaatgggtttttgagttccttgtggccaaaaagtgttttgaaaacccaaaatgacttaaacgtgaaaaatttacaaaaaattaatttagggtttttgtatgagtgggttcgattcccagctgaggtttaacattttgcccatttcttattatatttaaaactaattataagaaaatcaattggaatgccattgcatgaagccaaaattcctgctggttgggcaaggcgaactccaaatg

SEQ ID NO: 101949 - DNA, 158 bp, Heterodera glycines
  Promoter: Source sequence=SeqID_2641; Location=1802..1959; Strand=-; Gene=SeqID_80860
agacaacagagggcagacgcctcagatttcttttcacccatttcggccgcaactatggggatgaccgctgaatatctaaaacccaagcctaagccgagacaacagccagttgatgcctccaacttcttttctcccatctcggcagcaaccatgggatg

SEQ ID NO: 101950 - DNA, 211 bp, Heterodera glycines
  Promoter: Source sequence=SeqID_24022; Location=692..902; Strand=-; Gene=SeqID_54727
tccgactaaaatttccaaaccgtaaattcagcaacagatcgtacccaaaaaaccatttatacttttcattttacacatacatattttgtagcagtgaatatatctaattttacaagaaaatacttaagcaaataaaagaaaaaatgcgcaagaaaaaaataatatttgtatttgtgtggtaaagttaaggaatagaaagtgtgtaaagatg

SEQ ID NO: 101951 - DNA, 267 bp, Heterodera glycines
  Promoter: Source sequence=SeqID_34614; Location=664..930; Strand=-; Gene=SeqID_64360
attatatatttcttctatcttttcattctgtttgtgaattgtttctttccactatttatatattttttcattaatgcgtcgaatttttttattatcattttagcatcgtcttgattatatattgtttctttcatttaagtgaaatgttcattaaatattattttgtttaatcaattattcttaaattaattctagacttcatttactttttaaattttacttattttttatattgtaaaaattaattaaaaggaaaactcaagtatg

SEQ ID NO: 101952 - DNA, 86 bp, Heterodera glycines
  Promoter: Source sequence=SeqID_7472; Location=355..440; Strand=+; Gene=SeqID_64933
ccttaatgatttatcattttgggataattaatttttgaataaatcacccagctcgcggatgttcaggctgtgccatgccaaaaatg

SEQ ID NO: 101953 - DNA, 97 bp, Heterodera glycines
  Promoter: Source sequence=SeqID_27812; Location=1897..1993; Strand=-; Gene=SeqID_58478
ccagtgccagccagccttcaactcaacgcaacatcaacaccagtgcgcgccaagctcgtctacacatttcgtcgcgacaactcatcacttcatcatg

SEQ ID NO: 101954 - DNA, 163 bp, Heterodera glycines
  Promoter: Source sequence=SeqID_31931; Location=1581..1743; Strand=-; Gene=SeqID_62248
aaatttttacatttaaaggccatcaaaacaaacaattcaatgattacggcagaacatcacgaaaatcgaaaaactcattgtaagtattgctcaaacacattttttaacatttattaatgaaactgtataaaaaaataaatgaatttttagggccccacaaatg

SEQ ID NO: 101955 - DNA, 364 bp, Heterodera glycines
  Promoter: Source sequence=SeqID_20649; Location=286..649; Strand=+; Gene=SeqID_51207
ttggcagcttggcaaaacggacaaattccttgaaacgggggacttaaaaggtataaaaatcatagacacctcctcaacgggtaacatttccaaatcggcactataggaaaaggaaaattccgcgcttagaagtcgctaaaaataagaattgcattgtcagatggtcatgtttctcattttcagtaccccaacatatgggatgaggtcgtgacggtcagtcgaatgctcttccgacgaactttccctctccaaaagcggggcggattctgccgacgatagccgcggcttcctcccttcccccgatgagggaatcgttgagggggaagaagccgcatggggcagggcgtccgactcggcaacaatg

SEQ ID NO: 101956 - DNA, 65 bp, Heterodera glycines
  Promoter: Source sequence=SeqID_13060; Location=2832..2896; Strand=-; Gene=SeqID_76840
tttcaccgaaccagccaccaaaaaaagtacacgtcaatcaaataaaaaagtgctttgagctaatg

SEQ ID NO: 101957 - DNA, 479 bp, Heterodera glycines
  Promoter: Source sequence=SeqID_1864; Location=3036..3514; Strand=+; Gene=SeqID_76441
aaaataataatgaatttatatttaggcgtttcaaaagtaaaataccccttttgaaaaaaatttttcactatttttgtcctgtttttttttttaccaaattttttgacaacttttttggcatttttagcataattaagtcgaagccatttaatgactattaaaatgacaaaattttaattcaaatgaatacaataataatattatgggatgaaacatttttatcatatgtaaatatcaaacataaaataatttatgggttgaaaatttgtacaaaataatataaaatacaaacaacattaaattctaaatagacttttttttttactaaattaatttttttattattattattttcttaggcacaaaatacattcatcattatgagaaatttatgtaagcaaatggatttgcgttaaattagagaaaataaaagcatataattaagtggatttctgactattttcattttatgaaaaatg

SEQ ID NO: 101958 - DNA, 112 bp, Heterodera glycines
  misc_feature (21)..(21): n is a, c, g, or t
  Promoter: Source sequence=SeqID_21913; Location=2013..2124; Strand=-; Gene=SeqID_52548
ttcctttcaattgggcacacnatttcttatcaaaaaacccaaagtccaaatgtattcaaatttagcagccaaattgttggtggaacatcattctttcaacgggacaaaaatg

SEQ ID NO: 101959 - DNA, 891 bp, Heterodera glycines
  Promoter: Source sequence=SeqID_1975; Location=2054..2944; Strand=-; Gene=SeqID_77120
cctgtttcataggaatttttttttttttttgttggtttttatgtagccagggatattgcgtaattaaaaaataacaataaaaatacgaaataatgaaacaaaaaataattatgagacacggacacacgaacatcctaaaaatatgagattacttacgaaagtacgaaatttttaaatgaaaaatcattattcaaaaaaaaatcacttgaataattttaatttattctttacaaatttattttttcattttgacaacgaatatctaatttgacttgctgaatgattcaaccagctgcacaatttcttaatgatgaagcaataaaagtgcccaaattaccaagcatgggaagtgatcagaaaccgcgctacgattataaattgactttagacttatttaattgtgatgtggcatggcacgcttgcttctttaagcaagtagccttcaacaagttcaaattgggtattcgttgtcgaaatgaattaataaatttgtgaaaattaaaagacggatcaaatttgttaaaattattcaattttatttatgtaatttttcaaatttttatccattgtcctatatccggacaatcggtcagtggacaatcatttagaaatggagacaatccgtcagaaaattttatttgtctttcattaatggattggctttgtccatcttagactaattgtctttctatgacggattgtctccttcgccacaaatacaatgtccatttacggattgcccgcgagactcctgtcataaatgtctgaaatgggctttcttggtcctacgactagagaccgagaaattttgcatttaaaaactaatttttgtcggattgtatgtagccagccggagggggtattgcgtaacggccccctgggcatggcatg

SEQ ID NO: 101960 - DNA, 1003 bp, Heterodera glycines
  Promoter: Source sequence=SeqID_3193; Location=1032..2034; Strand=+; Gene=SeqID_83617
gtttaattgatcattttttgttcggcacttttctaatcaaatattgtattttgtatgtagtatatgaataaactataaaggaattctcgtggatgtaaatccattattttttttatgtataagcaaagtgcaaagtaaaatgaatatgcttattattaaatgaatttgatcaataaaaataatcaaattgaaataaaagtgctctgttcactgcttctaatcagtcagtctttccggtcgccccacttctctttgggcatgttaataatatctgatcataaatgttgatatttctgatcgcatttcttccatcattttgtttaattgtgcaaataaatttaagcatttggtttctgatcaatcacctgtcagcaatttttccgatcactttacggccactttctaatgctcactcccattgtgctttattcatcagtattttctttatgatcaattacttaattttttgaacaaaatgtttcaattatctttatgatcgcgcatcatcaccccaatttccgatcatttacttactagtcagttgagttaattccaacaaaaaatcatctatttattgcgtttaatctaacttactcactcattaaacggcttcaccttggcctccaaaaagtaaactaattgttaattgacccccgaaaagcgggaaaatatttttttgaatgaaattcgacactgaatttccacacaaaaaataactgtccaagaaatgattttgagaatcaaatttcttcacttttactgatcagtcgaatgtatacaaaaatgggggggggggagatcccttaaaaatcaaattgaaaaagaagtgcatccttgaaagaaaagtaaagccaaaaaggaaaaaaaggagttggtgtttgatacgaccgccggaaaaacatttgttggcatttctttggggggcgattggacaatcaatcgtaaaaaattccattattcttttatgatgaaaatatatataatacaatagttagaaataatg

SEQ ID NO: 101961 - DNA, 460 bp, Heterodera glycines
  Promoter: Source sequence=SeqID_39838; Location=1..460; Strand=+; Gene=SeqID_68320
tggatacaaatataatttttaaataataatgttaaaatgagacttttagagattttcaaattttttcaacgagagctttttgaattagagaaaaatgccctgttttttcaatccctcggtaccagtgagctcttccggggcattatttaaatttggcctccctgttcgttagtagaatctgccaaaagttaaaaaatgattaaattagtaattgtaataaaaaaaaattagtttcgcgctagctttgcttacgtcagtcattggtattcaatatgatgccacatttttctttgttaatgtcttcatcccctatttgcgcgtatttcatttatgggcatggcatttttataaaaatatttttttatttatgccattatatatctatttttacatcagatcattattaacacataaaaatttttaaattttccatagtaagaaactgctttcagcaccaatg

SEQ ID NO: 101962 - DNA, 1003 bp, Heterodera glycines
  Promoter: Source sequence=SeqID_18866; Location=1954..2956; Strand=-; Gene=SeqID_83568
acacttaggtttttgaatttgtaatgcggaagggaccgtactgacgaggcccacccttccagttattttttcagcaattgtcaggtccgcaaatatcgtccgcaattgtcgtccgcaattgccggtccgcaattgtcgtaacaccttaatttttaggtcctaaaaaaaccccaaattaggtgttaaaaacgggcaaatttttgaaaattttctgttcgcttcttagaggtattttagaaaaaaaatttagctcgtttcttaggggtgtattgttcttttttattgcatttttgttagtaaattttggacaaattggcgagaagggatggatgaaatgcgaaaagccagaggaaaattgatgtgtagggcgaggatttttagtggcaaaaaatcccaaaataattaactaaatattgacaaaaaaatggcgaacaagttccaaatttaggggtgtaattttttaaataggctgttttttaatttgaaaataatttaaaataaggcaaacaactttttcactgattgcagttacaaaatattttcttagcaaatattgaacagaaaaaaaatttgggggacgaatttttgtgaaaaataatttattttctgaaatttttaaaaaaagtcattgtagaaactccaaatcaagcggaaaacgcgttcttcatgcttatctgagaaaaatcaagtgctcataaattttacatttgccttattttagcaccctaaaaaaattttgattgacaaaaatttttggttttaaaaattaataatctcaatattgattttgttacttttttgaataaattttgtcattttacacccctaaatttaagactttttagagactattttccatttttagctcctatttgagagttcttagcacttaaaaatcgtatccctagtcataaaagtgcaaaatttcagatttgaattgctagcactcaaaaatgtctctgtctttttaaattatgaaaatttttttttatttaaaaagatg

SEQ ID NO: 101963 - DNA, 1003 bp, Heterodera glycines
  Promoter: Source sequence=SeqID_833; Location=2079..3081; Strand=-; Gene=SeqID_46283
cgaatttttgcctactggaaaaatcgctacagagaaaagaaaaagagtgatggagtacaaaatacattgtttttgcatcaaaaataacatttgttttattttttgtatcatttattctgaatttcgttttgtccaaaccaaaaattaaatttttaataatgtgtcaaatattagcgatactcaagcctgcaaatataaattagattacctatatttcataaactattgtattccattgtatgtaccattatattagtagatgtatatgtatgcatggttgtataaactcactcaataatttgctgacgaatttattttggtgaattgccacattttgggtaatcctttggaaatggaatttgtgtcccggcgttaaaaaaataaaaaatcgtaaaaattttgcaaattacaaaaaaagtaatatagataagtaataacaaattaagtgaaatcatgtgttacttgattatctcttatacaatttgccattggttgccccctttttaattaaaaaaccttcaatttgctctcgtaaattaatctgcgaatagatccttccttttttgctgctttattgagtattctgcagcctctgcatgatcacaattcatttactgtcgtaataaacagaaagaaaaactaaaagcattttttcgagtcaagaaaaaaagcaagcataaaacttcttttagatactaaaattgttcggttttgttaggaatgaagcgagttatggctgatcaaaatcaaaaaaggcatttaccagtgtaaattttaaattagtgcgcaaaaaattacgtcagttacgctatttggcgaaatgataattttgtctaacactgcactggacttgacccatagtgaaaacggaaataatgtatataaaaggagcgcatttgcagtgttccatcacataattcattgcccacatattattgttattatatattgctcatcgtctgcaactttaatcccacgaagcgacgtgcccggcgcaacaatg

SEQ ID NO: 101964 - DNA, 66 bp, Heterodera glycines
  Promoter: Source sequence=SeqID_5516; Location=820..885; Strand=-; Gene=SeqID_58313
tcggtgccaaattggacaaaatggtccgtgatgtgttggctgtgagttgaataatacagataaatg

SEQ ID NO: 101965 - DNA, 351 bp, Heterodera glycines
  misc_feature (120)..(121): n is a, c, g, or t
  Promoter: Source sequence=SeqID_12923; Location=958..1308; Strand=-; Gene=SeqID_76672
aaattaatgtttttttgcatatattgatattttgatgaatattttatatttattttattcatttgcatattatagggcttttatgggcatattcattgcttaatgtagcaatgtatggcnnaacaatttaacataattaataaaaaaatatataatttttcattattacgttactttatttatttgagttctttctttaataatatgaatatacattctttgttcattttactaattactagggaagtttctgagagtcaattgagattaagttgaataattttctaataagataatggtaatataatgtcaacaattacacatttagaagtaattaacttgtgatttatg

SEQ ID NO: 101966 - DNA, 210 bp, Heterodera glycines
  Promoter: Source sequence=SeqID_24170; Location=1..210; Strand=+; Gene=SeqID_54882
ctccctgtggctcctgaaagaataagagtgaatggtgcaataaacatttttgtcatttttttgaatcatttcatttatatatatatatatatattttaagcttggtacaccactattttgtgttttattactcacttttaattatattatttagtttgcctattttgtattgcaaagaattaatattttcctcttgtttagctaaaaatg

SEQ ID NO: 101967 - DNA, 358 bp, Heterodera glycines
  Promoter: Source sequence=SeqID_4409; Location=131..488; Strand=-; Gene=SeqID_54344
ggaaattttctttttaaaaattcttcataatttgttatatgtatattccatttgttggttatgcattttagtgcacaaattcaacaacgccccgtttggacagttcttcaagtgaaagtgaagaaaacaatggaagcgatgaagagaacgattgacagtagattgttgatgagacgactgctttttaatcattgttgttttttttgtaattaccgtaaatttgttaattcgaaaatgtggtattgtcacaaagttacgaacatagatattttttgaatttttccaatttttttcgtttacctattttagcatttgtttttttaaattaaggccttttttctttgaatctgtcggaatg

SEQ ID NO: 101968 - DNA, 1003 bp, Heterodera glycines
  Promoter: Source sequence=SeqID_15438; Location=752..1754; Strand=-; Gene=SeqID_79701
caatttttcaaataaaactccgagtgaaaagaagagttaatccatcaaaatttttgggtattttcaaaattgtaataattaatttcatttttttttaaattgggttaaatttctaatttcttttccacccttaatttaggcgaacatcaagcagaagaaattgacacggattactacaatttgaggaaaattaaattggccgacatttgtcatgacaaggaggaaccccttgtaaaaataataaaaaaaaaaaaattaaatttttaaattttttttttcttaattagggcaaccaaattagggctatccgaaaatacatttatcggacagcgcaagtggacgagcatattttggtgcttcttaaagggcttaacaacatggaatatccggtaaacattgggctgctgctaattaattaattattttaatcagaatttaatttgatttaaaatgtcattaactgatattgtttatttattttccttttttaattaattattccatttattttgatttttaatcataatttactaaataattaaatgcaatttaatagttattttaataagatttaaaattattattcaattagcgaattatgtttttgtttaatttccattcaaattaaaattttcataatttattaaataatttcaagataatatttttgtttaaattgatattgatcaatttataaaaataaataatgggttaatgagtttaccatttaattaatttaaaaacttaaatttagttttttaattgtttaataaaaattaggttaggtgtataaaccatcgatttaaaatgtttaattcgaatttgtttaaatttgaaaaatttaagcgcagcaaacagcgaataaattttgtggaatacaaaaccacttatttggacttttacattcgcagcatttcacggcacagtccacgacaaaggcaattaattgccataattagggggggggtaattaatttacttttttctttgtagatgccgaatg

SEQ ID NO: 101969 - DNA, 344 bp, Heterodera glycines
  Promoter: Source sequence=SeqID_13894; Location=1100..1443; Strand=-; Gene=SeqID_47169
taatacaacaaaaaatgcgccttgaaaaaagttgaaagttaacaacttataagtgaaagtgagctatctgcgtctttgccttaagtgtaaaaaatacgtatgagtaagagaatgaaattaaataaaacgtcaaaatattcaaatttaaatttgcattaattattttgcatttgtttgagtttgatttgatgggaatccctccctgcctttgctttgtaaaagatttcccgggttagctgcaagattggaaatacaaatacctacctaattaccacattgacaaagaagtttacaagatttgtttttagccattcttatattctagttttttttctgaagaaatg

SEQ ID NO: 101970 - DNA, 806 bp, Heterodera glycines
  Promoter: Source sequence=SeqID_13606; Location=1681..2486; Strand=-; Gene=SeqID_77511
ataaactggcatatttttgggaattttgcaatttttcgtttttcataatccattgccgatgataaaagttttttttatatataattttgtttgttttttgatttaattgaggaagtaaagctttttacaaattttccatattttttttatttttaaccggttttgttttattaggcctttactgtttgtcggtaatgttggacaatgatttaacaaattctcaaatattgtttttcaactaaaattttttaattctaatcaaaataattaaagaaaagttgaatgaaaagggtaaatataataaagccgttaggccctactaccagtgctaatgaggtaatttagtccaggggactctcttacgcgtccgtaattaggcccctcagggcttggaagggaagggatgatgaatggatctctgggggtacctcctaggcggggatcgattggccgttccactgaagtgactcccgacactgatcctcacactgccgtttaagcgctatcggagtgataaatgggcgggggaaaggccatttccggtcccggccttataatatcaatggaaaatcacaccaaaattgagaaaaaaaattgcaaaattttttataattataatccaaggcaaaaaaaaaaaagatttgcgaagaattgttttttggaaaatttttcaaaaatgaaaattttgggcattaactacaaaaaacattatttattacaatttaatatattctatttaattatcaaattaatgaaagaaataattcacatgtaaatttatttttccttacatataattcaaaatg

SEQ ID NO: 101971 - DNA, 223 bp, Heterodera glycines
  Promoter: Source sequence=SeqID_9282; Location=58..280; Strand=-; Gene=SeqID_70855
aaaatgaaaataaataaatacaaattcaaatttagaaaatcggaaattaaaatgctaaatttataaaaaaaaaaatcgggaatcaagattttaatgcaaaataggcttcgaaatgctgaaattggaatcctgttttaaaaatgcaaaaaaattattcaataaacttttttgaagcctaagattttttttttgaaagtttctataaaattatttgtagaaaatg

SEQ ID NO: 101972 - DNA, 126 bp, Heterodera glycines
  Promoter: Source sequence=SeqID_17065; Location=1376..1501; Strand=-; Gene=SeqID_81493
tcctcattaatagtagagtgcctaattaacaagatcaatcaataatcgaaagtgttttaaaaatatacaaaaataattattcattaattactttgctttttccaccgttttcgtttcgttcagatg

SEQ ID NO: 101973 - DNA, 108 bp, Heterodera glycines
  Promoter: Source sequence=SeqID_1482; Location=1..108; Strand=+; Gene= SeqID_73830
cggaggaaggcaaaatcgaattgtcggaatgtggtgacacaaaaagtaatgaacttttgagtgagacgagtgggacgaccatgccgaaaaaaacgtcgcacaaatatg

SEQ ID NO: 101974 - DNA, 198 bp, Heterodera glycines
  Promoter: Source sequence=SeqID_10086; Location=1..198; Strand=+; Gene=SeqID_73153
gagagaacaacacaaaaaccaaagtcagaattcaaaccgccgtcgacatcaaagaaacccgatcaccacactccggcaaaaagagtgtcagagtttgttgatctcgatccacgaccctccacatcaaggcaggccgggtataacccgcctcccccgacgcccaaaataaaacatgagccgacaacaaagagacccatg

SEQ ID NO: 101975 - DNA, 1003 bp, Heterodera glycines
  Promoter: Source sequence=SeqID_15978; Location=697..1699; Strand=+; Gene=SeqID_80336
gcaatttacgagggttgaaagtctttactaaagttgcttctcgaccttggagagagagaaaaattgggatccgggagaaaattccctgacaaaatataccgagaatggctggagaaatataaaaaaatgttgtgtaaccataccctcgttggggaggaaattttcaaaaaaaaaaaaaaaattcttagaaactcaattaaagacactttcatccgatttggagtgtaatcgtattcgcaattcttgcatcaaatcggataacaaccctagtccttacagagggcctgagaatagaaatccatataaatcggatctcttgtgacgaaaaatgccaaaacagtttagggcgtcactaatttagtgaccaaaatgctccctaataatcccagcttttaaatgacgaataataatggaaatttttaggctaaaaatattgtgtttttatattatttttcgctaaaaaaagcataaagatgtttttgtcttttttgacgaaattttttttataaataatgaaaaataggaaaaaatagaaaaaaaaatttagaaaattaaattttagaaaacaaaaatatttatgcattcatctttgaatgaaaaaagaaattattcatatgaaatcgaattaataatctctcctttgcatatttaatgtgcatttttcaaatgacaattaaaagaaatgtgtttaaatctcatttcatacacattaaaatccaataatttttccccataaatttacattttatttaaaatttaattttcttaattagctaattaagaaattatgtcttttttccttttaaaattgatgaataattcccttcaatccttcggtttgtgtgaatgaaaacatttgaaggaccatcgatttaattaatcgctgctttatttattcaccttttacaaattaattcccctcatttaaaccattttttctcaaaatttaatcgatattttttaatttataaaaattttttaacattaattttttttaaagatg

SEQ ID NO: 101976 - DNA, 199 bp, Heterodera glycines
  Promoter: Source sequence=SeqID_39692; Location=1..199; Strand=+; Gene=SeqID_68204
aaaaaaatataaatattcaaaaatttttgaactattgaaaaaatatttattgtaaaaatccaaacacaaaaacaataaatattaaatgaatttcttttttccaattagcgcaccgatgccgaactaatttatcaaaaacatcggccaaaagtgagcttgcccgctttggctatgaggtcaaattcgacacagcaaaatg

SEQ ID NO: 101977 - DNA, 427 bp, Heterodera glycines
  Promoter: Source sequence=SeqID_2395; Location=1458..1884; Strand=-; Gene=SeqID_79503
aaaaaggcattaaaataggcatttaaattttttattaaggatttttgagatcaaaatacgtaaaactaaatcaaaaaacttaatgttggtcatttaaatgattattaatatttaataattttttcgaataaggaaaatttttaaacctaaaattttttatcaagaaaaaaataataaattttggcgatcaatttttgaggaaaaatccaattcttagggatatattttctcaaattttttgggtcatttcttaggggtgtattttcccgaatttattgcatttttaatggaatttttcgtaaaaaacgccaaaaaaggcatcattttgatcgaataggtaaattataaaaataactgatttgaaattgtttgcaaaatattctagtctttttgaccccaaaatcttatattttttttcaggccgatg

SEQ ID NO: 101978 - DNA, 1003 bp, Heterodera glycines
  Promoter: Source sequence=SeqID_14180; Location=817..1819; Strand=+; Gene=SeqID_78191
tcgattcccacacagaataaaatatttcttattcattttaattgtaaagatatttttaaaatttaattaggaaattttccaactaccaaaaataaaaacaattaaaatatttctttcatttttttaaacatagccaaaaaatacaattgttagtgccaaatctttaataaatggtgacaagatttccaaaaaccgccggacccaaattccctaatttttaaaatttaattcaaaaaccagcagaaaagtgatcattttatagacaaaacctcttaacaaaatacacctaaattttccccggcggcgcctatcggcaccgccagacccctctactcaacaattgttgtaaaaaaatgcgctagaaatagatctcatcaaaagtaaggaattttaaataaaatttaaataaattgatttctcatttttgatttaaaaaatgtgaaaataaattgatttttaacacaccgagtcaaaaaacgagacatgtgccaataaatagagagtgcagagaaaaatacatttctctcattttggcgtactatttctttacagagaaagaaaaaaatttaaaaaatgacgatattcaagggcacccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattacgccttgcctaaccttaggcccatccgaataataaaaaaactcaatttcgagacttggacattttgtgggtcagcgctcctgccctgtcctgaactgtaactgtgagaccgattatttaattccaagggctgtcaagtcaagtgtccttatttctctagcatttgtccttattttgttaatattcagtaaatgaaaatatctcaaatttttttaattggttttttaaagattaaattagccatttttttctgcaaaatg

SEQ ID NO: 101979 - DNA, 356 bp, Heterodera glycines
  Promoter: Source sequence=SeqID_21988; Location=263..618; Strand=-; Gene=SeqID_52629
agtaggaaacaaaaatgggggaacaaaaactatggcattttttaatatttcaatggatatttttttatttagttcaacaatgttcgaacttttccgtacgaaaataaatcaaatgcagtctttgttaacgctggaaaagaaaatcaccaaaggtcgtcgcgtttttcttttaatcgaccatttgaggacgtcgtaagaaacgaattcgggtgatttataccctaaccctttaccaatttaaaccttttttatatttttttagagaaacgaaaatatttcttggtaacttatcgccgcgaatcgattctaacaatttgttcgacatatttcgcaaatttggcacaattcgaaaaatg

SEQ ID NO: 101980 - DNA, 340 bp, Heterodera glycines
  Promoter: Source sequence=SeqID_19252; Location=1..340; Strand=+; Gene=SeqID_83994
agattttccaagcattattgatttctcaaagatttgtttactttttaaaacaatgccaaaaaaaaatccaagtccatgccttgatccatgccatgacagcctggatttttcctgggtttttgtccaggaaatccaggccattcttttttcgaaatgttcaagggcttctttaatgtccaaaaatttcagatttattttataattgctcttatttatgtacatattaaattaaggtttgaaatgtgagcccataaaaagaggggactctttctttttgctcaaaaattttcacaaaattccaatttacgagccaaagtttgagaagaacaagcaacaaatg

SEQ ID NO: 101981 - DNA, 875 bp, Heterodera glycines
  Promoter: Source sequence=SeqID_11985; Location=1..875; Strand=+; Gene=SeqID_75508
ttcataatttagttcaaagttaatacataaatcaacaccatcgatagtattaccggccggtatcgcccacccctgggcgacgaccttttagatagaaccggcgcaatttgttaacagattttgtgcaaaaataatcgaattttgtgatgttgaccaatttttaagatcttaagaagttttatggtctgggcgacagcgataggttacgcagtggaaaaaaatcaaatttgttacaaaaattgctaatttcaaaatgaaaaaacaaaaaaataaaactttagcataaaatgtttaaaaactcaaatttttttaaatttgcaaaattaatttattaaattttattagcacaaatatgttaatgcttaaatcgccggcatggcgtccggcacagctgcttagagaaaagacactgcttgtgtggaaaatttccgtgagccaatgaacgtgagaacgaagaaaaaagcagagagagagagagagaaagaaagaaaataagaatgaaaagaaaattagtatttttggcgtatcttttaagtactgtactttcaaaatcattacagcatcttatttgttagtctaggtcattttcctaaaaactgacaatttcaatttttcttgaaatttttgtttgaatgagtaaaattttgaaaaatttctgtatgaatgaaatttcttgaaatgttctttctttataattaagattctcgaaatgttccaggtagttgcgttttttgacaattttggtgcccaaaaacgtcccaccctcattattacattgtgacttttttgtactattgaataatttaggtaatcgataaataaataaataaaccattgccccatattttttctttcaggtattggaacgcgacatg

SEQ ID NO: 101982 - DNA, 62 bp, Heterodera glycines
  Promoter: Source sequence=SeqID_3382; Location=1755..1816; Strand=+; Gene=SeqID_84462
ccttaaatttaaattatcattaaatggaatccctataaattattcactatgtgttggaaatg

SEQ ID NO: 101983 - DNA, 429 bp, Heterodera glycines
  Promoter: Source sequence=SeqID_4208; Location=1441..1869; Strand=-; Gene=SeqID_53603
aaatataaataaataaaaatgaaaaatattattatataatgttaaaatgaataacaccaacacaacaaaacctgacatacaaattttgaattccccagaagagcctaatgaaactcttttacatgtactacttttttctcattatcttcttgcatttcctgtgtttttgcttttttggttcgttttaattcggtggcttaaaagtcacggtcacttaacgcccagcgaggcagagacagtaatgcatgagatgaaaaatatccctcgacaaccaccaatatttttcgcaacaaaatgatgcaagattagagaaaactgacagtgaactctctctctctcttcagtatgaccaaatcgataatgagtcatgctggcggaggattctcaaagcgactcattttttttttcatctttcattttacaaaaatg

SEQ ID NO: 101984 - DNA, 1003 bp, Heterodera glycines
  Promoter: Source sequence=SeqID_18138; Location=1528..2530; Strand=+; Gene=SeqID_82722
gaaagaaaaaagaaagagagtgagagagagagataagagagagagtgagagagagaaagaaaagaaagatagtgagagagacagaagagatatagagagaatgaatgttagcttttttattcaattattttttaaattataaaaaaattttttttaaatttatttattttaatttaataatttattttaatttaatttaatttattttttaatctttttatttatttttttatttcaattaatttgaactttaacttttatttaattttaatcctattttaatctaatttcatttattaatttaatataattttagttttatcaactttaattctaattcatttaactcgaattttatttttagcgctcaaatttaacaagcgggctcacaaaaggcccctgcgtgcgctcagatggcacgcacgagcgctcaaatggtccctacgtgcgctcaaatggcatacgcgagcgcttaaatggcacacacgcgagcgctcaggtggcatgcgtcccttcccttccccataaggcatgacagctgacgcccatcctctgcctccctttcccttctctaataggatttggccttgggttttatccttcagatgttttttcaattatttacctcttctgggattggatatatttattataggtgttttttaaaggtttaaatttggtactgaaatgtccctttccactgggactgaaatggcggggctgaaaattaagggccaaaatctgcatgggtaactacttatcagttaataaggaattttcaactcttcaaatttgcacgccgccgcataatttaattagcacctcacacacgaaaattttcaaaattacacaaaatataatgccaaaatattaaaaaaaaaaattggcgactcgcaggcgtaaattcgaaattttctttttttaatttctaatttttctttcttttttgtatttttattttacttccatcttttttatagcaattattaaagctgctaaaatg

SEQ ID NO: 101985 - DNA, 852 bp, Heterodera glycines
  Promoter: Source sequence=SeqID_14494; Location=474..1325; Strand=+; Gene=SeqID_78539
agtgtgaaattttgctgaaacaaaaatattctaatgatttccaattaaacactatcatctgcctttaaatagaaaggtttgcgcacattaattagtaattaatacttgcaaattactaattaaagacaaattaggtgcacaagtttttgtaaaaaaaaaaaatccatccccaattcgatgaatgaatgaataaaattaaaataaaattcatcaaattacgtgatactcttgatactctttggtcggaaacaacaaaattttgttcgttgaatccaaaacactttgaataggcttttaaaaaattaaaaaaaaaaaattcaaattaccatttttaattagaggtacaggaaaagcacacgtttttaggacttcaagacgaatctggcattccacagcgtaatttgatcaaagtaacgccagaatttgttttttcataaatttttatgcatttttagggaataacggtccgatcgaacagcattcttttaatgttcgaatgattttacgaaaatgacaaggcaaaatcatgggaaaattttgccagttatttgaaagaaattaattgttttttctaattaaaaaaaacagtttcaaaattgtaagcatttcgtaagttgctagtggtgccgtccatccgctgacgaaaaacaaataaattatgccaacattttaagtgcgtgccacgtttttttctgcttctctgtttatatacaaaaaaattttaatgtttgacattatgaaactatatataataaattgtttttacataaacatattaaaaaaaaatccacgaaatataacaaaaaattaaaattaatttcaattaaatattatttagcgatttaataaatg

SEQ ID NO: 101986 - DNA, 1003 bp, Heterodera glycines
  Promoter: Source sequence=SeqID_463; Location=396..1398; Strand=+; Gene=SeqID_53332
tggaactcaaaattctttgcgggacgggatcccgcgggattaatcccgcaaatcccgcattttccaaaaaatgcgggattgcggactgggatcccgcaaaatcccgcgcgggctcccgtcccgcgccgggctctacaatttaaatcttaatctgaaatttttgaattgaaaagatttttcattttttggcccttggaaatttaggcgaatgtttgaaaattcataattcacttctaaatgaatcaattaaagtgcaaaaaagcattaaaaatagagaaaaatctggagcattttatacctttttagaattttctatcttcaaaatgaagaagttattacataaattttggaaaaattcgttttttgagaaaaaaaaaattaatagcgctgttctgaaaaggttttttgaaaaacacgaaattcttcctctataagcttctgtttattctatatttttataagacttttgaaaaaaagtacaaaaataaactgattttggaattcgggatcatagatggaagcaaatggtttttttgtgccatgggttcagatccacttgcctgtaaaaatgttttttagggtttttgggaccataatcaagaacttggcatccattttgcccaattccaaagccttgatccgaactcgaaaccccaaaaataattttttaaaaatgttgcaggcatgtggatttgaacccatggcccaaaaacccatttttaacaaaacaaaaaatatattgggtataatatttctatatttgcttgaaaattttttagtgattttcatcaaaatcttttccagtgcaatttattaacagaaattttttctaagctattgcttcgctattagacaatttccaaaaaagttatacatgaaaattgcgaaaagtcgaaatttttgaagttttttcgtaataaaattttttccaggcttgaaaatcttttcgcttttggtaaggctaatagagcatgttaagagctttcgagtgataccaacaatg

SEQ ID NO: 101987 - DNA, 142 bp, Heterodera glycines
  Promoter: Source sequence=SeqID_284; Location=1..142; Strand=+; Gene =SeqID_81138
cattccgatctctgggactcaacccaccagcatttcaatctctgagactcaatctccggcattccaaacactgggactcaacccaccaactttcaatgacattccaatctctgggactcaatctccggcattccaaacaatg

SEQ ID NO: 101988 - DNA, 781 bp, Heterodera glycines
  Promoter: Source sequence=SeqID_7889; Location=1167..1947; Strand=+; Gene=SeqID_66295
ttttgtatgatagacgcaatttttatttatttaatttataaatttttttagaaatattcattctttaatgctattgccaccaggggccgtagcaaaataaggtggttatttgacgaggtcattttaccacgaacttattaagcgattaaaaattctaattttttagttagtccccttttttactgaacagggtctttgttaattctcatagaaatggtttattttcattaagctttgctccggaaaattgccaaaacattggtccgggagttgcatgccacctgcaaaactttcgtcacattttgtctctatcttattactttccaaagataggataaaactattaaataacaattattcccaaatctgttgtgaattattttgactatatttaagtcatttttggttgcatttgagaaaagatatttttttactattaaagatatttcggcattttactcttttaattttacaacatagctatgataaaaatgaaatagaaaaaatattggtacaaaattgaaaagactatacacgtacttataaatttactcaaccaacgggttcaaaattggtcgaaaaaaattaaaacaaggaggcccggaaaatgggttctgttctgaatttaaaaagaaaagatttatcaaaagttagaaaaagcgcagcaacgtgccgccggcccaggaaatttttggaaattctaacaattttaaataatcaatccttcaaatccttataaaaaattattctaatatttttaaatgacaatttatagaatatg

SEQ ID NO: 101989 - DNA, 244 bp, Heterodera glycines
  Promoter: Source sequence=SeqID_42879; Location=1..244; Strand=+; Gene=SeqID_70684
aaatacggtataggtatttagaagtgtccaaattgagataaaaacaaatgtcaaaatttttattgtactttttcgaaattttgatttacatttactgctttttaaggaaaattggcgctagttgcaaagaggtccattttgaaaattttttcacttttttgacataatttttttgtttttgaaaattttttccctttttttgacatattttttttgatacggaatttactttttttactagatg

SEQ ID NO: 101990 - DNA, 135 bp, Heterodera glycines
  Promoter: Source sequence=SeqID_1233; Location=2128..2262; Strand=-; Gene=SeqID_70389
tttaaatcagcagaggaaatgcaaaaagaagaagaatggttgaaaagcattgaacaaaatgtatggcatttatatttaaaaatataaattaatttaattatttttaaatttattttcagtttaattttttaaatg

SEQ ID NO: 101991 - DNA, 460 bp, Heterodera glycines
  Promoter: Source sequence=SeqID_11623; Location=1219..1678; Strand=-; Gene=SeqID_75070
tagttggctgaactgaatgaatttaatatcattcaatagacctaagagttctctgttagcctagaaaatttcgaaaaatttggttaagtttcaaaaatattatggacaaaaaacttaaaaaaaaatcggttttctgaatatttttgtacatgacttttttgaaatttaaccaaattttttgaaatttagcaggctaatcgagaatatttaggcctattgaatgatattaaattcattcagttctgtcaactatgaaaggagttgtgcctcaaaaagcaggctggcgcccaactggtcggcgcccaatcgacccccaccgtggtcgacccccccacccccacccttattgttatgtatgatcagaaacacgaattagtcaaaagccgaattgctcatccatttatcccacgaacagaatgccaacaacggcagcggcggcatcggcaaaatgttacaaatg

SEQ ID NO: 101992 - DNA, 1003 bp, Heterodera glycines
  Promoter: Source sequence=SeqID_3269; Location=1737..2739; Strand=+; Gene=SeqID_47573
accgggaaaaggctcgtcaaaatatttaaattttctttaattttttccaatgatgatgatacacactctttttgtctttaaaataacacctattttggcattttcgaactttagcacctattttggcccttttccagaaatttcatagcaaaagtgcaataaaaaagaacatacacccttaagaatcaatccaaaaatttcagaaaaatacacccctaagaatcgacccaaacattttcaaatacacccctaagaaataaaaaaattttgtttaaaaaatatctccaaaatttattatttattttccttgactagttgccttgtgcaagcatagttgataaaaaaaattggtcacttttggatttttgtgcataaagacactggatatttccaatctttaacacctatttacgctgattttggcatttactgcgtttttagcacttattttggccttttttggcaccaatttcagtaactttagcacctaaaaatcttttagctgtagtaattaaagaccaaaaactatttattttagagacatttactgagagaaagtcattttaaactaaaaacaattgatcacttaattaatgaccatttgatgaagcggtggtagcaaatggcgaattggcccatcattttggcctttagtttaatataaaagcctgatgaatatagccaatgccttctgcttctatttggagttgaaaaatgccaaatgaattcacaaattctaaacaatcaaaaaacggtgtaaatatcacaaatataatttatgaaacttatttttggagggggtaaattccatttccatcagaaattcacgatccaaacgcgactcagccatggccaaaatgagtacttttcttaacattttgctttttgattttttgatccagaaaactatggccttttaaatttgtccttttgaaaagtattggtaaaaattgtcgcgaattttaaattgacgaaatttcttttattaattatcaaacagatg

SEQ ID NO: 101993 - DNA, 332 bp, Heterodera glycines
  misc_feature (31)..(31): n is a, c, g, or t
  Promoter: Source sequence=SeqID_34209; Location=1301..1632; Strand=-; Gene=SeqID_64053
gatgtgccacaattcctgtcgatgctcgccncaattctgtcctatcgccgccttgcgacccacgtctgaagcgcatcagtgctgaagcattgcctgtttcgtcgccctccgtccttccgccactaccaaagttcaaggcaacggtgcccgtgttgaatgtcaggccggtgtcctctgctgccgccgttgttgtaccaccgccgccgccaccgtcaccaccgccaaatgtgtctgttttcaagcaattggtgccatctgctgcttctgttgcgacgacggcgccggcaccaccaaatttgggcttcaaacgcgcatatggccttgtcggaatg

SEQ ID NO: 101994 - DNA, 53 bp, Heterodera glycines
  Promoter: Source sequence=SeqID_6463; Location=1..53; Strand=+; Gene =SeqID_61682
acatggcaaaatgtaaaaaataataaatgaattcttcaaattttggcaaaatg

SEQ ID NO: 101995 - DNA, 130 bp, Heterodera glycines
  Promoter: Source sequence=SeqID_9239; Location=1546..1675; Strand=-; Gene=SeqID_70717
tgtaaagtttgagaaccgatttcaagacaaaacaagcaatgttattctcccatttcagtaccgcgtttgctataatttgcacgaatttctcttgggacgtcgcgcattgggcgccaccgcgccgacaatg

SEQ ID NO: 101996 - DNA, 993 bp, Heterodera glycines
  misc_feature (469)..(469): n is a, c, g, or t
  Promoter: Source sequence=SeqID_26325; Location=287..1279; Strand=+; Gene=SeqID_57075
ttccaacgaaatccccggatattcgggcagatacaggcgagtttcgagattatggaagcaatttttggcttttttataattaaacagtttcaaaaataaaagaataattgaatgagtgaaaattggtcaatttacattaatttataaagaaaatttgaatatttattttttaatttacggtaaacagacatttttttcacttatttcttctttctttttgatttggtgccaccaacattttaatggacttactggggaaaatacaaaattttaattgtactaaaaattcccccagtgccaatttggtcattctttgttttgtgacttttttttgtctcagaataatccaactaaaacattgtaaatgttttttaaatattttatggaccgaaggacttcaactatgactccaaaaggtacaaattttgcgggcaaatcctcgggagtccccccccccggtttctcgtanaaagccaattcaagtaataaaatataccaaaaattttaaattaaaaatgcttacctaattttgggttgtcttatctttttgtttcttttgcagttactccaatgataaccctggcgaattccatttgcacattcgaaatgtgtcgttggatgacgacggacaattccaatgccaacttctgaagccgggtggcaaattttttcgtgcaaatgcttttgtcaccgttttaggtccattcattttttttcttgcttaaaatttcaaaaaattcgtttccacagtgcctccgtccggcgttcgcttccaacattaccagtccggctcgaccatcgcggtcaacgaaggcattccgttgaacatcacttgcgtgaccgaccgatcgaagccggaggcaaaattagaaaaaatcaaatatttaataattttgaaattacaagttctgctgttaaattattattagtcttttatttacccattttataattaatatttgtttaaaatttttttgtgtaaaggtgattatg

SEQ ID NO: 101997 - DNA, 126 bp, Heterodera glycines
  Promoter: Source sequence=SeqID_9794; Location=2484..2609; Strand=-; Gene=SeqID_72708
tttttcataagttaatacatatttatagttcccttcggtgttttatcaaaagatgaagtgatcgccgtttatcagttcaaatcccttccaaattgtcatgggatttccgacggaattttcccaatg

SEQ ID NO: 101998 - DNA, 393 bp, Heterodera glycines
  Promoter: Source sequence=SeqID_17942; Location=3096..3488; Strand=-; Gene=SeqID_82499
atgaagaaggtggcgtcgaattttttttggaaatttccttttatatgttttttaaattttggtccaaaaactttacttccctttcaaaatatttctaaaatttgtttcattaacattttctcattgaaatattgagctaaataataaaaaaaataatagtaattcttttacctttaggttattttgccacaatttttttttattcacgaaatatgaaattcagaaatgcccaacaaatttttctatttgccttggctatataaattataaaattcattaaaaatgatcaggacattttctaattaattactttcgatgaggacaaaataagcgataacgattcaataaaatcatattaattcactttacaattatcacccaaatcgtaaaatg

SEQ ID NO: 101999 - DNA, 283 bp, Heterodera glycines
  Promoter: Source sequence=SeqID_1231; Location=1162..1444; Strand=-; Gene=SeqID_70242
ttgctgcgatttgaaaggttttgttcgacggaacgacgaaatttgaaacaactcatttgtaatgcgagtgattcgcacaccaccgctgacgcggacaagagccttgaatcacggaatagtagttgaccgtgatgggaatgcacaccggaccgggaatttcgaagcatttggaaacagaccgaactcgcccttagctccgaattaaaatgaatccatagcaaatgggaatgatgtgactgatttagagcgaaccgcaaatcgtcgacttatcggtgtcggaatg

SEQ ID NO: 102000 - DNA, 848 bp, Heterodera glycines
  Promoter: Source sequence=SeqID_15118; Location=1..848; Strand=+; Gene=SeqID_79301
tggtaataatacgacaagaaaattttggaattattaaaaaatagatgataaaataactttctgaaattttttttgatcaaattttgagaataattcaaaaaatttttagaatttttagcaaaaaattttgcatttcgtgttttcgttttttagggcattccgttttcgtatttttcgtgtttcgtatttatttttcgattcgcaacaactctgtatcagtgttttatcaataaattttaaaatttaacgtaaaacaaggtcattttttggataaaatatgtgccaattttaaaaatcttacaggcgatttatatcggcatcgccgtgtcttaaaaatcctttgatttcttaaaaatagcaatttcgcggaatgttctgatttcgaccaggggtggagcgcgaccgcgggatgtttttttgcacgatccgcggccgcggcaaattgaatgcgcgctgtgcgaccgcggattcttttgcgcgatccgcggatttttctgtgcgctctccaccctgatttcgacccaatacgccattccaactggatgagttttgacggctttcgatcgtcaacgaatgccaacattggcacggaacggtttggcccaaagttgggcgacaaaagcgccgccgggctgctagagccgttccagcagaaggacactgagtacagcttcatatacaacgcccaaattgcctccggtctccaatcggcggaacaaagcgcggccagctcgcagcaaaaggcggtgacgcgcatccaatgcttggccaacattcacttcgcatccgaacggcatgcacagctgcgactggagcagtgccgggtgggccaacagaacgacaaaatg

SEQ ID NO: 102001 - DNA, 398 bp, Heterodera glycines
  Promoter: Source sequence=SeqID_10860; Location=3897..4294; Strand=+; Gene=SeqID_46907
tcgattttgcaaaagtaatggctatacaacaaatgcaaatggccagaagatggccaaccgtccgctgattcatcccaattgcctgcctccctttttcaatctctttagaattaaatatcattttttgcataatttgttttttcagagtgtcagaactttttcatcaacccaatagttaattaaagagggcaaggaaatgaaagtttttgcaaaattcaacgccttttatatgacttaaatttccaaaagaaattcattccaaaaaaagaatataaaagcaacaaatctcctccaatccctcactaatattcattttcgtctttctgccttttgctggccaacgacacacacatttccctcaacgaccttcgaccgactacggcacgacgcgtacgatg

SEQ ID NO: 102002 - DNA, 781 bp, Heterodera glycines
  Promoter: Source sequence=SeqID_29478; Location=1..781; Strand=+; Gene=SeqID_59972
agtgagtggggattggcataggacaaatggacaatgaaatgagtaagtggattggcaagggacaaatggacaaagacagtgagtaagtgggattggcataggacaaatggacaagaaaagtgagtaagtgggattggcaagggccaaatggacaaagacagtgagtaagtgggattgggcaagggacaaatggcaaaagacagtgagtgagtgggattggcaagggacaaatggcataggacaaatggacaaagacagtgagtgggtgggattggcaagggacaaatggcataggacaaatggacaaagacagtgagtgagtgggattggcaagggacaaatggacaaagacagtgagtgagtgggattggcaagggacaaatggcataggacaaatggacaaagacagtgagtgagtgggattggcaagggacaaatggacaaagacagtgaatgagtgggattggcaagggacaaatggcataggacaaatggacaaagacagtgagtgattgggattggcaagggacaaatggacaaagacagtgagtgaatgggattggcaagggacaaatggacaatgaaagtgagtaagtgggattggcaagggacaaatggacaaagacagtgagtgagtgggattggcaagggacaaatggacaaagacagtgagtgagtgggattggcaagggacaaatggacagagacagtgagtgagtgggattggaaagggacaaatggacaaagacagtgagtgagtgggattggaaagggacaaatg

SEQ ID NO: 102003 - DNA, 1003 bp, Heterodera glycines
  misc_feature (862)..(862): n is a, c, g, or t
  Promoter: Source sequence=SeqID_22334; Location=33..1035; Strand=+; Gene=SeqID_53012
ataacataattttccggtggaagtttaccggcaccatcggacaaaatttttttttaatttgatcatttttgaatttatattcaaaaaaaggtcgtcgatttacatggctgccccccccctctcttttaatgtatggtcactttcactgaatgataaatgggctatttctttgaataaatttgtcaaaaattgcaggttatttgttactgcgaccaaaattaagcaattgccaaccgaattggtcagatttcgcacttaccctcacgtttttccgatgattccaccgacccgcagaaaattagcgtttggaaagcggcccgttatacaagtgcggcgcccacttattttccaagtcttgacaagtacatcgacggaggtaaacaaatatgaccttattgaattatgaaattttgatttgatgaattagcaccagattctggtgaatgagtccgaaggttttcggcccatattcaggggagacgggacaaaatttcatcgccgaaatttcgccggccaaaatttcgccgccgtaatttcgccgggacaaaatttcgccacaaaaaaaaaattaaacattaagaaaaaaaaaaatttatacgaaaattccaagaaactctttttccaaattatttcatgaaattttctttaaaaattctgaatttttctcgaaaaattccaatgttatcaaaaaaacgaatcggccaaaaaacgaacgtccgtcgtccaatggtaccaccctcgtccccctatttttgatatttttcgaaattatattccaatatggtatgccaatatttgacaaagtcggttttgaaatttacattagaaaaatattttgacttctcgggtgtcccttccgaanttaattactggatatgtgcatgattataatgcacgtttttggtcctttttgagtcaattttttgaatttttaatcacttggagtctgtgccttaagtatttttaaaaataattataccaccaaacccttttaggaattatg

SEQ ID NO: 102004 - DNA, 129 bp, Heterodera glycines
  Promoter: Source sequence=SeqID_19691; Location=603..731; Strand=+; Gene=SeqID_84431
tgtaataatatttcatttcatatgtaaaataattaattttgaaaaccttaaggcaaacaaaacggactgacaattcgtcgacaatttctccaattgatgagaaaaaaggagcaaatgttgtcaaaaatg

SEQ ID NO: 102005 - DNA, 419 bp, Heterodera glycines
  Promoter: Source sequence=SeqID_26503; Location=1167..1585; Strand=-; Gene=SeqID_57233
gagccttgtggaactgatcaaaaaatggtacaaacgcactgtaaaggtaaaaaaatccgtttttttttctttttgcttttctggtctacaaaatttttaatgactttttcctgaaaattttttcatttcgggggagggggggggaggattccccggtgccggaacaggacaaaacacagccgccgaaacacaaccgtgaataaatttaaaaatagaatttcatcaaaaattgctgtgagaaagaattttaaccctttttttcggtttcggaaaatgctagaaaccatttcactttcgtttttggactgtttgaaagtttttttatataaaaatttcgttgacaagattttgagattatttcccaggtggagtaggaggccacgcacaaactgaacaaacctttgattaacatgggcatg

SEQ ID NO: 102006 - DNA, 175 bp, Heterodera glycines
  Promoter: Source sequence=SeqID_11679; Location=2577..2751; Strand=+; Gene=SeqID_75149
aagtgcacttttaaggggacggataaaacaataaattttaatgggaaattcaaaattgaaatagatacctcttgaaaattggatcaaattatgaataattttgagtttttcactttcatgacaatttaagctgctcaaaccgaccagctttggctgcccagtttatgacgaaatg

SEQ ID NO: 102007 - DNA, 554 bp, Heterodera glycines
  Promoter: Source sequence=SeqID_21057; Location=1865..2418; Strand=-; Gene=SeqID_51647
attagtagggttatcagccttgaaatatggatttatatggactaaaaacctttaccaaatcaaaaattttaacgtagtaatgttatttttaagcccctttcttcatagcatatgagcagaaaaaatttataaccttaataattagtcataaaaataaatgaaaacatttttaaaaaatgaaaaattttatgccgtttttaaatttttttaagtggcttatttttttaatttagacatcttttttagacatctttattttaaattaattgaatttcttttaaaagtgatccgcttgtatagcatttatatgaaatatgcgaaagagaaagtggaccatttaatggaaagggacaaaatgaattggaaagaaatcggaaaatatgacaaaaaatttggcaaatttttggagttaattctgacaaaactttcaagtgaatccaaagaaaaattggaagaatttgtggttgaattggtgagcagctgcaaaatcaacacttcctacagacaaaaggcgggctcagtgcttttcgattacaaaagtcactacaaaaatg

SEQ ID NO: 102008 - DNA, 758 bp, Heterodera glycines
  Promoter: Source sequence=SeqID_10768; Location=965..1722; Strand=-; Gene=SeqID_74025
aattgccactgatttcgcaaaaaaatattttaacactaaatttggttcatttacttggctaaaagcaacagaagccggtgagagcagctttttttttttttgctctgcgggacaaaaaacttgttcagtcaaaccgactctttttcggcaccgtcgaaaaaatccggaaatttggccatttgagaccaaacaaaaattatgggaaaattgtgatccgccggtgccgttaggtgccggggaaaatttagtaaacaaataaacccaccattttcgggggaaaacgaaataatttttcatttcgtcgggcgaactatctcccccttttgtccctctggtcacgggcctgctgtggaaattattctccctgccctccctatggccattacgagcaaattgtctattattgttttcgttcgagactttgtctgtccccgcgctcccttaactccatttaatctttgtcctccgtcaggcagtacgctccgcgtcggcttcgccaatgtccgatcactttcgtcgtgggtagtcgccacttggacgcgttgcgctccgccgtgccgcctccactcgcggccaatgtgcgctgcgtgggcgtaccactgccgttcgcctacggcacccatcacgccaaactgtcgctgttcgagtcggaggacggtcgtgcactgcacgtggtggttggcacggcaaatttggtgtcggaagattggggcgcgaaaacgcaggcgttttaccatgcgcggggcaaatttgccatg

SEQ ID NO: 102009 - DNA, 338 bp, Heterodera glycines
  Promoter: Source sequence=SeqID_5107; Location=188..525; Strand=+; Gene=SeqID_56926
tgcgaacattgattattttctttttcgtgcatttgaatcgatttttagcaataaatgtgaattttgttaaaaaataaatttttttattttattcgaatccgggtcaggggttcggaatcggtcgaaatggatgtcggattcgtgatcagcgaccccgaaaacccctagaaattaatttcgggggaggaaggggaaggagttcgactgcgattttcgacatttttttccgcgtttcacgaccgcggcaatttgaatccgcaaacgcgggattcatcgatattttaatttcaaatttttatatgtattagttgacattgcaaaaagaagttcacaaaatg

SEQ ID NO: 102010 - DNA, 571 bp, Heterodera glycines
  misc_feature (7)..(7): n is a, c, g, or t
  Promoter: Source sequence=SeqID_16615; Location=1925..2495; Strand=-; Gene=SeqID_81029
actgatntagtaatttcgtctgtagtaataaatggtaatttcattaatgcgctaaataatatttatgaatgttaatcacagtacattttttaatatatgaaaaagatgcatttattagaaaattaggaaaattaatttaaaaattaaattttatagtttgaaataaaattattagtaatttgattttttctatttttaaaataatcttgcaaattaaacatcatgaaaataattgacactatttgaatatcttaattttcatctaaattgatttaacttgatgctacgcataaaaaatatataattatattttcttttttttttgcataatatactaaaactctcatctgttacttttatgaattgtgtatgtatttttatattcataaaatgaattaatgataaaattaaataaattttaataataaatatattatgatttttgtaattaatagaatcattgttaattaaatgcattctacaatataatattatgttcataatttattttgattaagactttatgtttatggttttatttctaataatgtatttacagaacaagaaaatg

SEQ ID NO: 102011 - DNA, 206 bp, Heterodera glycines
  Promoter: Source sequence=SeqID_20333; Location=125..330; Strand=+; Gene=SeqID_50844
agttagcaaattaaacgtctcgactattttttttttgttccggacacttgactttttgcggcgcgtcaaaataaatattcaaaaaatactaatccctatattttaaatttttgaatcgggctgaatacgttatctgaacccttgagtgaatactagtaattggtttatttgtgttgcaggagtgcgagttgccgagtacagaaatg

SEQ ID NO: 102012 - DNA, 525 bp, Heterodera glycines
  Promoter: Source sequence=SeqID_1644; Location=1..525; Strand=+; Gene= SeqID_75029
tttagaaaatcttattttataggtcatgcaatggagttagctctggctaaagcagtcgtaaatttgtctactctgagataaattttaaatgttttaataaaatccctaagtgtcgggtccccaaaagtcgggtccccaaatgtcgggttccctaagtgtcgggtccccaaatgtcgagttccccaaatgtcgggttccctaagtgtcgggtccccaaatgtcgggtccccaagttgcaaatccccaaaagtcgcaccacgatggctacacctattaaaatcaggcagcgaaaattgcgcaaggccaaaaattaaatcaaataataaaaatatcgaaaattcagagcccttaataaaaaaaatcaaaaattaatttattaaaaattaaaggcataaaaagtacagtcattataaaatagatgaagcaagaaaagagtcatttaaacagaaaaaatgtatgccattcatccgtcgttagctgaaacttgttgaaagaattaaattgctaaacataagatatggcatg

SEQ ID NO: 102013 - DNA, 130 bp, Heterodera glycines
  Promoter: Source sequence=SeqID_31380; Location=630..759; Strand=-; Gene=SeqID_61743
agtattacgcggaagtccttcaacaactgaagcgtgccattgatcccatccggccaattaaaggcaagaaaaactacataatgactttaataattactatttaagtgatgtgcgacttcgagcaggaatg

SEQ ID NO: 102014 - DNA, 157 bp, Heterodera glycines
  Promoter: Source sequence=SeqID_30445; Location=915..1071; Strand=-; Gene=SeqID_60851
ttatgagcgctaaaattatcagagtgccgaaaatcgcatgtgatctaagcctagcaaaaaatggtcaagtaaaaatcgtaattacgctcaaaaagcttctcaaacaattttagcgcttccaattccttctacaatcgcctttatacatcccattatg

SEQ ID NO: 102015 - DNA, 1003 bp, Heterodera glycines
  Promoter: Source sequence=SeqID_1347; Location=968..1970; Strand=+; Gene=SeqID_72952
aaaagtaaaaattatgtagaaaaaacatccaaatttaaacatttaccaaaaggaaaaggatgataagcggcgaagcacacaaaacagaaaacatgtcagaaactagaacagatggtcggggttcagggctgcggaaggtgtgagaaatttccggcagaagatcgtaattgacatgagacgattttggcgacatcgaagcaacaaaaataaatgtacgacctaaaaatgccaaaaatcacacaagccttattctgacagaacactaacaaaaaagtacctaagtccaagccaaaccccaaaaaattacgtaggttttattttcagcctttcgcagatttaaataaaaatacataatgccacattaaacttggcatttaaaagaagcactaattcaaatgatcagtcgaaagcaaaagcaacaaatggacaaattgcttgaaaaaatttttaaacgaaaacaaaattgaaagaggtaaattgaaattaaaattaggtacatatgtgtcatttattcttttttttttattggtaatgcattttcaattacctaataaagtaatgcattaattttagtcattttttcgcatttttatatgttttcgttattcccgtctgctctttttttgcttctccaccacattgacatttattcgactgaccaaattgaggataagaaaaatagccacaaggaattggataccgaaatccgtacgctcttcaacgaaacaaaagtacggattttgattctttgggtttctttgaaatacaaaacaatcaattagagttcgacatttttaaaaaagcctggacctggattccttccatgttggcctggacctttggacaaaaaccctgaaaaacgccaggtcctaagaaaaatcccggttgaaaaaaaggacatgtacctggaaacaaggaaaacccattcctacaaactttataaccatcaaaaagcgtgttaaatacatttaggattatattccagccgcttttcgactacatg

SEQ ID NO: 102016 - DNA, 698 bp, Heterodera glycines
  misc_feature (70)..(70): n is a, c, g, or t
  Promoter: Source sequence=SeqID_6947; Location=3272..3969; Strand=-; Gene=SeqID_63371
aaaaaaatcaaatccaaaaatcgacttttctcgagtggtttcttttacgtgctgtaataatgattttgtntcaataaagtcaatgaaagcattgccaattgggtcattttttgataatatttatttgtgttccaatcaatatttggggcgttaaaatcaccgcagtaaattattctatttgattcatttacacttgttaaacacaccgtttcaaaaaacgagatgtgtaccaataaatagagagtgccagagaaaaacattatctttttttctctaattttttgtctccttttggcgcactatctaatattttcattatttgtcgcgactcacgtcacgagaaataaaatggaaatgataaattttataagcatgatgcaatttcattaaaaatgggaaaaaccttaatttaattggaaatgttccccctcttcgtcgttctattcaaaaaatatttgtttgtttacattcaattcttattcatttctcacacaaaaatgtattaatcagcgaatgacaccctatttaagtcgtggaattgttattgaaatcggttcagtcggaataaaacatcattcccctgcttgtctactgtttgtcccaatttctattttgccaaaatttttgccgggccaaatttgcctctgtttggtcccgacaagtggtgcaacggccgggaacctctgcactgatgaatg

SEQ ID NO: 102017 - DNA, 392 bp, Heterodera glycines
  Promoter: Source sequence=SeqID_13863; Location=1297..1688; Strand=+; Gene=SeqID_77811
tcattggattaattatttgcatttattaaatttgttaattttggtatttatttaattggaaaaacataaaactgtttttttttgttaaaatcgctactgtattatatgtagatacaaaatttagatagatttcaatacaataagtatcgttctttttgctaatcttcaaaaagaagagtaccactgaaacccactttgaatttgaagcgatacgccaaagttaaaaaaaataatgaaaaaattttgcttttaaattttcttttacctacaaacaaagtacaaacaataaaattgcataaagtgaaattcctaaccatttagatgaaattcgaattccaataaagttaggtgctgttaatctattatttaaattcatttaattgtggcttatg

SEQ ID NO: 102018 - DNA, 986 bp, Heterodera glycines
  Promoter: Source sequence=SeqID_9934; Location=902..1887; Strand=-; Gene=SeqID_72968
tcttcaatttttaaaaattatgaattaattagagactatcacaaaagctttgagctgagaaaattcccgaggttggagaatagccaaaaaaaccggcagtttatttttaaaattctaaactccattaaaattttgttgccactttttagccaaacttatttatatatatttttaaatctttctttctttttaccttttaaaatttgcttttccttttttgaaggttctgtagagttaattgttgcagatgaactttcaatcactggcaatactgccaaaaccgcaggaaaggaaaacaaaagcaatataaaatatttcatataaatattttaaaaaataatttttaaatatactaaacttttacatatacaaattaattttcttaaaattaatatttgtattttatattatatttttttaaattatttcttatttcgtaaagtattttgagccatttagcctttaaaatttgcattaaatttatgaatattaatactaatagaatgttaatccaaacactacacaaaaaaaaagaataaattttcaaaaatgaaaaaagcatggtaattaatcataatcgatagaaataaagcatgaattaaatgtttaattcatatgaattgtggcattggctatgaattaggcccatttcgagaaagaaaagaaaaatgagaaaagcgcactccatcagcttttttttcttaaaaattatttttatattttgtatgccttttatcaatttcattttcgttgtgactgcttaaaacctacaataaagcgcgtccagacatttgcggacggacatttgcggactgacatttgcggacggacatttgcggacggacatttgcggacaatttcgggaaaaaataaaaaatttttataaaaaaattttttttttaaatgcaatgcaaaattttgactcatcagaacgtttcttctaattttagatataaaaaaatattttgaagatatgcttaatcatg

SEQ ID NO: 102019 - DNA, 699 bp, Heterodera glycines
  Promoter: Source sequence=SeqID_26647; Location=1..699; Strand=+; Gene=SeqID_57399
aaatttaaaaaaatgtttatatatttatgtgttttatagcttgcgtccattttattcgcaagaatctcggctcaatttcctgttttttgtaagcctagggctcggagaaattttttgtttttaggcctaggagtctcggcaaatttctttgttttctggatgcccaagactcagagaaattttcgttttttttgtacgccttggtcttggagaatttctccttttttttataagcctaagtctcggagaaatttctcaatttttggagacctaggtctcggagaaatttcatgtttttttgtaggcctagatttcagggaaattctcaattttctggaggcctaggtctcggagaaattttaaggttttttgtaggcctaggtttcagagaaatttctcaatttttggagacctaggtctcggagaaattcctaaatttctaatttaaaaaaagaatttccattttttggctttttcaacttttatcacgtccatcatctttatttgaatggtacccaaaaaaagcttcaactcgaggggggaaaagcataagaaatgtgtgcactattttctattattttcacccctcccgcgccaattgtttcaaatttaaattttcgtcacaaaaaaataaaaaattttacgctttaagaatttccattttttaattttattcttttaattttttgacgcattatg

SEQ ID NO: 102020 - DNA, 852 bp, Heterodera glycines
  Promoter: Source sequence=SeqID_8441; Location=2655..3506; Strand=-; Gene=SeqID_68078
tcgaatgatgtttttatcacaattcataacataaataaaaaagaaaaaagggaactaaaaaagaaaaccgaacccatgagaaaaaatagaccaattaaacaagaagttttcttaaaaaatcaggaaatttttcaaatccttaataaccaaaataattcaaacgctaaaaaagtggagccaaatctgaactttaataatagttttggtctggaaaacattacagtgtccacaacaatcgttttaagtaccgcgtcaccacaaacaaatgaaaatttgcaaacccaaagccccaaaacaacgatgattcctagaattttaaccaatttaaaaacaacggtaccacccaaaattaaaaggccgccgccgacaaaacaaaaagccaatgcttctaatgagaaaaacattctcattgatagaattcaggtacaaacgactcctgcacaacaaatatacaaatctccaggaataaaaggaaaatcggctcaaaaacagtttaaaaccactccaaagcccatggtggtcacgactcaatttccaattacacaaaaaataatcagcacgaccacttctccaaaaattaaattaactttaaccacaccaaaaccaaagctaactattaatgccttagggaaactaaacacaaccacaaacactaaccaaaaaaatagaactgaattaataaaagaaaaaaaaattcctcaaaaattggaagtaaaatcttccagcccaaaaaaattaaacaaaaacattacgccgcaaaacactttaaaaagtcagagcgcaaaaccgacaacaattctcaagcaggaaataaaaaatgaggaaaatataaacacaacatcgggaaaaatg

SEQ ID NO: 102021 - DNA, 193 bp, Heterodera glycines
  Promoter: Source sequence=SeqID_18970; Location=1..193; Strand=+; Gene=SeqID_83703
attactgaaatgccagccaaacccatctcttctgtggatcgcatgaaattgttgctgagttcgggggatggggcggacgtgcactttttggtgggccaaagggacccaaaagaggcgagtgccgtggaaattcaaagcattacaaaattgttttggcttttagcttttgtcggctcacaaactcattctgatg

SEQ ID NO: 102022 - DNA, 226 bp, Heterodera glycines
  Promoter: Source sequence=SeqID_36315; Location=439..664; Strand=-; Gene=SeqID_65660
tcgtagcagcacttgattttgaaaaacaataaacaaaacgccaaaaaagtttacattattactaaaatgcttaattcatttaagcagggattaattgttttacgccgtttaaagcaacaatttcattttgttaataattaattacattttaaagcatttagcacaacagaaaatggcaaaaaaagttgttcatttaaaaaaaaatagaaaaatccagcgccacatg

SEQ ID NO: 102023 - DNA, 108 bp, Heterodera glycines
  Promoter: Source sequence=SeqID_11216; Location=1455..1562; Strand=-; Gene=SeqID_74575
tgtatgtcaaattaattataaagcatttttttaatgaaatttctcaattatttttttaagtatttctggtatgttctgtgcgcttgcgttgaaagaggagttacgatg

SEQ ID NO: 102024 - DNA, 187 bp, Heterodera glycines
  Promoter: Source sequence=SeqID_23598; Location=1..187; Strand=+; Gene=SeqID_54289
atttggcaaacgacgaagtctccgcgtggccaagaaaaagaataagcgaagtttgaggaaaatgtgagccgcattttccaattctatggcaaatgataagagctttttgcatttcagttggatttgcaacgatctttggatggacattttccctcattttgaccgtcctcaactcggcctcaaaatg

SEQ ID NO: 102025 - DNA, 499 bp, Heterodera glycines
  Promoter: Source sequence=SeqID_1138; Location=4502..5000; Strand=-; Gene=SeqID_68460
actgatcatggcactgatcagttggacttaaaaggggaggtgttagagaggcgaacattcaaatgtttgtaattttctctcttgtgaactttgacctcaaatattggttttccccatttattcatgcccttcccttcgtccatcccacagtcattctgttattttccttcctatttttggtgctccccaatttgctccgtccctccgacaaatattttttgtattatttttccatttgtgttaaataaatattttggtgttcgacatcacaaataattgtttgagcaattaaccggctcaacattggcgacgcctgttctacagaacctcaacaattcgaacattttctcgtgttgaaattgttcgaaagtggaaattcaaaaatctcgtgttgatttttggatttcgcagaattcttcaaaaaaccaatcactaattttgtgtgcggttctgctatgtgcagtttcttcttctaagtccatcctccaaatcaaccatg

SEQ ID NO: 102026 - DNA, 243 bp, Heterodera glycines
  Promoter: Source sequence=SeqID_10303; Location=919..1161; Strand=-; Gene=SeqID_73468
tcttgatgagggggggggggtcgtgaattttgggaggccaggccgttttcgtacgtgcacaaaaagttgtagaaaatttgccacaggcttttcccgaagcattccaaatatttgttcttggcatatgaaggaaattgtggcggacttggcaatcaattggtaatattttttattacaaatttaaaagatttaaatatttttaatccattttattttatgctttagtttcgttttgcctcaatg

SEQ ID NO: 102027 - DNA, 184 bp, Heterodera glycines
  Promoter: Source sequence=SeqID_21727; Location=1..184; Strand=+; Gene=SeqID_52329
acaaaaaaaaacgtttaggtagtattgtaatgtatatattattctttcttaatgaagtgattattaaaatttttgatttaagtgattttctcatttttttcaattgtcgtgactagaaaaattgtactgttgtttttgaattgcacaaatattctgctgtttgtttgtgacatcattcgaaatg

SEQ ID NO: 102028 - DNA, 156 bp, Heterodera glycines
  Promoter: Source sequence=SeqID_1768; Location=4126..4281; Strand=-; Gene=SeqID_75836
aatgtgcccgtatgtaaatcggtcaaagcggcggagagagcccgggaggaccatgccattgtggaccacatgttgaatgccacggacgtcgaccaggcaccaattgtcttccgtgtcggcaaacgaatggatggtcgaccgcgccccctcaaaatg

SEQ ID NO: 102029 - DNA, 847 bp, Heterodera glycines
  Promoter: Source sequence=SeqID_13013; Location=1288..2134; Strand=-; Gene=SeqID_76787
aattttaaaaattatcattccgtaatctaatatgtagatcctgaactgagatttcgatattgagacaggatttttaaattttatgaaaatttttggtaatcatcgcaaaaaattttgcaatcttggctttgatttattttgaataaaaacactggcgggcaacagtatgccaaaaatgcacgttttgtcaactagagcccggaaatttcaaatttgcggatcctgttgcaggattggaattcaaaaatttttgcaggaccggacccggccggattaatcctgcaaatcctgcattttaaatttgcaggatcccgcgcaggattgcggattcttagaaatttgaaaaaatttcaattaaatttccaaaaaagaaaaaatacctgacattttgaaaaagaaatttttaggggctggcgggatgcattaaaagggcgactaagattattcgaatgggtcagacggtaaaaagagatcggaaatcaaatctgttaggtcggtcaataaatttgactattttttgcttttcaaaaatgctttttttcggcgcaattttttcaaaaactaggaacaaaggggtccatctatgccgataggcgccgtctgaaatttttgaaaattttatcaattaattaactgattttgaccaaaaaaatgaccaaatgtcacaccttttgactcaattctacaggactaatgtcgatccaatggtgtcgataggcgccgccgggaaatttttttgcaaattctaggtgaaatttgagatgaaaattgaatttattttgattgattttattataaatttattcaaaaattttgacattccgtcttataaaattttcaaagaatg

SEQ ID NO: 102030 - DNA, 92 bp, Heterodera glycines
  Promoter: Source sequence=SeqID_19120; Location=1..92; Strand=+; Gene= SeqID_83864
ttttttaatgagagtgaaatcgtagtgtagcgcccgcccaaaatcggaaatgaaaattttggggaaaaaaaaattgttttggtcaaaaaatg

SEQ ID NO: 102031 - DNA, 541 bp, Heterodera glycines
  Promoter: Source sequence=SeqID_45128; Location=522..1062; Strand=-; Gene=SeqID_72497
cctgcaaatttcagtttttaataaatttatagcaaaaattatgtttaatttcagagcaaatattaattcattagatataaagttcaaagtttaaacctactttaaaaagtgacgaactcagagactataaaaaataataattcttaagaaattatcaaaaaaattgattcagtctgcaaaaaaaatccaaaaacaaatatttaaaaaattgaattttcagttgtttcgaaaacatattaaagccacgtatttcataagtgccaaatgataattacgtgataatgtgccatcagcagctgaccgactttggcaccacttgcacacaaaattaaatttttggcaccatcagcagcttaaaagaataatcgcaaaatgactacaaaaacaaaaatgttggaaatttgaattatttttactgaccaatttcaagcggtctcaaatgtggaaaatgcaacggcataaatcaaaatatggcatttttctcggcgcgtacgcattctgcttacacttaagcactcttgtcccccatcactagaaaatg

SEQ ID NO: 102032 - DNA, 150 bp, Heterodera glycines
  Promoter: Source sequence=SeqID_38; Location=10963..11112; Strand=-; Gene=SeqID_53327
aaaataattgtgattttaataaaaatacactacaaattattcgtcatgttctaaatttactgtctgattttcaacggaatattttgacaataatcgtaaagttttatctatttgcgttagaaatcagataagaaatgtccggcaaagatg

SEQ ID NO: 102033 - DNA, 269 bp, Heterodera glycines
  Promoter: Source sequence=SeqID_4554; Location=253..521; Strand=+; Gene=SeqID_54876
tctacaaaaattcaatttttgccatttaaaaaaataaaaattaaatttgttaatctaattgccaatgccaaattctgcaataataaagcatttagtcatttttataattaatttggctaattgtcatttaatgactaccgtatgctaattctacaaaaaaatatattttaccattttttccaaaaaaaattttctaatttccaaatttcatgaaatttccacaattttcctattgtcttacatggagtaagccttgcttttcacagatg

SEQ ID NO: 102034 - DNA, 458 bp, Heterodera glycines
  Promoter: Source sequence=SeqID_30760; Location=1..458; Strand=+; Gene=SeqID_61153
cagtagtaattggtcgggtgatgaaaaaacagtgatcaaccggtcaaatgattgaccagacattacgatcacttgacaatggcctctttagtactgctcagagttcccgaggcttgagatcgaaattggttcgggaattgaggaggagcaaaaaaaaaagcgaaaaatttcccgagttttgagtccgagaatctcgaacagctctcgcatggtgtaatgacaacttgtacaaaagataactcgcacaattgcttaggttaggctaaagcctaagctttaggcttgtcctaggcctaggcttaagctaggctttattttctgaaatacgagttgccattgaccccatcggtattttgagtgccaattcgtcaagtttttatatgtattggacaaaagagcaccaccgaccgaccatataataaggtccaccgcccgaaacgacgccattggtggcaatg

SEQ ID NO: 102035 - DNA, 178 bp, Heterodera glycines
  Promoter: Source sequence=SeqID_15387; Location=3591..3768; Strand=+; Gene=SeqID_79649
tcgaatgttctataaggttttaataattttctatcttgtttttttgtaatacatatttaaagatttcgttgacttttttaattgtttaatggctaaaagaaatttgccacacaagctcaattgcaaaagagcaaggcaaaaaagggagaacaagcgagaggagcgacgaactaaaatg

SEQ ID NO: 102036 - DNA, 84 bp, Heterodera glycines
  Promoter: Source sequence=SeqID_12177; Location=1..84; Strand=+; Gene= SeqID_75753
tttgtaaaatgattttgggtttgagcgggtaaattcctcctcttatagtgggcggagtcctaaatcccaggtatataaatgatg

SEQ ID NO: 102037 - DNA, 98 bp, Heterodera glycines
  Promoter: Source sequence=SeqID_22800; Location=1046..1143; Strand=-; Gene=SeqID_53501
actgtagatgcgggaaaacccgtttttaactatttttgcccatagaaacatatatcattcattaattatcaattatcactttgtccggtgagcccatg

SEQ ID NO: 102038 - DNA, 415 bp, Heterodera glycines
  Promoter: Source sequence=SeqID_4511; Location=1291..1705; Strand=+; Gene=SeqID_54722
tccctggtgcttagcgcccgtttttaaatattttaattttttcttaggcctaagaggaagttttgcaacaatttcaaatttaaatgaaaatttaattaccagactttaaaaattaatttgacaaaaagtaaccgtaatagaaaatttaaaaaaaataaaaaattaaatttacttaattatcgatttattggtatgaaaaattttcaaagacctgttgtttacttgagtaaacaaatcgtgggtcaatattattgtttgttgaataaagaacgtaatcaaaaacttacgtacttttaaaatttgctcatgttaatggtcatttggtttagctgttctcatatttttttaataattaaattattttactataattttttattttacatttttaaatcattaatttataattaatatg

SEQ ID NO: 102039 - DNA, 549 bp, Heterodera glycines
  Promoter: Source sequence=SeqID_12069; Location=1639..2187; Strand=-; Gene=SeqID_75615
aaacagtggaaaataaattttctaattatgcgagaaattatatttaccaataattttcgagaaatctctttttgtgatcagtgcgaaacgtattttgaaaagtgccgggccgagtacatcgcgacgatttttagcggagcaatcaatgagaatttgagcacagcgttcgtcagcccaacgaatggcctaataggcaatcaattaattaattatctaatttgaaaaatgggaaatgaagttagaaaatgaatgctatgaaattcaggattaaatcttaaaatcttattgtaagcagattcagaaccagccaaactgtgagaaggatttcgggaaaggatcaagcggtattgggtatcgacaagcgccggtggagggattatattttaattttgtaaaggaacccaaaaatcggggaacgggcgtaatgagaaagagaccaagattaatttgatggcattaaaatagtgctttaacgaaattctcggcaaaattgtcgacgggctaaccaactaagaaggattaaaattaattattacagcattccaaatg

SEQ ID NO: 102040 - DNA, 1003 bp, Heterodera glycines
  Promoter: Source sequence=SeqID_8321; Location=76..1078; Strand=+; Gene=SeqID_67680
attcatgtggaagtattcgcaattgttttgttgtttttatttggtgatttctggtgttgattaaaaagaaagaaactgtactcaattagcagcagtttaatgcgtcaaaaccaaaataaaaaaaatttttaataattttttaaaattaaaaaataaaaaaagctttgctaaatgtaacgaaagaattgaaaaatcacgggcaacaaaatttaatttttttttattaaatttaaattattttaactgagttaaatttcaaattatggaaaatttctctaaattgaggatccctgctctgtgtgttgtgaggtgtttgtctctttccgccgtttgagtctcgtttttctgtttctcccccctcccccctcttttccgcctgttccaacgcattctctccctttcccttttccccctcaatcggcggttgtgtcttcaaacacatttaaaatcgcttttgagacgggagaaaatgaaaaagtgacggatgttcgtcctttccttttcccttccttccgtccgtccctttctttggccttttcttcgatttgtcgcccgtttctccaacttaacaaaaatcgccaaaagtttgccttaactttggttaagctaaacaaaaacaaaggaaagagcgacggaataaataattcggcttttcctcaaaagcattttaattatttattttatgttttttttcgccaccactgttaaaaataaagagaattaattgccaacggcgatggatacaaattcattttctcattttcatccttttccttccccccccccgtaccaattggaatattcattttaaattgaccataaaagcaacgaaattgggaaacggaaaaacatttattgtgtgtacattttactggaaatttattattaaagataaaatgcgctctgtaaaaaatgctcgacgcaaccacaaaatttcaacttggaaaaataggccaaaaagaaaaaataatgcgcgaaaaaaagcgaacaaagcaaaacaatg

SEQ ID NO: 102041 - DNA, 763 bp, Heterodera glycines
  Promoter: Source sequence=SeqID_8132; Location=3322..4084; Strand=-; Gene=SeqID_67076
tagcacgatgcgagtcgtagccttggcattttttggctatatagtcttagtcgtggcatttttcattatgtggtctcggtcgtggcattttttgattgtgtggtgtagtcttagtcgtggcatttttttcattatgcggtcatggatgagttgtgcatggatgagttgggttcatccctagcaaatttaattcagtaaaattttaaaaaatttccagcgatttttcaagcagtaattcatcgttaaattttgaaaaaaattgctggaaagttttttaaaatttgtttttcataaagttttctaagaaaaaattattaattttgaaaacaaagaaactttgcgaaaaaagccttaattcgggttcgtgattgtgaattggccaaaagagtgccgaattcgtactcagcgccccaaaattttacctattaacgtgtttttggaatgtaaagaagtcaaacaaaaaggcttaggtttggcttaggttttctgtaccacccccccccccccccccgaaactgtaccgccccccgaaagatttaaaatattatcttagaaaagcgccttaagcacctattaaagacagaaaagagcacagaaaaattattctgttagaaaattttccttggactaagtcttagtgagtctgatcaaaagcttggggacgcgtatacttagagaagtgtgatttttagaaaagtttaaattagcttagaaaagcgccttaagcacctattaaggacagaaaagagcacataaaaaaatg

SEQ ID NO: 102042 - DNA, 694 bp, Heterodera glycines
  misc_feature (8)..(8): n is a, c, g, or t
  Promoter: Source sequence=SeqID_13911; Location=1..694; Strand=+; Gene=SeqID_77863
ttttaccnttttggttgaaatcagcagttcctgacttgagttataaagtgttaaaaatttgaaagactcataacttttttcatttgtatcgaattacttagcattcgcttagaaaaagattctacttttcaaaagctttttttagataccagataccaaacttgttcagtttagttgggaatgaagcgagttatggctgattaaatttaaaaaatacaaaaaaaagcatttaccagtgtaagttttgaattagcgcgcaaaaattacgccaattacgttatttggcgaaggccaagaattaaaaaaggtaataaggctgaggttcggttccgctcaacatcattaacattattatttattttttatacgaaaaacgaattatgaaaattatttttgaagaatatacaatcttggtacatatcattcgaaagcccatgaagcttttctaagcaaaagagcaattcgttgaattaaaaaaatatattggcgttcgaaaaatatacctaactgttgaactagcgcataaacaaaaataattgtctaatcgatcagaaaattttctctatcgatatgcgtatttaacattattctttctttctttttcatatcctatttcatgttaaaatatatggtaactaattgagccaaaatccagccctgttcattataaatatttttttgactcaattaaatg

SEQ ID NO: 102043 - DNA, 184 bp, Heterodera glycines
  Promoter: Source sequence=SeqID_40331; Location=195..378; Strand=+; Gene=SeqID_68699
atcgtgttggtttatgggactgcattttactcagtttattaaactcattatttatgagcaaatatatttttgtcactaatttgtctaaattacctaattttgagttttttccccatatatctatatttttttctgtggtcttttattcatttaaatttcgtcggacttatttgttaggaaaatg

SEQ ID NO: 102044 - DNA, 1003 bp, Heterodera glycines
  Promoter: Source sequence=SeqID_3693; Location=3154..4156; Strand=+; Gene=SeqID_51480
agcttcaaaccaagctagaaacatgttttccgtgcgtttcaggcctcccacagtccaagaaaagaatatggatttccatataattccgagccctacttattataaaaggcgtaatgatggtaaattcatgtacaaaatggtattaatgctgcggttgtagaatgaacgacaagaaatgaaaatggtgtcaaaaatactaaactatgacgaagcggcaaataccttgaaggaaggtactgtagttaatagaattttattatttaaattaaaattctctaataaattaatttttttatttagtttcatttattaataaatcgagttttgtttattcatttcgattttgatggttataatatttttatcccatcccttagcaattttcttttcaattcaaaaagttctgagaatatacatacatacatatctctaatattttcggcattttttgggtttatgtgaaatctttttactcaaattaatgtttaattaattgaaaaagagcgaaattaatattatgttgataaattaccaaattatgttaaatataaacatacaaattactaaaaattgaccctaaattatattaaccacattatcttaatctgcacattgtctatttcaggatttattctgtaaaagaggacttaggtgtccaaaattccgacggtgccattatcaaattttctgatgcccaatttaatttaattttttatttaatataaatcgaggatcaataaacttttccttggccgattatatttcatttaatttcaatatatttatttttttggaattccataaattattttttaacatttacaaacacggaaagggaaattaaaaatttttaaaatcaactatttaccattaaatataatagattgcaattgattgagatttttcaaaaataaatagagattttgcatatattccacttataatataacaaatataagcagaaaaaacaaaatttattattttttttttgcatcaaaaaatg

SEQ ID NO: 102045 - DNA, 509 bp, Heterodera glycines
  Promoter: Source sequence=SeqID_4723; Location=2241..2749; Strand=-; Gene=SeqID_55525
ttttcttctcttctcacagtgacgtgggaagtgatcactttgggccgtccaaaagtcgaatttcgacaaaacaaacaaaaaaaagcagaaggaaggtcaaacggaggaaattgcaattttttacgactgaataaatgccacaaaagtatttaaatttggtaactttttgtaaggggatgagaggaaaattgggaaattacaaattttggaaataaaaaaaagagggaaaatggaaaaacggcgggcgaaatgcgaacaaataacaaaatatgagcaaagaaaaatggtcatttattaattactcgttttggccactttctcggaacgaataaataaataaataaataaatgttctcttttcctttccttcctattttaatgcgcaattattttgtgtaaatgtttttttaacataaatatttacaccgaaaatactttttaataatttaatcaatattatttaattatttattcgctattaatgtgcatttctgaatttaagcaaaatg

SEQ ID NO: 102046 - DNA, 573 bp, Heterodera glycines
  Promoter: Source sequence=SeqID_23857; Location=2023..2595; Strand=-; Gene=SeqID_45817
atctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgagaaaaaattttttaatttgaaaattatgttaataattaggaaaaaagtcgatttttagggggtgtatttttcaattttcttgtatttttattgcaatttttctcaaaaatgccaaaatatgtgcaaaatatgtgccaaactccaaaatatgtgctaacatattttatgtgacaaaacgccaaaatatgtgtttttatgtttttataagtcgctctaaatcaaaaattgttcggagataatgctatttttgggcttctctcgccataactaagccgcaaaaaaaatatgtaaaaacataaaaatccgggccctatttattagattgtttttaagaattaaaaaaaaaattattcgtacttaaaattcctacctttattcaacattttagaaaatatg

SEQ ID NO: 102047 - DNA, 458 bp, Heterodera glycines
  Promoter: Source sequence=SeqID_18693; Location=1958..2415; Strand=-; Gene=SeqID_83361
aggaatcttcgatctcgcgcatcattaattgcagtgtccctaattcacaaattccgaattctccccccccccccccaccctttagcacttcgctgcacgtgaccactccgttgcagccgtaccatttgtttccgccgacgtcccaccaccacggccaccagcagcagcaccatttgcacgccaacaactgccatccaccgccgcaccagcaattgcagcacaaccagcagcaacaattgtgcgcctcaagcgacgcggctttgccgcagcaaaacggcggacacgcgcagcaccagacgcagcagcacagccaagcgacgaacaacggacagcagcaactgctgacccaccggcatcctccgcagcagcggcactgttcgcctgccggggttactgcttcaccttcgtcctcctcctcctgttcatcgcagcagcaactgttgcccatatgcccgatg

SEQ ID NO: 102048 - DNA, 150 bp, Heterodera glycines
  Promoter: Source sequence=SeqID_22375; Location=1121..1270; Strand=+; Gene=SeqID_53045
tattcggtgccgttccctctgctccttttgtccattcttagtccaaattcccgtggtcaccctttgcccgcccctttgtcctaacagcttaagcgacaagtggtgccgctagcaaatcaaaatcagatgtcttccgctaagctgcgcatg

SEQ ID NO: 102049 - DNA, 86 bp, Heterodera glycines
  Promoter: Source sequence=SeqID_6056; Location=1727..1812; Strand=-; Gene=SeqID_60164
ttttggggcaaatgccatttaaattaatcaacttcttatgtgtcttttggcccggtcgcgcgaaaacactgccaatttgagcaatg

SEQ ID NO: 102050 - DNA, 144 bp, Heterodera glycines
  Promoter: Source sequence=SeqID_27068; Location=1082..1225; Strand=-; Gene=SeqID_57787
ggggtgttcaattgctcagcaagaatcataatgctgttgctacaatgcaaataccttcaaacggtagagttttgtcaaaccgaatttaaaaataaagccaccaaattcagaaataaatgtttggatgggttcattttgaagatg

SEQ ID NO: 102051 - DNA, 252 bp, Heterodera glycines
  Promoter: Source sequence=SeqID_13563; Location=110..361; Strand=+; Gene=SeqID_77466
aattgtcagatttgagtttcagtaatgaaaatgccgataattcattggaattgtttaagtttagtgatgcgaataagaaaaaaagggcttcagattctcatcccttacgagtatttctggttacggacttgctgaagctataggatgataaacctataccaatttggttgctcgaatagctacttacccgtttatcgatgtcttggtcccaaagatcgttaagaatgcatccggcacttctcatcaaaaatg

SEQ ID NO: 102052 - DNA, 87 bp, Heterodera glycines
  Promoter: Source sequence=SeqID_1297; Location=2216..2302; Strand=-; Gene=SeqID_71909
cagtaatttatcaaagtttgtaaaaaaaattaaaatatttaatgaattaaaagtttccgttttcagtttccttttcggcaaaaaatg

SEQ ID NO: 102053 - DNA, 110 bp, Heterodera glycines; identical to SEQ ID NO: 98226
  Promoter: Source sequence=SeqID_32494; Location=805..914; Strand=+; Gene=SeqID_62800

SEQ ID NO: 102054 - DNA, 86 bp, Heterodera glycines
  Promoter: Source sequence=SeqID_40254; Location=260..345; Strand=+; Gene=SeqID_46622
ggtttataaattcaaatactgaatcattgactcccaataaaacaccgttagggcatggtgaaatattgatgggaaagaacacaatg

SEQ ID NO: 102055 - DNA, 547 bp, Heterodera glycines
  Promoter: Source sequence=SeqID_2678; Location=1779..2325; Strand=-; Gene=SeqID_81039
agcaaccagcaaatcgctgtataacatccaacagtaccagttcaattttgtcacccctcccccctcccattctcgtccccctttggcgctgatcggatcggtcagcagcatcagacccatcaaaacgaacggcaaaaagggcgccattccctttacggcacagcgagcggagtgagcagaggaaaaagggacgagagcggtgaagaggagcgggaaccaatcccgcctcagctgggccaagccgcatttggccaaagcccgcccgagtaaaagattggcgacaaactggtgccgttagcaggggctttctgcaaacgtcggcaaagcatcagtcgagagttttggtcgccgaggaccaacagcacaacgaagagaagctaacggcaaactggtgccgttagcagggggcaactgcagccaccaacaatcggtctacgagcgaccaatcggtctacgagcgaccaacgagcacgaattcgagaagctaacggcaaactggtgccgttagcagggggctccagctcaacatttcgagagacgacaaatg

SEQ ID NO: 102056 - DNA, 129 bp, Heterodera glycines
  Promoter: Source sequence=SeqID_398; Location=334..462; Strand=+; Gene=SeqID_51355
ttcgtcaaccaaaaaagcgcccttgtcaacatcccaatcaaatgtaatatttaataaatgtgccattttgaaaatttaaattttattttccatgttcattcttaaatacaaatgctttaacaggagatg

SEQ ID NO: 102057 - DNA, 684 bp, Heterodera glycines
  Promoter: Source sequence=SeqID_29722; Location=1..684; Strand=+; Gene=SeqID_60199
aaattaaatatatagattgttattgcattctgcatattatttttcaaatttataattatttttgatttgaaaaattttttataagatatatttgagtttgtttaaataaatttttcttatttttcgaacaaatatgctttcattaagatgtggaatgatgatttagaaagtcacatttaataggatttaaaatttataagattgtacacatgttttctttaatggttactattctttgcagcaagatattcattaatatttcattatttacatttaataaatatagtgatgaatgaagttcaatttatgtgggttgttcaatttcgccattaatgttcttcctttaaatattatattttaataccttaactgctacactattgtgttttttttaatacaaatgcacacatgtgtgcgaaagtgttcttactccagcttctgccaaccaccgcctggcgcgatcggttccttgaattcgcagatgcgtggcaaaaatttcagtgtttttttgtactaaacgcttttttcccttttcgttttagtaaaacagaaattgtttgtttcattttatttttggtttttaaatattttttttttgttttcgtgaaataaatatttttcctttctttttgatttcaatttgggtttagttttataactaattttaaatgttgacacttcatg

SEQ ID NO: 102058 - DNA, 1003 bp, Heterodera glycines
  Promoter: Source sequence=SeqID_24033; Location=170..1172; Strand=+; Gene=SeqID_54733
ttgcccagatcggcagtgttatgttcgtcggtctgatcaaatcgggcaaaggggtcgactggcgcgtgctgctcaacgtggccctgtcctggctgctcactttgccattgtccgctgtattctccgctctcataatgttggcacttaaaatggcatttctgtgaaaaatggaaatgcctttgctttgcacttttggcacttcgcaactttggaaaaagattttcgtcctaataatttgttattttgtttttaattgtttacccatgtgaatgttgttatctcttttgtatttttaattgatttttaatatcgaaattaaataaacatatttttcgaactttttgatgacaaaaatttatttgaacattaagcatttgcactttctggcatttaaattagggtagtgcgggaccgggactgggccgagccgggattcccgatccccgataggacaaccgggaactataattttaatgatcgcatttattattttttattgttattattaaattcacttacaaacataccaagaaaactttgctaatttaatatttgtttttccaattaccaattaaataaatggcaataaaattagtcgagaatttgtctcgaccaatttaaagaattttaagaaaataccaaacaaatgggcattctttcttttaaaacatttttcgttctttttacaacatcacttttcctttttaatttatattcacataacattttgaactttctcacaaaatgattgttccttttatagtaattgcctaaatttcatgagaatgaaaagcacggcaaacacaaaatcaaattcattttgaagcattttctctcaccgttttattttcgcctttccgtttttctttttaattattcattttcatttatttgttccaattaagttaattggtgaaatgagctccaaatggcactgtggaaactgcttgctttaacaaaatattctgtacatttcatttataagtcataaaaaaccaaaatg

SEQ ID NO: 102059 - DNA, 68 bp, Heterodera glycines
  Promoter: Source sequence=SeqID_1317; Location=615..682; Strand=+; Gene=SeqID_72418
cctgcggggaagtaaaacgatgatggaaaattgaaattagtcttggcattatcacattgacgagaatg

SEQ ID NO: 102060 - DNA, 1003 bp, Heterodera glycines
  Promoter: Source sequence=SeqID_38; Location=13377..14379; Strand=-; Gene=SeqID_53328
accagactcgaaccccttgaaatagccggtcatcagcgtcacaaagtgaattatctttctgcgaggataacatgcacagaatgttgtgattctgcgaatcgggctcggaccaattgccaaatttgcacgaccgtgtatggaacgttggatcggctaaaaaattggtcagtgcgttgttaaaatttctgcccatacattatgtaaaggttcatcgtctattaataggagcgaagctgaaggacacgagccaatctcagagtttgtagaatggattatgcgcgcatggactaacaaatttaaaacttatatttgggtgggttaaacccatttaacacgccaaacctttcttatctacacgtgtttttgaaatcaggcgcacaacgcatcacgatttgacggccactttgtgttaaagtatttgggcgaaactaaacgccgcccggatgttgtaatgaacgggcttaaaatttttgaattccgcctccaacattcgagacgtcattcactgctcacatggcgggattcttgtcttcttatgccaatccgactcgaggatttgccaaaaacgttcagtttggattgtgcggacaagccgttttttccatacgcattcaatcggcagttagcattaaaaactatggtaaaagttaacgatttctgtgaaatttagtgaaaattataatgtaaatttgcaacatctgccgccaatgaacgactattacccagggtcaatgaggcaagacaaatatgataagtttataaaatggtatgtagaatgagtgaggagatgattcgaaactctaataacaaaacgagcaggtacgaagaaaacaaaaacactccattttcgctgacgcaggagttgcgtctctactgccaaaacgacacagaaattttgctctccgcgattatcgaatttcggcgaatattgatggacgaggttaccggaggatttgatgtgttacctctcagcgctacaattgccaggttcagttaacagatg

SEQ ID NO: 102061 - DNA, 547 bp, Heterodera glycines
  Promoter: Source sequence=SeqID_12755; Location=1..547; Strand=+; Gene=SeqID_76462
tttttcaacaatttgctctggtgacttctgatcccacatgtctcttcaattccgtccgttctcaaccaaaacgtaataaaattccccgaggcgttttacctccgttttccgggggcgaaaatttttcccttttcacaaaaaggccaacgggtgagtaggtggacggaccgacgggcatcaccgcccccgagggccgaatggccatcgtcccctccccccttccttccccccccccccatttcttccgcctctcagcggcggcctccgtccatttttcaaagacggtgagtcgggaagatatgtccgtcccttggaggtggtgatgagacgacgaacacccaatggggaagggtccgtcctttctcgactttggcgatgagcctacgactcactctcgattgagagagaggggcggaagagggattggccatccaattcagcgggaccattgaaggtgttgagggaggagacactctgctggaggagaaaatatggggattctctgctggaagagaaggaagagattgataagggaagaaaggaaatg

SEQ ID NO: 102062 - DNA, 187 bp, Heterodera glycines
  Promoter: Source sequence=SeqID_2021; Location=993..1179; Strand=-; Gene=SeqID_77369
tcggaggcataaatgccacaatttgagctaagatctcttcgaatgggtctgcgctacggattttcactatgctatgggaatgaagaatattacaaatcagctcgccagctgttgattttaaaaaaactgaaactttggccccaaaacggaaaagtaccctttttattagtgtcgccctgaaaaaatg

SEQ ID NO: 102063 - DNA, 130 bp, Heterodera glycines
  misc_feature (8)..(9): n is a, c, g, or t
  misc_feature (40)..(40): n is a, c, g, or t
  Promoter: Source sequence=SeqID_15764; Location=1..130; Strand=+; Gene=SeqID_80093
gcctgcannggtccctttagtttcaataaaaaaaattttntgaaaaaatctgctcattaaaatattcaaaaccaataaattaaatgctctaattaatccatgccactttcagaaatcttttctgcaaatg

SEQ ID NO: 102064 - DNA, 187 bp, Heterodera glycines
  Promoter: Source sequence=SeqID_17696; Location=2576..2762; Strand=-; Gene=SeqID_82225
agtaattgaagaaataacaaacaaacagaaacatggcctattctctgatcacttttgcgtggtcgtctactgtttttttcagtatttgactgagttcggttgggccgaaaatgggcggagaatttgcatcactcagccgcgacgggtggccgccatttcgctggcgagtcgcgtggcggacgaaatg

SEQ ID NO: 102065 - DNA, 69 bp, Heterodera glycines
  Promoter: Source sequence=SeqID_6814; Location=2527..2595; Strand=+; Gene=SeqID_62974
ggtcaggaataatttataaacttaaatttaaaaaaaaatttttttagcttttttggacaaaaaataatg

SEQ ID NO: 102066 - DNA, 206 bp, Heterodera glycines
  Promoter: Source sequence=SeqID_35592; Location=1194..1399; Strand=-; Gene=SeqID_65122
aaattgaagaaaaacgtaaaattaagtttcaaaaattggaaagggggagaaaacagagaaaattatgccattttttgtagaaaatttatcagaattaacaccatcgcccaccgatattttgtctattagcccaattcatttttcaactagaaaaaactccaaaaaatcatgaaagctaaaaataataaatttttaccccaaaaatg

SEQ ID NO: 102067 - DNA, 1003 bp, Heterodera glycines
  Promoter: Source sequence=SeqID_17348; Location=1544..2546; Strand=-; Gene=SeqID_81827
tataagtatttttcatcttctcaacttccgcttcttctgcagttgtcatagtttttgttgatgaatttgcaataatttagtcaaaaaatgaataaatgtgtcaatttaaaatggattttgagcgtcatttgttaaagcaaagaaatatttttcatggattttaagtttggaaaatacataaaagtgtagaaaagaaagaaatgtcaaccgtaatcgaaaaagtttgaactcaaaacttggccaaattgttgtgactgagtcgtagacgatgccgccacggcaatattattgtagtgccgaaagcacaagtagtgggtatgaaggggagaaagaaggtgcggtgcgtaagacaataagctaatgtaattcaaattagaacaattttaatcgtcgtttcactcacaaaaatgccattcccaattttctgcttatttcaatcgaagtgcgcaaaaattttaggcatttgccttttaattcaaatttaaaaaggtaaaaattcaatagtagacaacatgtgtttatataatattcgagaaattttaaaaaggaataaaaattaatattaaaaaattaaaaattttcacgaattaaaaaaaaaaatttcctttggccgagtttttcgtcagtttgtacactttaaaaagtgaaagcttatgtaaataaaataaatttatgccaataacgaaatgttggcaccaaatgatttattgttaaatgcacagtgttttcacattcgtccaaagaaaaataaataaataaaaataaaattttttaaaaatttaatggccaaacacattttataataaaaatggaaatgcaattagaacggatttgttggatttaatgcatttattatgaacggggccaatacatattatggctgccacaattattccttaaattttccatattattaaaatgctttaataaaataaattaacattttccattttccattttctttttttatttatttctttaaaatgaattaaatagcaaaatg

SEQ ID NO: 102068 - DNA, 1003 bp, Heterodera glycines
  Promoter: Source sequence=SeqID_12944; Location=744..1746; Strand=+; Gene=SeqID_76695
atttttattaatttattatattaaaacatttagaatgagctttttcttcaatataaaattatatgaattacataaaatatataaatatttttttaaaataaatgttttcatgaaaaaagatagaaatttctttgactgatttgtttcataaatgatttgttcggctttgatggatatgtttaaaaaggagaaatttggctaaaccttgtgattataaaaaataaatatttctacgttgtttaaatgatgtcatttccgtgaaaattgcccaattattaattgatttttttcactaataaaaattttattaataataaaaaaattttgattgtataatattttttaaatatgaactgaactataaactacaaaaataaatggatttaaacctcataaaatgccaaatttatcaaactctaatttcaacaattgcaaactaagttatttcatgattttttggtaaatctcatctgtttgtagcgaaaattttcggaagcgaacaaaatacttaaaaaattgccaaattttcaaaaaattactcttttgtgctgttttattaatttctagaacgttgattcttaggggcgtatttttagatttttttgcttttttcttgtgaaagtttcctaagaatggccaaaatatggactaaaaacgcaaaaattgcaaaatatagaatattcccgaaaatcccaaaaatatggatttacatatatgaaaatcttcaccaaatcaaaaaaaaatttaaaggagaaatgctatttttcaacccctttcttaataaatagtatatgcgcagaaaatttatttttattccacatttcatggttatttgttcatttttattgtaatatttcaaaatttacacccaaatacagtcatggtcatatgtttaacaacacttcaacatttttgatttaaatagctataatattttaatttgattataaatgtgtagtatgtcttaagcttttttgttgcattttttctgggctttccaatg

SEQ ID NO: 102069 - DNA, 436 bp, Heterodera glycines
  Promoter: Source sequence=SeqID_24181; Location=1263..1698; Strand=-; Gene=SeqID_54892
tcccctttccttaatccgcaaaatgttttttcattcgttcatttctaatccatcgacaattattcctccattcttctttaaataactcagaaaaatctttgtgtacattaacattagcagccccattcttaagggcatcactattcacacatttgtatatatgtagcaacaataaattactcctttaaaatttagctaaattttaaatttttcaaaactgattgtgagacttcattcaaatgcagcagcaacagcccgttccgaagtgtggcaatggtcggtgttttttttaaaaattattaatatataaaggaaggattgtattatttttgtgcctttcttttcgataggccgagtaacaaacagtcagacaattttcatatttagtgaaatgcccctgtggagacgcgtgccagtgcggcactgactgcaaatg

SEQ ID NO: 102070 - DNA, 98 bp, Heterodera glycines
  Promoter: Source sequence=SeqID_37425; Location=101..198; Strand=+; Gene=SeqID_66506
ggtgcaaattacttacaccgattgcgaattatttaccgattcaaccttttttccaattttttttccagtcgtactgttccaatgtcgcgcgcactatg

SEQ ID NO: 102071 - DNA, 315 bp, Heterodera glycines
  Promoter: Source sequence=SeqID_5023; Location=1556..1870; Strand=+; Gene=SeqID_56604
aattaccatttttttcaaatgtttccaaaaaatttttcggaggatgggacgaagcgatacattgagggagtggaaacgagctgcccccgttaacgacctgctccgaaataaaactttttcgatacaaattcagttttttttttgtcaaatacacattttttagcctggcacattccgttacgtgttcttgttttgtttggcacattttatgcacggagttggcgcaactccactgtacaccattggcttgtcctacattgacgaaaatgtgtctattattaaaattttcaaatatctctccaaactcaaacgatg

SEQ ID NO: 102072 - DNA, 78 bp, Heterodera glycines
  Promoter: Source sequence=SeqID_11417; Location=361..438; Strand=-; Gene=SeqID_74811
tggcatgaactgtcctacaaaatggggacacgttcgtggcaaaattagtgtggcggtgggaaagggtgccaagaaatg

SEQ ID NO: 102073 - DNA, 715 bp, Heterodera glycines
  Promoter: Source sequence=SeqID_20843; Location=1..715; Strand=+; Gene=SeqID_51429
ttcataaccctttttgcgggatgagctttttgaaacaattttataaatttttgtttaaaaacttaagttttgtagtttgtaagtatcaaattcttagatttattgtaactgttgaccgatttccaatttcttaacagattttgcaccagaatgggttcgtccgtcgatgcacccttaataatttgaagcaccccactttctcattgttccctatctcgccatttcttcatgatttctttcaaattgcaactgtttaaattatttaattttaattttatttaattttttgattttttgtcaattttttgcgatttttgggtttattttctttcatttttcattataaaaaattcaaaagaatttgcctttttgtcgcaaaataaaacccaaaattttatgtttcctaatgaataaccaaacaatccaacgaaaaagcgacaaacttagtcataatttgaatgagcaatgatacaacaaaatgacatttaaaaaacagagtttggaatggaaaaacggagaatttacggagcccaagaaagcatcgttattaaaaaacataaaaattaaattgtcgaaaatatttttgataaaattcagagaatgtccaatattattttttcacatttcccatgggaaaaattgaaatttgtttttgttgttttgccgtctttgatgtttctttctgttatttataaaaattacagtttttcatatg

SEQ ID NO: 102074 - DNA, 52 bp, Heterodera glycines
  Promoter: Source sequence=SeqID_27892; Location=83..134; Strand=+; Gene=SeqID_58561
atttaaaattcgaaaaaatacaaaaattgaaaataaatataatttgaaaatg

SEQ ID NO: 102075 - DNA, 60 bp, Heterodera glycines
  Promoter: Source sequence=SeqID_33081; Location=798..857; Strand=-; Gene=SeqID_63252
tcgtaattttttggcaattgtccaatttcgtatttttttaggtattgtttacaagcaatg

SEQ ID NO: 102076 - DNA, 707 bp, Heterodera glycines
  Promoter: Source sequence=SeqID_37844; Location=242..948; Strand=-; Gene=SeqID_66829
gtagctccaaaacttaaaaactgcttaaacacggtcggaatggatttaagacgatataaaacgatggaaacaaaaaaaatgcaaattaggatactaagcaccctgaatctacttttttaaatcgatcccaaaagactgtccagttttgagtttgggagcctatgcttaatatttaccaattttcgccaaaaaagttataaaattattttatttttaatttccaacaaattttatccaaaaattttcctttttaatttccaaaaaatttatccaaaattttcctttttataaaaaaaaaattcttttaagcacctacaaatatttttgtacattaaaaccaggacttccagcagcactgctgattatcagcagttttaaaggggtcaaaattgaatttttttttaagatgctgatttgttctaattttaagaaaaaatcttcaaaaattgctaaaactgctaccaaaaactctcaaattttcaaatttatggcgatatgttggttttttttgtgtgtgactttttattccttcgagattttattgcttatgttgtttgttaagtattttccgagagctcctccttttgacacatgaacttgaacggactttttacacaaaacgaaagcactcatttcactttttttttaaatcaaaaaattgtatttttttaatattcgggaacgtggaaatttatcgctttggaatg

SEQ ID NO: 102077 - DNA, 201 bp, Heterodera glycines
  Promoter: Source sequence=SeqID_32; Location=1339..1539; Strand=+; Gene=SeqID_50794
ttgcgcgcaagtgagattttgtgcacattcaagcgcttttatatgtgcgtaggagcaccgtaacttcgtctttcacgtagcgcgcagcactgtaccttttcgctatataaaagcacacaaattgatgcaaaacttcattttaatcagacgattttttgcaaaataaaaatgaatacttttaataatgttcagcaaaacatg

SEQ ID NO: 102078 - DNA, 560 bp, Heterodera glycines
  Promoter: Source sequence=SeqID_15029; Location=2629..3188; Strand=+; Gene=SeqID_79194
atttgagaatgttcgagtgatatgaggcttcgaaggagtgaccaaacaaggaaagattggaaaaattccctcgaattttcaaaatctgtgaaataaaaatgctctccaattccccccgcgaaaaatatctgtccgatggttcacggaaaaaattttacctttaatgcgcacattttattacgagttttcggccaaaaatttacgaaattataagaatttttcgtaaaattttgaagctaattcaaaaaggaaaaaaacaaattccaaaaatcgtttttcatctgtcaatttattttccgacgcagaaaacccttgtcccttccgaataattggataatccctccattttctggtgcttttccaacatcttccaacatatttgtgtaaaaattgtagaataatgacatggaatttggtgcagaaataattaatttgttgcctttgctgtcacttttttttaaattacttccattgtcacataaaaaaatgtgaaaattaacttttcagcaaaaaatcgggaattttttgacacgaattgcagcttttaattatcgcagatg

SEQ ID NO: 102079 - DNA, 69 bp, Heterodera glycines
  Promoter: Source sequence=SeqID_34872; Location=1..69; Strand=+; Gene= SeqID_64572
tgtgacggcatcagcgtttacagtgccgacggcgatttggcacaaccactgcagaaatagcggaaaatg

SEQ ID NO: 102080 - DNA, 384 bp, Heterodera glycines
  Promoter: Source sequence=SeqID_43295; Location=1..384; Strand=+; Gene=SeqID_71002
tatgctgtttatgctcaagacaaacatagatgaaagaaaaaaactttaaaattttttttttgaaaaatgttcgaatccgggttcggggttcagaatcggtcaaaaataaggtcggattcgtgctcagcacagtaaaatagccctagaaaaatttttccatgatttttaaagaaaaaaaaaacgggaccagtaaactccatgattgccgtattaccggcttaggcgccggctttgagattaattttaggatgatgtaattaattctgaatacttcataacctttctgaaatattaaagaggtgttgatgactccttaattgagcctatatattgtgatttacaacagtatttcctctccttttttcttaattaagctgacaaatg

SEQ ID NO: 102081 - DNA, 434 bp, Heterodera glycines
  Promoter: Source sequence=SeqID_13187; Location=2240..2673; Strand=-; Gene=SeqID_77010
ttccttgccttgtgctttagcgcccgcttaattagcacaattagcgaaataaagcctcatttcaaaaggttgactgatgatattttacataaatttatctttccctttttcccttttattaaatgcgcacattgcgcaacagtgaaacgcaattttcaactaattttgaaattgttttgcgtgaatttggtttcgggtcatccgttgggatggcgcgggggggggagtaattgcagggtcaattaatgaggttattgggtggcgaatggtcgctctctgttgccggtgggcgcatcttcacccaattccccaattcaccgacatttccgccccggcggtcaaatccttccccaaataattttgtatcctccgaatttaattcactcactctccgccattcacagaattaaatcagcgaaaatcccccaaaaatg

SEQ ID NO: 102082 - DNA, 612 bp, Heterodera glycines
  Promoter: Source sequence=SeqID_13137; Location=3364..3975; Strand=-; Gene=SeqID_76941
atgcaaaaacacctaacaaattgggtgaaaacgaattcccttcccattttaagtcgtacaaagttttcatggctcagcgatgtccgctgacgtgcggccaatgcgcaaatcatttgaagaattacaaagatttgcgacgcactgtcagcagcagattttgatcaaaaaattataatttttatttatattttctttccaattttctcttacttttctctttttttctcatagtctcgcgatttccataattatacgaaaaacgaacaaatttttcacatattttccaccaatgaaatgaataaatgaatttgcgatgactcatctcatccatccttttattttcaccctttttcattggtttagcagtcgcttttccaccaaacgaaaatcccatcaataaatatttgtttgactttgtcccatttccaaacactgtgccactcctctcccattgctccgccccatttcttcagcatccatcaacatttattcgtctctttcccttctcatttcccctcctttgatttggtttaattttattttagtcattattcttttttgggtttaaaataatctcattaaatattttggcagcattaattcccacttatg

SEQ ID NO: 102083 - DNA, 721 bp, Heterodera glycines
  misc_feature (18)..(18): n is a, c, g, or t
  misc_feature (151)..(151): n is a, c, g, or t
  Promoter: Source sequence=SeqID_19266; Location=1..721; Strand=+; Gene=SeqID_84011
ggtaggaaaacgaagttntagcgaatgcaaaacggaacaatcgaattccgctgacaaattaatgcccttttcggcgcgatttaacaagctcaaacttaagcgaggaaacattccgcggaagtattcgttattatttttacaaaaaaacttntaagaaattttttagtgcatttttttaccaataaaatttttatggcccatcgttaaatgtacaattaattcaattaattaagaaaataattcaaattgtacacatttatgtttttttttttgcttttgtctaaatgataattcgctgtcgcttatcgttttccaaaaaagaaacaacgaattgaaaaaagagaaaaggggcggacggaggaggaaattcataaattaattacaaaattaaattgtaaaattacccttaaattttgggcaaaactctcataaatcacagagagaggaaaggaaaaggacagtcgttttttaactttcctctcaaatcaattaattcccttctcagttgttttaatttaactttacgaattcggggctattatttttccaaaaaatgtaaaaagagcagaaaattgccaaataatcacttaaatgggataaatggaatagaaaaggggcaaaataaaataaaaaaaaaccgaataaatatatttaatttgattatttttaattatttgattcttcaaaactaaacaaaataataattattatattaattatg

SEQ ID NO: 102084 - DNA, 331 bp, Heterodera glycines
  Promoter: Source sequence=SeqID_11152; Location=1417..1747; Strand=-; Gene=SeqID_74504
ggtgctaggtcgatccacaaaaaagctcagtgtgggcgttccacaaaaaaagctcagtgtgggcgttccacaaaaagctcagtgtgggcgttccacaaaaaagctcagtgtgggcgttccacaaaaaagctcagtgtgggcgttccacaaaaagctcagtgattgataaaataaaataataaatttaaaataataaatttaattattgtattggtaacatccacgttgaaatcaataaccatcaatacatataattttgggctaccactgaaaatgtaaaattaatacaataaatttttatatgtttaataaaattataatttagaaaatg

SEQ ID NO: 102085 - DNA, 378 bp, Heterodera glycines
  Promoter: Source sequence=SeqID_20984; Location=1831..2208; Strand=+; Gene=SeqID_51560
acattaatttttataaaataaaaaaaggctctctattatattaagatggtcgctgatcaagaccgtgaaacgccaaccatttttattttaaactcttcaaatcactttgaagtgatacttaatttgattgggaaatattaaataataacgaaattataattatggccagcaatataattaatagattaaaatagttatattattaattaattaaaatcattattcggtactgaaatgacccgcctcttctgatcaccactcatttgcctttttgtcacttcgcacacatttgcctttttgtcacttcgcccacatttgcctttttgtcacttcgacacagcaccactgaacataccgggctttccgggagggagaatg

SEQ ID NO: 102086 - DNA, 57 bp, Heterodera glycines
  Promoter: Source sequence=SeqID_6972; Location=411..467; Strand=-; Gene=SeqID_63443
aattatgaatcaaaattaccaattaatgaaaattttgaagaatatttagagaaaatg

SEQ ID NO: 102087 - DNA, 85 bp, Heterodera glycines
  Promoter: Source sequence=SeqID_19991; Location=1680..1764; Strand=-; Gene=SeqID_84762
ggtaatgcgaataaattagtataattgtatgtataattaattagaataattaatttgttgcaaattctttgaagtgccgccaatg

SEQ ID NO: 102088 - DNA, 481 bp, Heterodera glycines
  Promoter: Source sequence=SeqID_25344; Location=1..481; Strand=+; Gene=SeqID_45924
ggccggggtcattacccagccctttctgtagagtttttgaacgaatttgaagtagtaaaaatttagattttttgaacagtccaagattctttgataaagaccaattggggttctaaaaaatggattgactacaactcaaatattaaaaacgatggacgatatatatatttctatacaaaggaatcaacaaattgacataatctatattgattttgacaaggcgtttgattctgttccaattgatttattacttcaaaaaatcaaaaagattggaattgaaggaaaaatttataattttttaactaactttttaaaaaatcggagttttaaggttaaaatcggcgatgaattgtcagaaagtttcaaaatattttcgggagtgccccagggaagtgtcttagggccattactctttttaatttttataaatgatctgccgtcctttatttcaaaaaaagcatcatcagttggcataaaaatg

SEQ ID NO: 102089 - DNA, 113 bp, Heterodera glycines
  Promoter: Source sequence=SeqID_3996; Location=2382..2494; Strand=+; Gene=SeqID_52741
aaagtgaagtcatcaaattggccaagaagatcgtcaaaaacgattttgaaaagaagtgccgcgagatgttggtcggtgccattttccaagcatttattcgtcagcttaaaatg

SEQ ID NO: 102090 - DNA, 1003 bp, Heterodera glycines
  Promoter: Source sequence=SeqID_7914; Location=1492..2494; Strand=-; Gene=SeqID_66360
aaaacaaaaagaaaaaatgttcatgggaaataaattattaattttctgctcctttataaaagtacatataattttccattcataacttaacactttttaaaacgttgctaaatttgtcacagagaaagtaatttcatcattaacaacaatttctgtgattttcattttcaacttttgttttggtgttaatttgattttttttaagaatagcaaaatttattaaaaaaaacgctgaataattatgtacaaaaattattacttttttgccttaaaaatgtttggtttacaaacatacaaattaattaaaatgacattattaatgcccaccaactgaaaaccgccaaaatttcgagaaagtgcatttgtccatatttcatttttgcttctacaaatgatggtaaacattacatgtgttatataacaattcaaagattaaaattgttttatctttaattggtactcttaaaaaatccaatttttcattgcgcaacagaatttaattatggtcttagaagtgaacatttcagctggcaatttcgcattaaaagttaatcgccatttgtgaacattagccaataattactaaatattcgacaagcagaaaattgaaaatttaattatcactttggaatttaagacaaaaaatcaaattacacacttaagtgaaactgcaagaaaaaggaaattataatttaaatttctttcattttgacaaattaaaccacaattaagagcagcattgaacaaatgcctgaatatggtcatataaatattaatcgacttcaaagcagtgaaagcattttctattagttattttcttaatgcattaattagttcccatgattggcatagtcacgcaaagccatgggaaaacctaagacagaagcaaaattgtcaatttgttcataatttgtaaaaaataaaataataaattattattcttgacattcgaaaattaaaccaaacaaaagccgaaagctgaaaagattttctttaaaaaatg

SEQ ID NO: 102091 - DNA, 853 bp, Heterodera glycines
  Promoter: Source sequence=SeqID_1273; Location=855..1707; Strand=-; Gene=SeqID_71240
aaaatctaatcactgatagtcggaattaaaatggtttcttggcataacaaaaataatattttgtaaattctatttaaatttcgaaggcgccttgccgaagcaaaaattgccttttgtttactccttaaataattttggcccaaattttttgagaaaataaaggaaaagtctgatacgataaaggtgggtcacgcagaaatttttttgaaatatttgttagatttgttaagaaaattacttcggttttatttttttctctttaaaattttacttttttttcccggaggtgcgtggtcataacttttcttaatacatcaaattaaacaatcttgtagtcattcgatagctcttgggttgctctattagcatggaaaattttagaaaagttcactgacaaatcagtacggcggcgcctatttgtaacgccggccctaaaatccttatttctattaaaaaaaaattggctcaaattcgcaaaaacaggtcatttttggacaaaatttactaacaaattgcattaaaaatttaaaaatcgcggctgcgtctatcggcaccgcagctaaatcttttttttttatgaaaatgcgttcagaaagtatggcaattttttgaatttttgatcacaaatttcttaaaaaaatctcaatgaatgtttctgaaattttttaaactaatagagcaacccaagggctgtcgtatgagataccaagattatttattttgttggatgtttttcttgaaaatgtgtaaattaggtaggcacttttacgaaacgccatagtggcattttttaaaacgaccttaaaaaaatttcagttggttcgacactgcttgaaatgaaagtgaacccatg

SEQ ID NO: 102092 - DNA, 322 bp, Heterodera glycines
  Promoter: Source sequence=SeqID_11486; Location=225..546; Strand=+; Gene=SeqID_74903
ttgtgaagggagaaaaaacggagacaaaataacggagaaaggacggattgaaggaattcagcgaggcgatgttaccggtgccgaaaaaagctgaaatttagcggttttttatgagtataaatggaaattaattttgaatttacccatttcaattgaagcgaccaaacaaagggctcttagaaattcggaagttgaaagaatttgttgaggaatgaattcatctaaatgacattaaaatattatagtttttcattaaattattttttgcctttttcattgccaaatttcggtgccctttctctgattgtaattgctaaaaatg

SEQ ID NO: 102093 - DNA, 953 bp, Heterodera glycines
  Promoter: Source sequence=SeqID_14453; Location=1..953; Strand=+; Gene=SeqID_78495
gtttcgttaatttgtatttcgttggtgtttttattttataagttcagtcagtgtagtgcttttcgccacttgtttctttttcgtgttggctttgtcgtcggagtaattgattaggagtcgctctgtccacttaattatttaaattagtgatgggtttgctgtagggtttattatgactttttaattatgtttggctttttatggtgtcctttttcggttttttgattgggtttggtgatccgtgtgtgtgtgtgtgtgtgttttttttttttaaattgggtttgtcaacccttgattttgtatgggcttggtgacccttatacttccggatgacgagcagttgcgcaacggtgaatttgacgttttgacgtggcaatcaggtgcagaccggacaggcagcacagtaagacgaatgggcacagcaggacaaacgggcagagcggcaggcacggcaggacaaatgggcacagcggagtggacaggcacaacagggcgaacgagcacagcgggacgcacggcaggacaaatgggcacagcgggaaaggcacggtcccgggtcgtggcaccaattcttgtcgtggcgacaagaaatttgcgtcgaactctgcggggtgaaggggacgggaaggggatgaaatgggcgaggcgcgcagagtagccggtcgggggaacgtagggggtcgggaccgatcggagagcgatgagtcgtgccggttttcgtccaggcaaatagaccaagttgggcacaattttaataagagtatgtttattgtgtcgacctcaaacttgggtaattaaaccgtcccaatcgggacggtgaaggaaacgaaaaatgggggacaaacatgataatgtgaacggggaaaaagggcacaaaaacggtgacagtaaataaatcacaaatggaaaaatgtggtaaaatcaaaaggggtcagaacggcgaaacggcgatg

SEQ ID NO: 102094 - DNA, 65 bp, Heterodera glycines
  Promoter: Source sequence=SeqID_9265; Location=1669..1733; Strand=-; Gene=SeqID_70801
ggtaaaaactgtttattttaatttaattaattaattttttttaatttgagggaaccactgtgatg

SEQ ID NO: 102095 - DNA, 240 bp, Heterodera glycines
  Promoter: Source sequence=SeqID_23267; Location=1..240; Strand=+; Gene=SeqID_53977
ttcttcccgcccattcttctttgatgataaaacgccaactctactaaaatttaaaattttcaatttaataatgaaatttttgtttatacctaaattctaattttagcatttaattttaagccttcaagccgaataaaatcttttttcttcgatggatcaacaggagaaaaggtaaactttcaatgtgtggtaatttattcaaattaataaaaacaaattttttaaatttagttccggatg

SEQ ID NO: 102096 - DNA, 302 bp, Heterodera glycines
  Promoter: Source sequence=SeqID_5677; Location=958..1259; Strand=+; Gene=SeqID_58882
ttgtttgcctaacaattttcattaaactttctcctttctatagactttggaaattaatttcctggtctttaacgagaaagggttatggtaatgtgcctacagtattggcaatactgtacttggccgggggaggatccttcggatgtggtgttgaatcacgtcctatcccctcggcattcaaaagattttgtgagtcacccctcgttcaggggaatgattcatctcttccattgaatggtggtataaaagggtggcggatttgccacccaaccacactcttcaaatcatccttccacggaatg

SEQ ID NO: 102097 - DNA, 1003 bp, Heterodera glycines
  Promoter: Source sequence=SeqID_13250; Location=3063..4065; Strand=-; Gene=SeqID_77082
atttttttctcctttattaataaaaaattttgatttgagaagccaaagattactttaaaaatttttgtatgtataataattctaaagctttattttttccttaatttatgctagataaattttaacattatagctttctattaatatttatcataaacaaaaatttataaaaaaatttagcctttttttggtcgtattatttctttcttcataatacattaaaaaaaaattcttaacagagcaaaatttctgataacattataataactctgggacaataaaaagaaaaacaaatttctaatctgatgccgattaaaggctgaccgagattcttgaaatcccggggtaaattttcgctctcaattctcgagctgaaaattgctcgactttttgtttctcgttttgcttgtcttgtcccgaaaattttatctcaagcagctctattaattttaattactaaattttctaaaattaaaaatatcttttttatttaagcggttcaaatgatgctaaacatgcttttagtcttcatttttatttgtttctttaacaccaatggcacttttggtggggtttgcgtttcaaaatacgatccgatgataagtgagcaaatgccatcgaaaaaatatcagtcgaccaattccatgccaagaacggatagctattctcacatcaacattaatggtatttatatatttttgaattaattctaattgttgcaaaggcttaaaatagcaaatttggaattcacgagattctcgaaatagaaatgagtgagctttggccatgatgtgtttgaccattaaacccggaatattgaaaatttagtttttaattattcaaaattcaatataattcaaatggcaaattttaaaaataattttcaaattaaaattatttaattttcttatttgaaataaaaattcggtgtcattttcagatgcagttataaaaattgaaataaaaattcgattaattttgttaaaaaaatatttttagaatg

SEQ ID NO: 102098 - DNA, 581 bp, Heterodera glycines
  misc_feature (210)..(210): n is a, c, g, or t
  misc_feature (215)..(215): n is a, c, g, or t
  Promoter: Source sequence=SeqID_2373; Location=1..581; Strand=+; Gene= SeqID_79396
tttttgttttaaaagtcgcgaaaaatgttttctggggctttttgggtcgctgattatgttccttgaactccccagggggctgaaccccaaaaaattaattgttaagctacttttcgagttattagagcctatcttctaggttttttatttttggagcctaaaaaacttaaaattttgaaaaaaatatttttgactatttttggcgtttgncccanaattattaacaaaaatgcaataaaaatgaaaaataaattttgtcattttacactccgaaatttagattttttagagcctattttccatttttagtgcccatttttggggttttttagcgcctaagcctagcggttttagagcctaaaattggatccctaattatggccattttggccaattcggaatcatcggacccgaactcgaacaagaagtataaattaaattttcgaatttcgccttttgttctaaaaaataactttaaacttggctgggctgtacatactaatttaatttttaaaaatttattaaggtatataatatttatgtaaatgccgatctgaaattgaggctataacactaaaatg

SEQ ID NO: 102099 - DNA, 297 bp, Heterodera glycines
  Promoter: Source sequence=SeqID_8809; Location=1186..1482; Strand=-; Gene=SeqID_69289
tattggctgtggacttagatgtaaattgtgaaaataggctaaaaccgaaaagtcggggctaaaatcttttgctaaaatggtgaaaaaaggtgaaagatcgaaactacaaggtgaaaaatataggtgaaaagtcatatagtgccatgttttcgagcgggatatgtgatgaatgtccaggtgaaaacaggttaaaataggtgaaatggtaaaagaacaaagctgaaatgttcgagaaatggtggaaaaggtgaaaatatatataggttgagtgcatttaagagcataataaaaataatg

SEQ ID NO: 102100 - DNA, 99 bp, Heterodera glycines
  Promoter: Source sequence=SeqID_22347; Location=1162..1260; Strand=-; Gene=SeqID_53017
aatcaaaatattgcttcggcaagccaaagtgctaatgaaaaggaaatgaaaagaattgcagaaataaatcattgtagagaaattattataaaaacaatg

SEQ ID NO: 102101 - DNA, 1003 bp, Heterodera glycines
  Promoter: Source sequence=SeqID_11854; Location=1191..2193; Strand=+; Gene=SeqID_75354
atcacaaattatgttatacaatatatgtgcatattgcctttaggatatttagtgattttctgaaacagcgtttgttgttttcttaaaaactggctcaaaatcacaaataaattgttaaaatgttctgatttttgaccccaaaacctgattttttggcccgatgttctgattttgaaaaattttcgatccgcgccctgtctaatacacaccctaagtattattaaaagtcaaagaccatttatagaatagttttctaagaatttccaatggaaatgtattttttgactttaatttttaagtagttaatcatgtggtttttgggatggattgtttaaatgttaaaattttttcaataaaaatcaaaaatttgcgatgagcgacgaagtgaacaaactcaacagattatcgctgaactttaaaatttgattgcaacatattgctgataaaatttgatttaataattgcaactataattttttaattaaaatgtctttgtttttaagccgaattttttattttttgattaatgatgtcatttttttcaagagtttgtgatgcgatctctgttttattaacagtgctgctggcctattctggtattacttaaaagtttttgatagttgaatcgttttatatgatggtccgcaaaagcacacataaacaaacttctttccatggtaattcgtaataaattttttacaaaatgcttaaaaaaataaagctccaaaaaaagctttttattttctataataagcttaatcaatattctttttttttttttgcaaaatttgtataaattatttttcattgtatattatacaatatttctttaaacattatattgtcttctattttattgtgcgtcatttagtcatgccaccaatgcaaatgaattaatcccctgattttatcttttttataaaatgcaaatgtgtaggaaattattcatttaaaataaatttttatttaaaaatattattaataaaatttatttagcagaatg

SEQ ID NO: 102102 - DNA, 1003 bp, Heterodera glycines
  Promoter: Source sequence=SeqID_3543; Location=1897..2899; Strand=-; Gene=SeqID_50803
acacaaccggtcggttactctatgtatactgtatgtattataagttctttttttcggcctaatttttgagttcgaccaatcttccctgcatctgtcctttaataatttgctcttttcatctttttatttaggtaattttaattatgaaaaagcccctaaatgcatgtacgtacacctatgttaatttgattaccgtatatgtctaattatagcccatggggattatttttcaacctcctcagaaaaggggggataattagagactgggggattatgatatagggattatttttcaaaacacctcgtagactgggggataattggagactgcgggattaatagagactgggctataattagagaatatacggtaatcaatcaaacgttattcgcattttcctaaccactcgttcaaccaaactcacagatcaatcgttcttaaaaagtaaacacttaactctcctatttatctaattaattttgatggggtgatgcaactgaacagggaacaagaataatttatgtacaggaaggagaggggaatgggggggggggcgggtaatcgttgtgtcgtcgtgggaatgtcctcctccacccctccctctgctactccattcctttcatccatttcatcatcccttcccttccaactcatccattataaataagttccagtcatattctcagtgtcagctcacaatgttctagtcattttctcagccaccagtcgcatttatttaatttttgctagctgtgttatttacttatttgtacatatgcacagaaagagaggaccaggccattttgctgctattcattcattgcattattcattcattcgtctttccccttttccacacaacaaataaattcacattaatatttacgcaatttctcattcgaatgaatgtacaatatttgtttctaaatcgaattttgtggatgttatgtatattttgcaggttaattattttgtccgtcctttttgtcccactcaaaaatg

SEQ ID NO: 102103 - DNA, 323 bp, Heterodera glycines
  Promoter: Source sequence=SeqID_11754; Location=2374..2696; Strand=+; Gene=SeqID_75249
ttgtttatttaacaaaaattaattttttatttgcaattttcgccgccgccaaacaaaaaattgataaaattttgatttttgataaaataacggtccaataaaatcactcataaaagccctcagttttgtgctgctcactaatgaattcaattcacacacacacgcacaaacattaacattaacattaacttatataatttataacattttgccccaaattaattaattaattaattggctgttgaaattttatttattttttgctttttttttgttttgcccttttttgagattatttaaatttaaatttttttcagacaatg

SEQ ID NO: 102104 - DNA, 87 bp, Heterodera glycines
  Promoter: Source sequence=SeqID_23194; Location=1474..1560; Strand=-; Gene=SeqID_45767
agtgtgttcttttgaattggtttataactcatctaatttgttattatcaagcattttattatgttttgtccgccacttttccaaatg

SEQ ID NO: 102105 - DNA, 155 bp, Heterodera glycines
  Promoter: Source sequence=SeqID_19275; Location=1333..1487; Strand=+; Gene=SeqID_84023
agattgaaacggctaatggggctgaatggacgccgctattgatggctctgatgatgagacggttaagaaaaaaaaactggatttataaatattgttcccaagctcagaacacaatcagcatatgaaacaattcttacaaaaactacagaaatatg

SEQ ID NO: 102106 - DNA, 396 bp, Heterodera glycines
  Promoter: Source sequence=SeqID_170; Location=7356..7751; Strand=-; Gene=SeqID_76057
aaccgagatggcacaccacgatataaggacgatctcattttgaagaatttatacttgttgatcaaatgacaaactctttctttgtaattttgccgagcaatacgccaggctttgttggaaataaaacaaacaaattcaaagtgcacttgccaaagaagttggtgtttgatggggccgggtggatggttggactgtcaggcataatttacccaaacaggtgggcgaaaatcatggctattgggtccgatttttggcttaagttgggcaaagctgggtacatcagaccgacaatatgtgattgttcacctgcacgacggccgaaaataccgtttccgtgtgccaaagggaagttttctctcgccacagcagcttgagaggggcattcatcatggcatg

SEQ ID NO: 102107 - DNA, 86 bp, Heterodera glycines
  Promoter: Source sequence=SeqID_1338; Location=8643..8728; Strand=+; Gene=SeqID_72882
attttttttttggattatgcgtttcatttgaaaaataaggttgtgcgtggcacgggtgcaaaaagtgttatccaagtgataacatg

SEQ ID NO: 102108 - DNA, 217 bp, Heterodera glycines
  Promoter: Source sequence=SeqID_39126; Location=1..217; Strand=+; Gene=SeqID_67772
ttttatttaggttgaaaatgcgcttaaattttcaccaaatgttgggccaatttgtttgttcggcctcggttgacttaatcaataaataatgaatatgcgttttaatgttttttttcttttccattaagatgcatccggaaacgacaaatttggcacattttcaccattaattaattcccaatttattattgctggttggggcttaactcagccaatg

SEQ ID NO: 102109 - DNA, 222 bp, Heterodera glycines
  misc_feature (97)..(98): n is a, c, g, or t
  misc_feature (104)..(104): n is a, c, g, or t
  misc_feature (215)..(215): n is a, c, g, or t
  Promoter: Source sequence=SeqID_16633; Location=1..222; Strand=+; Gene=SeqID_81044
ttttatcaaagttataccatcacacgaaatgcttcaatggatgatgtgaaggatttgaagctgcacaaaagcactcaaattattttgatcggattgnnccagcnaaccggacaaagtgtgaccagtagggaaagcagcggcacggatttgtcattggacgatttggtcaaaaatgcaaaaaataacaataatttaaattgttgtttctttaaatntagaatg

SEQ ID NO: 102110 - DNA, 704 bp, Heterodera glycines
  misc_feature (20)..(20): n is a, c, g, or t
  Promoter: Source sequence=SeqID_30456; Location=1..704; Strand=+; Gene=SeqID_60864
attaaaatggcatttttttnattgagcattaattaaataattgaatcatgtgccagttattattattataaatttttaaaagagaaaattataatttctaaatatttattcaatttcactttcatgattttctgccaaccttttttcagttcagaatgccaaaaaagtaaaataatcgccagtttagtaaaatttagaaaaacgaaaacaatgcttgaagtttaaaaatcagacaaaaaatttttgaaacaatttaacccaaaaattatgcattattttaaatccatttcggagcattaattttgtttaattaatttttgagttttttaaacatttactgactatcaaattatcagtcagacccagtcactttctatcacttatataatgctgtttaggctatcagggattgataaaactaagtttgcacccgattttgggtatagccagcaaatctgttgtgcgccaatatcggataaccaaaattgcatctcccaattttttaaattttaatgccaaaattctgcaaaaaaaaaaaaatactaggcccaaagcaagttcaagtcgggctccacgtgctgcaccatcaccgactttcccccatgggtggtgaaaatggcacagaatcagccgcgcaaattttcgccggaaatcattcgccaaggcgaggcggtcatcccgctacagtacggcaccaacaaatg

SEQ ID NO: 102111 - DNA, 73 bp, Heterodera glycines
  Promoter: Source sequence=SeqID_15353; Location=1..73; Strand=+; Gene= SeqID_79605
atcatttatataactaaaaattgtacaattcagatcacaaaaaacaattatttcttgctaattattcgtcatg

SEQ ID NO: 102112 - DNA, 75 bp, Heterodera glycines
  Promoter: Source sequence=SeqID_204; Location=1581..1655; Strand=-; Gene=SeqID_77387
ggtgggggtcggaaacgaacgaacggcacggcgcaatcgcaaatccattgaaattcccccatttcaggaggcatg

SEQ ID NO: 102113 - DNA, 84 bp, Heterodera glycines
  Promoter: Source sequence=SeqID_33182; Location=1..84; Strand=+; Gene= SeqID_63325
gacgacattctgttgaacagtcagttgggcttgtccatcacattccaactgtacctgggacgatggagcaacacggtgacaatg

SEQ ID NO: 102114 - DNA, 238 bp, Heterodera glycines
  Promoter: Source sequence=SeqID_3613; Location=1..238; Strand=+; Gene= SeqID_51111
cgaaaaattttatttttgccaaactttattttttgatttaaattcttggatgagaataagtgatttgctgatcaaatatgatcagttggactataaaaataaaattttatattatataatcgtataatggacttatttaaaaaataaactttcaaggacgtacttggtaaatcaatttttaatttgaaatgattaggctagactcgaaataaggacagccttttaaataaggacaatg

SEQ ID NO: 102115 - DNA, 65 bp, Heterodera glycines
  Promoter: Source sequence=SeqID_35330; Location=438..502; Strand=-; Gene=SeqID_64907
tggaagtccccttatatacacggcattgctataccgtccaaattcacaagtttgccgtgtaaatg

SEQ ID NO: 102116 - DNA, 272 bp, Heterodera glycines
  misc_feature (53)..(53): n is a, c, g, or t
  Promoter: Source sequence=SeqID_14284; Location=1..272; Strand=+; Gene=SeqID_78303
gcagttttgttactgtaagagacacaccgtgatcctgtagtatatatttgcgncacgaacggtcttaataaaaaatgattgatcatcatctgattgagtttttctttactattttaaaactcataaattaaaacttaaaatttattacaatttaaattattttaggatcattatttaaatacccaatttttgatacatttgtaaggctgtgtgatttgtcatatttctcatttggatttaattttttattaaagaaagatatatttataatg

SEQ ID NO: 102117 - DNA, 414 bp, Heterodera glycines
  Promoter: Source sequence=SeqID_9959; Location=1741..2154; Strand=-; Gene=SeqID_73000
tgcgcttactgtctgatgaattagcattaaaatcctaacggaaacgaagtgctttttctgctggtttaacatactttaccaaaggtccaaccgctgctcaaactgcaaaagatcaagccccattggatgttcactttggacgatttgatacgaaacgccgttcagcaagcgataaaatttcttagaccacgtgacattttggcacttttgctgctttgactgaccaatgcttctcccttccttcagaagagccgacgagtcgcgacgaaggcttcgccaattccaagcaatgttcgtcggtccatcagttgctgcccgtcccccaacaatcttcgcttttggcgccggcttcgtctttcgatctgttgggcaaggcgtacactgaccaaatcaaaaggtaaaaacagccaaatg

SEQ ID NO: 102118 - DNA, 671 bp, Heterodera glycines
  misc_feature (146)..(146): n is a, c, g, or t
  Promoter: Source sequence=SeqID_21546; Location=1..671; Strand=+; Gene=SeqID_52161
caaattgggaaaaatacacccctaagatttaaaaaatttctcaaaaaattgatcgccaaaatttcatttttttcttgataaaaaatttttagattaaaaattttccttattcgaaaaaataataaaatgtttatttaataatcatntaaataaccaaaactaagcttttgattaagttttacgtgttttgctctttaaaaatccttaataaaaatttttaaatgccttttttcatgcctttttcgggatttttgtgccttttctttaattaaatttatttatttcgccgagccaggaattctcccctcctactttccatttttttcaaaaaaaattgaaaatgccattggtgcgttaagcgattttctgctgcccaatcgttagaccaaattatacggcacaaaaaattttgctaagataaacagatgaacaaatcagctaacatatgaattactgctattcacttcaaattaattaaggtcttcagaaataataaaaaatataaaaatatatattaaatatatttaagtttttgcctttgctcccctcactctttcattcccttctgctgctgctaccatccacaattgtcattttccctctcattgtaaatattgcgggcaccgctggatccattcccgtggatttaagtaaatttagccacaaaaatg

SEQ ID NO: 102119 - DNA, 1003 bp, Heterodera glycines
  Promoter: Source sequence=SeqID_8461; Location=1586..2588; Strand=-; Gene=SeqID_68153
taaattaaaaaatttattttttattataaaacaaacactcttttaaatgaattaaaaacattaaaaatagccaaaaatgcatagcaaaaatattgtacaccgcccggattcgaacttcccccccccctcaaaataatgcctcagaatccccaatcacacagggattctgagggcttaacgttgtaataactgaaatctgatgtcagattggtgatcagcaccctcaaatagacctaaagacatgtttttggatggtttttgatggaaaaattttcccactcaaaaatcatgtgctcccccctttggacccgaagcacaaaatcacttttattttagctctggttgtggagattttgaatttttaaaaaattatctgggacttttaggccgcttcgcggcctcgaacgggcgcttcgcgcccgtttttaaaattttgttgggcttggacgggcgcttcgcgcccgtttttcaaattttattgggcttgggcgggcgcttcgcgcccgtttttaaaatttagttgaactcagacgggcaatcacacagggattaagagatataaaagggattaaaagaggcacaacagtgattaaaagaagtacaactatgaaaagttcgaaatttataatatagaatatttattgaaattgaaaggaattaatttctcgaaaattcaaattaaataaaacagttattcatcagaaaataatttaaaataaattaataaaacaatttaaataaaaaaattaaataatttaaaataccccttgagatttttcaaatattcgcccaaattcccaagggccaaaaaaagtttgaaaatattttcgaatttttaaaaaattctaaaatgtacaatgattggttatttattgtatattaatttgttgacaaattctaattaaaaaaaacaaataaattctttagtttatcaattttaaacaacagtgattaaaagacgtacaaaagtgattaaaagaagtacaacagtgattaaaagatg

SEQ ID NO: 102120 - DNA, 650 bp, Heterodera glycines
  Promoter: Source sequence=SeqID_4118; Location=1..650; Strand=+; Gene= SeqID_53251
attttcactgggactcatttgtcccagtgctcagatggcattggttcgactttagactttgatcgtcaaaatcttttaaatgataccaaatttgttcggttttggtttatttaaagagtaataaaagccaaatttgctccattttcgagtttttaaccagttcaaaaaccgattttttggcatttccgcaactgctggagacctaattttcgtgcatagctcctcgagacgaatcgaatggcatatcatttgtgccgtttttctggaacgttcgggcgttcactttatttcacccagacagaatattgttaaaatgattctttttgcttttaattggttttgcgaaaggattcatttttttcgtctccttttcatataatcccttgaggggattaacaaaagttgacatgtatttatgatgtcattatgtatgatttaaaacttagcggaagtttatctttaagacaatggaactcaattagtaaaataagctgagaatgatgtcatttaagaaagggaaaacaaaaattgattaaaaaaaatcaaaactaattaatttatgaatattttaatttgttattcatttaatttgcacttttatataggcacagaacgaaaatttgttcggcgcctatttgtctcggggaatg

SEQ ID NO: 102121 - DNA, 1003 bp, Heterodera glycines
  Promoter: Source sequence=SeqID_1896; Location=2742..3744; Strand=+; Gene=SeqID_76636
caatgggacgaaagtggggaggacgacggaagagcgagggaaggaatggcaaaaagtgccattttggccaattggcttctgacaataaacggcaaaatcgccaccggactttccccgtgataaaatttcccgtccacgcgaaatgttttctcaaaaatgctcattcatttctcacattgttaattaattatgcattgttattcacactgttgaattattgtcttttcatttaaaaaatatttcgttaagaatattttatttgataaatattaaaatgttcaacctcatctaaataataatagggccgtggaaggggaggaattatgcaaatgtgggtacttccgtgttttgccccccccccctcgaaaaattttaaaattcttattttggggttttcgaggtcactgatcacgaaaatggtgtttggtttgacatctgctgatgatatctggtcatagattaacaaaatatctatgattttttgaatttttaaaatttttcaggggggcgggggggggggggggtagcaaaacaagcaatttacaaaaagtgcaaatttgggcgcttcaaaaaagtgcaaaaataaaaaatcagattttttcaagatgtgtaaaaaatgataaaatgttaaaatttagaaaccccggtaacggcaattgtctcactgccagacactcaaattggtctctgcttttcaaaattttccaaaaagtgcgaaatcggccatatgtgagcctaaatttactaaaaaatgctatttccacaataagattttgaaatgcacaatttttattttgtcctccgtttttgcttattttacagtgacatcaatggccaatgtcattgtgttattaatgacacggtcacttacaaaggcttagttctgagttcgcgcaaatgccgtttaaatattttatagcaccataactttataggctcttctgtagtccttaagtccttaagatcgcaaaaaagaattatttcttgctaattattcgtcatg

SEQ ID NO: 102122 - DNA, 141 bp, Heterodera glycines
  Promoter: Source sequence=SeqID_18303; Location=1449..1589; Strand=-; Gene=SeqID_82895
ggtccgtaatggtgtttcaagtggaacatatatgtgaaagatggcgcttttcgaagcccgtccaaataaattggcaaaattttggagtgcttttgtgatttcaaaatatttttatccccaaattttccagggtcgacgatg

SEQ ID NO: 102123 - DNA, 714 bp, Heterodera glycines
  Promoter: Source sequence=SeqID_13034; Location=118..831; Strand=+; Gene=SeqID_76815
caataatttaattatttacatttaaaatttaattaaaatacaatacatatatgttgtaattaaaacaaattttcaaagtaaaatttgaaagttctagctaactcctaagtttctgttaaatgctttcctcaagaattaacatgttttttaagccgaattattatgatagagatttatttttaaaattaaattaatttttgtaataaaacaaaaataattgcaagaaaatgaaaagatgcttttttttaatttaataaaagttattttttatattctttgttgataataataaggtacttgtagattttgtcaccctccgcaaatttttttagataattttttctatgctgatttattgtgctaatcacgacccatcttggcccatcgcgaaccccggattcgaacaaaaagtctaaaccccaatttttgaaaattcgatttttgttctaaaataaattaaaacaagcaaaaactgatcataaaccattacaacaacaaaaaataatcattacacaaagattcgaacataaaagagaatttctgaaaaattcgaatttcgacttttattttaattcggttccgagattcgaaataggccaaaatatatgccatattcttgatcagtaacccaatccgaattggcatgatgcccttctctttgatcagtaacccaatccgaattggcatgatgctcttctctctctctcacaaatg

SEQ ID NO: 102124 - DNA, 100 bp, Heterodera glycines
  Promoter: Source sequence=SeqID_45139; Location=1148..1247; Strand=-; Gene=SeqID_72501
cctgaaattgtgtttgggtacaattatatatccaatttataaaatcataaaaaccttccttttttaaccaatttaactgattcattttcagatctacatg

SEQ ID NO: 102125 - DNA, 593 bp, Heterodera glycines
  Promoter: Source sequence=SeqID_24609; Location=1034..1626; Strand=-; Gene=SeqID_55351
ttggcgttttgtcttacgccaagcaaatttataaattctctatttttctttttttatttctttaaaatcggaaatccttaacataaatttccaaattggaggtgttctttgatcctttctaagcgacttaattgattaatgattaattttttaaataagaaatttacgaaaaattttataggcacttaaaatgcagttttgggttgttttttcctatttttttcaaatttaggccttagtgaaaaaataagaccatatttcgccttaaaaatgatcatttaagcatattggaataagtctcgcttcaccttcgtaattaaaatttaatgctatgtaatacccttataaattataaaaatcgacgtctgccaaaaaaatgaattttatttttttaaatttttttttaattttagcaaatttatctattcttctgtttcttacttacttttatgctattcgcgcacaacaaataaagcagccagaggtggaaagaaagtctcgtccaaataaagtaaaaaattcttaaattttcaatttttttaaaatacccctccaaaatttccgtttagcaaccgatcaaaaagccaaaaatg

SEQ ID NO: 102126 - DNA, 325 bp, Heterodera glycines
  misc_feature (17)..(17): n is a, c, g, or t
  Promoter: Source sequence=SeqID_17116; Location=1192..1516; Strand=-; Gene=SeqID_81555
gaaaaaattgataaatntaaattttattaaaaattggttaatttatatcaaaaataagcaaaaaatggaaatttcgattttttggtcgattttctcaagaaattgctttttttcttctaaaacgagtttttataagatttagccatttctgaaagtgttactttccgtttagcgaatttgaagaaattttgagaaatcataccctaaatttggaaaaatttatgtccatatttttgccattttatatccatatttcgcgattttatgtccatatttttggactccctaatcatcatccatttgtcattatttttacaaaaaaatg

SEQ ID NO: 102127 - DNA, 119 bp, Heterodera glycines
  Promoter: Source sequence=SeqID_29908; Location=1..119; Strand=+; Gene=SeqID_60366
tataattttgacactttaaccccttaattgattacatttttgtgcttcatatactgcgccttttttctaatgccaatcaaaacttcccttttccttatgcttttgcttaggcttcaatg

SEQ ID NO: 102128 - DNA, 140 bp, Heterodera glycines
  Promoter: Source sequence=SeqID_11517; Location=420..559; Strand=+; Gene=SeqID_74942
tggacagagtaaggcaaacaacaaataatgcacgcactcaatgctcattaataatgttgccagaaattgctacaatttgtcaatgcttcttccgatcagaaaggctttattttaattagtggtggattttctgcccaatg

SEQ ID NO: 102129 - DNA, 621 bp, Heterodera glycines
  Promoter: Source sequence=SeqID_21382; Location=1..621; Strand=+; Gene=SeqID_51994
aaaatttgcactcttccgatcctttggatggtcagtttcagcaggcgtcgtcgctcctcctactttgactcatgtcaagtgctactgataagtatggggggggggaaggtgaaattgcacggtcgaagagccaatgcgaaagtgacgaccgcgtgcaagttccctaacgtttcagtcccgaagagacgaggcgatcgatcgctctcttcacattgtattcgtctctgctgctgtccaccagacatgctccctcgtgtcctaatcgttcagcaattgccaatccaatcctgtgaataggcacattttgtacggcattttcatatcagtgatcatcgattgagtacccttctgaatgctggtgtagctcaaacagtggtagctgctgtgttctactcgcccttcttttacaattgtaagagtttggtccaagcgaaacgaccccccccctacaccaatcgtctatcgcatagttttcgccttggaaggccacttgcattgaaaaaagcacaaaaaactcgtgtgggctcgcttcatacatatgattgagaactggtgacatcaaaatgaatacattttagggtgctcgggtactcaaagtttgagaaggtcaatccggacatg

SEQ ID NO: 102130 - DNA, 105 bp, Heterodera glycines
  Promoter: Source sequence=SeqID_27799; Location=687..791; Strand=-; Gene=SeqID_58461
gattaaactgttaggtgaactaagtccctaaatagacgtagcacataggcaagtgatagcgagcaaggttgactggtagaaaagttcaaaccatagcactcaatg

SEQ ID NO: 102131 - DNA, 519 bp, Heterodera glycines
  Promoter: Source sequence=SeqID_10038; Location=3896..4414; Strand=-; Gene=SeqID_73097
ccgaaaattttttgagtttttcggtttttttcggtttttatacggaaaccgaccgaccgaccctcttgtccggtctctattaataagaatggtttattgctttttttgcgaaaaaatataaaaattcaaaaaaaaaccgaaaccgaaacgatataccgaaaatttttcttcggtttttttttcggttttttttcgggttttataccgaaaccgaccgaccgaccctcttgtccggtctctagttagaattagaattttaattaatggtgaaacagtttttatttatattattattattattataaaattattaatttcgatcattcagtagagagaaaaaattcactttacaatttaatggatatagtgatcctatcaatattttaccattaatgtaaatttataaggaagagaaaaattcatttttgagaaatatttttattattatttatttctttttttcatatcgaataaattataatttttaatttttaagaaaaagaaaaattgtcaacaatg

SEQ ID NO: 102132 - DNA, 123 bp, Heterodera glycines
  Promoter: Source sequence=SeqID_4543; Location=133..255; Strand=+; Gene=SeqID_54834
tagcaatttgcgaatggccatcaggtatataattgacaggagagcggtccgccctaccattaagccacctggagcggccatatttgaagagaggcttaggcaagatccaattttgtattcatg

SEQ ID NO: 102133 - DNA, 65 bp, Heterodera glycines
  Promoter: Source sequence=SeqID_6597; Location=3969..4033; Strand=-; Gene=SeqID_62142
tgtaagaaagttttaaaatattaaaaaagacaattgaaattttctcaggtggccattgccctatg

SEQ ID NO: 102134 - DNA, 169 bp, Heterodera glycines
  Promoter: Source sequence=SeqID_923; Location=1511..1679; Strand=+; Gene=SeqID_64143
actgaaatgttgggaaaagcacagaacggtgcggtggccacgcgaaatccaatagaaaaggcaacgaacgattggcatgagggggaaactgacaatgagaagggagtgaaggcacggcacaaaacaacaaagggaaatgccgtggcaattactgcaactcgtagggatg

SEQ ID NO: 102135 - DNA, 723 bp, Heterodera glycines
  Promoter: Source sequence=SeqID_18488; Location=1..723; Strand=+; Gene=SeqID_83106
atggcatacatataaaagttcaactgaagcggtgccaaaatcatttctgcataaaaccaacaacgatcagcctaaatttgttcatttcattcctaatacctaatcaatgaacgagtttttagttactaaaatcgcgaaattgttgcctaaatagttgttaaaaactgaaaatgccaaaatggttgctatgtatattattattttattagttaatttttgcgaaaggaaataaaagtcgacgattataaaagaggaaaaatcaattatttgcttggaaacatctaaaaatatctaatttacaaataaaatttgtttttaaatctatttaatcattttttgaaaacttgaaaaaacatcacttgaaataataaaattaatcgctccaaaaatgacaatatttgtaaaaaaaaggttgatttttttttatatgaataataaatttttcgaaaacttacaaaaaaatcgttttaaaaaaaagtccgctgtcgaaaagtccgggagccgaaatacgactgattattaaaatagtgaaaaattaaaaaaattagtataaaagtggttgctcttccttcctctgtcactttccattattcattcgccattttcgtctcttcaaattttctccctgacattaccatctgaaatgagtctgtacgtttttcgtttttttctccacatttacccttttccttctcattttttagtctgttcgttgtgtcaatg

SEQ ID NO: 102136 - DNA, 89 bp, Heterodera glycines
  Promoter: Source sequence=SeqID_8152; Location=937..1025; Strand=+; Gene=SeqID_67151
ttgtcccaaagaatcggctgagtgtctatcaaaaaaaaaaattttttttttaaagtaagtataaaaactgttttgttctgtttcagatg

SEQ ID NO: 102137 - DNA, 461 bp, Heterodera glycines
  misc_feature (106)..(106): n is a, c, g, or t
  Promoter: Source sequence=SeqID_16916; Location=3009..3469; Strand=+; Gene=SeqID_81351
attgcctaattaggtgatagcccataatttggtcagcagttaaatgaaatctgattttcgcctgattgatcagttaaaagaaacaacaaaggatggagccgctgtntaattaattactaattaggcatctcacttgataagcacagtttgatcaattaaaagaaatctgatcactagtctgatcagtttattgattggcctgattagctaaataaaagactggtgattgatcacggaattatgacagtctaaggcaattcgatcttatcaaattctgaccaattcattggctaaagctgacctgtcctaatagaaaatggatttttgtatcaatggactaactcctttctgattgaaaattatgatcacttaggaaattccaaatcactgaccaggtcaataaaacttcggccggtcatcctccaacgtacgcgccccaatatcaaacgcgtccaccaatg

SEQ ID NO: 102138 - DNA, 838 bp, Heterodera glycines
  Promoter: Source sequence=SeqID_23869; Location=451..1288; Strand=-; Gene=SeqID_54558
ttaggctgggggttttttgtattacaactatggtcggggatccctttacaatttaatcatttttccttcttttagaaattactctttttctctgtttctctcctctctcctatagtgaatgcgcatctctcttcccagggggggggccaagatttctgtcctaatactactaatcatttataaaatttttaattaatttgaaaatattgggcggcgctttgaatttaattatgaaaattatcccacccttttcaagcagtatatgtgaagcagtggaccaaaacaaattgactaacaattaagtgcggaataaaaataatgaacaattaattggttttgagtaattcacgtaaatgtaaatattgttgttgttaatattggctagttgatgaaaaaagcatttgtaaaaaaaacaattgatcgaaaattatgttaaaatgttataataaaaataaaattatttaaataatttgaaaaaaaactaaattcaataaaagtctcaaaaatgctctttcttttttttcgcccgcacaataacaaaccaaatacatttcaaggtgttcaggaacaaaaaatggtcaatttttctgataaaattcttttatacttgaaaaatgcgccgcaaatgcttaaaactcctcagcaaataacatgacggcagtaaatgccaacaaaaaactctaccgcaaatttagttaataattttgtcgttcctgacaataataatttagaaacatttttaattgaggccctcacttttctcggccttttaaaattttttattttaaaaaagaaattgtttataaaaatatttaaattgcttaatgaagaagaaatg

SEQ ID NO: 102139 - DNA, 52 bp, Heterodera glycines
  Promoter: Source sequence=SeqID_34464; Location=1..52; Strand=+; Gene= SeqID_64250
acaacagcaacaacaacagaacgatttgcgccaaaaagctaacacggcgatg

SEQ ID NO: 102140 - DNA, 581 bp, Heterodera glycines
  Promoter: Source sequence=SeqID_30051; Location=1..581; Strand=+; Gene=SeqID_60499
acaacaacaacaacaacaacaacaacaacaacaacaacaacaacaacaacaacaacaacaacaacaacaataattggccacaaagttgtgacccaccgatgcaaccatcgccacctgggattgcgctgatcagtaatcagcgaacacaggcaaaaaaattaagctttttctgagaaaattaatggagggagaacaagttttacatagtgaatttattggaaattaaaaaaaccctttttaagaatcaaaattttaaataatagccgcaaaactttttgttaattcgatgcttattaatagattaaaattcggctgaagatcttcaaattttttacgagcgtttattcatcaaaattggttctggtagcattgaaataattacaaaaacttgtgaaaagatttcaaatatccggttacaatcgcattaattgcttctaattgcccatctaattgaccactcagttttatagaatagccaagtgtaacaacttccatttaaaagattatggccaatcaaataatttagttgataaagtgcattggtatgaaaagaaatttatgacaaatcaaaaaatttaatg

SEQ ID NO: 102141 - DNA, 58 bp, Heterodera glycines
  Promoter: Source sequence=SeqID_23610; Location=294..351; Strand=-; Gene=SeqID_54308
tcgtctacaacacttcatcacacacgaagcggacgtggccggcgcaacaacttcaatg

SEQ ID NO: 102142 - DNA, 219 bp, Heterodera glycines
  misc_feature (39)..(40): n is a, c, g, or t
  Promoter: Source sequence=SeqID_33640; Location=937..1155; Strand=-; Gene=SeqID_63645
ggtgaagtattggtattaaataatttaattcattattannttatggaatcaatgaattaaaattgaaagtaaatattattaaatgggggcacatctagggaaattggtctaattaacaaaagctttttatttttaggaaaaaagcgattttctgaattagagaaacgaaaaatagtgagacattttatggaaatgaaagcgaacaattggacaaaaatg

SEQ ID NO: 102143 - DNA, 1003 bp, Heterodera glycines
  misc_feature (238)..(238): n is a, c, g, or t
  misc_feature (438)..(438): n is a, c, g, or t
  Promoter: Source sequence=SeqID_5954; Location=667..1669; Strand=+; Gene=SeqID_59802
ttccttcttccatgtaatttatgaattcaattatataattatttccaattctttaattatactctgataattgaggtctaattaaaatataaaaatagatttggaagtcaaaatggcgaatttgtcatctgaattgtgggatgaaatttaggtttttccgttttaataaattctagggttacacgggtacgaaacccgggtcccgggtattgccaggtatagaaaagccggtacaaanccgggtccgggcatccggtaaaaccgggtattaataaaatccaaaaaataattactaatggaggtaattttttctttaaaataaaagctcatacttacaaaggagaggtacccaagtgacggtggaacttccgaatgaaactttgaaggtagaagatagattactccccttttgtcttaatttttttttttttttgctanatgaagcttctggccgagatatgaagcttttcctttttgccatatcaatatcatttaaaaagaatgaaaagccaatatgtctgtcactgtttttaggtttatttttcaatttttctatcttcctaaatttttctcaaaaatgctaacaataaacattggagagggaacagatgagaggaggaccaacgaaaagaattttttaattaggaacagaatccaagagattaaccactaagccaaaggagcaattgatgaagcggcttttaaaattaatattaattaaatttaataaaaaattctttcctccaactttgctcaacgatttgaccaagacccccattcttaccagtgtactcttttggacccggacctaccgggtcgggtaccgggtattggattttcaaaaatctgggtccgtgcccgggtagtaaaaaaccgggtatccgggtctgggacccggttgggtacccggaccgtgcaaccctaataatacgcattaactgcgaacagttcattggaaattttatcatagcaaattatttggcaaaaaattgcagtagggatg

SEQ ID NO: 102144 - DNA, 428 bp, Heterodera glycines
  Promoter: Source sequence=SeqID_2714; Location=1412..1839; Strand=-; Gene=SeqID_81222
agcggaatgtgagttctgaaataataattttgaacaattccaccccaaatgctggcacccataaaaaaacgtttttttactatttttactttcccgctttctttttcaggttcatttacatcccctcggtatgtttgttttttttattatttcttaagacttatggctgctgctgtaaattcttaaaattaattttaaaactaaaagttcaccattccgcaatttaagcgggaattttattgtgctatttcttgaagtttaaatgattttttgcttatatagacaaaaaaaagcgcaaattccaagggatttttgaggccggaattcatgattataaaaatgttttagtctcttgttcattaaacaataaaattcattttaaatttttcccctccccctcttcttaggtcagcatgttgccggaaatg

SEQ ID NO: 102145 - DNA, 484 bp, Heterodera glycines
  Promoter: Source sequence=SeqID_16270; Location=1..484; Strand=+; Gene=SeqID_80654
cttaacttatcggaccaatcctttgcccgtggcacctgtcgcctcagcgttttaactttacatttaaatgttatcccgttttaaattcgatactaaaaattattgaataatttttcaaatatgccatgttaaggacattctgtggtttctctcttccagttacggtaaccgtatcccagcactgtttggccaacaattgctgcccttttaccgtatgatgcccggctgggccatcgttctgtgtttttattttgcaacaacagtcgcttaccaagcctcaaatattgccacttttctcattcagatgaatcgtttgactgcaattgcatttcccctcaaacagaaaagggtttttaattattaaaatattaattaatattttaatttcatccattagatttgggaaaagcaatcatttttgatgatattggcactgattgtgttcgttgtgccattgctaagctgtttgccaattatgaaaatg

SEQ ID NO: 102146 - DNA, 140 bp, Heterodera glycines
  Promoter: Source sequence=SeqID_21472; Location=1598..1737; Strand=+; Gene=SeqID_52082
aaacattaattatgaattgatagagcaattaatgaaacgaagggagggggaactcatttggaagctaattatctcatcaccaaacaaagacgctttgtccgcttggtcccgctgaaagagccgaattcatccgaaaaatg

SEQ ID NO: 102147 - DNA, 60 bp, Heterodera glycines
  Promoter: Source sequence=SeqID_6413; Location=2551..2610; Strand=-; Gene=SeqID_61465
aaagtcagaagttttcgcctctcatattccactagccagctgctaaattttgaatcaatg

SEQ ID NO: 102148 - DNA, 468 bp, Heterodera glycines
  Promoter: Source sequence=SeqID_7523; Location=1..468; Strand=+; Gene= SeqID_65113
taatcatgttcaaatgatcgcattaatcgaattttcgtaaaggtaaattttgttgaagatatattctgacgctataaaaaaggccaatttgtacaaaataaaaaaaatttattcgtatagtttaacgaaagcccaacgttttcttataaaaatgattgtttcaccaataagttaatccaattatagctcatttgagattataaattgcttatttggtatagggaaattgcgaaaactttccttaaaagaaacattatttatttacattctacaaagatttttttataatttttatttatttttaaataataatttatgttttatagtttaattgtttattttttcgaaaatttattcgtttgtttaaaagagattaaaaaataataatcttaaaacattatttcttataatggttaatttattactatttattataaaatttgaaataataaattttttttaggtatg

SEQ ID NO: 102149 - DNA, 425 bp, Heterodera glycines
  Promoter: Source sequence=SeqID_1355; Location=1..425; Strand=+; Gene= SeqID_72988
tatgctccagcagcaccatcagttcggcgccttttcgtttaccgacccgacgctggtcagaaacctttaatcatttgacaaatcatcattttatttaactgatcacttgtccgacccatgccgtttgagttggacaaacccgaaatacgaaccaaaaaacaccctccaatttgctttcaaacattcatagagggttaagaaataagtaatagcaataagatttttaaactttcttttgaaataaaaacgaaaaaccaaattgaaacttttcctacaaaaaaccgctaacaataagaataagaaagtgaaaaacaaaaaaaaattacggttttttcaaaattttttagggatttgggaacttcatgtacccttttgtttgacagcctctccaattcaattcatttttgaatttcaatttgaagatg

SEQ ID NO: 102150 - DNA, 702 bp, Heterodera glycines
  Promoter: Source sequence=SeqID_20002; Location=1..702; Strand=+; Gene=SeqID_84777
tcaaaattaaacctgcttgatatcgttcggtaactttaagtattcaatgttagcttatacaatttcaaaaaatttctttgctttcataaaatatgacggaaaaagttaaaaacttttatcacatttttcgctgctattagataaagttataagcattaaagttatcaatttattttatggccgtgtaaactacaatgtagctgatttcatggctttttacttaatatgggcttggatactttgtgggtccgtcgacattaagtttgggcactcactatatggaggaatttcgaaaaaaaatataattttgtaaaatcttattaaaatttaaaattaaatttagtaatttaacaaaagatgtgcttacaaatttatattttcttgaaaataaaaaactttaattgtggaaacctcttgaacagactgagccttgtaatgattacaaataatacatatgtatgaaattgatatataatgaattataatgagcctagcaaaataagcatggttaattgagaggacatgcgttaaaaaactttcgattcctaaacttgattaaaattactatgcttttaaattagatgattgtaatttttaggcaattaaaacatttttaaatttgaaatccttaatttggtgcccaaacttcccggtgcctaaatttctggtgcccaaaacccccgcggtgggggcgccggaatg

SEQ ID NO: 102151 - DNA, 906 bp, Heterodera glycines
  Promoter: Source sequence=SeqID_7379; Location=3117..4022; Strand=-; Gene=SeqID_64658
tagctttgaaccggacccggtctgggagatagcacttgaaaaacaactaaattgttcttaaccgggccagtcgggttaaggatcaggcacttttggtgccccgaaagtaatgcaataggcttcaggaaaatgaccaatcactgagttttttgtggatcgacctagcaccgttaataacatccaatgtgtgcatctggtactcaattgcatgtaaggaaacaggaaatgcagaataaaatttccttccttgacacatggagactgattcaaaaattttaacgaaaactgactactaaatgatattttattaaattaataaaaaattgaaaaataaattctaaaagttaatagacaaaaaatatgtaaataaaaaaatattaatataattaattacaatataaaactatgattcatgttaaattgtaaatcttttattttataaagattttttatatttattttataaaaaacataataaaataaaaagacaattcttaaatttcaaaataatcatcagttcaagtagtataaggcaccttaatccggtgtaaaatccttaatccggtgtaaaatcccccccccctgccctccacccttccacatcctttctttctgccttttaacattccatttcaatttccccctcgcaccacttttcacccttttcttccgcgcagtttgttagttgttgccccccaatttcaacgcctaattgcgcacaaatcgatcgctgtccttcgcaacaccccccccccccccccgacgaatatccttcacaaatacaataagttgcggagatgattctccttttacattttacgttttgtaggacgtttaatctatgtattataatttttttattttagcatcagaaattttttaaactctccaattgtctgcaacatg

SEQ ID NO: 102152 - DNA, 498 bp, Heterodera glycines
  Promoter: Source sequence=SeqID_8303; Location=1285..1782; Strand=-; Gene=SeqID_67634
ttcaaatcccaccccccccatcctttttccaatcatccccggtgattggacggcgacgcgaacgacgagagagagaaacgggagcgaaactcccgtcttcagcgatcggaagagttggcacgtccggagtgctgactgaagagctcggacttaggcggttgaacctgggagcaccggcttctcccccaaattgagtcggtggtgccgttattcaaacaacagcccacttcttgtttgcctcccgcccttctctccattccacccccttgggaagagaccgagcggcagcgaaaagagagagagagagagaaaagagaccgaattttgaggagtggattggagtagaaggaagggagaaactccccgccaaatcggcagagagtttttgccacaaacaaagttggtgccgttagcagggggccttctgccacgaacaaggaccagcaaccgggagcacctcccgctacacctcggactaaccagagcgaaacgaaaatg

SEQ ID NO: 102153 - DNA, 483 bp, Heterodera glycines
  Promoter: Source sequence=SeqID_8235; Location=4806..5288; Strand=-; Gene=SeqID_67394
acatttctcaaattgtaagaactaagaatccaaagacaaaactaaaaaaacaaattcttctattctatgtataacaataaaattttacaactcaaaaatgcgttaaaattttacttatttatcgataaagaaaaaattgccatcagaagggcgggaaccacttactctgatgactgatcacagtaaaatagtcacagagtaagtgaataaatatcaagtgagatcacaggttaagataaacaataacgaaaaatttatatgaaaataaaatcgaggtcaaagtcaataaaatgcctcaaaagttaataattctttatacattggtgctttcagaatcaagagtcaattctaataattttttaaaggtgtttaaagagctagacattaacgttttatcaagggcattccaggccttgactgatctgttaacaaaagatttggaagattttttagattgtaatttaacatttaaccggaaaaatg

SEQ ID NO: 102154 - DNA, 1003 bp, Heterodera glycines
  Promoter: Source sequence=SeqID_2708; Location=814..1816; Strand=+; Gene=SeqID_81188
aaaataaaaataaaatttatttttttcaattatttatactagagtagagcgggaccgggaccaaaacacggacaactgagtacaactgagtaccgaggtcccggttttgaccgggacgggaccagtcccgggttttttcccggttttcccagccaaaaattcccggtttttcaccccgaaaaggtcccggtcccgggtttgcccaaaattcccggtcccgctctactctaatttatacacttacacatataacctatttttgtgttctatatttgtgtcacatcgtatgaataaatataaggcaaacaattttggataggtaatatttgggtacgctaacgtgaaaatcccgatatcccgattgaaaatccaggtcctctcgtttcggctttctgatcccggcaagtcccagtctcggttttttaagctgctcgttacaagcctatttttattatcctattaattattttcaaagaatttagctaagtttcttaccatggggttctattttttttctattttttaataatccatttttaagagaaatatttaaaaataaattaaaaatgtaatcatttgtttttgtgtaattcaataattgccaacctgctaatggtgtcatacaacactcggatatgcgtaaaatgtataatataggaagtaaaaaattgattaatattatcaattattattattattataaaaaagtagaaactgtcagaataaaaggcaactctcaaatacgactttgatcatcatttttttttgggttttatttctttttatttacaataaaaattctaaattaattttcaatctttctatttttcattgcattttttaaataataatacatacattttaaaaaagtcacgggaacaatattcgaaaattcattcatctttggttgctttttaaaaatatggcctcctatctgtaaaattgtcgagagtattttaaaatatatattttttgtcatttctttttagataaacaaaaaatg

SEQ ID NO: 102155 - DNA, 163 bp, Heterodera glycines
  Promoter: Source sequence=SeqID_18893; Location=100..262; Strand=+; Gene=SeqID_83596
ttcgtcgtcgtcttcgcctcgtgcgtcgtcaccgtctgagcggaagcaaaggaaatttactcttcgaattgatcgagtgacttccgtcgattcacttccttttaaaatccgtccattgcctggaaagggtctttttgtgagcgaagtttgtgccgagaaaatg

SEQ ID NO: 102156 - DNA, 392 bp, Heterodera glycines
  Promoter: Source sequence=SeqID_17712; Location=288..679; Strand=-; Gene=SeqID_82243
tgttgctgaacgttgctgctgatgtactttgtgttgatgaagtgcttgtgccgaattgcttgtcgactgcttttgttcgtttggttcagctgcgaataggaccgaaaatacgaaaggacaaaggatcggattttgccgaggaatttttcacaacggaggaaaataaattatttcggaatttgctgaaacgactgcgatcgtttgaagctgctgtttgcagccaatttcggcaagtcggaaatgaattgaacgtaaatgctacaagtacgagttcccaatttggacatttggagagatcgatggatgagctaagtgctagcgaagaaattaatgattttgttctggaagagaaattcattaaattggaggaagaattcgaaaaatcaaaaatg

SEQ ID NO: 102157 - DNA, 447 bp, Heterodera glycines
  Promoter: Source sequence=SeqID_17363; Location=430..876; Strand=+; Gene=SeqID_81848
ttattaataaattgtttgaaaatcagaaatgaaaaaatgcaactttatttatattaatattaaagtgactaaaaatgaatgaaaatctgtttttatacttgttaatgtttacttaacctatattcttaactattataaatagcagttgaatttcttttttttcattaatcatcttttacaaaataattttgcaaatttcctctataaaattaattaatataaatctagattaattagaaaaatggtccttcttgctgaaaaaattgcacaaattttgaattgtcgaattaatgagctccgtgatcgtctaaatcatccatcggattgtgaaatagttgtgaaagcattctatggaaagcatattcaaacaacatacaaggacagaaatggatacaccaaaacttggtttttgggggtattactgcgcaaggagctgcaaccacaatg

SEQ ID NO: 102158 - DNA, 75 bp, Heterodera glycines
  Promoter: Source sequence=SeqID_923; Location=1245..1319; Strand=-; Gene=SeqID_64144
aaaaattggaatttgattggactaattaattgcccaattttcggtttaaggtttgaccggcggagtgggcaaatg

SEQ ID NO: 102159 - DNA, 197 bp, Heterodera glycines
  Promoter: Source sequence=SeqID_12963; Location=736..932; Strand=-; Gene=SeqID_76720
atgatgcttttttgttgtttcctatttgtaaacgattccttaattttcacagatcctgcttcaacaacaattccatcgcttttctccatcgtttgcgtccaattttcgccgcctgtccaattaattaaaccattcgcgacgtctatacgaccaatgatcacacttttgagtccattttgcgcaacatttggccaatg

SEQ ID NO: 102160 - DNA, 1003 bp, Heterodera glycines
  Promoter: Source sequence=SeqID_257; Location=6259..7261; Strand=+; Gene=SeqID_79950
ttatttcaatttttatatgataattttgtttaatgaattaaaagttttaccactttcttcatgtttgctttaaattattttctcgcgcttcattcacttttttttgccattaaaatttgtgtccttttaattgggtatgtaacacgcgtttttgtgacgataattgctgttgtgtaatccaaactatgatatttctttttcttaaacaaaaaaattattatgattcataatttttatgttccctaaaaataataataattttttattttttaataaataaaaaaaattcatcccgatggaattgttgctgtttcgtcatgacgaatttgacaaattgtacggctgtgagggatttaatgcggacaaaatcccacttgaagaaagaacaaacattgtgaacggatgcattttgatcacactttttttcgtttttgaggtcttaaagagaatatattaagaattaatatctatttttttaaattaattagttaattttaaattaattaatagttaatttatttatattaattaatttaaaattaatttttttaaaataataaaaaaagcaaaaataagaaaaaaaaagaaaataataaaaaatcaaaaaaatatcattaaaaaatctaaacgcaatcgtggaaaaaaacctacgaataaaaatattttcagggggtgattgaattagggctgctctagagtaaaaatttgttatattcggatagcgagaccaaaagtaaagaaaattctcgaaacttaaaatatgaaaaattaagctactttacattccgtgtatggtatcaatttacaaaaacatgaaaaacaatgcctgctacaaattgatgttctttattggcatattggacatggtcattttttaattgaataaatgcaataatatttatcattccaatttaattgctttgtctgcttcatgaattctcatattttattaattatgtatttgtattttttaattaaatttccatagtcggccttgttcatg

SEQ ID NO: 102161 - DNA, 472 bp, Heterodera glycines
  Promoter: Source sequence=SeqID_21850; Location=513..984; Strand=-; Gene=SeqID_52482
tttggggtcagcagatgatgagtgcagtgttactgtacctggacggtaacggtgcggcttcctcgtgccggtggcattcgatctgcgggccattgaaacaatgtgtttgcagagatggattattgtataatatgtgtatatgtgttcggtaacgcttaaaataaattttttgaaattacaaatggacaaagattaaataatgagaatgaattaagagggctgaatgaaaattcattcaaattaaagaaaaaaaaaattctgcttagaataggtaaatgatggtaattggaataaatgattttcagtctatgcattttcttcattcatttcctttcttttataatgctataatttcaatttttctcattgtttttctcccaaatttttgacattttgtgacacatttttctttataaaaggcattccatcgaccatttttcatcttattttttatcaccgtaatcacgccatg

SEQ ID NO: 102162 - DNA, 1003 bp, Heterodera glycines
  Promoter: Source sequence=SeqID_7860; Location=1225..2227; Strand=-; Gene=SeqID_66195
gtttaaaaataaattaaattcttgcttcccagtaatattaaaattttaaaagacacaaaaacttgcttatatgataaaaaaccaaaaaattttttattaattcatttggttctcgggccttaaaattaatgatttggcagttttcactatagcatttacgattcattacagctagtttgatcaaacatataattttgtcacttttaaaaacaaaaaaaaatcaaaaatgcattatttttttaaaaatttcccatcggccattcaaaaaataaaagataattcacatttatatgttccgcttttttaacaaatagcagaaattttcaaagcttgccgctgatgaccccaaattgccttaattttttaaatcttgtccaagaatccaaaaattctaagatttaattattcgaatagtattctttatggtctaagttaattttcaattatttttcctgcaacttgttaattttatacataatttattgaacatttggtttgaatttttttttacttcgcacataaacatttggacatacttggtttaatttatttattttacatgtaaattcttgaaccccacacttaaacgacaatgtcataaagcatcaacattggatttttaaaaagttaaagctttatccttaattttcacctcaaaaaatcatttttaaacaatggtgttcttcttgtaattgtaagaaaaatttcgacggcatttctggtttaattgttttttttaaataagttttcaatgggtcatgaaattattattatttttcttgtgaattttaccaatctaagcgaactaattaaaaatcttaagggttaaatgttttagtagctaaatttctatttttttctcatgtgcaaagattaaaagggctaatgacagtgcaaattctctctaatactttgtgtacgcgcgaatggagacaattaaatggcagtgaaaaaaattgtttttaccaattatttacgaatgataatcactcagtaaaatatg

SEQ ID NO: 102163 - DNA, 1003 bp, Heterodera glycines
  Promoter: Source sequence=SeqID_14770; Location=2987..3989; Strand=+; Gene=SeqID_78905
caaatttcagtggtgaagaaattaatgccttttgttgtttttaatatcgcacgaatttctttcataacaattttttgaaagaaactttcgtttcaaaaaaaactcattttttcattcggaaaaagcattatttttcggaaagacattctcaaataatataatagatatcggcaccgccggaatcttaaaatccttaattttcttaaaaaatgcctcaaattttcaaaaattggctatttttggacataatctgacactgtattgtattcaaatatcaattttttctcggcggcgcctatcggcaccgccggctccctcttcctccctggtcaccaaaaagttttttcaaaaaataagccgcaaaaaattgttaaaattaataaagggagtcaacaaataaattattaaaaaattttatttgaagcaatttgaaaaaatactgattttcgacccataaatgtgatttttttatttcaaatttctcctttataaatttttttatctattttttctttaataaaaggattttccttcaaatttgtgcattaaaaatatttttgttagtttttaattaaattttcgaattactcccgctcccgcccgggactcccgtaaaatttctgcgggattttaacgggagcgggattttcacgggattcccgatcccgctcccggaaaattttgaactcccgatcccgctcccgctcccggaaatttttttttaccggactctaataatagataattatgggtgtcaatttatgatactacacaaaaatacaattttaagggaaaaccccttgttttaattagtgatgtacattcgagagttggactcccaggatgagcgtgctctggttttattgagtgcgcctcgttcttgcgttcgtcttactaaagatgttcgggcatattaaaatttgaatttaggctaaaagttttgttgtggttgactaagaaattaatttcaatatcttaatgaaaacatcaaaatttaggaatg

SEQ ID NO: 102164 - DNA, 665 bp, Heterodera glycines
  Promoter: Source sequence=SeqID_37436; Location=1..665; Strand=+; Gene=SeqID_66516
ctccactttttttagcccttttctcttttggcgtttcctatgctttgcacgtgaatttcctctgcattcgttgcaaaactctagcgagtgggcgagcaaatgcgctgcccacacaacaacaaatgtcggacgatggatggggcggggaggggcggagaaaccttcgcccaatgtgacttttggccgggggcggcccgtcctttctcatcaaatcgtccataaaatgagggggacacagtgaacccttctcattctcatccgcacctttttgtacggaaattgacctcagtttttgggtggttaactcttttcttgggacttcgattgactacgtggtgagaaagaaccagtccaaactctttgatcagatggacattttgtttgtttagcgctgcgctcaccgatttctcggcccaaaaattctccaaggccacttttgcaataattttgttagtttccccaggtaggaggggtcctcccccgtgccgtacacagctgacacatacatatgacaaccaaaacacaaacaaccacaacaacaaactctcctcagcccatccttgcgtatttaaggctgtttaaatctaaaattatcactttttatctgttcccatttcgagcctaaattattttgttctcatttaaaatcacaacagcctgaaatg

SEQ ID NO: 102165 - DNA, 88 bp, Heterodera glycines
  Promoter: Source sequence=SeqID_15474; Location=1..88; Strand=+; Gene= SeqID_79747
aaaagaaatcattgtgttggcatattttggcgtccgacaaacattggcactgatttatgaacagcggcgagaaaatgttttaagcatg

SEQ ID NO: 102166 - DNA, 1003 bp, Heterodera glycines
  Promoter: Source sequence=SeqID_9329; Location=254..1256; Strand=+; Gene=SeqID_71009
ttttttgtctgttaatgtttttcggatttatgacgacgatatcagcaagcttttcgaatggatattaatcaactggtaaaatatgtaattaaactcattggtgcatttttgcgaatgtgaattttgctggttcattttcggttgctttgtaatttcaatttgccttcttatgctttttctttgttatgaccatagagcactcgcttctctttttctcgtaaaatttccttttcaagaacagaaaacgggtggaaagtcacttcattaggagacactttcgaaggcgcaatttgccatttcgaggagcgctgcctttaaccgtccatcattcacttctctttgtccattattcattttgcacattctgcggttggtaattccccccccccgcttttgaaaggatttgtgtgatcgataaatgaagggagaggtgagtgaggagcactttcgaccccgtccgatgggccctcccccgcccttttgccctgtgtacgcaaatacaattgaatggcgactgaggggactcgggtgggtgttgaggaagagaagaggattctgagaaaggaaagtcctttggatgttgaagaactctcattttctcctcctcaaaagcataataataatgtgtaacggcacgcacttttttgcccttcaatggatggacggactgtttttgcattttgctcctttctttttttgtgtgttatgaaaaaatcattttggtgcgatttgttgccctttgaagggccattcccactgaccattgttgttttattggatcattaattataataattaattgtctgacacccgtcaactttcaaatgaattggtttcctttctgtttccctttgccccaatctttcgtccatttattgtctcctcccccctaattactctttcttttgcattttaatgaaacggttaaaagggcatatgttcttcctttcatttagcagagggaacccctcgccaattgagtgcgttttttggcattgccatg

SEQ ID NO: 102167 - DNA, 502 bp, Heterodera glycines
  Promoter: Source sequence=SeqID_19037; Location=1..502; Strand=+; Gene=SeqID_83772
ttttctcaaaaaaatgattcatgggtccttttattctcacagtaaactcaaattaagaaattaaaaatcaattaattaagaatttatttaaaaaagtagtgggtcttttatccgtgggtcttctgtcggcgtgggtcttttgtctgtgggtattttgcgagtgggtcttttgtctgtgggtcttctgcgttgacaccattggaagcactgggttcaaggtggaaaaacttaaaaatttttaggattttttaataattcttgaaaggcttattttatgagtggtctcgaaaattcaaaaccaaatataaatttaaaaaaagtacataattaattgattttattgtgtttcttaatcttatactaaattagaaatacattcatttcttattgttttttcatttttattcttttcttaaattaaaaaatatttttacttttcaattttaattatttttttaaatagcattgtaaataaaaaattatttagctgaatgattacatg

SEQ ID NO: 102168 - DNA, 269 bp, Heterodera glycines
  misc_feature (53)..(53): n is a, c, g, or t
  Promoter: Source sequence=SeqID_31807; Location=723..991; Strand=-; Gene=SeqID_62093
aaaaatagtatttctggacttctcagaaatcagaatcagtctccaatgtgcancaaattgtaggccaccagccacagcccccttgcttctcccagttttaagtctcggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 102169 - DNA, 386 bp, Heterodera glycines
  Promoter: Source sequence=SeqID_11703; Location=260..645; Strand=+; Gene=SeqID_75189
tagtccaaaaccgtccgaaaatcggttttttctatttcggaaattatttacattaagagttctacattttcagttataaaggaacaatctgaccaatagaattgattatgcattaaacaaaacctgaaggtggtgagagagaaggaatagcgttccgtgctcatttcggcaacaaaaaaaaatgtattttgtgaataaattggcttaaaattgatacattaaactgcaaaataataagcaaaaaacaaatgaatgttatgtgaaacggttcggcgaaaattgaatccaattaatgaaagtacagataaatacaaagtttggtcccccgtaagacagtcatacttccaaaatccatcatttttcagaaaataacatgctctataatg

SEQ ID NO: 102170 - DNA, 203 bp, Heterodera glycines
  Promoter: Source sequence=SeqID_4138; Location=4040..4242; Strand=-; Gene=SeqID_53335
aattttgacatttcacccattcatattgaaaaattccttgactgcccaatttgcatgtgctcctttgtgattggggagggggccacttctccattgttttcacattttccatacttcttgtattgtcccttggctgagaatcagccgtagctgccccgtttgtaaatttattttgccttgaataaatttttttcattgtaatg

SEQ ID NO: 102171 - DNA, 274 bp, Heterodera glycines
  Promoter: Source sequence=SeqID_16013; Location=58..331; Strand=+; Gene=SeqID_80366
aacactaatggactaccgcgacttcggacaacaaagggaaaagggcgaccgcctgtctcctcacaatcgcacattttcaaagtcaacaacaacgacaactactgccttttttacgccttggaactgatgcgctactactcattatatatcaggggagtaatttcaaggaaacaatttagatggattaacaacaaccaaacaacggttttacgacaaaaagtgcagcaactgctccgcgaggcgggtatcccgacaactgaaccggaatacgatg

SEQ ID NO: 102172 - DNA, 151 bp, Heterodera glycines
  Promoter: Source sequence=SeqID_30229; Location=211..361; Strand=+; Gene=SeqID_60662
tgctgtgggtcgacctttcttggtagcacttgccggagctaaattttttctattaataaatggttatcttttgctggtcttcataatacatttcatagagacaaatcctcaaaatttcattcacagcagggacgtccgcctcgtcgaaatg

SEQ ID NO: 102173 - DNA, 452 bp, Heterodera glycines
  Promoter: Source sequence=SeqID_45412; Location=543..994; Strand=-; Gene=SeqID_72710
aaaattatcagagtgccgaaaatcgcatgtgatctaagcctaacaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtcatctaagcctagcaaaaaatggtgtaagtaaaaatcgtaattacgctcaaaaagctcctcaaacaattttagcgcttccaattccttctacaatcgcctttatacatcccattatgagcgctaaaattatcagagtgccgaaaatcgcatgtgatctaagcctagaaaaaaatggtgtaagtaaaatcgtaattacgctcaaaaagcttttcaaacaattttagcgcttccaattccttctacaatcgcctttatacatcccattatg

SEQ ID NO: 102174 - DNA, 650 bp, Heterodera glycines
  Promoter: Source sequence=SeqID_28361; Location=1..650; Strand=+; Gene=SeqID_58990
gatcagttcagggggcctcagagatggtgatcgcttttggtaggtcattgttcattcctctttctgctagtcattccggtgcttaaataagcttcagctcactgtcgattatttaattttttaatcaaactttggttccggattaaataattgaacacactactagcttgaccaccaaatagcttcaataccgtataccctcccaatacaattcaggtacgaaaatgatggtgtgttcacacagcttcagctagcgcaaattcggaaaacctcactggccaaagttctgtgtacgaacggcgacgacattgaccgtattcaggtagtacaaaaagttgatactaccgtatctttcactgacttggcgacaataagtaggctcaacccgaaactggtgaataccatatcgagattttatttacaccgatgaatcatgcacttcatcataaaaaaaattctgagcccagggaatgctcctccggcagcgtcaaaaatgtaatggaaaattccttgaattttgaaaatcgtacccaagaaatctgcatttttttgcctagtgcggttctcaaaagctataaatttttttggactcaaagagaaacaatgggtcttcagttggccccttccgaaattcgtgctttctggttatg

SEQ ID NO: 102175 - DNA, 99 bp, Heterodera glycines
  Promoter: Source sequence=SeqID_34059; Location=1..99; Strand=+; Gene= SeqID_63948
agagtctgatcaatgggaaataaaaaggaattcttattaatttttgaaaacctttgaatgttctgattaaatttaattgataacattttttcaggaatg

SEQ ID NO: 102176 - DNA, 396 bp, Heterodera glycines
  misc_feature (106)..(106): n is a, c, g, or t
  misc_feature (110)..(110): n is a, c, g, or t
  Promoter: Source sequence=SeqID_18367; Location=1..396; Strand=+; Gene=SeqID_82969
atgttcgacaatcatttaatattgggtttttaatatatctctaatatttgaaaaagtctgcatctgtattttttttactacataggttcaatatcagcaaaacganaatntagaattaaatgtgccacaaatcacaaaatgcttattgctaaaaaactgctcaaattgatcatggacaatcaaaaatataacatttgaacattttaagcgtgttttgaatgaattttgtaaaaatgcggctttttgaccaaaaatgaggcttttgaaaattttaatctgggagccctgattaaaatgcttaacgattgaaaaatcccgggtcatacatatttcagcattttaatttgttacctcgggagtttggacccgagcggagcaaattgggcttatggcatg

SEQ ID NO: 102177 - DNA, 155 bp, Heterodera glycines
  misc_feature (18)..(18): n is a, c, g, or t
  Promoter: Source sequence=SeqID_14886; Location=1..155; Strand=+; Gene=SeqID_79044
attaaaagaaaaaaaaanattttgggcatttcatcaccaagggccggcaattaataaatttcccgatgttaattatccaaactcatgcgagttaatcatttatgaaaatgtgaaaaacggtaaacaaataataattggaacaacatgaagagatg

SEQ ID NO: 102178 - DNA, 481 bp, Heterodera glycines
  Promoter: Source sequence=SeqID_12974; Location=4225..4705; Strand=-; Gene=SeqID_76736
ttaattcttcattgactcctcatttccctcccgggaattaaataaaaatttgaattttctccaaatcgcaatatttttcttttttattttttctatcaccatatatcaattttttaataaaaaattataaaaaatataattttactgggatgccttctttgttattttttcattacatttttcgctgactctttttcaaataaaataattagagtagtgaggacccggtggtatcgacaggtaacacctaatttagaattcttattttttccttctctaagttgttttctaaaaaaagttaacaacaatacatactttatttattcaaaaataccatttatactttatgcccagaatttaaacgatgttaaaattaaattatttttaaaattaaaagaatttttccccaatcatattccgtctcattttcatctgtcagcgttcttcatcctcagcacgcgttgcatgctttggcacaatg

SEQ ID NO: 102179 - DNA, 125 bp, Heterodera glycines
  Promoter: Source sequence=SeqID_45555; Location=383..507; Strand=+; Gene=SeqID_72830
agtgagtgggtagccatatttattatggactattgcatttaattttatttgtacattgactctaataaacctataattcgtcgtgacaatttcaaaattgcttttaggccgcacttcgcgcaatg

SEQ ID NO: 102180 - DNA, 756 bp, Heterodera glycines
  Promoter: Source sequence=SeqID_7358; Location=443..1198; Strand=-; Gene=SeqID_64588
ggtaaatttcgagttactggttcggtgcttttttggagttaggtaaataatttggacggacggcagaaaatgttttttccaatactattttaataattttctttctctgtttccactgtctgccttttgtaatggaatggaatggtagagaatgaaaaaggactatgcgtctctacacctcatgaaagggtcgaagtcgcttgggccgagtttttgaactataacttttttcgttgtcaactaaatcctacaatcttggtatcattcgatagctctaagtgtcctctattagcatgacaaatttcgaaaaatttcatttaggttcaaaaaagctatgacaaaaaatgttcgaataaccagttttttaatcttctgctcaacataacgaaatttttcgaaattttgcaggctaatagagaaatcataaatttcatatttttaaatggattaaaaaaatcaatgaggacgccacaaaaaaaataatgcaaattcaattgtgattaaattcattgctctcaattattttaattattatttatcaattaattatttgttgaatttttttaattctaccgaagatcagtttcacagattgattaagctagcttttatggcaatgctttctcaacattcattagaattttttttattaacaattctttcctaatggattttgccaacttaaaaaaattatttatcatttataacaaatatttttaaaaaatattaaaatataattattttttttaacagatg

SEQ ID NO: 102181 - DNA, 920 bp, Heterodera glycines
  Promoter: Source sequence=SeqID_43868; Location=744..1663; Strand=-; Gene=SeqID_71447
aaagattctctggaatttttaagggcacacggaaaagcgcctcagataccacaacacatctccacgttggagtcaaaagttttgggagttttctacaaaatcacacacgattgttgtaggagatggtcccctccattagatacgagggcaccagccaatggaagaacagtagaagaaattgaatgactagcaatagcaggattacaaaagatgcactgtaaaatgacaaaaaataaaaataaacaaaaagaatcacaaagacaatcatttttggcacaaaagaataaatcaataacccaatttttaattggttgttaattaaaaaatatcgcatattacactttaaataggaccaaagagatatgaatagatgacgttacaactcagtgccacgcgatgcccgaaaaaccctttaggtcaattcgactcaaagccatcccaaactattgtttttggaccagcgcaacgatcgtccgtcacccaccccccaactccccacaatccaaacctagacttttacaattgtaataacccgattatactccaaagaggacgataccaaatcactccccagcaaacacgaaagggagttgtatgctatatttgcaactaaccaggtcatatatcgcatgaatgtcaaagagtgatcgctacagcgagacgtaaacaccgtagcagataggagtaggcaacaatttgctacgggagcaaataacatttcactgcgaaacaatgcatacaatcagcgaaatgccataagaacatatccggctgtaaaatcccaaaatttcctcaaacaaaattgcatagtgatgcaagaggacaaaccccccgatgcattttgccgaggagtgaaattgacatccgaaatttcgagtttcatcgaaaatgaacttggtgaagcaacgcagactgaaatg

SEQ ID NO: 102182 - DNA, 374 bp, Heterodera glycines
  Promoter: Source sequence=SeqID_23278; Location=1243..1616; Strand=-; Gene=SeqID_53990
aggtagtgcatgacaaggtgaagcttactctttgatggtcccactcaaaaagtcggggaatgatggtgttgcaaaagtgccatttttgcattgatggaggaaaatatacgaattattagcgttttcggatgtacaaaaaatgggtgacgaatttatgattttgttagacgggtttcttacaattttcgaccaaaaaaacaaatcgtggtaaaacatggaatcaaagtcagacattactactgtaaaaaattctaagagcgaaagtaaaaaatgtaaactttttcggaagttgtatgtttagcactcacacttaagcactttttttactcgttgagaatgtcgtgcaaaaccatcattttcagacttttttcatg

SEQ ID NO: 102183 - DNA, 1003 bp, Heterodera glycines
  Promoter: Source sequence=SeqID_5708; Location=472..1474; Strand=-; Gene=SeqID_58983
ttctaacaattttgtacctcttctgatcacagttgtacctcttctgatcactcttctaatcactgttgcacctcttctaatcactgttatacctcttctaatcactgttgtacctcttctaatcacttttgtagggcgcgaagcgcacgtccgatctcaacaagtttaaaaaacgggcgcgaagcgcccgtctgaggccgcgaagcggccgaaaaggcccaaataaatttaaaaacgggcgcgaagcgcccgtctgagctcaacaaatttaaaaaacgggcgcgaagcgcccgtccgatctcaacaagtttaaaaaacgggcgcgaagcgcccgtctgagctcaacaaatttaaaaaacgggcgcgaagcgcccgttagagcaaaacaagatttgaaaaacgggcgcgaagcgcccgtactatgccgcgaagcgggcgaaaaggcccaacaaaatttaaaaacgggcgcgaggcgcccgtccgctctcaacaaatttaaaaaacgggcgcgaagcgcccgtcaaagcaaaacaaaatatgaaaaacgggcgcgaagcgcacgtccgatctcaacaagtttaaaaaacgggcgcgaagcgcccgtctgaggccgcgaagcggccgaaaaggcccaaccaaatttaaaaacgggcgcgaagcgcccgtcaaagcaaaacaaaatatgaaaaacgggggcaaagcgcccgttcgaggccgcgaagcggcctaaaaatcccagataatcttttaaaattccaaatatcttcataataataatttatttacttttattaaagaactcctatattttttaaattagaatttgtaatattaatttcttaatttcaatttaaataaatattcaatccctgtacatttcaaactctctttttaattaataaaaggaaatttattttatttttaaaaatttattaattacattcaatttttaatcttactttttaataaacgatttccttaattatttaattttaaaaccatg

SEQ ID NO: 102184 - DNA, 386 bp, Heterodera glycines
  Promoter: Source sequence=SeqID_11703; Location=258..643; Strand=-; Gene=SeqID_75190
ttatagagcatgttattttctgaaaaatgatggattttggaagtatgactgtcttacgggggaccaaactttgtatttatctgtactttcattaattggattcaattttcgccgaaccgtttcacataacattcatttgttttttgcttattattttgcagtttaatgtatcaattttaagccaatttattcacaaaatacatttttttttgttgccgaaatgagcacggaacgctattccttctctctcaccaccttcaggttttgtttaatgcataatcaattctattggtcagattgttcctttataactgaaaatgtagaactcttaatgtaaataatttccgaaatagaaaaaaccgattttcggacggttttggactatg

SEQ ID NO: 102185 - DNA, 160 bp, Heterodera glycines
  Promoter: Source sequence=SeqID_3670; Location=2148..2307; Strand=+; Gene=SeqID_45605
aggaaaaagactatttacctaatacatatttgaataaagagcattgtttcaatttctcaatcatattgcttttttgttgtaattttgtctaattttgatacctccaaaaatttgttagcctgaacaactgactgccatttaacatttgaagcagtgaatg

SEQ ID NO: 102186 - DNA, 145 bp, Heterodera glycines
  Promoter: Source sequence=SeqID_12167; Location=1449..1593; Strand=+; Gene=SeqID_75740
agtgcgcattcgaggattgaatgacgagccacgacggtcaagaagcgattttcgaagacgagtaacgaaaacgcgatcatcgtcacatgggaaaccgccggtcctccaacggcatttggctaccagtgaagcgacagaaacaatg

SEQ ID NO: 102187 - DNA, 166 bp, Heterodera glycines
  Promoter: Source sequence=SeqID_22013; Location=1423..1588; Strand=-; Gene=SeqID_45689
atttgttatttatgcttaagcgcctttatttattatcggccaaattaaaaaaaacaaacatttatgattgttttgtttttatttcttggaagtttcgttttcactttttatttcccataaatggtgcaattgcaattttatttttcgtattttaagcaaaaaaatg

SEQ ID NO: 102188 - DNA, 276 bp, Heterodera glycines
  Promoter: Source sequence=SeqID_5168; Location=1446..1721; Strand=-; Gene=SeqID_57138
tccctttttatagagaatttttacacggaaattgaggggtaggaaaatatttgtataaaaggggcgatttaagggtagaaacaatcattcttcatttgtcctttactgacataataagcgtctgtctccttcttcattttgttccccttttgactgcacttcagcaacaatgctcatcagagaatagtgagttgcttttcatcatcatcattcttctgacacctccttaattacgttaattaattacgctttccttttttcagtcgcatcgtcatg

SEQ ID NO: 102189 - DNA, 277 bp, Heterodera glycines
  Promoter: Source sequence=SeqID_12731; Location=3030..3306; Strand=-; Gene=SeqID_76433
aattcaaaacagaaagacggagagatatttgttctcccattcgaatttcgaacccaacccacactttaggcatttatggccctaaaataagtctagttataagcatcctgaacagctttattgcttttttgaagggtgtggcatcaaaatggaaaagtaccgaaaatagatcaaagtatggacaggaatttaacgaccccaaaaagaatggcgagggcattttcggaaagattttaatttaaaaatttaacagagaggaaattaagtgccaataatg

SEQ ID NO: 102190 - DNA, 198 bp, Heterodera glycines
  Promoter: Source sequence=SeqID_1442; Location=5318..5515; Strand=-; Gene=SeqID_73580
tgtcaaaaaatcggttcaaattctcgaaataccttaaagcaattatttgttcggtcaaaaagcgaaaacccaattattttcaaagcaagctaaaaacactatttatttgattttctaaataaatatttgaaacccaataagcccgcgctaaaattatatcgtcaaaatcctaatctccatttttgtttattacgtatg

SEQ ID NO: 102191 - DNA, 139 bp, Heterodera glycines
  Promoter: Source sequence=SeqID_10927; Location=1..139; Strand=+; Gene=SeqID_74229
ataaaaatgtttgttttttcgattgcctcgcatttgaaacaaagtaaattttctaacgcaataattctgcaattattcttccctttgtgacgacatcattcggaactcggccaaattgtgctaattgctgccaaaaatg

SEQ ID NO: 102192 - DNA, 58 bp, Heterodera glycines
  Promoter: Source sequence=SeqID_27495; Location=1..58; Strand=+; Gene= SeqID_58186
aattgcaaacggaaataatggaacgcaatttgagcagacgctagccgaaagagaaatg

SEQ ID NO: 102193 - DNA, 1003 bp, Heterodera glycines
  Promoter: Source sequence=SeqID_12373; Location=726..1728; Strand=+; Gene=SeqID_75978
tttccggcactttttcagcctgaaaagggcaagcacgccgctaattctattttccttcccatttctgaatttttacatcggttctgaccctttttgagcagttttgagtttgtgacctaaagcaatattttccatattttctgatttctatgctaaaagaaaaaaattccttcaaaatttcaaatatggattcataaaactcggaaatttgactttttatagcttttctggcaaaaattctacaatctgtgataaaaaaaaatataaaaaacaaatttaataaattgctgtcataataattcaaatgaatttggaattttttaaatttataactgcagcaattaatacttgttttatttttgcccttttttcggcgccactttcttagttaattattttttctcttattttctctctctcactctctcttttctgttcacctaattcattttaaatccttcttactcttatatttcattgtctctgtctctcttctctctctcacgctctttctttctcttccctttcacttggctcattggcctctctgagtctctctcactatatcgctgcatcctcagccaatcgacacaaaacggcgcggtcccatcgcatcatttgccttgccctcttctcgcctcactcggtgctaggtcgtttcctaaaaaccgccaccatgggcgtttcctaaaaaccgccaagtgggcgtttcctaaaaaccgccaccatgggcgttttctaaaacccgccaagtgggcttttcctaaaaaccgcaaccatgggcgtttcctaaaactgcaaagcaaaaatttcgaaaatatatctttcctttttaataaaatttttatgtcagttgtttgccaacgttataattaatataaatcttaataatattttacgccatttatttgccaacactatcatcattgtcaagcgcaataaaattaaaatattaatatatttattgctacttataaattctaactaataaaatttataaatg

SEQ ID NO: 102194 - DNA, 160 bp, Heterodera glycines
  Promoter: Source sequence=SeqID_1303; Location=4362..4521; Strand=-; Gene=SeqID_72160
tcgaggaagacttcaccaagtgttgggcacaaacaaaaacacttaaaggttgttataagtgtcagtcgggagcccaattgaagcttagatgttggacggaatacggttcagcattgtcagatgtctactgtgttgatggaacacgtttcacggtaccatg

SEQ ID NO: 102195 - DNA, 198 bp, Heterodera glycines
  Promoter: Source sequence=SeqID_7645; Location=939..1136; Strand=-; Gene=SeqID_65509
ggttttgcttttgtttggcatttcaaatatccgatttagagtaaacacttattgctaggtaacttattttattttttaagcgtggaaggaaaaaacaaaaaatgagtaacaataaattgtaaggtgaaaatgcattattttttagtggtctgaatatttgaacatttggtgctttccaaaaaataggaactcggtatg

SEQ ID NO: 102196 - DNA, 171 bp, Heterodera glycines
  Promoter: Source sequence=SeqID_18062; Location=2865..3035; Strand=-; Gene=SeqID_82656
cagcctctgggaggtagatcaggtaacaggagaaacgaaaatcctcaaagtaaaagactttgatattgagccacggctcccagggatattcgaaattgaaaggcactcatttcaccaaatggctttgttcaacgtctctgacctgaaacacatgcttttctaagcggtatg

SEQ ID NO: 102197 - DNA, 1003 bp, Heterodera glycines
  Promoter: Source sequence=SeqID_12974; Location=2250..3252; Strand=+; Gene=SeqID_47092
taccaactaattattatgatatagtaaatcaccatcgcctacaaatgcaatttgcagcttctactcaaaaaataggcgtataaaacggagaaaaacctcaaactttgattaaaaataatttttcgataattgttttcatcaaaatagataagaatatacataaattcattaactcccgcgggataaatgaaaaataatttttttaaattttataattataaatatacaaatttaaacaaacaaattttgtttatcgcaaaaaattgttattttaaaatttattaagtcaactcttttttgtttatgaagctgcaattaacaagcagttaaatgttcgcctgtttctccccaatcgagtactaatgagatgattgaaaagtgaatgtcattttcggacgctttaatttgttcatggtaaatgaaattgttttgaaattcggattaaaagattttttattaaattattagaaaattttccagaagaattttgagaaaattcgcaatttcgcgttttttggaatttcgcgtttcgcatttaattttatttcgcatttttgctttctcaaaattggcgtttcgcattttattaagaatccttgaaagaaaaaaatttggcgattcatcaattcgagaaaatgtaattaacttttttcgcctagtcaaattttataactcatatataatcaattgctcttatgaaattcaattttcattgaaaaaaattaagcaccaaaaaaattggtcaacttttttaacatttgttagcacagcttaacaatgacttaattgaaattcggcggaaactcttctccaccatttgaatgaacgtggatttaaactgcaaaaaggtgaacaaattttaattagataaagtgcataattatcggtctctatccgaaaattagtgcattatttaatggcaaaactcgccaacaaattcattcaaaatttttttaatttttaaaattattttctaatcattaatatttaattcctaattatg

SEQ ID NO: 102198 - DNA, 683 bp, Heterodera glycines
  Promoter: Source sequence=SeqID_32369; Location=1..683; Strand=+; Gene=SeqID_62685
aaaatgaaaaaaaataattaaaaaaaaaataattgctggtgtgggtaagggggaaggactgtgtttcctccaggcaaaaaatttttaagaaaatttaataagcatttgtagggtttttcagcagtttcccctgcaaaatttggtgagcttctgatcagtctagaacgttgtgtgataaaatgaaaaaaataatttaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgtgtgataaaatgaaaaaaataatttaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatg

SEQ ID NO: 102199 - DNA, 311 bp, Heterodera glycines
  Promoter: Source sequence=SeqID_10784; Location=3392..3702; Strand=-; Gene=SeqID_74040
agtcggaccagggaaattttttcttttctcgcagatggtttttggcgccgcaacacatcggttggtcgatggcatttccgaacacttttgagttttaaagggtcaacggcccgcaagagagagggggggggggttctaatccagtaaatacggtaatcaattttcaattgtgaattcattttcctttttgccccccccctttttaattggttttctttcccccttcatcagacccaaaagaggcggttcaaattcacgcattggtcaagtcgaagaagagcattgccgttcattggggcacttttgagatg

SEQ ID NO: 102200 - DNA, 834 bp, Heterodera glycines
  misc_feature (382)..(382): n is a, c, g, or t
  Promoter: Source sequence=SeqID_23621; Location=1..834; Strand=+; Gene=SeqID_54317
ggcccgcatggggcaggctcccgtgtcggtccagttttgccggatcgaaaatgggcgcccgacaaaggcacaccacgcgccccctccgtcggtttacctgttgtcaaaagagctcacgtctgaaacggggatggcctgcacccgccaagtgttgttagaattgtcggcgaacaccaccaagcaaatgctgacattctccaggcccaattcattttgcaattggaaaaaatgttcattccatggcggagtcacatcgcttttggggaacaaaattatccttgcatttggatggatctaattaaatttttttatcagtttgttccaaacctttaggttccttatttcgtcttgtgataaattctatgacttttacagtagcgcncgctttttcttttttttgaaaaggacgaactttcaattcgttttcttttgagcccaaaattgaatcgctttgttcaaagagtttatctttcgtgaggtatgcatgtagttatttaacattattataaagtttggattttaagattttccttattttcatgagcttcacatggcgtgaaatggtacgaaaataaagtatttttggtcctatttctcttttttcctttctttttttagtagactccaaattgtactattttagacagcttaggtcctcaaaattcccagtcctttttacctacaatatgcggggaaataatgcaaattgcacttcttatatacctacgcattaaaagaaattttttccatttttccggtgtttttggttcaaaaatgagtatataagccgacttttttgctccctctcagcataatttccgtgtccaaataatg

SEQ ID NO: 102201 - DNA, 394 bp, Heterodera glycines
  Promoter: Source sequence=SeqID_6792; Location=2927..3320; Strand=-; Gene=SeqID_62924
ttaccttcctctgcggacggatgaatcatttaaaacatgccaatccaatcaatgcctttccttttccttttcccttttcttttgcctttcccttttctctttcccccaatccgtcgccattgaataattaattaattgcgttacctaattcactcgtttttgtttgcacaaatatttgggtaataatagaacctatttaatttgtaatgcccacacattcccttgcttttgccattaatcggctaaatttgcgaaatgagacagaacaaaagtgagtgtggcacaatgtaattaattaattaattaatttcacacatattattcattctcgtcctaattaattcagttttccgcttaatctctgccgtcccttcgcttctcctccccccaaatg

SEQ ID NO: 102202 - DNA, 95 bp, Heterodera glycines
  Promoter: Source sequence=SeqID_5344; Location=5065..5159; Strand=-; Gene=SeqID_57738
ggcccctttttttccccattttgaaaataagttttgtttttgtcaccccccccccccccgggggggggggggatgagaatggtgcagcccaaatg

SEQ ID NO: 102203 - DNA, 708 bp, Heterodera glycines
  Promoter: Source sequence=SeqID_1935; Location=7764..8471; Strand=-; Gene=SeqID_76889
aaaagtaccgacattttttgatgttcctaagcaattcgttgactttatcaaatatttgttaattgctttttaaacaaattcaaaaaaaaaaatcaaggtccaggccatgacaagcctggatttttatccaggaaatccaggtccaacattgaagccaggttcattgtcaggctttttttcaaaatgtctagttctactcaaaaaaaacacaacaaatgtacatactgttatcaaagggactgattaatccggttaatttttaactgattatttattggaacgaaatcacgaaattattgtaaatgacacgtcattcattcagtccaaggcaaaaaaaaaaatggggtggtgtgaatttttgatggtccatctcgaatacaaaactgttcaaaaatgaaattctaaacgcaaaaactagcatttttactagtgctaattacctaaattagcaattttagtagtattaattagctaattatcctaatccatcccctcaaattaggtgatccacatggtttgcattggtgcaaagagttcgtcaacaaccgctgggaccaacacaaccccgtcacgggaaaacaatgcgggcgccccaaccgcaaatgccgcgaccagtgaagggcttcgccaccgtggcaccaacaagtgcggaatttaagacatggaaaaaaaatttctggtgaaacttaaccctgtggtcccaaaatg

SEQ ID NO: 102204 - DNA, 1003 bp, Heterodera glycines
  Promoter: Source sequence=SeqID_6344; Location=394..1396; Strand=+; Gene=SeqID_61221
ctcctcttttctctttctctctctcttctttctatctctctcctcttcactccctcctcttttctctcccttctctcctctctttctttctctccctcctcttttctatctctctcctcttcactccctcctcttttctttctctctctctctcacctctctttctttctccctcctcctctctttctctctctcttcctctctctctatttctctctctctctctctccctcctctatctctctcctcttctctccctcctcttttctctctctctcctcctctctttctttctctctcctctttctatccctcctctcttcctctctctcctctctctcacctctctctcttcctccctctcctctttttctctctctctctctccctcctcttttctctccctcctcttttctctctctctcctctcttctttctctctctctctcctcttcactccctctctcctcttctctcccttctctcctctctttctttctccccctcctctttttctctctctcctcttcctctctctcctcttttctttctctctctcctcttctccctttctttctctttctccctcttctgtttctctctcctcgattttatgtgctcgctcataacacaaaaaagacgtaaacaacaaacagaaaagaaaagaaaaaaagactgaactattttccaaaaggaattcgtttcgataaattgtttacttttaaatgtattagttacagcgcaaaattaggttcatttctcgtttttagttatacagaaatttaaatttttcttttggcacgataactttaataaatattatactatactctcattcattagttgttcattcgcagtactaaccgaaatatagattcacactttttctttatttatttcgaacatttttgaaatttattagctacatacctaattcgtaataattttcttttcattaggtacttttctgaattctcttcgcttttctttatctgtaaaaatg

SEQ ID NO: 102205 - DNA, 506 bp, Heterodera glycines
  misc_feature (23)..(23): n is a, c, g, or t
  Promoter: Source sequence=SeqID_21172; Location=1530..2035; Strand=-; Gene=SeqID_51762
attaaggcctttatgcgcatctntacccttaaaataatagaagcgagtgaaagacagtctcactataaatatgtgcttattttaaaattatgaatacgtcttttgaaaaatgcaagtatattgtaattggtgagtaattttcaaaattattagctaatcaagaaaggacaaaaattgtcctcaattagtgaaaagaaaaaattcctatttttactccgcagtattcaaagtcaaacagctgcagacagaaaaagtataactacttttaaatgaaaataattaagagatgaaaattttaaaataatttagtagtatccgctagtcaaatctattttacaataaactcattattttgagcaggagggagtccgagatagaattacacaaaatatgtgaatatgttcttgtgtttaattaaggcctttatgcgcatcttttaaccctttaataatagaagcgagttgaaaacagtctcactataaatatgtgcttattttaaaattatg

SEQ ID NO: 102206 - DNA, 86 bp, Heterodera glycines
  Promoter: Source sequence=SeqID_31230; Location=899..984; Strand=-; Gene=SeqID_61601
tgtttattgatgtcgaacttttgttttttaaatgatttgtgatttaaaactgaattgaaaatcatttcagaataaattttcagatg

SEQ ID NO: 102207 - DNA, 118 bp, Heterodera glycines
  Promoter: Source sequence=SeqID_33336; Location=725..842; Strand=-; Gene=SeqID_63429
ggttagtcaaaaaattaaaaatcggattttttcgaggtcactggtaaattgtttaagcactcgaaaggtgattcgtcgatggatttcattcgttgcgaagaaaaagcagcaaagaatg

SEQ ID NO: 102208 - DNA, 236 bp, Heterodera glycines
  Promoter: Source sequence=SeqID_22360; Location=1..236; Strand=+; Gene=SeqID_53029
ccatcaaacgtacaacttacaaggtatcgggccgcatttgcataatttccattgccaatgacacggaaaaattcgtaatcggccaccagtttgagctcacatcgattgccttttatttctttaaggggagaatggcattcaaaaaacggcaaaataagtataattggcacggcagcacaccttttaacgacgcattcaatggacaccaccaaatggaaaacagcaaaaaaaggatg

SEQ ID NO: 102209 - DNA, 471 bp, Heterodera glycines
  Promoter: Source sequence=SeqID_24620; Location=1..471; Strand=+; Gene=SeqID_55358
aaattattttcatttcaaaaaaacaaaaaataaattttataaatttttcgaggaataatgagtagggctttcaaaaatatgcacgaaaaatggctaaaatatgcggtgaaatatgcacaaaaatcgcaaaatatgcaccaaatatgcacaaaaaactaaattagggatggaaattaattaaaaaattttattccttataaaataagttgtttttgcaatttcaactcaaaaaatttctcaagattttcggcagtgaagctcatcgcgcacccattcagtttggatttaattttaggcataatcaaaattttttccgaagagatattcaaatcggaaaatatttgacgaaaaatggcaaaatatgcaaaaaaaacaaaatatgcaaatataagtcccgatttttgttcggaaacacaaaaaagaaagtgtttttcgtactatttagagcatggaaagccaggaaaaaaaatg

SEQ ID NO: 102210 - DNA, 378 bp, Heterodera glycines
  Promoter: Source sequence=SeqID_27323; Location=408..785; Strand=-; Gene=SeqID_58014
ttgtgacatttccaaatgtttctttttcctccccaaccttttcttttttctatccttcatcaatcggagcaatcattgatcgcatcgcacacaattttcatttaagtcacacgaattgaatgtgatgataattaaattgctaaatattaccgaaatctaagaactgaataacaaatcgcccctcccccattcattcgtaattttgatcttcactcaactttccccaattattgcattttctcggctttcatcttttcaccccgataaatgttgctgttggatgattgtgactaaatttacaaaaaatctttacaaattttaaagtttgcgtgataagaacatttgctttatgtgatggtgagtcatgactggcaaatg

SEQ ID NO: 102211 - DNA, 452 bp, Heterodera glycines
  misc_feature (25)..(25): n is a, c, g, or t
  Promoter: Source sequence=SeqID_36480; Location=1..452; Strand=+; Gene=SeqID_65779
tttgtctaatcagaacgactgtganaaaccataaattaaactgaacagtttctggttcggctcatttctttgtaaccacacaacgggtggaaaaccagaaattaaattgaacagtttctggtttggctcaccacttcccctttgtctactcagaacaactgtggaaaatcagaaattaaactgatttacatggttccgatcgcagatgtatcatattggtaactttatggttgtttttctggtcatgtttctggttttgctcttttcttttgtctaatcataacgactgtggaaaccagaaattaaactgaacagtttctggttcggctcatttctttgttaaccacaacaacggtggaaaaccagaaattaaactgaacagtttctggtttggctcatttcttttgtctaatcagaacaactgtggaaaaccagaaattaaactgaacatg

SEQ ID NO: 102212 - DNA, 368 bp, Heterodera glycines
  Promoter: Source sequence=SeqID_29919; Location=1591..1958; Strand=-; Gene=SeqID_60381
taaataatttttataaattctaaaaattagacaaaaaaaattggtggctttaaaatcgggaatgatcagagtatcgcaatgtggttggtaatgaaacagaagagctgctgcatacacttcaacagatcgatcctcagctcggctgcgctaatggccattcaaaaatgtccaaatcgatgaccgtttcatcgatttctttgcgaaaagcggcttttgaaatttaacccataagccacgcattctcatttaattacgaaagtggaacaaattctttatcaaactttgtataagcggcgcccaatcactccttttttattacagaatttattggttattaaaatttacaggatttgatttgaaaaagaatg

SEQ ID NO: 102213 - DNA, 681 bp, Heterodera glycines
  Promoter: Source sequence=SeqID_6773; Location=1512..2192; Strand=-; Gene=SeqID_62852
acaaataaaaaaaataaataaattctgtaaaaatgccatgatagagtaatcgcaaaatatacatatacctactcatgttagacaaaaagtctaaattatgagcgaactcggactcgtaaaaggaaacccataaatcatagagaattatattcaagtaaacgaaaacattatgccacaaatgaacattataacaaaactttatggcaaaaatcaaattctttgcattttgcaaattcattttgctttacaaatttaggaataccgaatgtaccgaatccttttcaagcttttcccggaatttattctggtcagcagttgcgtaaaaatatatgtactttacattttcaaatgccaataaatgtatacagattataggaattcaaattttatattggtcatttaaaaatgtatgtgaaaagtgtccattaaaggaaataaaataaatgtaccccggatttagaacccgaaaaagcgggattttaatcctgaactatgaccggttcatcctacatccaaaactccgtgctcaactgattagaaccaaaataaaaatcaattcgctgcattttttgctttccgcgaaatttcttattttaaatttaaaattaagtttcagctagctattatcagtgccttttgaatttttcattttgtcaccattttgttgcctttttcacaatg

SEQ ID NO: 102214 - DNA, 213 bp, Heterodera glycines
  Promoter: Source sequence=SeqID_1727; Location=1..213; Strand=+; Gene= SeqID_75526
tgacagggcatttgagcagctggccgcaaaatacgcttacgagaaccatgcagggagaaaaatgaaagtcagatgttcatggatttcacttttatatccggaaaagtggtgccacgcctactccaaactttgcccaggaggcacgcccactctcaaccaacatttttcatctggccaaaactcaaattcatttcgccaattttttccaaaatg

SEQ ID NO: 102215 - DNA, 85 bp, Heterodera glycines
  misc_feature (74)..(74): n is a, c, g, or t
  Promoter: Source sequence=SeqID_10227; Location=1..85; Strand=+; Gene= SeqID_73374
ctcgcgcaaaatcaaaaattggaacgttcaattgaagaaattgaggacacattggaccgtgaacgtcgtcaacnggttggacatg

SEQ ID NO: 102216 - DNA, 113 bp, Heterodera glycines
  Promoter: Source sequence=SeqID_22824; Location=513..625; Strand=+; Gene=SeqID_53534
ggttcgttttaaaaaaaaaaacctaacatttttttagcccgcttttcaatctgccattttaaaagtgccacaaataaaatttttttttttttgtaggaatatcggcacaaatg

SEQ ID NO: 102217 - DNA, 88 bp, Heterodera glycines
  Promoter: Source sequence=SeqID_4578; Location=1..88; Strand=+; Gene =SeqID_54965
tcacatgaatttgaatggatatgctggcaaaaaacaatataatttctataatatttttgtttatatatttgttatattatcagcaatg

SEQ ID NO: 102218 - DNA, 257 bp, Heterodera glycines
  misc_feature (68)..(68): n is a, c, g, or t
  misc_feature (102)..(102): n is a, c, g, or t
  misc_feature (114)..(114): n is a, c, g, or t
  Promoter: Source sequence=SeqID_33508; Location=1..257; Strand=+; Gene=SeqID_63551
tttctttttttatatgtctaattcagaaaaccaaagtttcgtcgaatggcaataattcatttctattntatattaccattccttagtgtttgaattttcctntaaacaatcatntaaatctgtctttctctaaaaaacataaacaaatctttactaatttttaaattactttgttcaatccttttaaatacttttctagctaaatatcaaaagttttaaaatttcccgacaagaaaattcaaattttcttgaaaatg

SEQ ID NO: 102219 - DNA, 1003 bp, Heterodera glycines
  Promoter: Source sequence=SeqID_14730; Location=420..1422; Strand=-; Gene=SeqID_47228
ttgtcaccaacgacttcttcgaaacgcagcaacgaggttgtgtttcgtccgtttctacttccttccaccttgcccatgctcggcttttgcttcccttcaggcgaattacgttacgccgattcgccgtctccgattcccttttaccctcgtcccattccaaccgataaagtgccaaaatttccattttcaaagttttgccaatgaatgggtaaatgctgcaggactctgaccgaatgttgtatttgtacgcctccgattacacgctgaattcgatgctttaccatgcctatcaaatggaacggctgaccattcgagtaaattttaaaaaatcaatcaaaaattgatggcccaatttgtcaaggtcaacgaggcatcgttgccccaaatgtaccggggatttgtgcggtgaatttggccaattattcgggcaaagtaaatgtaaacttaagcacaacatgccccgacattgagcaggtcaatggagactttctgcaggtgcaaaaatgaaaggattaataacttaattattgaaagtgattaaatggtccgtttaagtccatttgcgttggcaaattgatcccggccatggccaaacacttccccaactccaccaccaaatttgtgatgcttccccacgaactgcccgaaatgcattttcataatggacgcagcacaatggacttgaacggttggttgggtatcttatggccttgcatttgcttttggtatttcgtttttctttggcattattttttcggcatttccttggcattattcctcccttctccccgttggccattgatcagctcgcattttgacccttgtctcggacaatgccacccgtcgagatcggcaaattctcgtttcatctgccgaaggaatggcggacattcgactgaatgccgtcgacaggaaaattgccggagacctcaaattgcgcaaattgaacattcggctgcaccgctccgcgattcccattgagccggaagtgatctcacagatg

SEQ ID NO: 102220 - DNA, 110 bp, Heterodera glycines; identical to SEQ ID NO: 98226
  Promoter: Source sequence=SeqID_25574; Location=702..811; Strand=+; Gene=SeqID_56317

SEQ ID NO: 102221 - DNA, 203 bp, Heterodera glycines
  Promoter: Source sequence=SeqID_18503; Location=2378..2580; Strand=-; Gene=SeqID_83124
ttttcaaattccgaatgtgtcatccgatcgatcaacaatttcagagaggtgatctgtcatattttcttttattattattatttttatttactaattttgtttagacatttctccgtgccactgcttcggtcggctacaaaattcgtattgtcattcgctctgtcagttaccatattcaactttttattcatgtggaaccaatg

SEQ ID NO: 102222 - DNA, 105 bp, Heterodera glycines
  Promoter: Source sequence=SeqID_2356; Location=1241..1345; Strand=+; Gene=SeqID_79291
aaatttttatcaaatttaatgaaaaattgggcaccagccaagcaaatcattagctaattacccaggtctaatgagcatataaaagagcattttgtgcaaaaaatg

SEQ ID NO: 102223 - DNA, 59 bp, Heterodera glycines
  Promoter: Source sequence=SeqID_36343; Location=1253..1311; Strand=-; Gene=SeqID_65681
tattgccatttgttgttttatcttaaaaaaaatccattaaacaaaaattcagcaaaatg

SEQ ID NO: 102224 - DNA, 356 bp, Heterodera glycines
  Promoter: Source sequence=SeqID_18419; Location=1890..2245; Strand=+; Gene=SeqID_83016
taagcggatgaacgaattggcaccgctttccagcagtacgacgccacggcggaagcagtgtttgagttgcagcaaagggtaaatgctcagcagagagatgtacggcttggaaaggcgcgtgccggcgccctcaacgcactgctccaacttaatccatctgaccgtgccatattagagtgcttttccatgctggataatgccgaccggtgcgtctgttgccaaaagagcgtttgctgaacatttgccagtgccattggactggccgccgtttcggcacttccttcgccactttcgacgactcgttcagccaattccgtgttcaggtaaagcatttcgcagaagagggcattccgatg

SEQ ID NO: 102225 - DNA, 287 bp, Heterodera glycines
  Promoter: Source sequence=SeqID_40591; Location=1..287; Strand=+; Gene=SeqID_68870
cctgtttgacattttggagaaattgaagaagaaaaggggcgaagaattcgcgaagaaactgccacaaatgcgaagggactgttccgatatcgcagagttagaggtttggcgcacaaccaaaaacgtgctggggcaaatgcgctgacactgaaatccgtcaatcctgcgatttccgtttcccaaatactcaaaaagtttgcggtttcttattctaaattattaaactctttaaaaatgcaaacttttgcattgtgttgcttttttacagagtccccagccgttcgatg

SEQ ID NO: 102226 - DNA, 885 bp, Heterodera glycines
  Promoter: Source sequence=SeqID_18719; Location=1207..2091; Strand=-; Gene=SeqID_83389
tttagttcggatattcttcgttataacgccactattcatcactaggaatcactattttggagttttgccactaaaaaaactttttcggaagttggccactaaaatagttttttgccactattttggcgtttcgtcactatttttgccactattttggcatttttttgaaaatttcacaaaaaaaaattcttcggattaggtacagaatttttattttctccttcaataaaaattaggtagtatgtggcgccgtaggggaaaattttgaatttttagcagattggtttttgcgggttttccccaaaaaaacaaaaagtctcagacttattttgaacacggcctcaccaaaaccacaaaataagacaaaatcctcgcattaggtatccctgcgtattagtgtgtttttcgaattaaaaagaaatagaatttttaaaaaatttacgaaatatacaaaatttatatgtacctaaataggtattatattttaattttagaagtcaattgagttatttctcatatgtattcttattcgtaattattgaagaacgctctctggaaaacatcattgtaattaattgaagaaacgctcgtttgaaaacaccagtgaaaatgacgtaattttgtcactttcaaaaatagtttggctctattgcagttatctgaacaatttacacgactataaaataacaaatttaaagcataacttttctagaagtatccaaattagtattcttgatattatttaatgctctaagagttttttattagcctacaaaatctcaacaaatttttatccaatagttgattcacgcaaactttagctacaacgaatccaatgacttcaaggagtattcaagttttttacgctttttttcttcgagaatg

SEQ ID NO: 102227 - DNA, 176 bp, Heterodera glycines
  misc_feature (46)..(46): n is a, c, g, or t
  Promoter: Source sequence=SeqID_20478; Location=1..176; Strand=+; Gene=SeqID_51017
gttttaagtcttggatttgtcaaataaattcaagacttcaaattanataatcaaaaattctcttaaaatttttttgactcaatttcaaaaaaggaaaaaaatttgcagtcaaaaaattattcgaatttctccaattttgtttccataatttccgaaagttattcggtatcataatg

SEQ ID NO: 102228 - DNA, 370 bp, Heterodera glycines
  Promoter: Source sequence=SeqID_22399; Location=1214..1583; Strand=+; Gene=SeqID_53065
tattttttaaaatttattttaccccaatttgtagcctgcggcgtgtccccagtgggccgtggcggaggatggcaattccttcagctggcaatgaatgaccaacggtgcacgaatgtaattttggcagtatttaaaatatttgcattcattttgcctctgtttccccatttttttgccaatgttttttttttgcaattctttcccctcgggatttgctaagtcttgtgattgggtattgggtataagaggttttttgaaaaattggcatcggcttggcaaaagtcgggattagtgggatcccggatacttttggtcgtccaactcaatcattagtgaatttattttgaaaatgattaagaattttaacatg

SEQ ID NO: 102229 - DNA, 213 bp, Heterodera glycines
  Promoter: Source sequence=SeqID_1935; Location=672..884; Strand=+; Gene=SeqID_47102
attgtctattttcttttattattcctgtgattttttaattggtaaatttatataaattatgctttctttattttatttttttcatccgtcccattcatggcacatttctccacaacaattattgctttttcaattattttttgctttttatgtaaaattttgccatttattttattgtactcttctttttttgtgtgctattgatttcaaatg

SEQ ID NO: 102230 - DNA, 1003 bp, Heterodera glycines
  Promoter: Source sequence=SeqID_27090; Location=724..1726; Strand=+; Gene=SeqID_57802
aaaaaggaataattaagatctagatgagtttatattttcaaattctgttcgttttgtggcgccgaaaattgaaaatttaattcgatttttgttaacagacttttcaacaaaatttccaattttattgttttcctaaatggtttccgcttcatttccataactttattgagaaatcattatatattttaaatttaataatctattctttacaaaatgtctttaaatgtaaatcataagtattctgtgcttctcaggtttcccttcgccgcgaccctttcacaatgatcaattgtttccgtgtgatcactactagggcttatatttatagttgctaaaagctgccaaaatattagtttttagtttctaaaagacccccaaaatagttgctaaaaatgggtaaatatagttgctaaaaactttcaaaattatggatgtaaaacaggggtgcgatcgaaaaattttcaaaataagaacaccaaggcaaaaaaataagatttttggatcaaaaataagaacattttgcgaaattgcttcaaaacaattatttttcaattttttcgatcaaaaatgtattaaatactatatttttagtctcccattattggttttaacaattttggggaggaaataagcaaatcataaatttcagtgcattccggatcaaaaactcagttttttaacatttttttttgcggcgtttttttccaaaaaaaaattggtgaatgggcgaggggatagtgtccggcggtgaaatttttgtaaaattttgggtctgacaatgagtcgttcgttagtgctttatgagcgatccccctcccccccccccaaaaaaaaagaaataaattgggctcaaattagccaattctattaaaaaaatttcctatcaacggcgcgccgtagctaaagtttttcgaatgatttgacggcgccgtcatcggaaattttttcatttaaaaattaaataatttcctctttttgcaggcccgtctgaagaccatcaatg

SEQ ID NO: 102231 - DNA, 123 bp, Heterodera glycines
  Promoter: Source sequence=SeqID_17182; Location=1246..1368; Strand=-; Gene=SeqID_81630
ggttggcggtcgcggcaaaaagtgtggcgaccaaacgccccgtcaaaagttcgcattttgctcgattttttccgtgccacgcgcggcgcaaccgccaacgatggcaaatcgtccacgacaatg

SEQ ID NO: 102232 - DNA, 1003 bp, Heterodera glycines
  Promoter: Source sequence=SeqID_7864; Location=2514..3516; Strand=+; Gene=SeqID_66219
tcccccaatttcacaaccaaatttcatttggcaattttgccgtttctctccccgcccccccccatttgcctttaactgtgatggccccccaattttgatcattctttgaaccccccgattgttgatctttgatctatggcccggtgccctccatttctgtttctcccggtcccattcattgatttctgtgatttcccatttgccccagtaccgaatgcttcctttctgaaaattttcctgtcccatcccggtccccaattcatttgtgattaatcccccggtgatggcattttatctgtgatcaattttgtgatattttgttcaccatttttaaatttttgtttaattacccaagtttgaggcttttttcccggaataaattttgcttaatcaattctcggcgtttgatttggccggtcctcgtccctgcctgccccgaccccgcaccggtagaattcacatttggcccgacccagagcaatcgggacaaattggcgctcctgggtggatttgctgtgaaccacggattgactcgacgaatcccggtgacacaggggaagggaaaagcaaattagagagcctagacaaggaccctctgaggcttgtctagtgttcatagtttcgtatagttattgtcctccgaggcataacttcacgagggacgtagcggacttagtgtttaccctctgaggaagcacttcgtccgaacagagggttggaaggtgttgtgtagtggacgaagtacttgccctccgaggaagtacttcgtacaaaaagggtgttcaagcgcgcacaaggccactgacaaataaggaaaaaggcaaactaacagtcctccgaggctttagtttagccataaggcaaaaggcaaacaccttgtcctccgaggcaggtgtttagtcacagaaggtccaggaccaaggccagactgatcccggaaaaagacacaaaacaacaagtgcaccacaacacacacacacgcacaaccaaactgcacgcaatg

SEQ ID NO: 102233 - DNA, 549 bp, Heterodera glycines
  Promoter: Source sequence=SeqID_43317; Location=1..549; Strand=+; Gene=SeqID_71014
acatggtctattagccttacaaaaagcgaaaagattttcaagctgggaaaatttgcatgttttttgaaattattggtttaattgagacgaattcctgtaaaaaatgcacatttttggaatattttatgattatttattgtaattgcgtcttcaatttgattgaattggtgcacttttaactaattatcttactttcccctatttttaataatatttttcatcaacttttaccaattttgttcaataaattctctcaatttaatgagtcgcgactttattttggcaataaacaaataaacaggaactaattagcaattaatagtcaatgatttcagacactaattaattacctatcatcaatcaacttccatcgatgaatgattatgattctgtttggcgtttgttttcaataaattttcgtgaaaataaaaggacaatggaatcaaaaacaaaaattaattggactatttaagcgtaaaagtgagcagcaaaagtcaccattcaatttaattatacccaattaaaaaaagtaaatcctctttaaaaatg

SEQ ID NO: 102234 - DNA, 93 bp, Heterodera glycines
  Promoter: Source sequence=SeqID_27638; Location=944..1036; Strand=-; Gene=SeqID_58318
ttgaattgccaccaccacctccccctgcagagagtgccgaacttatcaacgggttggccaccgcctcctccaagagggaatgtcgtgcacatg

SEQ ID NO: 102235 - DNA, 1003 bp, Heterodera glycines
  Promoter: Source sequence=SeqID_20015; Location=410..1412; Strand=-; Gene=SeqID_84791
ggacatccaacagcgaacttggagccatggacagaaaggcatctgtgggagagggagagcaatgatcagcaagggagatgaagagagagagagagagagagagagagtgaggggcgagagagagagtgaggggcgagagagagagtgaggggcgagagagagagtgaggggcgagagagagagtgaggggcgagagagagtgaggggcgagagagagagtgaggggcgagagagagagtgaggggcgagagagagagtgaggggcgagagagagagtgaggggcgagagagagagtgaggggcgagagagagagtgaggggcgagagagagagtgaggggcgagagagagagtgaggggcgagagagagagtgaggggcgagagagagagtgaggggcgagagtgtggtatcccaaaacgtcgctggaacattttttggaccataaatttttcgtttaactaaattaagcattcttggtattgttcggtagctctatgtgtttatagtatttaattatgccaaagcgaaaaaatttggttaagtttaaaaacagttatggccataagaattcaatgccatgatttttttgtataaatattttggaattttttaaattaatagagtttgccaagcactttcgaacatttttaatttggttgagaaagaaaaagttatggtccaaaaattcgtacggcgacgttttgttgtgatggaagacgaagggattccgttaacatttcaatgtctttcttttttgctatttgtctcaccctcgaggattgggttggtggctgatgagttcgtctcataaaactccgaagtgttcagtgtcgtcgaaggcggcgatgctgccgaagtgtgcggtacgaatcccccgccgaggaatgcgtctctgaccaccgtcgtcggcaccgctgtgccggtgccgcccattgcgttcatttcggcccagcagtcgtcgtccatcggccctttgtccgttctgttcagtccgtccaaatg

SEQ ID NO: 102236 - DNA, 79 bp, Heterodera glycines
  Promoter: Source sequence=SeqID_29678; Location=1325..1403; Strand=-; Gene=SeqID_60145
tcgttacggcttcgcacaaatatatttaaggatgagcaggaggaagatgaagggacagttgtgttcattcctaaaaatg

SEQ ID NO: 102237 - DNA, 76 bp, Heterodera glycines
  Promoter: Source sequence=SeqID_23337; Location=1096..1171; Strand=-; Gene=SeqID_54047
acagttcgatgaagtgagaaggacaaatttaaacatcatcaaatgggacaaacggacacaaactgaaggacaaatg

SEQ ID NO: 102238 - DNA, 496 bp, Heterodera glycines
  Promoter: Source sequence=SeqID_5848; Location=1..496; Strand=+; Gene= SeqID_59430
tttttatgtttttataagtcgctctaaatcaaaaattgttcggagaaaattgtaaaaaaaaatatgtaaaaacataaaatccgatctatattaataaaaatgaaaaaagaaagtttttgaaaagagaaaaaaattaaaaataaaacaagaaaaattgcataaagaaagaatttttgattatttaaacacaaccgaggcaatgaaagttaaatttaatattttttctcgataaaaaatttcatatttaaaaattttccttattcgaaaaagctataaaatattttaatattcattaaataaacaaaaatgagttttttttgattagattttacgtgttttcctctctaaaaatcctttaaaaaaatttttaaatgcctttttcggaattttcgtgcgtttttttcaattttttggtgcctattatagtgcctttttcgcgattttggtgcctttttagacggtctctaatcattaataccattatttttagaatatg

SEQ ID NO: 102239 - DNA, 389 bp, Heterodera glycines
  Promoter: Source sequence=SeqID_31646; Location=1..389; Strand=+; Gene=SeqID_61964
tgatgggtcccggtctttttttctgtttgacaggaaacaagattacaaactctgatccttgattacatctaaatgataaaaaaatttgttttttgttttaagaacagtttatcaggtataaatataaattagaaataaattgacaattaattctcaactgctaatgacaaaaacatataatatattggaaattatttttgtttttatttttaaatattaaaataattttaaaaaattcataaaaaactgcgtaccaaaaattgagtaaatgctttatgtatattttttggatttcaaataactcagttattagatccattttaataaaaagaaaaataggaattttgtggtgggattttcctatttttcagatattcccaggcatcatg

SEQ ID NO: 102240 - DNA, 323 bp, Heterodera glycines
  Promoter: Source sequence=SeqID_26117; Location=1313..1635; Strand=+; Gene=SeqID_56867
aataaaaataatttattttataaaatcaaaaatgatttatttaaattaataaagtaatttgataagaatttttaaataaggtgcaaaatgagttccgccaaaattgttgggatgccctcgcttgtcacaatcggctgtttattaatggcaaaagtttgacgatcaattacagaggatttttaatgtttggtaattaattctaatgaaaatatttttaaaatttgttttttcaaggctattgttccatcttcgctaaacattccattttgttgaacaaagattgctccaacattttttactttgaaatttcagtcgcaaaaatg

SEQ ID NO: 102241 - DNA, 60 bp, Heterodera glycines
  Promoter: Source sequence=SeqID_43460; Location=231..290; Strand=+; Gene=SeqID_46742
tgtatgttttggttttgtacacaattgtttgaccttttaggggtttcgcttacgacgatg

SEQ ID NO: 102242 - DNA, 111 bp, Heterodera glycines
  Promoter: Source sequence=SeqID_7208; Location=3931..4041; Strand=-; Gene=SeqID_64155
ttgtgaagcgcccacagagcgtaatggtgggtgtgcacacatccgatgcacgcaatgtcaggtgaaagaaaccacccaaaatacttttggaaatcattttcagtccgaatg

SEQ ID NO: 102243 - DNA, 115 bp, Heterodera glycines
  misc_feature (35)..(35): n is a, c, g, or t
  misc_feature (47)..(47): n is a, c, g, or t
  Promoter: Source sequence=SeqID_21862; Location=1..115; Strand=+; Gene=SeqID_52493
gaaaacatgccaaaagagaaggagaagggaacatnggcagaggcaangacatttcggcgggagcagctctttcctccccccccccccctctcttgtctttcgttttgctcccatg

SEQ ID NO: 102244 - DNA, 815 bp, Heterodera glycines
  Promoter: Source sequence=SeqID_5078; Location=1333..2147; Strand=+; Gene=SeqID_56814
ggtaaattcaatataaaaataattttaattaattttttttaaattttacaatttttggcgttcctccgtttgtttacctcgcgttgaaccgttcaattcgtggggaatgcgttcgcttctttcgacctcatgtcaatgcgccacaaacgcttaaaactcagctgataacacgacggcatcaaatgccaaaaacactccgcaattttggttaataattttgtcgatgctgacaaacaacggacaaaaacaacgacagttgaaaatgtaaagcatttaataaaacttttaataattaaaaaatatttggacggttttggagtttaattgtgaaaattttcccaccattttcaagcagtatatgtgaagcattggaccagcaaaatggtcagtcagcaaacaaattgactgacaaatgagtgcgtaacaaactgaacagtgaaaattattgttttgcataattttatttaaatattggttattgttgactagttgattaaaaaatatctgtgtaaaacatgtaactgactgtgtaaaaactaattcatcaaaatttgcattaaaatgtcccaataattttttagtgtttttaaaggttagccgacttttgcgccgcagacatttgcgccgcgacacttgcgccgctcagcaaaaaagactcttgcgccgcgacatttgcgccgtacagcgaaaaaagacatttgcgctctgattaaaataaatatatgtgctttatagaataagaattgatagatattcattattaattcctttttcgaagcctttcatgtcaattccatattgaagtgcacgtaatg

SEQ ID NO: 102245 - DNA, 156 bp, Heterodera glycines
  Promoter: Source sequence=SeqID_20870; Location=437..592; Strand=-; Gene=SeqID_51454
ttgacctgaaaattggcaaacataaaattatgcactaaaatgccatacaatatattaaattttggtaaaattgaaaacaagaccaaactataaaagtatttaatgaaactaatattttgaagcatcactcacagcccaataagcattccaataatg

SEQ ID NO: 102246 - DNA, 507 bp, Heterodera glycines
  misc_feature (63)..(63): n is a, c, g, or t
  Promoter: Source sequence=SeqID_3121; Location=1..507; Strand=+; Gene= SeqID_83289
tgccaaatctctcaattttcgagctatgaatcggtctctctaggggtttaaacttgtcggagnaacttcccccacccccctatcgatctgtctcatcgagagctatcgattgttaccatcgagattggtccacgagaaaaaatatcgtataagtctagagaaccatatttcttttaacggattgccatcctttcatcggcgtgaaaagttttaataaagttatcttgttataaaaaatattattataaatctaatatttttggcaccctcccgagagaaggtgcagttccaaaaattagtccacaacgttccttacaggaacgaaaaagtgttgaaaaataggcaaatatatgttaatttaaaaactaatttatgatgggtttaaaatagaggaaggggagagagaactgatcctttatatttctctttttgtacgccttcttttccccctcgcccgtctcttgctcttagttcactttctctcattttcctcctcttgtcagaatg

SEQ ID NO: 102247 - DNA, 90 bp, Heterodera glycines
  Promoter: Source sequence=SeqID_2856; Location=8258..8347; Strand=-; Gene=SeqID_81973
ttttactgtattttgttctaattagagtttaatttacatttaatcaaagcaattaagttagatgttgattattcggcacttttgcagatg

SEQ ID NO: 102248 - DNA, 86 bp, Heterodera glycines
  Promoter: Source sequence=SeqID_38729; Location=612..697; Strand=-; Gene=SeqID_67453
ggtgaaaaatcaagcgaaaaacaaaaaattcaatttttcttttttcattttaagaccatctcaaagcggaatacattaaaattatg

SEQ ID NO: 102249 - DNA, 286 bp, Heterodera glycines
  Promoter: Source sequence=SeqID_26292; Location=578..863; Strand=+; Gene=SeqID_57039
ggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaattttgaaaaattttaaaaacaacaagcgttggcattttttcaggttaagttagtcctttacaatg

SEQ ID NO: 102250 - DNA, 100 bp, Heterodera glycines
  Promoter: Source sequence=SeqID_12487; Location=1127..1226; Strand=-; Gene=SeqID_76117
tcgcgctgctggtcactgcttctgctgaaaaagaaaccagcaagagcccgcttgatgtgctggacccgacaccgttcggcacagtgcggtgtaaaggatg

SEQ ID NO: 102251 - DNA, 301 bp, Heterodera glycines
  misc_feature (14)..(14): n is a, c, g, or t
  Promoter: Source sequence=SeqID_16029; Location=1..301; Strand=+; Gene=SeqID_80386
aattctatcctttntgccatttttataagagacattcgtatgagtaagatagaaagaaagacggaaatttaaaaaaaacagttaattcaaaagcacttttttatttttaccagtttcccagtgaataagtaaaataatcagtcataggacagatcatttgttagatggaggaaagtgaatgaatgattaattaaaaaacaaatggaacagtgacaaattagtaaaacgcattttacaatttatttgtagtcagtaaataaaaattccatcagagagacattcaaaatttaaaaaaaaaatg

SEQ ID NO: 102252 - DNA, 690 bp, Heterodera glycines
  Promoter: Source sequence=SeqID_6605; Location=1..690; Strand=+; Gene= SeqID_62172
cggcggtaggaaaatggcggtatgaaacggccagtatgaaaatgggtcgatcccaaaatagtgattactagtgatgaatagtggcgttaaaacgaagaatttccgagctaaaaatgttttcgtgcatttcagtggaaacaaagccgcagaaaaaataattaaaaaactaaaaatccgttccctactaatcacactgtaaggccgcgaatggaaagactgattcttgagaccgttttgttttcatgactttcgaacaaaacttttctcccaaaaaagtggggagcataggcagtatttttcgacttcagggtttgaaattggtgcaaatgaatgtcaattcgtgatcagcagctatcctgaaaacccttgagggtaatactatcgatggtgccccccccccaatttttggaagaattttttttttttgttctgaaatgtcgtggaaacatatttacggggggttttcagggtcgatcgatgatcgcgaatctgacatccattttgccctatttcaaagaaaattcaaaattttgaaaattcacttttagttcaccctctaaatccactccctagttcactaagttattgctcacgaactgtacataaatgttgaagaattttttaagtcattgaattcacagcctttcttccatctctcttttattatttcgcgaatttttgtgtgaaatg

SEQ ID NO: 102253 - DNA, 1003 bp, Heterodera glycines
  Promoter: Source sequence=SeqID_25192; Location=265..1267; Strand=-; Gene=SeqID_55930
aactcgaaaaattgagtgaatagaggggcttatgaccctttaaaatggtcaaattcggacaaatttagtatcatttgaaagctcttgatcagctaagtctaaaaaacaaggtataaactcgaaccgatgccgtctaagcactgggacaactgagtcccagtgaaaaccgacatttcagtaccaaaaaataaaaaagtttttttcttatataatgcacgaaaatcgtgtagccttgaatatcgagtattgcgctaaaaaaccgccgcacactcgactacggcggacagtaggtggagtgagactacaggttacgaacgaaggcagagtgtgattcgtatgctcaatatatcggaactaatgcgcagaaattgggatatgcctcaaattcggtctctaattataactttatttttcattttttcgacctcgtcatactttgtgtggcagcccgactcaaatgactttgtccgagcagactttggcataatacgcagaaccgaagagggttcgctcattttttaggtctttcccttacaatctcaacaaatttagcgggtcaagatttttcctaatttgccaaattttacttttttcaaagttaatatcctaatacaatgaattttgaggagctttaggacaatcaaattttatagacattgatctgagtaaacggaccatgctaagcgttaaatattcttggtatttgagaactcattcttgattattctgtaaaattaaaaaaaaattaggttttaaaaagcttggtaaattaaaacaaatttgttgacttttgattacaaaaattgccagtttgatgatgatttaagtataaaagcgttcgtaaattattcttttaaaatttacaaaatgcaaaatttattttgtcttcgagtttaaaaatctgatcatccccatcgaataggtcaatttctttctgatcggcaccttccgttatgccatcgctgaggcgaaacgggcatatgaatttggacggcaacaaatg

SEQ ID NO: 102254 - DNA, 110 bp, Heterodera glycines
  Promoter: Source sequence=SeqID_29196; Location=1..110; Strand=+; Gene=SeqID_59730
aaaaatatgatccttaaattataacaaacacataaaaatttttgcgcattaaattgagtcaacaaaatgttcagcaaataaatccatctctgcattagcccataaaaatg

SEQ ID NO: 102255 - DNA, 603 bp, Heterodera glycines
  Promoter: Source sequence=SeqID_37619; Location=237..839; Strand=-; Gene=SeqID_66639
ttgctcttttgtcaccgccctttcatttttgcctcaacggtcgtgcgacgtcaaagatttaggccatatcggtgaaactatttcgcacaatttgccttcaaagcgctgttttttgccggggatttgcgccgattttcgttgtgcccttgtctctgtgagcgttgaccgaacaattcaggtgtttaaccacaaaaaaatactaaaacaaattgtggcacttttcaggttcaccaatttcccttccccactcaaagttctttctccgccttccttttccgtctgtcaattctgacttctgttctctacgttcttttgtggactctttttgcataaataaccattggcattgatttgttgtgatctttgaatgtctctaaattttaaattgtgaatctgtgatacatacgaaataataaagttttttgttaattttttggtaaaataaaacaattgaatggactttgctggtattcctttaaagcttcaaatgagcatgtttttatggcttacgattttgccatttgtttcttggcatttcacattaatttcgactaatacatagcattttttcaggtacgctttttaaacactgcttaaaagatg

SEQ ID NO: 102256 - DNA, 556 bp, Heterodera glycines
  Promoter: Source sequence=SeqID_10839; Location=3230..3785; Strand=-; Gene=SeqID_74109
agaaatttaataattttaaatttttctattattattttattgaataaaatttattagacgatttaatgattttgtgggaaaaatataaaaattacagaaaaaaacattcctcagttttttgccactcttttcactagaagtgccatcgaaaaagtttccaaaaaataagcaaatcactgatcaaaaaaatatttttgattcaaaataagcacatttaaaaaaaaatgcaatataagagcttaaatttgtatattattggaaacgaaaaaaaaaaataatgcaatttttttatcaattccaaaaatgctcttcttaacagattgcgctaaaaacggccaatttttgtggtaaattttaaattaagaaaagcataagagaggtgaattatttttaatataatttatgcattaaaattagggctgagcgggaccgggaccggtgccggaaatcccggttttttcaggtcacggtcccggtttttggaaaaattgaaatcccggtcccggttttgctagtcccggtcccggcgggactaaaataagcactggtaagaatg

SEQ ID NO: 102257 - DNA, 164 bp, Heterodera glycines
  Promoter: Source sequence=SeqID_22024; Location=118..281; Strand=-; Gene=SeqID_52659
cggtgtcatctatgttactagatcggggatcgatccccgggcggccgctcgagcaggacctgcagaagctagcttgatggggatcagattgtcgtttcccgccttcagtttaaactatcaagagagggaggagagggttggagaaggaaaggaaaaaaaaaatg

SEQ ID NO: 102258 - DNA, 468 bp, Heterodera glycines
  Promoter: Source sequence=SeqID_12049; Location=1..468; Strand=+; Gene=SeqID_47010
atcaggtccggggttcggaatttgtcgaaatggatgccgaattcgtgatcagcgaacccgaaaagccttagaagcatgttttcactacttttaaaaacaaaaattaattttttcgaaaaatggggggggggaccagctccactattaccaaagtcagtacctattaccaaaagggcgttatatataatagccatcctagaagccctatacaagcttaaacatttttagtacttaatgtattaagtgcgataaaacttttgaggaaaaggattgaagtcaccatcatataggtatcagtaccaggacccttgttttcaggactttttaaaccaacaaaaatttgtgaaaaatttcgacccaaaaggggggggggacccaaactgaattagtaccggtatatttcatattcctttctttaatcttcttttactttagagagtatttgattgagctttacttgaaaaaatg

SEQ ID NO: 102259 - DNA, 146 bp, Heterodera glycines
  Promoter: Source sequence=SeqID_27; Location=9743..9888; Strand=-; Gene=SeqID_83723
ttttttaaaaaataatttcaaaaactttttccaataaaaattttttgtatttttcagggttctttatcaaatataggtttcaaaaagggaataccagtaactgaaattaccatatcctagcatattaagtacaaacataaattatg

SEQ ID NO: 102260 - DNA, 425 bp, Heterodera glycines
  Promoter: Source sequence=SeqID_7025; Location=613..1037; Strand=-; Gene=SeqID_63600
tggggaaaagttgtgggaaagggcaaaaagcacacaatgatcaacatcatccattagaagatgcagtaatagcagcagcagcagcagcaggaagaagaaacagttcaaagggagtgaaaagcgaaacaatttaaaataaaagtacaaatgaattctaaatagtgaaagcaaaagaagagaaaaatgctgtaattgaaagtagggagggaatttgggaatgaaatgccaaatgtgcggggggtcggatcgttttatagagataaagacagcaaatatgcgcattcattggcatcatttgggggggggaggcaatgggccaaaagggcgcgcgaggagaagcctaagcaattgatcactctccctcctttagctgtaggcccttctccctccattaaaatcgaaatgcggcgcttcagcagagaatg

SEQ ID NO: 102261 - DNA, 480 bp, Heterodera glycines
  Promoter: Source sequence=SeqID_25367; Location=1..480; Strand=+; Gene=SeqID_56112
gtcaataaaatgtgattgattgagtttcttatttatttcttttcattatttttagttttctgttccaactatttcttaattttttccgaaattttgcacacctgtcaagaaaaatgattgatgacattcgaaataaagaatatccagacgatttttttttgcagttttgaataaaatgtgacagttgtctacggaaatgattgattaccctcaaaattaaggcaaacccagacagtcacgtgactagacccctccccctttttgcctatttcgcacacccggcccaaatcgcaaatcattcaactaaatagttggatttcattaaactctcttcacgctctaattttatttctctccgctctatttttatttgcattaattaaatctattaatctattactatttacctacgtctttttcttttcaaatctctgctctctttaattcttctgtttcaatttcgtttttctttttaaaatg

SEQ ID NO: 102262 - DNA, 131 bp, Heterodera glycines
  Promoter: Source sequence=SeqID_30163; Location=964..1094; Strand=-; Gene=SeqID_60597
ttcatttgccagcagggaggaaatcccggctcgaaccatcattattaaattctcgctttgaatttatgtaccacttgaaaattttattttcattaaattaatttttgaaaatttattcagcaaaggaaatg

SEQ ID NO: 102263 - DNA, 288 bp, Heterodera glycines
  Promoter: Source sequence=SeqID_31098; Location=735..1022; Strand=-; Gene=SeqID_61480
tttgggcttaatccttttcaaataaacaattttcaccggaaaaatttccaaaaattagccaacaaatatgccatggacaaatggcactttgttaatttagtcgctgtgagtgaatccccgcctctgaaaatggctttttcggcttagtcatccgctctttcattctttcgatgctgcgttctcatctcttttctcatggcttttctgatactaataaagcttcatttcttcagcaaaaaaaaaacttttccaattttccctcaaattttctttcgaattcaaaaaatg

SEQ ID NO: 102264 - DNA, 626 bp, Heterodera glycines
  Promoter: Source sequence=SeqID_42422; Location=1..626; Strand=+; Gene=SeqID_70321
caaattttaacgcatccccgtgcccccggtgtgcattcggccgtcggtggtgtccaatctgaaggcgggctccaacgagggcgacttgaacatgaagttgacggagataaagctgatcaatgacatcctgaagaagcacaagcgcagcggggcaccgataaaaccattgccgaatcgtaaaaattttcagtttttggtttttcaaatgccataaaatttttcctcccctcccctacttgtccacctatgtcgtgcactacacactgcccaatgttcaacaaataatccgttttaagaaccgcttaaaaatattgtcgatgtttttttcactcaaaataatcgtattactcgacagaaaatttaaaaaataaattttatggattaattttaagaagtggatacttttttttgttaaattttacattaaaaatctaaattatcttagatttataggaattttccgtggcggcgcctgctggcccgcctgaccaaagccaaattgtgtggctaggctcatgtttttaaacgcataaaaatcccaaaaagggcatagaatcctaaaaatactgataaggcaacaaaaaaagagcatgaaaaactaattttaggttttctgttaacagatg

SEQ ID NO: 102265 - DNA, 500 bp, Heterodera glycines
  Promoter: Source sequence=SeqID_12671; Location=78..577; Strand=+; Gene=SeqID_76349
aaaattttgtaaaattaataaagggagtcaaaaatataaagttaataaatgttttgttcgaattaattataaaaaataatttatttaagcaatttgaaaaaattttctgatttttgactcaaaaataagatttttttatttcaaatttctcctttataaatttttctatatatttttaatttaataaatggattgtcctttaaatttgtgcattaaaaatatttttgtgagtttttaattaaattttcgaattactcccgctcccgcccgggactcccgttaaaaatggacgggattttacgggagcggaatttttacgggaatcctgttcgggactcccgtcccggaaaattttgaactcccgatcccgctcccggaaatttttttttaccggactctagttaaaattgaaaaaaatttaaaaatgtaaaattggccaattggcgattcgaatggatttaaaacattgctgattttcacttttcatttgtatataaatg

SEQ ID NO: 102266 - DNA, 329 bp, Heterodera glycines
  Promoter: Source sequence=SeqID_37482; Location=135..463; Strand=+; Gene=SeqID_66546
ggtttaggcagagtatggtattgtagttcgagagtctccgtgttgaggagggctcgactcgagaaaaatctcgagttttcctttcgtctcgactctcggtctcgggttgcggggtcgagtctcgtcaattctttggtcaagaattgccaaaaactgatccagacgcccaaaaaagttttttgaacgccaataaatcactgtttaccggtcaatttcaaaaaaattggttacggtaaaaataggaaaaattttcaaagaaaactgtattcaggctaggtgcgtttggcttcctttatttgggcgacggaagcgccgcgccgggcaacatg

SEQ ID NO: 102267 - DNA, 391 bp, Heterodera glycines
  Promoter: Source sequence=SeqID_14904; Location=1..391; Strand=+; Gene=SeqID_79066
atataaatacattccctgtttataacacgtgaatatctcttctaagatgttgtctattattattttcggaaatttctaactattgaattattgcaaatttgtataagaaatgttttccgacttgttgtaaaatatatgttttttatattgtaagtgtaagaaagaatttgttaaattataattattattttaaaataaaattaagatcatattattttaaaaaatgaacataaatattccataaaataagtcaggaaaaataactgtttctaaatgttaactttgaacaaaatttattttcaaaaattttattaataataacctttaacttaaaagaaatgaataattaaagataacaaattgaaaatatttaaatatttttttagaaatg

SEQ ID NO: 102268 - DNA, 1003 bp, Heterodera glycines
  Promoter: Source sequence=SeqID_17730; Location=1821..2823; Strand=-; Gene=SeqID_82268
ttactctaggaacatccaagttaaacattcttggtgtcattcgacagctctaagatttcccctttagccctataaaatttcaaagaaattcgttatgtttaaaaaagttatgaccagatttcaaaaaatttgttttctaaacattttggtcataatttcttttgcaacaaaacaaaatttttcgaaattttcagttttaatggaggattcttggggctatcgagtgataccaagaatgtttaatttggatgtttctataaaagttttctataccataaagggcccaatttggctcacattttcctcaaaattcgtttattcattttcttggccacgcgcacactccgccgccttccaaatgatgtcacaagtgaacccatctgttactgtttatgttcaccaattgctgcagaagaaatgagtcggcaattgtcggaggaaaactttttcttttttctgatgggcggtgccataacaaataattttgactaaatgaaatttttgtatgaaaaggaactagcaaaattttatttatatttgtaaaattaatctgttgaaaattagtattacaaattgctaacggttggaagccgaaaatgcaaaaacaaaaaacagtgaaagtgtttttaaaactgccaaatgttccttccttttatacctttctatgagcccacaaaaaaaaaagaaatgcaaattttttgttgcctttgagtgaaattcgatggggtataaaagcgatgcatttttcccttttccaatcattcattctacgctctgttttccatcattgcctctccccattttcacaatggtaaccgaataaatgcttaaatgtcaaaatgaagactttttgattaatacaacgaaaagatgattagacagggtattgaatacgtatttcttcgagaatttgctgaaaaattttttcgttattgttagatctccgaaacatatactgatacaaataagattgtaaaagctcggggttagtgccgtggagatg

SEQ ID NO: 102269 - DNA, 1003 bp, Heterodera glycines
  Promoter: Source sequence=SeqID_12590; Location=1529..2531; Strand=-; Gene=SeqID_76252
ccgataatggtgctttttttttaaatttgctaatttagaaatttttcaagaaaaaattcttagaaagtttttaataagaaaattctaagaaaaaaatatttcgagaaattctcagccttagaaaaaacaaaaaaattagcttgtaaaaaagttatatagaaaaaacttctaaaattttgattttttgcaatttcatgttataacttttttggtaattgtctaatcgcgaagcaatagcttctaaacatgttaaagtttcgaatgataccaagttcgttagatttggtcgacaaaaaatgttatagtccgaaaacttgggctggcgccaaaacgtcggcgccaaaacgatacggacccctgcctcccacacctatataggattttaattaaaatttttggtatcttcaaaagttttctattgggaaatttccggttggttccggtctctgctttttcgcggttacggtcctggtcgaaaaacttggtcccggcttttctggtcccggtgtcggtttttgtcaaaattcccgtttccagtcccactcaactctagtttttatcgtttattaaactttataaatataaacgcttaattctgggattttgttcccggcaattagcacaaaattaatttcataaaaataaacccaattttcagtttgtattgggcaatttgctagacttttggccagaattgatgaaatggaagcgcaaataaatggaccgaagaaaatgcaaaaaagaaaattgtcaacatccccagcaacagcaggggataaaaatattagtgggagttcaatttcagtggtgggtgggattttatattattattatttgggatggatttcatttaaatacatattttttttttgaattatccaatttttcaaatactaaaatgtgattctaagccaatttgttttgctatttttcttagatataattcccaaccctagtaattatttttaaattgcattttcccgtacagaatcggcatggaatg

SEQ ID NO: 102270 - DNA, 164 bp, Heterodera glycines
  Promoter: Source sequence=SeqID_9314; Location=2550..2713; Strand=-; Gene=SeqID_70974
tattttttcagcctaaaataattttttgaaatttgtcaggctaatagagactacttagccctatcgttagatatcacgattattttatttggttgcggaacaaaaaagttagagcactttaaagttgactgcgccaaagtgaccccgactcaaatttaagcatg

SEQ ID NO: 102271 - DNA, 104 bp, Heterodera glycines
  Promoter: Source sequence=SeqID_38181; Location=607..710; Strand=-; Gene=SeqID_67074
attgaatttttaaaattgtatttcaaaaaattaccttttcgtcaacaccaacagatcacacgtatttacttatttaatttctttttatttgcagacaaaaaatg

SEQ ID NO: 102272 - DNA, 394 bp, Heterodera glycines
  misc_feature (60)..(60): n is a, c, g, or t
  Promoter: Source sequence=SeqID_7385; Location=1..394; Strand=+; Gene= SeqID_64673
aaaaatgtcacacgtataaaattcataagttgtctcagtttcaccgaaattaatattccnttgtatcatccaatagcactaggtgttctctattcaaatataaatttatgtagaaagaaaaaagttattatcataaaagtaaaaaaaaaattgggtcagaatgttttgtccataccttttttgaaattcaataaagtttttaatatggaatattaatagagcatttcttagagctatcgaaattccattaaagttggaattctgactgtagattttttgtacttttatggccataattttttataattgaaaaaaaatttcgaaccgcttggcggatttatgaaacaacccaagacgaaaattttgcattaaaaatgatcaactgatttatatg

SEQ ID NO: 102273 - DNA, 882 bp, Heterodera glycines
  Promoter: Source sequence=SeqID_15171; Location=2196..3077; Strand=-; Gene=SeqID_79367
ttgaaagaccaattttgaggcgatgagtcagattccatagctaaattacagaaatatgtaaaagtagatagtcaagaattttttaccgctattggaaatagcatttggggaattacatttaggcactcatgtttgggaaacgagaaattttgacgtccattaaaaattttttacggtgatcactgatcagacactccaaaaaggttcagtgacgaaacgttcggccaccgtcgaaaattagctctttccggtaaaaattttattaaaaaataggtaaatacaaaaaataaaggtaatagcttagattagagttgagcgggaacgggacgggaactcccggttctacgaggtcccttgtttttacacataaatgttcttttgtgcaacaattgctaaacgtttattccttttaaaagagttcaaattatatcatttgatttactttagttgtcaaaataacgaaaaaataactatgtatactgtcttttttaaattaacacaaaataccccactttggcatgttgaatgatttgtcacactgggcttgacttaggcctatgcctaaaacaggcctagtctatgccttgtatgaaatgtacatatatctgatctataattattttccgactaaaatggttcgaaatttagttaacgccattttttaacatttcctctttttttgttgactgtatctacgttaagcccaacattaaccatacttaaattctttttcaattcctaaaactgcatttttacttttgtttgtttctgttctaattaaactcaacatgaatattttggctgtttctttttaccgttttcatctgcctactttttttttaattgcagtgaatttcttctttaagttttaatttagcaatg

SEQ ID NO: 102274 - DNA, 204 bp, Heterodera glycines
  Promoter: Source sequence=SeqID_2856; Location=2972..3175; Strand=-; Gene=SeqID_81974
tgtatgttttcttttaatttcttctatccatgttggcattttttcatatttttacacaaattttgatcccattaatttacatttttcacaaatttcaaatgcattttaacccccttctttgaattccatttccatcaatttgccccacagattgtcaacactttgcccgtcgctcttttgtccgcttttgtcctccgacaaatg

SEQ ID NO: 102275 - DNA, 391 bp, Heterodera glycines
  Promoter: Source sequence=SeqID_832; Location=2911..3301; Strand=+; Gene=SeqID_62445
tttggttgattggagaacaagcgcggtcgaagttgacgtgtgtggaagatgtatcggttgaaggtgttgcgcaattatcgtcgttgagattattttattattgggaagtgagcgaaaatgcgaatgcccgttccttttatacaatctcagccacgacaattcttaaacccaacattttgccaaatttcatttgatatataaggggatgcgttttcatccttttcaccttcgctactaccatttgcccatttcgaagtgcacccactgcaacatttttgtgagttttttctcttttttttcgtgtgtttttttgtcttctttttacatcccctccatttgtgttcagaaacggcctcgacaaacaagcaaattcttcaccaacacaccgatg

SEQ ID NO: 102276 - DNA, 150 bp, Heterodera glycines
  Promoter: Source sequence=SeqID_8869; Location=1..150; Strand=+; Gene= SeqID_69467
aaaaaagaggtattaaaacataaatttgaccaacgatggtcaggaccatttcaatgtgtaggagtggaaaaagaaaaaaataatgtaattttacaatcgctagataaaaaaggaaaattacggaaagttcaccaagaaaaaataaaaatg

SEQ ID NO: 102277 - DNA, 880 bp, Heterodera glycines
  Promoter: Source sequence=SeqID_6417; Location=1..880; Strand=+; Gene= SeqID_61484
cattcgtcagagtaaaaaagacatttttgtgtgatattttctccacgtgatggcatattaaaaatagcattttcatactttttaatgcgaaaggtgggaattgctgaaacggaggtgtttgtgagcagtgaaatttacacatttatcggtgaagattggttggtgaagttgcgggcggatcggacgcccgacacaaaccatcgaaggcttaataatgtgggaacggggggaggggaggggggggggggatatgcgaaagatggaaatcaacgaacgatggatataaaaaagtgtccaataaggttgtggatagcacacactttacttttctgtaatttgtttaaaaaatattgttttttgatcggaggcgacagattgtgagatgatcggtgtaaaaagcggtgggatgggaacattgcacgaacggccaagtttttgccggctttaaaatgatttgttgttgcaaaatggatttcattttgaacttttagttcattgcttcatcctcttcggctatactgttcttgaactttgttgagcaatggcaaacaaagaaaacgaagtaataatgacaaaaaatttaaattattttcacccctcatcctcaaacatccccccgggcataataattaccctaaagaaatccaaaattggccatgtgcggagtttcttatatttccacttttttaatgagtcttttttggtatttagtgcctgatttaaatagcacgaaatgtacaaaattgatgggcaaagaagggagtggagcaaattatttgaaaatggccatttttgagtaaattaatttctatttaaggtcgaaacgtgggagctgagctctgtctgccagacaattaccatcaccgggctgtcccaaatg

SEQ ID NO: 102278 - DNA, 139 bp, Heterodera glycines
  Promoter: Source sequence=SeqID_8293; Location=577..715; Strand=+; Gene=SeqID_67601
ggggtcgtggtgataaggtcaatgggttccaagacaattctgatgtcgttgagatacatctagatcattcccgtttcgaacaatgcaaacagtaaataatatcacatgtccaatatttagataaatctagatgggtatg

SEQ ID NO: 102279 - DNA, 484 bp, Heterodera glycines
  Promoter: Source sequence=SeqID_22373; Location=1874..2357; Strand=-; Gene=SeqID_53040
ttagggaacggaggagaagaatgcattttagtctcggaattccattagtttttcgcttttttagccctcttttttcttgttacatataaggtatttgtggacattattatttgtcgctgttcacaccttatacataattatttttggaattaataaattatttaattgcgattttaccgatatttttaggataatctagctataaaaatttttatttgattattcattaagcacctaaaaatgcttactgcgattggttaatttgaagagaacatctttgagcgcccttcgactcattcctttcaaaaatgggcatttttaaaattctcttccaaaaacttactctgacaagcagggcaaagagctgaagaattctaaatgatttttaaattagtttaattttatgtttacaactgtcaattaatgccgtatctgatgaatcagttacaaataaatttttagggtgtcagtgttttcgggaatg

SEQ ID NO: 102280 - DNA, 93 bp, Heterodera glycines
  misc_feature (59)..(59): n is a, c, g, or t
  Promoter: Source sequence=SeqID_27334; Location=1122..1214; Strand=-; Gene=SeqID_58024
cgagcagtactattagtgggacgtccgatcatctagaaggattctcctgatcaaactcncgcccgatgccgattgaggtgcacacgaaaaatg

SEQ ID NO: 102281 - DNA, 484 bp, Heterodera glycines
  misc_feature (57)..(58): n is a, c, g, or t
  Promoter: Source sequence=SeqID_1051; Location=1..484; Strand=+; Gene= SeqID_66892
aatagaagagcagatctcgagtaaaaactagacagctaaaaaataactgtgatcatnntagggggtcaaactatgggcctatgcaaaattcaaaaaaagttaccaatggacacacaacataaggaggacttgaacctggggccccctttttggtgactaactcacagaccactaagacgaaaaatccaacaattgtactgggagcccgaaattgactcgccgtgtttattggtcctaattagttctatgagcggatcctaaaaataaacacaaaccaagtcaaaccatttggaatctgttatagaatgctgctgcagttttctatttgcctcctccaactttttgcgctcttcaaatgccaagaatttgtgtcaaaatttagaataaatttctaattaaataaaaattgtggtcttttttagaataacattcgctgcatttttctgtttttgcctgctgtcccattgctttttaattgcaaatg

SEQ ID NO: 102282 - DNA, 262 bp, Heterodera glycines
  Promoter: Source sequence=SeqID_30926; Location=1400..1661; Strand=-; Gene=SeqID_61299
ccccccccctttactacgcccttgttctttttatgattgttagtaaaaggttcaaccctttgcgtattatgaaattttaaattaagaaaataatttcttaaaattgtttattaaacaaaatctttctaaaatatattttataataataatttaataattacaaattaaattaaattaaattaaatttgcatatgttaattggcttagggccaaattccgcttcgaattgtccgcgtgtttgcgtcggcatggcaaatccatg

SEQ ID NO: 102283 - DNA, 91 bp, Heterodera glycines
  Promoter: Source sequence=SeqID_8597; Location=1..91; Strand=+; Gene =SeqID_68643
aaattttgtattttcaattttttcgctgttattttttttagcaattttataacaggtaaatctgtttgccttgcattagtcaacaaccatg

SEQ ID NO: 102284 - DNA, 263 bp, Heterodera glycines
  Promoter: Source sequence=SeqID_44846; Location=530..792; Strand=-; Gene=SeqID_72262
tggtcgaaaatatttcattttaaaaaggcaattacaattagttgtgtactgtagattaaggaaccgtatcctgtttcttaagattactgtagagtcagaaacagtactggttccagtattttacaataaataatcaacagaattaattgtgtactgtagagtcaggaacagtaccgtgtcctggcttttcttataaattactaatagaatccgttaattctctaattcttttttcaatttaggcaccaccaccagggccaatg

SEQ ID NO: 102285 - DNA, 285 bp, Heterodera glycines
  Promoter: Source sequence=SeqID_24310; Location=1..285; Strand=+; Gene=SeqID_55031
tttggcatcctttctctcgctatttgccacgcattttttgtcattatggctaacttattttatgaaatatatgctaggaacctgatcagactacggcagggtttccgggacctgttaattttgagaacgaataaatgaattttcgcttatccaaaaatcacaccagaaaacatttggaaatgaaaaccggtttcatacccgaaggtttgtaacgctaattttcgaatttggatttttaataaaaatgaacaaatatctaaaaaatattttgtttaaggcaaaatg

SEQ ID NO: 102286 - DNA, 146 bp, Heterodera glycines
  Promoter: Source sequence=SeqID_23610; Location=404..549; Strand=+; Gene=SeqID_54309
tgtgaggaaaagtgaggaaatgtcgcccttttatacaactttttttccgttaatttcgaaatttttttgcttgtctatataaagggagggattgcaaaatttgctctcattcattgcgcccgtcaaattttaattcttctattatg

SEQ ID NO: 102287 - DNA, 103 bp, Heterodera glycines
  Promoter: Source sequence=SeqID_10949; Location=1265..1367; Strand=-; Gene=SeqID_74256
cagcagcaaaacagcgtggatgggagaaggccacaaaaaagaggagaatgaattgaaccgagtcgaaagtgtcattgtccgccggctcctctttttgaacatg

SEQ ID NO: 102288 - DNA, 505 bp, Heterodera glycines
  Promoter: Source sequence=SeqID_36176; Location=554..1058; Strand=+; Gene=SeqID_65566
tactccgttcgcagtagatcacttattcgatgattttttaacatatgttcaaatgtttttggcagttctaacgacaatcacttaatttgcattttttttttgcatttttgacattagtagtattggggtaaaaatcttggcccccccccctgggcagagagatgcgcatttattataggagagaggagagaattagagaaaaagagtaattcttaaaacttggaaaagggattaaaacggaaaaaaccccttttgttatttttttgtcttgcggcattttttaatgcgggaaatgaacaccattttccatcaaaaggaaggggcgggaagcgctgccatcctctttttggagatggtcccatttttttgagtttgagttcacagcgaaaaaacttttcatttcattcaaaatttaaatttcgcgcgtcttttgacctaattattttgcaaaatcctgcccctgctgagtcagctgtcaaccgaaaatgattgatggctaaaaatg

SEQ ID NO: 102289 - DNA, 121 bp, Heterodera glycines
  Promoter: Source sequence=SeqID_20540; Location=659..779; Strand=-; Gene=SeqID_51079
ggtgaaataatggggctattaaagtttctttgcagtttttcaaaagaattcttggtataccgtcaatagaagtattgtttttatccttaagtttacataatgaaaaataaatttcagcatg

SEQ ID NO: 102290 - DNA, 959 bp, Heterodera glycines
  Promoter: Source sequence=SeqID_9569; Location=417..1375; Strand=-; Gene=SeqID_71922
aaaaaaagtgttcgaaattatgaaaagataattatgagtttgcttatatagaaagagcttatgctaatgaaaaacttttttaattaaaaataacatattaaaaataaacttttatattaaaaaatgtttgggtataacttgaattgttaagtgaattaaaaaacatgcaaaccacactactcagcagggtcacaaaataatttataacatttaaaaatccaaaaaatacaattttttgaaaaaatcaataaataaagtaccaaaaatcctaaaaaccggacactttaataaaaatactcggaatttggggaaaaaattttttcagagccattttgaaaattagaggccgtttttgggcaaaaaatgcttaaaaacaacaaaaaaacaatttatttacaaaaaatacatttaaaaaaactggccaaatttggaaatttttttatttttagagccattttgaaaatggaggccagtttttggcacaaaatccttaaaaacaacaaaaaaacaatttatttacaaaaaatacatttaaaaaaactggccaaatttggaaatttttttatttttagagccattttgaaaatggaggccagtttttggcacaaaatccttaaaaacaacaaaaaaacaatttatttacaaaaaatacatttaaaaaaactggccaaatttggaaatttttttatttttagagccattttgaaaatggaggccagtttttgggcaaaaaatgcttaaaaacaacaaaaaaacaatttatttacaaaaaatacatttaaaaaaactggccaaatttggaaatttttttatttttagagccattttgaaaatggaggccagtttttgggcaaaaaatgcttaaaaacaacaaaaaaacaatttatttacaaaaaataaatttaaaaaaactggccaaatttggaaatttttttatttttagagccattttgaaaatg

SEQ ID NO: 102291 - DNA, 70 bp, Heterodera glycines
  Promoter: Source sequence=SeqID_27506; Location=1..70; Strand=+; Gene= SeqID_58198
agggaatgggcctgagttcaaagagaatttacacaaaaacggccaagtatttactgaccgttttgacatg

SEQ ID NO: 102292 - DNA, 95 bp, Heterodera glycines
  Promoter: Source sequence=SeqID_2892; Location=2163..2257; Strand=-; Gene=SeqID_82216
acgatagcccaatacaatatgtcaatttcaataaattttaatcttttcatacctttcggggtgggaaattctccgaaaatgccaaaaaaaacatg

SEQ ID NO: 102293 - DNA, 637 bp, Heterodera glycines
  Promoter: Source sequence=SeqID_14323; Location=303..939; Strand=-; Gene=SeqID_78352
atatacaataaatctacgatctttttcctcacgccactttttgcggcgttttcttaaaaaaagaattgtgcaaggggatgatccgaatatgcgccgttttttgcggcgcgttttttccaaaagacttggggaagggggcggggcgatccggcggtgccgataggcgccgcccgggaacccatttttgaattttgtattgattcggctaaggaaattgtgcatattttaaatttaagtggcgtgaaaagtaaaaaagaatgtcgctaatttgctcgaattgtgaaatttagacattttttgaacaaaattgttaacaaattccattaaaaattcaaatccccgaaaaagcagttttaaaaacaacaacaaaaatcggtttagtggccggatcccttcacaaaattggacgtcgacctctctttccaattatcaaaaaagcacaaatcttagaactgttcattaacggctttactttcgctttcaatttaattttttttaggttatcgttgacgaaattgagttgctcaaccacaaaagcatttcgttcaagcattcgtcgtcggtgcattattttgtcgacgatttggacgacgcccaactgacaaacgaaacttacgaaagttggatcaaagacatg

SEQ ID NO: 102294 - DNA, 776 bp, Heterodera glycines
  Promoter: Source sequence=SeqID_10010; Location=1272..2047; Strand=-; Gene=SeqID_73059
aacttctaatatatatatatatatatatatatatatttatatacataatcatatgagttggcggttttaagaaacgcccaatgtggcggtttttaagaaacgtcccagcaccgtttacaactatgcaaaagtgaggcattctctcgcgaaattgttgacgctaatttaaaacgaaaattatttaatcgggttaatcggtatttgaaaatccatattgttttcctggactttcgcgatttatgtccatgttttcatagttaccatattttgacataatatcctcccctttggtgccgtaaagaattcatcaaaataaattcattgaattatttgaaaacaaaactttaaattcttttttgagtaataagccggaaaaactagaataaaacaccaaaaaattcttaagagatttgttattttacgctgtcgacctcattttgcctttgatttcgcatttttgtctttgtcgaataaaactttcttatttgttagagaaattttttaaatcaaaaaaagtgttttgattttctttaaaatcaaaagaataatttttttttaaaactaatttaaaatgactttttgacaaatacaatacttcaataatactcaaataaaaatgaaatgaatagaaaataaagcaaataattttttttaataaacacagatatgattttgagcactttcaaaaattgcttattttgtggctaaaataaggggaaaaagtggacgctttttgagcccagcggtctcatttggacaccgtcagtaaatttatg

SEQ ID NO: 102295 - DNA, 67 bp, Heterodera glycines
  Promoter: Source sequence=SeqID_20460; Location=1222..1288; Strand=-; Gene=SeqID_45580
ggtgaggaaaaaggggacaaattgacacggaaaagcaaaattaaatggaatgaaatgaaaggtgatg

SEQ ID NO: 102296 - DNA, 120 bp, Heterodera glycines
  Promoter: Source sequence=SeqID_33752; Location=801..920; Strand=-; Gene=SeqID_63721
gcattttttgaattattggcattttgtgtctgcccacccacggagcctttggcaattaatgagcatcgattgatatttctgatcagatatctgcacccggacttcgacaaagaagaaatg

SEQ ID NO: 102297 - DNA, 414 bp, Heterodera glycines
  Promoter: Source sequence=SeqID_13851; Location=1768..2181; Strand=+; Gene=SeqID_77790
aattataaataaataaaaatattattatgtaatgttaaaatgaataacaccaacacaacaaaacacgacatacaaattttgaattccccagaagagcctaatgaaactcttttgcatgtactgcttttttctcattatcttcttgcatttcctgtgtttttgcttttttggttcgttttaattcggtggcttaaaagtcacggtcacctctcgcccagcgaggccgagacagtaatggaagagatgaaaaatatcccccgacacccaccaatattttttgcagcaaaatgatgcaagattagagaaaactgacactgaactctctcttcagtatgacaaaatcgataatgacttatgctgatggagcattctcaaagctactcattctttttcatcattcattttacaaaaatg

SEQ ID NO: 102298 - DNA, 258 bp, Heterodera glycines
  Promoter: Source sequence=SeqID_1974; Location=1521..1778; Strand=-; Gene=SeqID_77116
tttctgttacggaagttattgtgccacaatgggaaaagacatggcgaatgtgccattctgttgagggaagttaaacattatattaatataaagttggataaaacacggagattgtgctgttctttgtattttgtcgatgggtccctttccatcgactcattcctcgcatttgttaagcctagactaaatcaaattcgaatagtccaaaaatgaggtttaaaataaatgattttacacaattaaaaactgtaaaaaatg

SEQ ID NO: 102299 - DNA, 174 bp, Heterodera glycines
  Promoter: Source sequence=SeqID_2636; Location=1482..1655; Strand=+; Gene=SeqID_80837
ttttttccaatgaaacggaactagagaaattttttttgaatgtaccattattcatggtaccgaataggaagctgctcccgcggcgataatttacattccggaagttgataattttgaggaatacgaaacttaaataggcctacatatctcccaaaaatattcagggagataatg

SEQ ID NO: 102300 - DNA, 135 bp, Heterodera glycines
  Promoter: Source sequence=SeqID_17811; Location=549..683; Strand=+; Gene=SeqID_82342
gtgaaatttgcacgcccggccaacagagggattattcgtacccaaacaaaaacggatcagtgatcagttgcgtacgctgtggtaagtgaagtggcaaaagggcggcggagcgattcattagaaaaattaataatg

SEQ ID NO: 102301 - DNA, 267 bp, Heterodera glycines
  Promoter: Source sequence=SeqID_21186; Location=1990..2256; Strand=-; Gene=SeqID_51776
ataaaaaagattaataattataaaaatgggaaaaacgaaataaaaattttgtgttttaacaattagggccgtaaggtccgaatatggacttaaatctgacctatttttaccacttgcgtttttgtactgctcaaaaatgaccaatttaaccagtaaattctatgcccgtggaattggaaaatggcaatttattataaaaattataatggaaattattttgagatttaattgttattttaagcatgtgacaaattgagaagcaaaatg

SEQ ID NO: 102302 - DNA, 140 bp, Heterodera glycines
  Promoter: Source sequence=SeqID_10649; Location=784..923; Strand=-; Gene=SeqID_73891
ttatttaataatgttatatttatattatttttaatttacattttacttttttaaattttttataatatttttaacgtttaaaaaaataaaataagttaaaattaaagcgaaataatttcaaagcgcaacatttagaaatg

SEQ ID NO: 102303 - DNA, 1003 bp, Heterodera glycines
  Promoter: Source sequence=SeqID_9705; Location=1877..2879; Strand=+; Gene=SeqID_72429
taattaattcattaatcaatttaagagcaaaacaattggcataattaattatcgttttgaattaattaattaattaattcaatttaagagcaaaacaattggcatgattcttccaaatcccatcgcccatcttttcgcgaaggatcactcgcaaaacgaattttctgccctataaaaacgatcccaataaggtgaattgatcaaaaacaaacaaacaaacaaataatttgtaaaataaaaataataccattccaaaaaatccgggcccaatgtccatttgcctggctctaagcaaagaaaagccttggtttttctgggcctggactttggtccaaaaaatcttttccatgttttacataaaataccaggttcagttgttattttagagaccggattttaaatggccaggactcggtaaatgaaccggaaagttgcggaaccatacatatacaaggggtgtctcaacttcgcccccgcgggggtgaaaatacatccctaagaatggcatttcttgtgataaaatgcaataaatttatacaattttgaatttttttaaacatcttgaccattttttataaaataaagtaattttgctttcttttttaatttatttatggtttagttgttagtgctgcagcactaacaaaatttttgttatgagttcgataccggttgacgttttcttttgaatttatttttttatgattaatgtacaaaaacacccataaaattgaccattcttggcataattcattaacaaattaaactcaatttttaaaaaaaatgtcggtttttttcggttaaaaaccgaaaccgaaaaccgaaaaaaaccgaaaaaaaaaccgaccgatccgatctctagtttcaattatataatatggaccacagcaaaaaattaaaacaaaacgaaacaaagttaagttagaacatgacggcgcactctatgttttcgaccaattgagcgcagatagacttcagaaattttggcgatgtgagtttcatg

SEQ ID NO: 102304 - DNA, 570 bp, Heterodera glycines
  Promoter: Source sequence=SeqID_13071; Location=891..1460; Strand=-; Gene=SeqID_76858
tttctttccttctctcttttctcaacctttctctctctcccttttgcgtttttctttcccaatttttgtttcttttcgcttccgccgagtgagacaaataaataaattttagagaaatgaaaagctctattcaccaaataatctctatggctatagcatttttaatgtgtgacggtcgaccgacgaaatgcaatggaatgagtggccccgtggcctccgccaacggcgaacgaccgaccggcggacggacaccgccgccacttaaattggggtgacagcgtcagctgtgtgtctgtactgtctttctttctctgctgaataattgtgaggggaatggagaacctccaaaatgtgccgattcggtgcaaaaaaagtcgtatagccgcaaaattccatggcacttaaaaaagacgaaaattgtttgtgaccagccaactgaaatgcggacggaaatggaggattgtacccgataataataataataataacaaaagcaatggtttatggcaaaaagcacacgaaaattaacaaatttttatttgttgaaatttttaggttacgcaaattatg

SEQ ID NO: 102305 - DNA, 522 bp, Heterodera glycines
  Promoter: Source sequence=SeqID_11321; Location=1004..1525; Strand=-; Gene=SeqID_74703
aataattattggggggacaacaatgatttttccaccatttgttgttgtttgtttgtttgtgcgtgttattattgtgcctttaataattgttatagaattttagttccaacttattcgtttggctttttacaaaaaaaaaaaaaaatttttttttgttaggaagattttattcattgccgccacacaattcaatttaccaaatcatccgagaaatgaatggacaacccaaattcgagaggcaaaacatcaaaacccccgaaaattgtggtttttctaattcaaataattgaatgttggtactctcacaaaagccagataataatgacccgggaaaattggcctaaattgtgcctaatttttatcattgccctgaaatgcgattttaaatctgtcatttaaatgttatcaatggcatgtgccatcatttttcatcaccatatttgggttcattcccaagttttttttaccatttaattgctattttttgagcaaaaaattgctctaaaattttgatcagagatg

SEQ ID NO: 102306 - DNA, 1003 bp, Heterodera glycines
  Promoter: Source sequence=SeqID_17151; Location=2260..3262; Strand=-; Gene=SeqID_81588
aatttggcagtttttggtgaaattttgttaacaaattgcactcaaattttcaaaaattttccccagctgcgccccacattctcctcaaaagtctttgggaaaagcgtgcgcgaaaaaatgttttggaaagcaaaaaaaaatgtgatcaaattcaatttcactgatcatttaattaattttaatgatgattatgactaactttttttttgaattttttgcttgtataaaattttaaaaaaatacggaaaattaaaaaaccccgaaccccgaccccgatccctgctcccaaaaaatctaagcctaaaaatgactatttaattaactttaattaacttaataaatatatgtttaattataaatgcataaattctatttgcattttttacaaatcggcaaaacgctgacctatcccaccaaaaagagacaaagaaagtcactcatctctttatctaatgcattttttttattacattaataattcctattaatcattcacataattatgtgcaccttatattctacatcaactcttaattacatttttatgttatatttaaatttttattaggaaatttttcaataatttttttctttagaaataaaactggcttagatggatggacatttacaataattatcttattgttgacgaaaaaatggtcaattttaccacgaattgctgtagtaataaagcttcaattctcaaagtcaaatcccaattttctgcaatgtaaaaagctttcatattttaaaataagacttttactaaatttagtgaattcacgaaaaatcggcattacaaaaataattataataattatgggccagaatttttgacaatcaccgatattagcaatggttcactgcagaacggttccgaattgttggcgcaaattattttgtggaaatggtctcagggatcacagaccattctaaaagtagtaattgatttatttgttgctaatttcttttctaaattaggcaccaattttagacctttatg

SEQ ID NO: 102307 - DNA, 343 bp, Heterodera glycines
  Promoter: Source sequence=SeqID_39148; Location=433..775; Strand=-; Gene=SeqID_67787
ggtagaaatgaacagagacaaagacaaattttttgttaaaaaataagtaaaacatttttgaacggactcgaacctacgcctttctcccttttctatcttcaaaaaacatttagccatacatgcaattaattcttttttgtacaggagctcattttcgggatagtgtgttaaaattcaaatttatttttaaaatatttttttattatttttttggctttcagtttttttcataattttttaaaagtgcctgtcctgcccccaattccccccccccgggtcgattctcaagagttcaaaatttcgggttctacaaatttttacagaaaaaacggtagtagaaatg

SEQ ID NO: 102308 - DNA, 391 bp, Heterodera glycines
  misc_feature (20)..(20): n is a, c, g, or t
  misc_feature (44)..(44): n is a, c, g, or t
  Promoter: Source sequence=SeqID_42189; Location=589..979; Strand=-; Gene=SeqID_70140
ccgttagtggtcaaggtgancaaagatataaatttgtgattttnaaattgaaaataattttaaaaaatcggaatctgttaaataatttaagaaaaaaaattaagttaaataaagctattattagtttatctcataattatttgcatcctaaaaaacggtgattatgtcaatctttggttttattatttctttggcaataacttttttaaattttaactatttgagttaaaattagcttcatttgattcaaattcggtattctgcaccgaatgataccaaatacaaataatttgtttttacttttaaaatttggcatactttttataggttgaaaaataattatgaaacgacccattattagtttatttttattttaaagaattatttgatg

SEQ ID NO: 102309 - DNA, 721 bp, Heterodera glycines
  Promoter: Source sequence=SeqID_27821; Location=1..721; Strand=+; Gene=SeqID_58484
tttgacaatgttccatttttggcaaatttatttgtaatattgatcaatgatcattttcattaatatctcctgacatttgtcttttttcacgctttcttttgtgttttaaactggcgatgccttcgctcactcagaattaaattctctactaatttccattcataatccggaaaaacggtcaaaaattataatggaactaataaatgaatacgaataaacggcaattaaagagagaggagtattaatggtttaaacatcggttgctaaagtgactgcaagaaacgagctaaataaacagagaaagagacagagagagagcgagagagagagagcgagagagagcgagagagagagaggggggggggaggggagacttctgtttagtattgtataataaacaataattattcttgcataaatgacaaagcttggtgtgggcgggaaggaattggtgtgtttggaagaaaatttatttgcaccattttattaattaatatttgtttaatatcattgtggacacgcaaagaaatgcatttgcataaacattgaaaattcattgattttcaatacaatattttatatacatatacgaatataaattgtgcttttcatgccagaaatataattatagtaataaaataaaaattatataatattattaatttatttcatttcgacctacaaattttgataaaaattattttgattcgcttaaacaatg

SEQ ID NO: 102310 - DNA, 867 bp, Heterodera glycines
  Promoter: Source sequence=SeqID_6964; Location=4430..5296; Strand=+; Gene=SeqID_63427
ttcttcagaataaatatatcagcagctaaagaatacgtcaaatgatgattttgtttgtaaagatgagattttaggcacgaaaaaaaactaaatatgtagtcctttacggtaggggtcaactccttccgggcaactccgtctcagaactgttcaaaaagctatcttttttctgagttcaccaaatttatcaaagatggtatcattctaaattcgaatgatatcaagattgttgaattcggtgaacaattaaaaaagttatgttgactcaaagttggctcagacggagatccggtcctttaagcaggcaaaaaaaaaacattggcattatgttaacaattaattttaaaatcctgaataagtaccgattctacagatcaactttaagcaaaaataaagtaaaaattaaggttcgagccccgcccccgggggcgggacaggttttttgggctcacccccgcccccgcccccgtgacgctgacccccgcaacccccgcccccgcgaaaagccacccccgccccacggggctcgaaccctaaaataaagcatacctctgctgctgataaaaaagaataattaaaaaggaggaacaaagaaatttgtttcaaatttaaattgatcatttgtttggcgaaatgttttctcaaatcaaatctcgacatgaactcaaaaaaccggcagcgacaaagatgcctttttctccatgtacataaattggtttgccttttttcgtcgtgagatttctttttagagtgctttatcatttgtttttttggtattttatttcgtatttatctctcaatgtttctttcctttctgtttcataatattttcttcctccgtcctcccttttcgcctccttttaaatg

SEQ ID NO: 102311 - DNA, 267 bp, Heterodera glycines
  Promoter: Source sequence=SeqID_4611; Location=561..827; Strand=-; Gene=SeqID_55080
tgaaaaggacagagacaaccgcgtccaaataattcaaaaaattgataaatggggccgactaaagaaaaaatggaaaaaatgatttgaaattaaaagtgcaacgaacattatcttcttcgtatagcaagaaactgctaatgcgaacaccagaagcagcagaagaagccgctgatgggctgctgtcattagcttcaacaagcagcttgccttttgtggggcaaaagatttcatcgtgaataggaaatgagaccaggcaatggccaaatg

SEQ ID NO: 102312 - DNA, 218 bp, Heterodera glycines
  misc_feature (3)..(3): n is a, c, g, or t
  misc_feature (6)..(6): n is a, c, g, or t
  misc_feature (10)..(11): n is a, c, g, or t
  misc_feature (15)..(17): n is a, c, g, or t
  misc_feature (19)..(19): n is a, c, g, or t
  misc_feature (24)..(26): n is a, c, g, or t
  misc_feature (28)..(30): n is a, c, g, or t
  misc_feature (33)..(35): n is a, c, g, or t
  misc_feature (41)..(42): n is a, c, g, or t
  misc_feature (44)..(46): n is a, c, g, or t
  misc_feature (49)..(50): n is a, c, g, or t
  misc_feature (54)..(57): n is a, c, g, or t
  misc_feature (60)..(65): n is a, c, g, or t
  misc_feature (70)..(70): n is a, c, g, or t
  misc_feature (73)..(75): n is a, c, g, or t
  misc_feature (83)..(84): n is a, c, g, or t
  misc_feature (89)..(89): n is a, c, g, or t
  misc_feature (91)..(94): n is a, c, g, or t
  misc_feature (109)..(109): n is a, c, g, or t
  misc_feature (118)..(118): n is a, c, g, or t
  misc_feature (127)..(127): n is a, c, g, or t
  misc_feature (130)..(130): n is a, c, g, or t
  misc_feature (134)..(135): n is a, c, g, or t
  misc_feature (147)..(147): n is a, c, g, or t
  misc_feature (152)..(152): n is a, c, g, or t
  misc_feature (154)..(154): n is a, c, g, or t
  misc_feature (158)..(158): n is a, c, g, or t
  misc_feature (160)..(160): n is a, c, g, or t
  misc_feature (165)..(166): n is a, c, g, or t
  misc_feature (169)..(170): n is a, c, g, or t
  misc_feature (175)..(175): n is a, c, g, or t
  misc_feature (178)..(179): n is a, c, g, or t
  Promoter: Source sequence=SeqID_42737; Location=860..1077; Strand=-; Gene=SeqID_46715
ggnccncagnncacnnncngcacnnncnnncgnnngcccanngnnnccnncgannnnccnnnnnncaggncgnnncgcaaaanncccancnnnnggcaccaagggcggngcaggcagngaagaaacngangagnncaccggaggacncaagngncaancngaagnngannaaagncgnnaaaaagttgggcgaaacgggggaggagtcgcagctcatg

SEQ ID NO: 102313 - DNA, 463 bp, Heterodera glycines
  Promoter: Source sequence=SeqID_7629; Location=1..463; Strand=+; Gene= SeqID_65468
tcatttagagtcagcaaaaagtcatttgacttaaattcccatccctagtcatcattttgcaaaatattctcctctttggtggtcctcctctgttgcgttccctttttcttcctcttccaatcggtcattttatgccaaaatgtttccgccccttccgtttttgtcaatgatttttcgcctcccattggcacattgtccaaccccatttaaggcaaaaaaaatgtgattttcgtgtttctttcatcaagtactatccgtaaaaaataggaaaaatctaaaaaaatcagggctctctctattcatatacaaaaaatattcaccaattcccttttcatgactataaaaatcttttgttttccgctttgactcattaaaaaaataaagtttccaacgaattattattctgctcttttgtttgacatcattcggaactcggccaaaattgtgctaattgcaaaaaatg

SEQ ID NO: 102314 - DNA, 170 bp, Heterodera glycines
  Promoter: Source sequence=SeqID_18516; Location=1022..1191; Strand=-; Gene=SeqID_83138
cctaaaaatgaaaattcattttagcgcaaaaaattttcatctcaactaagactttgttaaaataattttttttttcgaattttggagaattttcgggaccaaaattggttggcttcgttattttataataaaatttggtaaaaattccaatttttcaacaaaaaacgatg

SEQ ID NO: 102315 - DNA, 442 bp, Heterodera glycines
  Promoter: Source sequence=SeqID_8203; Location=2325..2766; Strand=-; Gene=SeqID_67297
actgaaaaagaaaaataaattaaataaagttattccaaacgaaaagttttgtaaagaaaagttgcccagaaaattttctcactgcccattttttcgcagttattttttgggaacgctattttccagaagtttttttacaaagaatcgcgatccgttaaaataacaaataccaacggcttttataagtgaaattccattttataagggcaatcaaaaaataaaaaagctatgcggaacttctagaaattcttatatttttttacatgttttgtatagtttaagaataatggaattaaaaagttttgtgccaattaagcaaattaatttgtaatgctatttctctctcatgctttttcttatcattagcttatcagatttccttattatttttcgtgccattatttcccaccccacgcgttcttctcactttgctgaagagatg

SEQ ID NO: 102316 - DNA, 71 bp, Heterodera glycines
  Promoter: Source sequence=SeqID_16949; Location=1734..1804; Strand=-; Gene=SeqID_81379
ttgtgaattttaaaaacgaaccgggacgggggggggcaacaatttctgggaagaacaaattgcgaacgatg

SEQ ID NO: 102317 - DNA, 1003 bp, Heterodera glycines
  Promoter: Source sequence=SeqID_7148; Location=1428..2430; Strand=-; Gene=SeqID_63964
ttgttgtaaagtgcccatttttagtttttttgctttttttttgttttttgcaattagaagatttttcgtaacattttcagcaatcgcgcaacaatgtttggttggacattttccccttttttgaatgttctcaactcggcctcaaattggcactgcttttgcaacgtttcaatgagctctggtggacaaacattttgatgacaattccaatttcggcaagtttttttgactttttttttgtaaaagtgagtagttaaatgcttttatttaattgaaaatagttttttgttttattaataatacaaaaatttttaaattttgaattaaaattttttttttgtgatgaataaatgtttgacatttaaaattgattatttatttctttttaaattaaagaattcatttgttttttaattagaatttgtcaaaaaattaatttcaattaaatgtatatataattcatgtacatttcaaattaatcactgttatacctcatctaatcacttttatacctattctaatcactgttgtaaagttcaaatccggacgatgtatattatttattttctatgtatttttggattatttatttcatcttattaattttaaattaatcatttaaatatgaaaattgtcaataaatttttaatgtttaaactcttatttaaatatgtttttatcctttcgataaattttttgtccataatttgtattttttttatactccatctgtttattcacattttcatgtttgaaatggtgtgcgttattgattaactcaacttttttgtcagtggaaaagttattatgggcaaaaaagaaaagaaattaaaatttttcggttttcacatatttgttaattttgtttaaatcatagtaacgaactgaaagcatccatcagtgcttaattaaacgataatttaaatcatttttagaccaaaaaacgtgaacatttttctttgaaatttttcaacaattttttattttttcacaatttcagatg

SEQ ID NO: 102318 - DNA, 772 bp, Heterodera glycines
  Promoter: Source sequence=SeqID_4109; Location=6000..6771; Strand=+; Gene=SeqID_53221
tcttaaaaatcgattaaacggactctaattgaataaactaacgcaaatttttaagcacacacactaaaatagaacgctactgtatagtttttgtaggcaaacttctcacttttttcaagataaggacgaaggaaacacaaaagaacatgaaaatcagcttaaacaatattttattagcgtaaaaattgaataatttcttttgtttctgctcatcaaaaaaattacaaaaattgcaaaattttgactgttctttaaggcattttgggtaattagactatttgttaacagattttcatcaaaactgacaaatttttacgagtttgaaccaatttttgaaagaaaaaataacatttagaatcaatccaaaagaggcaattttcgcactttgcatatcaaactgcttacaattagcattcgcataaaaaagaaagattcctctttaaaaaatgttattaaatcaaatttgttcttttttgaattatcgcgttaaatttatgccaactatgctatttggcgttatgagcaatttttgtctgacactgggcttgacccgtcgtgttggttcatcgctctttttccggacgccatgtaaatccaaattgaacagaaaatattgtttgtatcaaattgcttttcacaatgctttacaatttcatttctttacaatactttaaatttgtttacataaaaaatcagggtaaaatttgtggggagcttctcacgtctctctttatttaattataagtattatttaaaaaaacgggtggaaatg

SEQ ID NO: 102319 - DNA, 58 bp, Heterodera glycines
  misc_feature (21)..(21): n is a, c, g, or t
  Promoter: Source sequence=SeqID_15023; Location=1..58; Strand=+; Gene= SeqID_79185
ttttccttcaaaagcatcccncctccccccccccccccaggtccgtcctaccgtaatg

SEQ ID NO: 102320 - DNA, 1003 bp, Heterodera glycines
  Promoter: Source sequence=SeqID_8025; Location=1361..2363; Strand=-; Gene=SeqID_66734
ttgttagcttattcctcctcctctttcaatgcttttcgtgtaacaaccctttctaatatcggtaaaaaattttgtcgtcgtcgtcaaattggtggcacagtttttcacacgacggttatgaaaatgaaatttttttcgtaaaaaatcggccaaagtttttctgcttttatgacaacggtggcggttggccaacaaaagcgtcaatttgtgggcggcggaagggtccttcagcaattcgttgttgtcggagcacataaattttgttgaaaaattaagagaacgcactcttctctaagaaatttgagctaaagtttttaagtgttttttattttaaattggggaaaacaaagtttttcaacggatttcaggacagaatttggtgtaaatccgtgttcaaattagcatgaagatgggaataaattagctaaatgctaattgaaatggaaaatcttacagttcctcctgttttttaaggctagacttgtgaatcagcagatttttcttacgaaataattttaatttttttttttaaatttgttcattctggcataatgtttcatttttaaatttcatggtttttaattttcgtttttgtaaggttcaatttttaagaaacccaagtaaattttctatgaaatttccgcttcatcagaaattcttatatttttgacactaaatttttcgtgaaatttttcccgattttttaaaaataaaatttttcggcgtcaaacaacaattacagtaaattgaattttgtacaacaattgtaaactgtccaacaatttcatgtttacttggatgacggccaagcgatggttgttgcgtcggctcagcttaattctggacctatctcggcacattttgttagattttgaacataaaattggcatttttattcggccacgttttattgtagaattttttttttcaaattttatacacacaaattgaattggaacaaatattgtagcatttgttcaaaagaattttgtttctacatatg

SEQ ID NO: 102321 - DNA, 140 bp, Heterodera glycines
  misc_feature (53)..(53): n is a, c, g, or t
  Promoter: Source sequence=SeqID_19826; Location=1..140; Strand=+; Gene=SeqID_84574
tttaatttttcggcggaggaggaacggggcggggaatgaagtgcatacgcttntgaaaccaagcctagtccagttttggtccattcattcatttttataatttgagaattcatgaaaataatatttatttagcattaatg

SEQ ID NO: 102322 - DNA, 616 bp, Heterodera glycines
  misc_feature (263)..(263): n is a, c, g, or t
  Promoter: Source sequence=SeqID_25790; Location=1072..1687; Strand=-; Gene=SeqID_56532
aatggtttttgagacatatttccacaattttagaaaaatatgggttttagtgaaattttagaaaatgtgattatttactgattttcccaaaattactttatttcgagcgaattttttaataaacttaatgatttttttaattaaaatgggctcatatgtacttgaaactttgctttttattttgttttcgcacaatatgttttttgactttgctcaaaaagtttccggaatagagattgggccggcggtgccgaataggcggncgccggggggaatttttgaaaattttactctgtttcttaccaaaaatttcccaaaaaaagaccaaatttctctatacacggcgagtcaattttgggctccaagtacaaataagtttattatttatttagtaatcagaacgccaaaactttgcaaaacttaaaatttattggggattttcccttgtaaaaatagaagagccgatctcgagttaaaaacttaactttcacaaaataaacttagaatcgatagaggaggtcaaaatattggcctatgcaaaatttcaaaaaaatcgttgcataaggaaaaattttttagcatagcaaatatttataattgtttacacaaaaaaatg

SEQ ID NO: 102323 - DNA, 241 bp, Heterodera glycines
  Promoter: Source sequence=SeqID_13131; Location=311..551; Strand=+; Gene=SeqID_76933
tcagtccctctccatcaagtccagagcagcgttggccttttgtcgcaagtcgttcttttgctgctgctgctgctgctgctgttgttcttggtgttttgggaatgtgatggcaggcagttctccgtaggggatgttgaacacgcgcgccttgttcttcacgcggaaaaagcagtgtccgggtagatcatagatgatgtcgaacggtacaaattgaactttgtcgaaccgtgtacaccaaatg

SEQ ID NO: 102324 - DNA, 97 bp, Heterodera glycines
  misc_feature (24)..(24): n is a, c, g, or t
  Promoter: Source sequence=SeqID_25034; Location=1..97; Strand=+; Gene= SeqID_55768
atttcaagaaaataaacgattttntggaggattcttctaacaaaaaaagaaaagcaaaaaacataattaattacccctttcaaatcattcaaaaatg

SEQ ID NO: 102325 - DNA, 253 bp, Heterodera glycines
  Promoter: Source sequence=SeqID_2784; Location=1..253; Strand=+; Gene= SeqID_81573
gtaatgagagaaacggagtgatcgctatcattcttgttactaatgtgcaatttaaggccgacatgtaatcatatgctgactatagacgtgtacaatagggtatttaaggagaggccattcctgactaatttttgatttgctatatgctagattttgaccagaattaatcgtaaagttaaataatttaattccaactatgtattttgaaataatattttttaatttaattacagcgaatcccgactttcaaatg

SEQ ID NO: 102326 - DNA, 488 bp, Heterodera glycines
  Promoter: Source sequence=SeqID_29755; Location=911..1398; Strand=-; Gene=SeqID_60221
tctttaattaaattcgcttgagctaatattttcttatcttacatgatctgctagttatcgatatgaaaatttcaatttttctttctgattgtgtgctttggatccttttttgttgtgtaaatttatgcataataaactactggtatgatagttcccggaaaaaatctttatgtccccctgaaccgcctaggtcttatgctgatcaaggacgattcgtttttggccaattctttttttattccgattagtttttggccaattattttttattcggattcgtttttggccaattcttttttattccgattcgtcgttttaccctcttatgcatagatttgtattgcttaattttagtacagccaccgcggaatgttcggcatccaagcgatttgaactgtgatttttctaagcccgaattgtgtaaataaaatttttgtaaaccatttttaacaaaacaaatgtttgaaaattaggtaaatggcgaaatg

SEQ ID NO: 102327 - DNA, 370 bp, Heterodera glycines
  Promoter: Source sequence=SeqID_24882; Location=1438..1807; Strand=-; Gene=SeqID_55629
tttgcaattttctttgagacataaaaatttaataagtaatatttctcaaatttaactattttcatgtgtaatactttagttggtaccccctttttgaaaaaaatattttttgttttcaaaaatcatgaaaacataattctaatggattacgagcgcgattgtcttctatcttacaataatcccgagaaaattcctatcctgtgacaacatacacaaacacccacgccagttttttaggaattattttaaaaaacttgaaatatataaaatttaaaagttcccactactatcatgtgctgatttatattgaaatgttgcacatgactgtcccgcctgatctcatccgccagggaaccatctcctggaaatg

SEQ ID NO: 102328 - DNA, 595 bp, Heterodera glycines
  Promoter: Source sequence=SeqID_1137; Location=1457..2051; Strand=+; Gene=SeqID_68459
ttgcctttatgaatctgacataatattttaagtgggattttccgaaaatttatctaattgagtttaatataaaattcgatagttaataacctattccgaattgatcagaccattcaaaattgtgtttaaaagccggaaaaattgaaattgagttcattaaaaaaataatcaaaaatgaaaatatttcttttttatttcttgctactctcggcagtgaagaagaaaaaaacttgtcattgctcttactgtatgcgttgaccaaagacaaaaaattaagtgtttacctttgtgattagtgatttattgttgtgtttttttaattagttgtcattttgcgtttaatttatagttttagtaaaatttgttgataattacctaatgttgaattttatttaaaatgtaattggaatggaagttttaattccgaatgctacattaactttaaacattaaaattgattgagaaaattatctttaaataatcaaaatgggggggggggcggcgcaaatgtcggcgggcaagtgtcattttggctggtcggcgcaagtgtctgcggcgcaaacttgtcgcggcgcaagtgtcggcggcgcaaatg

SEQ ID NO: 102329 - DNA, 118 bp, Heterodera glycines
  Promoter: Source sequence=SeqID_12194; Location=3660..3777; Strand=+; Gene=SeqID_75771
attaaaataaatatacattcggttgaagaaaaattaaaatattaaagcaatttgatcaaatatatggcaaattaaaaacgaaattaaatgaaaaattggaaggaaaagggacaaaatg

SEQ ID NO: 102330 - DNA, 207 bp, Heterodera glycines
  Promoter: Source sequence=SeqID_21684; Location=174..380; Strand=+; Gene=SeqID_52299
ggtgtgacttgtctcagaaaagacgagagcgagagtttggcgagaggcgagagtccccaaaaagacgagagcgagagtttggcgagaggcgagagtaccaaaaatggcgagagttggcgagaggcgagagacgagaggcgagagttgtcccacccctggtacaccggcagaaaatttgacatcgaaacttagattttaaaaataatg

SEQ ID NO: 102331 - DNA, 208 bp, Heterodera glycines
  Promoter: Source sequence=SeqID_17745; Location=192..399; Strand=+; Gene=SeqID_82281
attacttttatgacaatttttgtgtccaaccttcgaattttgctgggcaacaaaataagggacgaccgaaggaacaaaaaacaaaacaaaaaactgtgccaaattggcatttcgttgtcttcaattagcatcgaataatcttgataatgctgtgtccctttctctttagctcgtcggcttttaccttttgctgcgttacgaaggcatg

SEQ ID NO: 102332 - DNA, 784 bp, Heterodera glycines
  Promoter: Source sequence=SeqID_7239; Location=1179..1962; Strand=+; Gene=SeqID_64230
ttttaaagggaaaagttaatgaaaatagtgtgacgggtgaagatactatgaagatggtgaaaataggtgataggcaattaattaagtgtttgtacatattgcttagaatgcattttcagtgcctggtgatatagagtgcgcggtataatcaattgtctgagttttgactaggtgggctgagtttttggctaggtgccaattcactattgattcgtgcgctaaccattttcatcatcaccaaatgctacaattttctcgtccaccaattatcgtgccttatgatgtctgtccgtaccttatacacgccaaacaatagtgaaaggggcgtgactcagtcagccatgcgcatactttgttcgctaaactcggtaccagccgctaccgtttatcacggacagtggccggcgtctctttttgtgtatttaaggaagggatttgtagcacattactcactttattaaagcagcaaaaattaaaattgattatttttaattaaatatgtccgaaaaaattccttaaaacaggaaaagaagtaagagcaaaaagaaatgtaattaatttttttaaaacggtcccaaaaaaaaatgacgaaacaaattatttcgaggaaattgagagttatataacggaaaacaaaaaattcggcattacggggcatgttacaaaattctattttaaaaatgcctatacagagtcggctgaagaaaactttaaaaaaacaattaacaaacttattgagaaagcttgtaataaagaggaaaatggacgtaaaatttgcaaaatg

SEQ ID NO: 102333 - DNA, 172 bp, Heterodera glycines
  misc_feature (8)..(8): n is a, c, g, or t
  Promoter: Source sequence=SeqID_3988; Location=1..172; Strand=+; Gene= SeqID_52713
agtcttcngggtgtaataaagtgcaccccaattcaaatccattatcgtaacttctcacaatctccacataaattccgaaactggcagaaaaaaaaattgtgtttggttaacacaaattacaaatcacacactttttcacccatccctttcaagcagtaacagcagcagcatg

SEQ ID NO: 102334 - DNA, 166 bp, Heterodera glycines
  Promoter: Source sequence=SeqID_30108; Location=1149..1314; Strand=+; Gene=SeqID_60550
tgccctccgggcgctgctttgccggcaaatgaagcgtaaatagacaagcaccgtgacgagaatgtgcagcgggagaaactgtttaaatttgggggaacaattttcaaaatagatcagaatgaaaatttcatatttaaaatgatgatcattgattgatgacggcatg

SEQ ID NO: 102335 - DNA, 134 bp, Heterodera glycines
  Promoter: Source sequence=SeqID_14505; Location=1..134; Strand=+; Gene=SeqID_78549
gatcattttttgatcagaacatagtgtagattaaatattttggaccattttatgccaatttttttaattgtaaaaatcaattaattttaatttttgcaaattctctgatcactttttacttctgatcagttatg

SEQ ID NO: 102336 - DNA, 1003 bp, Heterodera glycines
  Promoter: Source sequence=SeqID_4553; Location=1227..2229; Strand=-; Gene=SeqID_54874
ctctctctgtctccttctctctcattctttctctctctctctcgctctgtctcccctctcgctcttacttcactcttctttcacacattctctcttctctcccccactctctccggaacgggccaactccgtctgagccaactttgagtcaatataactcttgaagtttttgaccgaatcaaacaatcttgatatcattcgaaagctcttcacaggctctattagcctactaaaaattacaaaaaatttcgaactataaaaaaagatagaaataaaaaactttgaaaattctgccttttttgcggttttaaactgacaacttttttgagagctgattaatcactgagaaatagcttataaatatcttctaaacatctagggctttcgaacgataccatgattgttaagtttggccaacaaagaaaaaagttatagctttttgaacattgctgagacggagttgacccctaccgactctctctgcttttttttatcatctcaactcttttgattctctcttttctcccattatctcgccttttctcttccctctcacccactcctctctctctctctctcactctttctcccttctccgttctctttccccattctctctctctcatccacccccccactctcccttcttttctcgttcttccctttgtctcctcctctcatccctcgcactctctcttatttttcctatctctcacttcttattccctcacgctcctacgctttcatcacacataagtaagcaactgtctggtcttcccttttttctttgtatatgctatttcttttctttttctcttctttttttcatattaagtcaaaacgccaaatgccaatttaattgagggggcggggcttgctctcatttaatatacttaggggatacttaaacatgcttttcattcaaaacaaatatcaaaaaccaaatcagattattttcgtattataaaggaaaattaccaaacctttttaggaaacaagaatg

SEQ ID NO: 102337 - DNA, 950 bp, Heterodera glycines
  Promoter: Source sequence=SeqID_2669; Location=1859..2808; Strand=-; Gene=SeqID_80973
gtacggtggcggtgttggtggtgtatcgtatagcggcgccgcattcgcgccccaacaactgcagcagaagcggttcgattacgtaccgacagacccctacagctatgagaggtaataaaacacggaataatcaaaattatgtgatcaataagcggaacaatgaattttggggccacaatatttgggggagaggggggggtgtttgaccaaatttggactttgtgaaagtgtagaccaccctgagaaaaccattacctcgtaattctaaggccatttacccattttcggggtggaagtggccgaatatacaatcctttttcgaaataaaagcggcataattttaaactaagctttggataataatcgaaagtgaatggaaatccgctgtcggctgtttacttttgttgactttccttctaccgtaccccggggaaccaaaggcaaaaaattggcaaatcttaatcctattacataaagctgtcttcgacagcactggttatactcaatgtacctaccttctgcttattcagcttctaccctcttgtgccggccaaacgctttgatgccggcggctttggcgccgcttacggatcgcgcggacgcttttccggctttctttaagccctttacatgggatgatgaaaaaatgtgttatgataaaaacgatagacgacattttcaattattttctcgatcgaaaaataaatttttggtcgaaaaatgttcaattttttgtatgtgttccttacagcacttgtaagactgatcaattggacaataataaatagattattattattaatttataatcagtaaaatcatattaataattaaatcaactataaaaaaattagacgaaaaaattctataaaaatatttacattgcaaagtctaaagtcttttaaaactgtgaaagtcgataaaagaagccgctgcggtcttctgcgatg

SEQ ID NO: 102338 - DNA, 297 bp, Heterodera glycines
  Promoter: Source sequence=SeqID_11; Location=9279..9575; Strand=+; Gene=SeqID_69060
taatgcgctccattgagcagtacaataagcaatatataatgaattgtcctaaacctaaattgtttttttattgatttgctataaatggagcaaaattttcaatcattcaatgtgacggacacaaaatttcggcatccatttacattgacgatttccggtagcacaggaagtggaaaatcagaatgggttatacgttttttgagaaatgtggatgcccgggtatctaatgggccaatcaatatgatattttattgttatggtgagtttaaccacaacattgcttctctccaaaaaatg

SEQ ID NO: 102339 - DNA, 836 bp, Heterodera glycines
  Promoter: Source sequence=SeqID_2101; Location=3966..4801; Strand=-; Gene=SeqID_47170
agtgttctccccccccccccctctcattttgtttttgtcttcccctaattgtgcccagaattgcaccaccaccactaacgcctcactttttgtcccgctgtcagaagagtcaggcctaatcggacaaaaccctccctcctttccgtggctctcatctccgctgatcacacaactttttcccccacccatctcttcattccgcttgacgacgcatttccccctcctcctcctccccctgtgatggtggcgaaggcaaaaacccaacggggacactccatccaaaagagaacatcgtgaaggcgcctcttccattgcggacggacggacatcctcaaaatggcgagtgcaaaacagaattcgtttattatgaaaaaggcaaattatacttttttttatttttataattccttttgttgggatttttttccttgctccttaaattaatgaaatggactctctgaatttggctaatggatcttttcactgtttgttgttgttgttctctccatcccatcccttcttctttcactgtccttgaactcctccaactgaaaataggcgggctttctccggccttccgtcccccccccccccccctccccccataatcagccccacctttcccattttccgcgggggggttttggtctccaattaatccatcccccaaacttttgccctcgtattcatcgtacaaatggttattacaactggggaatgtcataaaatgggggggaatttggtgacttggaatgtatcaatatttgtaaaaggaatgtgtataaaaataaaattaaaaacaacaaagaaacttaaacggaaaagtgaaaggaatg

SEQ ID NO: 102340 - DNA, 99 bp, Heterodera glycines
  Promoter: Source sequence=SeqID_22482; Location=2416..2514; Strand=-; Gene=SeqID_45717
aaattttattcaaagtaatgcaatggcaatcgatgtaatattcgggtcctttgaagaatttgaacatgtccgcgaaaatttttaaatttgtgcagaatg

SEQ ID NO: 102341 - DNA, 1003 bp, Heterodera glycines
  Promoter: Source sequence=SeqID_13968; Location=395..1397; Strand=+; Gene=SeqID_77927
ttgtcacatttttttcctccgcgcaacatcacacgaaaatgtccccctttccatccaaaacaaaacataaaacgcacgaatcaaacgaacaatttttcagctgcgcctttttcagtccgtttttgccatttttgttcacaacagccaacgactcgactgagcacaacgaccaccacactatcgaccagtaaaaccattacagcggtggcgggtcgacgagtctttcccccgccgccgttcgccaccgccgccccttctcttcggctggcctctttttcaccactctcttcgcccgcctcacctctcccgccacttttatcaaaacttatcatcggtgcgtttgttggccgtaataattctccccggcgtttgctctgtccccaacagcgcagcagcagcagggcactaacattggccaaaggtaaatgactataaaagccaccaaccaaactgaattctttaatcatcagacagtttgacttttcagcttaaacttgtgcccctttaattgaatcataaatttattaggcttcttcctctctacatcagccgcttttatggcggaaaggagtggcgccggacacataaatcacaatggaattgccacactttccgaacgtaatgcgcacagaacatcggtgcaacaggtgatttttgagaaacagagggcgccataacattacaaataaaaataaatttatatttcatacaaattttgtatatttttatataatcattatactttaaatcctactttatctatgtttgtatatatcattttgtttgtctttcttcagtgtccttcgtttgcgccgtttaaaccaaatcgggcattaattgtttcaaaatcttcgctgcttgagtatgaatttgatcggagagggcctaaaaatgaatacagcggccttgacgacccgcgttttctcaaggaggtcactgattataaaaaaaaaattgggtaatacatctttaaatttagttgcatatacaacaaataaatatg

SEQ ID NO: 102342 - DNA, 129 bp, Heterodera glycines
  misc_feature (45)..(45): n is a, c, g, or t
  misc_feature (116)..(116): n is a, c, g, or t
  Promoter: Source sequence=SeqID_45262; Location=775..903; Strand=-; Gene=SeqID_72592
attttttattatcaatttatataaattgattgcaaaaacatattntaaaattgcaggcgcttctgctgcttctgaccacgtatttcaacaatgaatattttagagctatggaattnatgaaaattaatg

SEQ ID NO: 102343 - DNA, 451 bp, Heterodera glycines
  misc_feature (19)..(19): n is a, c, g, or t
  misc_feature (44)..(44): n is a, c, g, or t
  misc_feature (49)..(49): n is a, c, g, or t
  Promoter: Source sequence=SeqID_3156; Location=1..451; Strand=+; Gene= SeqID_83454
gaaattggaaatgaactcncaaatcatcggaaaattatttactnttacncatcatcttccatccaaagctcattcaaaacaatatgcaattgtcagaagagtgtaatgttttgttgttcccatcctcccgtatttttttcatttattcatcgctttgcccctcggggtaaaaaattgatccaaatcaatacaaagaaacattgtagaaaatggtgtgtacataggttgaataaattatattaatattaatgaaacagataatttataattttggattagaataaagcgtaaaattaatttaattttatgggtcagccttttattcgtaaagtttttgtttataaataaaaactgaaaaggaaataagaggatcatgttagccaatggaaaaaatcataaatgtatatttaattatgtaaattaattaggaaaaattgcagagaacaaaatg

SEQ ID NO: 102344 - DNA, 430 bp, Heterodera glycines
  Promoter: Source sequence=SeqID_17287; Location=1683..2112; Strand=-; Gene=SeqID_81766
tgcaactttagatgcataaaaggatctttaaacataatgctggtcatctcgaaaagtgcttctcataaaagcatttgtttcgccatcaacaaaaaaattgaaaaaaaattacttgatgaaaaatcatagatttgaaaaaatcatatattagatgatgtcatatgacaaatctgatgtcatattcgtgatcagcgtccccgataacccccgagtagaacaaaatatcattaaaaacgcctttttttctttttttttagggaccagtaaaagtaaccattatcagatcacccatatgtgcacttaacttttttgaaattatgcaaaatttatttttcttttttgatgcaacacttttttcctgcactgtatctaaaaaattatcaacaagagctttggctccaactcggcgcgagtctcgagtgaccgaatg

SEQ ID NO: 102345 - DNA, 119 bp, Heterodera glycines
  Promoter: Source sequence=SeqID_11747; Location=484..602; Strand=-; Gene=SeqID_75237
tttttgtgcataaaataaatcatagctttaggaaattaaaatacttttaaatttttaaagaatttaattgtttgtgttaattgtcttcttaatgcctcgtttattttattccaaatatg

SEQ ID NO: 102346 - DNA, 1003 bp, Heterodera glycines
  Promoter: Source sequence=SeqID_8609; Location=1501..2503; Strand=+; Gene=SeqID_68673
atattgaagaaatatttaatttataaaattcattaacattatcaccattactcacattaagatcaataattaggggagtatttttacttcgaaaactcaatctttaggggtgcatttttcccgaaacttcgagcattttcgcgaagctcgaagtttcccgccccggtcccggtaacgagctcaaaaaacgcatttctgcattaaaaattttcgattctgaggtcattatcggtcactagaaatcactattttggggttttgtcactaaaatagttaacaatcactattttggtgttttgccactatttaattaaattttagttttgacgtgcttcaaagttgggtatttgaaaaaataatatttttagtaaatgattaatttatgtattctattttacattatatatttgaaaatcaataaaattacatttgatgaagatttgaatattttcttcaatttattccattatctttaaatttaaattgattttaataacgattcctcagattagattattttaattaaataaacactttaaaaattgtgattttactgatgaaataagatttaattattttcttgattgtttgaaaattgaccatgagacatgaaaacatttcaacaaaatattcgcgaactgattaatttgttttcagatttttgtcataaatattcactttctcatcgatctctgctaatatactttttaatttcatatttttatactattcatcaatactgcatttaaaaaccattttaacgatttatttcatttaaatttatattaaaatctatttattaaataaaattaattgtcacctcaataatattttttatcaatgataaaatatgaacatagacatgtaatatgttttaaaccattcattttggataattttgtaataataaattttttaagcattcttttatttaattttaattttattgtcttttttaattgtgaatttcaatgccttttttcacttgtcttcttcgaacatg

SEQ ID NO: 102347 - DNA, 242 bp, Heterodera glycines
  Promoter: Source sequence=SeqID_37877; Location=702..943; Strand=-; Gene=SeqID_66858
ggtgatcagctgatcagaaagaacagcttagatagaaaattgttgatcatttgattagcactgtgttttctgttttaccacttttctttttcatgggatgcaaatgatgctgataattcgtaagactggattttgataaattggcataatgtttggcaattgtttagtactttgggtttaatagagcttcgacattttcgaaaaaagcctgtatatgtacctatatctatattccacaaatg

SEQ ID NO: 102348 - DNA, 1003 bp, Heterodera glycines
  Promoter: Source sequence=SeqID_146; Location=1146..2148; Strand=+; Gene=SeqID_74914
gggatggcgtttttgtttattgatttttccttttttaaccttttttaaaaagcgttggcaccactaaaaaagttgtttcgtgcctctttttttgagcctattctacttaattgaaaatggtttttattttactaattaataataattacattttttaataaatttaattttttttgaaaaacaagaaatttctttagacttatttgtaagcaaaagttgaacaattcatttaaaaacaaattatactaaggaatttctaaaaattattctgtttaataattaataaaatttgctcattttctctacacactctctttattgacgcatctctcatgttaagcgcacggtgtgctattgattaattcattattttttgcactcgtcttaggaaaaaaatacaattacttagagtttattttcaaaattctctttgctaagtttagcacagatatacgaataaataaattttcctatttaaaaaacaagaattgtattatttttttagaagatttattatcttagttttccatttctcaccttttttacaatattcatttaaaagcagattttttatattattattattattataacatttttaacctcaagccaaactttattttctctaaaaattttaaggctctacaatttttaatttctttttctcattagatataagacaaattctatgggtgcgctaacaaatggcattaaaattgcttctccgtccaaatcgcccagcattcaactcggctcaaattggcactgttttcgtcccgtttcaattcgctggtggacaaacatttcgatggcaaaaaagtgaattgttttttagggtttttgttgtggcatttctgtttctataaagcaattttttaatggaaattttaatgtttttgaatttttaatagaaaaattttggtactaaaaaatttgtttaacccttattgcttccctttccgctaaatattaattttcgcaatttcagtggtgtgcagcgatg

SEQ ID NO: 102349 - DNA, 242 bp, Heterodera glycines
  Promoter: Source sequence=SeqID_6636; Location=1..242; Strand=+; Gene= SeqID_62286
tttcaaatttacaactataggaagtcgaagttggtcaaaatggatgtcagattcttgtgcagcgagcgatccctaaacccgaaaagcaattttcacatttttttattacaatttacaaagcataatggtctcccccccctctttggtttttgataaattcaaaaacggtaacttttaaagtagcgttagtttttttattttatgttgtaaaaaaaacactgctttgtcccttgtccttgatg

SEQ ID NO: 102350 - DNA, 95 bp, Heterodera glycines
  Promoter: Source sequence=SeqID_14679; Location=3196..3290; Strand=-; Gene=SeqID_47222
tttttatccatttattctgctcccctcaactttgccatttgtaaggtgacgaattgcttaacccatcggatttgccaatcaaatatgccggaatg

SEQ ID NO: 102351 - DNA, 615 bp, Heterodera glycines
  Promoter: Source sequence=SeqID_13131; Location=755..1369; Strand=-; Gene=SeqID_76934
gctgaaattgataaatataaaaaaaatttaaaaaaataactacaaaattaaatatagtttattctagaaattaaaagcaatgcataaaaaaatacttttttacatttaaatattttataaaattgatacctaaatttttaactttaagtaatataaaaatatttttaaaaagatgaaaaattttaaaaaattggtgattttggttcattgcagaaattacctgatattagtagtaacccccccccccccgggaccgttggaggttgacgctaattagaagtgacaggtggtgtaattaggggtgctaatgtgctaattggtcaaacccaagcctatgggaggggtgcagccctttgaacttgccgacagatgggggtggggtggtaattcgtgatgactaattggtactaattaattaattgggagtagggcatggagctagatgtgcggggtgacagatgtttagtttgacaccctcttctacaccagtactatatctcttcgctctttttctctggctatcatcaaacacctgcactatttctccacacccgaactgcgttgcccctataaataggctgtagttttggtctttcccaacacaatcatcaaatg

SEQ ID NO: 102352 - DNA, 567 bp, Heterodera glycines
  misc_feature (76)..(76): n is a, c, g, or t
  Promoter: Source sequence=SeqID_25203; Location=1..567; Strand=+; Gene=SeqID_55943
atttttctcttttattttcataaaaatttgctcaaaatcacaaatttgggacatttttgtggacaaatctgttacnaatcgcataaaaattacaaaaaatttcccgccggcgcctatcggcaccgcgggcccctattcccgaagttttagtgccgcaaaaaatcactttcgattttcgtgctcagaatcccaaatgctttatttccaataaaaaaatgatcaaattgatcatggaaaatctaaaatataacatttgagcattttaaacgtgttttgaataaattttgtaaaaatgaggctttttgacccaaaatgaggcttttttgtctgccaaatgaggcctttgaaaattttagtctggctaccctgtatacaaaagtgaataatgtgagggatggtggaccttcttttttaaatcaattttttaccatcaaaaaaacgatagattgcaattgattggtatctcataatgaaaaagttttatttcttcatacattatatttaaaatataacaaatataagctgaaaaaacaaaattcatttaaatttctctgattcaaaaaaatg

SEQ ID NO: 102353 - DNA, 632 bp, Heterodera glycines
  Promoter: Source sequence=SeqID_6005; Location=500..1131; Strand=-; Gene=SeqID_59991
tcgcccactctgaaaaatttattactcgcaattattatgtatttattataacctttttaatccccttgaaaaatgtctctttccttttgcatctccccgcgcaagcatttcagtctttttattgtacagaattaaaaagggtattattttaagcacatttaaaaaaaaaaagtgagcgagctttttaatcaaaatcaaaattgcaaaaaattttagagctttttaatcaaaatcaaaattgcaaaaaattttaaatgtttacggatatttttgtcagaatcaaccattttcatcaaaaggtagatattttgtagtaaaatttagagctcgaccttgatctggatctaaattgttcccgtgggggatcgctctgatcagtgatcatgaatctgacattatttttgaccatccctaaaaaggatggagggggggggggaggggggtaattaactgaaaccgattattcatctctccattaacaccccgattaataaaaagcccaatcttcatcaatttttattatgtttaatatgtatgattcttatattttcgtgagcaatgacttggaagtttgaaaacgatttttaatttaatttttgccgactcaatttttctttagcgaataagttatg

SEQ ID NO: 102354 - DNA, 396 bp, Heterodera glycines
  Promoter: Source sequence=SeqID_41466; Location=774..1169; Strand=-; Gene=SeqID_69575
tgagatatgtctttgcagggggtacgacaaagaaaaattgaaaattttagcaaaaatacttgggcggagcgtctgttcttgaatcgtggtccgggatactgtattattactattatttttgaataacgttgaaaacaaaggattattaccaagtctaagtttgcttattaagaatttcgtttttaatggtgtaaatttttgttgtgctttatggtggtggatttattatgaaaaatattaaaaaaataaatacattattttttaattttctgtgtttttatttagtaacaacaacgaccacaacaacaactgtttcaacagttgcatcatttgcagaaaattcgactgaaaatgtgccaaagatagccgcgggctatggcattgtgaagccaaatg

SEQ ID NO: 102355 - DNA, 785 bp, Heterodera glycines
  Promoter: Source sequence=SeqID_8627; Location=342..1126; Strand=-; Gene=SeqID_68715
acaatttttgaacagaaaattttttcacaacttcgtccaaaagcaatcaaatttaaaaatttaatatctttaaatagccctaaattttttctaatatcctgcaaaatttcagaaaaatctgttaagtttcaaagaagttatagcctgagaaactaaaaaaaataacaatttttaaaacgtttttcgtcataactttcttgaaaataaaaattttttttaaaattttgcatgatattataaaatatttaaggctttctaatgatgattagtgaggaataaatgtgcttaaatatgaatttttggtgagtgtgaaaaaaagtactgattttttctaatttgttctgaaagtagtatatagcgtcaaaaattttggtcaattccgaatcctggacccgaattcgaaaaaaaccgaaaatttaaaattttcaaaattcatttttatgttcgtacttgtacagaataccattttttgatgttccaatggtttttggctaaattaactttttggtcaatttaagaacaaaggtgataattttgaatcttcgacttttttgactaaattttggatgaaacggttggaattttgacataaaatatcaattttcttattttgttccatgtctttctttttctctccataaatagggcccgggtttatgtgctaaaaacgccaaatatgtacatgttgtgccaaaaaatgataatgttctagatttgtcaatatttgatccgaatcatctaagtatccaaaattaagaattttttgaagaatttccgacaaaatg

SEQ ID NO: 102356 - DNA, 419 bp, Heterodera glycines
  Promoter: Source sequence=SeqID_13245; Location=1546..1964; Strand=-; Gene=SeqID_77074
aaaattttctaatatttatttttaaaaatttcttgtttttcatgggagtggggtttgcctgtccgggtaatgtcgcgtagggccagcatgtcatgcgtttaccggggtctatgacacttttcgagaaaaaagaagcgactagcggacggccggtgccgacgggcactgctttatgtacagatttgccccaaacacaggtgacccgtcggcgtggcctatttcccagcttcgatctgctcgactttggcctcgtccgggcgggcggtgggccggtgcgtccgcgcgcgttcagcgtgttcagctcgctggagcgtggcgtggaaattgagtcggtttatgtggagggccagagccgtggcgtgtacctgcagttcgagtcacggccgcccatttcggtccgaagcgacgcccgaggaatg

SEQ ID NO: 102357 - DNA, 917 bp, Heterodera glycines
  Promoter: Source sequence=SeqID_7572; Location=288..1204; Strand=-; Gene=SeqID_65270
agatattaaaattcgcttcctctttttatgggttgaaaaatttaaacaatttgacttttattcctatatttaatttgtttcaacagtattgatgtgtgtcattatattttttgacagaagtatgttatcttataaacgcagttcgatatatatatatatattttttataaaaacatatgtctggcatttttttgagtcaggtatcatatttagttgatttttttgaatttttcatgattaaaactccaaggaggcataattattttttattgaagaaatccattaattaatatttcttttaaaattacataataattattttcccagttaagctcataaattaataattttttacttatttgtaaaaactattcttgcttagattctatttataagaaatacttggaaacataaaactttcgactaaataaagaaagtgactgatcttctgtcaaagaaaataattaaaaatattttttgtttgggtataataaaattttgctaaatcattgaatgaggataaaaaaagaaactttttgtttggtcagcttaacctgggttcactgtgagacacacataaataggccaatccaattgcttgctcgaaatggttttaatctttataaatagtatatatttgttctgcttaacgctcaaacagtttatggacgcactaaaaaaagaaaataattttctgccattcttttgttaattaaaagttttaccaaaaatataggaatatgaagcttatacaatatgtccatattattgttataattaatgttcttgaaaatgtatttttccatcatgtttcttgtggaagcttgagcaacgcagcgagtaatagccaaggttttggccaaggagggggagggggaggaggacaaggcagtggccaagggtggggccaaggcatg

SEQ ID NO: 102358 - DNA, 130 bp, Heterodera glycines
  Promoter: Source sequence=SeqID_44610; Location=805..934; Strand=-; Gene=SeqID_72078
gctgcaaaattgatcattgaaaaaattttaggaatttttttttctaaattttccgatcagtctaggcccgaatatgaatatctgatatcaggtttaacatttaaatgtacttgtaattcatttagtaatg

SEQ ID NO: 102359 - DNA, 241 bp, Heterodera glycines
  Promoter: Source sequence=SeqID_2052; Location=4486..4726; Strand=-; Gene=SeqID_77527
aacagatgaaaaacatttatttgaccatttattaccaaaaggaacaattttcaaaatcaaataaaattggttatttatatcgaaaaaatatttaaaagaattaggaatggaaaatcggaattatatacgtagggtataacataagttctgtcggccttaacataatccgtaatttctgtatttattttaatattcactttttctttgcttaatcaatttttcagcttttttcccaactatg

SEQ ID NO: 102360 - DNA, 813 bp, Heterodera glycines
  Promoter: Source sequence=SeqID_22733; Location=600..1412; Strand=-; Gene=SeqID_53425
actgcaaaattaaaaagcatatttatttacatgcacttttaatcaaagtcaatgtatttttagtttattgaatccatagacagtctctccaatttttatgttaatactaccgatggtaagacccttttttgaaaaagattttcaagaaattaaaaaaaaaaagttagggccaaagatgctcgaaaaacaagcttttttgagttcctctagccatagcttttttgaaacttaatgaaattttttgaaaatttgtagactggtagagaacacttagtgctatcgaataatatcaagaattaagaattttattgctattgcttttgaactaagttttatataatatcaaatcatattgatggattttttaaataacgactccgtaccatcggtattagagatcggatacggaccggatccgtatacgtacttttacggatccgtagtccgtaatacgtattttttttcggccgatacgtatttttatgtactaaggattttccgtatttttagtccgtaagtacttaatccgtatcggtgtcaagtacgtaatactgatacttatccgtattttcgcaaaattccgatctctaattggtattaataaactcaaaatattgtaaaaatcttaattcaaaaaattatgattaaaaagaaattacttaatttctctcaaatttgtttaacaatttgtttggcaatttgttattcccaatcagttggagctcattgtcagaacaacaaatcattttcagctcaaactatgagtggcttcgaacagttcagttcatttttaagcaattaagtctcaaaatg

SEQ ID NO: 102361 - DNA, 173 bp, Heterodera glycines
  Promoter: Source sequence=SeqID_7052; Location=2084..2256; Strand=-; Gene=SeqID_46354
ttccgggatttcattccataagattgtttttcatcaaatttcatcctgtcaattttttgcactaattgtaagctcacacacgcatttccacattttgtttagctcaattcgccaaaattcttaacttcaaccaacttcacaaacttcacaccgacatttctctcctgaacatg

SEQ ID NO: 102362 - DNA, 534 bp, Heterodera glycines
  Promoter: Source sequence=SeqID_13942; Location=1656..2189; Strand=+; Gene=SeqID_77897
ggtaattaattaattggaaaactgtagtaatttacagtacaggacagggaggcgcaaattttgtgcccaaattgtaaacacaaaattgttgtttttgttcagcgaacccaaaattgccagcacactgtgtgagtgtgtgggcggggagaaaatcgagaaatacctcacattaaaatggtatttgtaatttgatttgattttgatcgacgggtgtttttggggtgatctgataggctgattgataaatatggacaaaggaccgattgatcaaaatttgattgatcacccaaatcacaaaattgtacaacagagaaggggggcatcttgctaccgcccaaacttttgtcaacaaactctcatacattcttgatcaacttgatcaattgatcaaacgacgtaataccatttcccgaaccggctgaaaatttttttttgttttttgctataaaagtgggccgaaccgacgaaaaaaatcattccataaaacggatcgccaaaaacaaaaaccaacaaatccctcaaaaaacaaaaatg

SEQ ID NO: 102363 - DNA, 633 bp, Heterodera glycines
  Promoter: Source sequence=SeqID_4338; Location=2621..3253; Strand=-; Gene=SeqID_54095
caaaaaatggcatttttaatatttcaattttaaattaaaaaacatttttcaaatttgaatgcaaaaaaatgtactattccctaatttaggtgatccttttaagttataaaaaggtaaacacattttgccaagagattgaaccaaaaaaatgaggctcgagaattgtgaaaaaaaaaaaattcgaaaattgaagattttctaaatgtaaaatttcggcattttgtttaaaattcaaaaatttaaattccactcactaatgagactaggtttatggcataatgcaaaaaaaaattcaaaatacttagttcattcgttcactttcccataaaaatattttttttatataactcaattttgattgtatttgtaaatagaggttcgtcagctcaccctaaaatttttcaactctcgaacaaaacgccaaaaatttcgggcccaatcaaaggatcagtaaggtttttgatctgggatatagagtcaagattctcgagcctcaccataccggccgttgggtaaagcccacacataagccgatggcaccgcaaaacgtctccgttttcccctcccctcccgcgtgttcagcaccggtccgacgactcggagcagtcctcgctgagccttggcaggccaatg

SEQ ID NO: 102364 - DNA, 1003 bp, Heterodera glycines
  Promoter: Source sequence=SeqID_638; Location=1373..2375; Strand=+; Gene=SeqID_57910
aaattaaattttaacgatcaatttttgagaaaatttttcatttcttagtgatttaatttttgaaattttttaagaccatttcttaggggtatattttcccgattttattgattttttaatggaatttttcaaaaaaacaccaaaaaggcatttaaggcacgaaaactcagaaaaaggcaaaaaaaaaaaaaaaaacagtttgatccggaattttgttcaattttggacttctcgtgcgataacatatgtgtgaaaacatgtaaattaaaaaaaaatttctgggttcatgttttgcgcttattttgcgatttaattgcatatttggccattttcagaaaaatctcttctcctctccatccctccctttcactctctctctctcatttctctctcactcactctctgactctcactctctctctcactctctcccactctctctctctctcactctctcccactctctctctctctctcgcactctcactctctcttctctcactctctctcttctctcactcactctctctctctctctctcactctctcccactctctctctctctctcgcactctcactctctcttctctcactctctctcttctctcactctctctctcactctctctctctcactctctcgctctctttctctcgttctctctctctctctcgctctctctctctctctcgctctctctctctctgatcaattacaaatcattttcattgaaaaagcgaaagcgattgaataaatttcaaagattgtgaataattcatcactaaattctcattacaattttccatttattctcattaatgtgaatggttcgtcctctaaacgagttttttttttaaagtgtcccgtggaaccaaaatttggttgacgcatttattttgcaaaatgagcaaaataaaaggcaataaaactaattaattaattattgcacggatcattaagaagaatcttttaatttcctccctaagaatttttccaaaatg

SEQ ID NO: 102365 - DNA, 1003 bp, Heterodera glycines
  Promoter: Source sequence=SeqID_31109; Location=829..1831; Strand=-; Gene=SeqID_61488
ggagaattattttgcgacatcggcccattgtctgtacacaaatttttatttgtgccacgtaaaccctagacgacaaaagaggccaaactgggtgccacttgaaacagacaaattggcactaagttcgcgtggtgagacgtaccacgtcgacgaattttgggtcgatccacggtacgaagaaaatgacaacacgttccaaaattacgcgtacgatttcgcactgatcaaggcatttgccaaaattgtggccttttttcacaagcaattttattcagagcagttccaccgtttctgccgaacccgtctgtttggcttcacgtctggaccgctttaaggactcttgggggaatttagtcggctatgggctacatgtaaaaataaatgataacatataaaaaatataataataaattgttacatttttcatcaatttttagcgtgccgacgcagaatgggaccaaaaactgcgccatgctgtcgtcaacttatcacccagcgccatatgcaaactgttaatctaataattttatgattttttgaaatttcaattttaagaaaatggggtgccaatgcaaaactctgttctggctctgcaaacgcaggcgctttaattgtaagtcaacgtaatttttaattcttttttaattttgtcgtttttccgccattttactcatgaaaatgccgaattcaaaaatagacaaaattacaaaactaatattcaaattctttgcatggttaagagcgatttaaatacaaaaattttttggatttttcaatttttcaaaaaaatttttacttggaaatttcccggtcccggcttctcaggtcccggcaagtcccggacccggttttggcaaaaattccctgtcccgtgacactcttcctaaaatagacaaaattccaaaactaatattcaaattctttgtatggtgattctggtgcggcactattgactggccatctgccgagcaatgtttattttgctcagggaatattgagcatg

SEQ ID NO: 102366 - DNA, 320 bp, Heterodera glycines
  Promoter: Source sequence=SeqID_15248; Location=587..906; Strand=-; Gene=SeqID_79455
tttcttttccgcaaaattttgaaaatttcaagggaaaatgttttttctatagtcatgtttataattttttcaaaaatttatacattttaaaaatcgtattttcgattttttctgcatttcgatttttcaaaaaataaattttgaatttattagtttttttttaaattttcgaatgccattcttttggattggaatcatttttttgatttatttcgtaaatttgtgtcaattttgggagtggagaggggaaaatctccttttttcaaaaaaaaaaaaagttgcattatttgctgaccatctttccatttttaggacaaatg

SEQ ID NO: 102367 - DNA, 1003 bp, Heterodera glycines
  Promoter: Source sequence=SeqID_12691; Location=628..1630; Strand=-; Gene=SeqID_76374
accaaattctgatcaacactctgatcaatgatcaacccatcccctgtactggacagccactgctcctcccaattcgcacactcaccccccccccctcataattagccccccccctcacctcattaattattaatcaccccccccgggccggcggcaaagatcaaagggaaaaaacccattaatcattttcacaccctacagcgaaacctggatactaactacttcggtataaagcatctaacatatgctattagtaaaaaaattacggctaaatttataaaaaaattttggggtgtgttaaacatatgaccatgactgtattataattttattctagtaaattttaaaaaaataattagattttttgcttcttttctctgtatgtatgaaatttttattaatttttcagttggcgatctgtagctttttttttggttaaataacattttagcataaatctcaccttctcaattttacattgttctgtatcaatttattgcaaaataaatggttgcagcgattgatccggtgaattttaattttgaattgacaaatagggttaaattttaaagtacaagaaaattagtttgaaaatttttattaatttaaatagctttaacttttggattttataaaataaaaacctaaataaaaatttaattatttaatattttcacttgaaataaattaaaatttgaattttttttaattttttgaattttttttaatttttaaaaattcccggttggtcccggttcccggtcccgaacaaaaatcgaggtcccggtcccgacttctcaggtcccggcaagtcccggtcccggttttgcccaaaattcccggtcccgctctactctagtttttagcacctataaatattagcccctaattattaccatagtggtaacataacgccaaacagacgatcaattccaatgccaagttgcaaagtgacagcaattgatgagccaattagaggcactaattgaatgaagaagcaatg

SEQ ID NO: 102368 - DNA, 561 bp, Heterodera glycines
  Promoter: Source sequence=SeqID_14919; Location=2273..2833; Strand=-; Gene=SeqID_79082
gagcacactattttggcaaaataaaaatttcaaaaaaaaaaacttgaattttctcttaagggattttcggaaaaaaatgtttcgcaaattgaatggcgtgttttggatcttaaaaatggttggtagcaatgaaaaagaacccacaggctcttgcctgggtttcgtacctcaaaatttttttttgcaaatctgcattaaatccatcaaaaaatcaacaagcagtgccaaaagaattacgatgttgaacgcgactttgtctttttttttgatcagacgaattttttttatacgttcggctttgatcatactattcagggcagcagttccgtaaccagagaaaaaaaaatcgcagatcgggaacccggagactttttttttttgctctttggcgataattttttttggactacctaatttttaaaactttgccctgttgatgaaaatacaattttttcgccaaaaatttttctgatcagaatgggtatttagcatatgatggtagtgctgctgactctctgatcacatccctgtttcctgatcactttttcttgccttaagatg

SEQ ID NO: 102369 - DNA, 136 bp, Heterodera glycines
  Promoter: Source sequence=SeqID_23113; Location=2032..2167; Strand=-; Gene=SeqID_53819
tcccttttgcgcgctctcatctttggtgggggctgatcagtgaacaaggaatggaacacatgcacagaatgtgcaacaatttggtttaatgaataatttttcccattaaaattataaatccaggtcggtcgttatg

SEQ ID NO: 102370 - DNA, 473 bp, Heterodera glycines
  Promoter: Source sequence=SeqID_27202; Location=1..473; Strand=+; Gene=SeqID_57892
ttttatgtgtaatgctacctaaaaagtgttaacaaaaaattttatttgcctatttgagggtttttgtgcctatttgcgatttttttctgcctttttaggtgcctatttcgcgattttttgtgcctaaaaatggagtccataatcattaattatcggttttgtgaaattttaacaaggttaattttaaaatgatcgggaatttcagttcccaatgagtcatttttaattctttcactttttttcctgctgctgtcatcttttaccgtaccaaaactgtccccattaccgtataactaccggttcccttttcacagacccttctcggctttgccatcggcacccgacgtgccgcctcgttgctcgactgtttggagctgtgcctggcacacaacaatttcaacagtaatcaccaccaccatcgccaatcgccggcaccgtcctcctcgtcaagttcaagcagtacaacatcaatg

SEQ ID NO: 102371 - DNA, 443 bp, Heterodera glycines
  Promoter: Source sequence=SeqID_29350; Location=682..1124; Strand=+; Gene=SeqID_46160
agttcaggattggcatcagaccggcacatgtgccgggattcaaaacccggttttgtcaaggttccaatcccggccctttaaaaaaagcgggatcgtgatcccgtgaaaatcccagcgagatcccgacaactacgctggctcttttgaccaacacaaagtagaaaattcacaaaaatatctttttagcatgaatggcatggaatttcgacccgattttcgacattattgcggtcggaattccgatttccaaaaaaattttgtgatgccactgattgctgaaacttacgctttttgtggtaccttataagaaaaaagaaatgcatttttttagatttttttccgtttgtcctccattttccgggaatatttcccaatttttaaacgcatttcattttgaggtgtccgactttcatccaattggtgccaaggctgttttgtggatg

SEQ ID NO: 102372 - DNA, 130 bp, Heterodera glycines
  Promoter: Source sequence=SeqID_35048; Location=707..836; Strand=-; Gene=SeqID_64704
ttgtggaattttgcagtggtgggacaaaacaagtaaagttaccatctgtgcaaattgtttttttaatttttccgcgcattagtacggcctgtgtctgcgacgcaagggcgcggaggcgggagcccaaatg

SEQ ID NO: 102373 - DNA, 475 bp, Heterodera glycines
  misc_feature (30)..(31): n is a, c, g, or t
  Promoter: Source sequence=SeqID_39016; Location=639..1113; Strand=-; Gene=SeqID_67684
aatttgaatgaaatgtcgaatttttcactnntagacaatgagcaaatgagttggagaagacctacggaaacatttcacggctttaaaaaatcaaaacaaaaaatgccaaagttcctaattgtgaacaaatttaaatcagttaaactttttttaactgttaagaattaactacttttttaacaaagctagcatttcctaatatattaacctggggttttatgtcacttttacaaaaagaaaaaatgcttttttcaaacagttttgatattgatatggtatttgcctatagaaacaagaaatgcattaatgttttgtgagatgaatcttctgtttcttgactatggagtttgccattaattacatcaattttcgcattttaataacgacaacaaagtttgtttttaaaattcaccaaattatttaataaaacatgtttttctaatggtcagtgtaaacaatatcaaaagtgaaaatg

SEQ ID NO: 102374 - DNA, 280 bp, Heterodera glycines
  Promoter: Source sequence=SeqID_12350; Location=1..280; Strand=+; Gene=SeqID_75946
ttcaaaatatgagaaacgataggaaattaatttttttgaccataattttagggtgccaggttttgaagttttaaccataaatttttcgaaacttaataaaaaaacaatttttttttttgaaatttgcattcttttttacctctgctactggtaagatatattttcataaattcataaaaaaatcatcaaaattttgttctatggatcagccccaaccgatgaaaacaatgaccagcagcaagacaatgccattggtagcggaaaacttatgaaaggcatg

SEQ ID NO: 102375 - DNA, 125 bp, Heterodera glycines
  Promoter: Source sequence=SeqID_39564; Location=838..962; Strand=-; Gene=SeqID_68107
acttcattatgccacattcattatgccagtactaaaaacaaaaagcaaaatttaaatacctatctgtttaaaattgtatttttcgattgctaatttaaaacttcccttaatagcttttgctaatg

SEQ ID NO: 102376 - DNA, 263 bp, Heterodera glycines
  Promoter: Source sequence=SeqID_42605; Location=1..263; Strand=+; Gene=SeqID_70456
atatgtgatggaaacgcaacaaagtaaaattataatctttttttttcagttattagcgcctgttttctagatttttattttgaagcctaaaaactttaaaaaaaattttgaaaactagtttttgtctattttggcgtttttaaagtttatttaaaaatgcaataaaaataattcacccttgaaaatcgaccccaaaaaattcttctgcaaaattaagtgaaaaatcctcaaaaattattttttagatttaattcttaaatatg

SEQ ID NO: 102377 - DNA, 1003 bp, Heterodera glycines
  Promoter: Source sequence=SeqID_15189; Location=1713..2715; Strand=-; Gene=SeqID_79387
gcagataggcgccgccgggaaaattttttgaaaactgatggatctgttaatagattttgtccaaaaaatgataggtttttgcaatttttagagaatttttttaataagatttacgaatttttgggccatgcgatgccgataggcagcgccaggcgaattttaaaattaaaaaaataaattaaaaaagaaaccgtcaacctgaatcgaactcacgacagaaagtaatgtcaaggttgattcattaaccactacaccacactacacatcaatataaaaaatttgtcaaaatggttaaaaaaatcaaaattgtatgaattttttgccttttatccatgaatatgtcattcttaggggtgtattttcacccccgcgcccccgcgggggtgaaggtcgcgggggcgggggatggcgggggtcagagtcacgggggcggggacgggggtgaggccaaaaaacctgtcccgcccccggcgggggcgggggtgacgggggcggggtccgaaccctactttttattaaaaaaaataaccaaaaatgacccaattaatataaataaaatttcattcacaaaattattatttttaacgacacaaataattgacattttgaatttttaatgaaaaaatgaattttttttttattttgacaatattgacaaattcaaaaacacaagaaaaatcaaatatcatttatttataacttttggcttggtggcttcaagaacgcgctagcacctttatattacatatagcagaaatactttataaattttctcaaaattcattaaaattacaattttttcatccaattaaattaattaacttatttcgcacttttggtctgcaaaatgccaaaaaatttcgctaggagctttctggtttaaaaattattgccaaaaaattcagcaatttatttcctgtaaaaattcgatctcaaattaaaaaggtacatttcgagaaatgatcgcctctactttttcccactgttcttcgcctcaacaatg

SEQ ID NO: 102378 - DNA, 429 bp, Heterodera glycines
  Promoter: Source sequence=SeqID_23303; Location=994..1422; Strand=-; Gene=SeqID_54009
tcaagacgatttattttttgaaaatttctacggggctttaatcactgaaccattgtcaaattattttaccattaatcaagacaatattaccaaagtcaaaaaatttaaatttaatccttctaaatatatatttaaaattactattgctctcactgtgcatgtacacaaaaatttgtcacaccgtaatatagaaattttctgtcaaacaatttctgaagaagtaacaaatagcatactatcagactttttacacacaacagaacaaaccataattgactcaatcgaaacggaccaaagaaaaatcaaattaacaaaatttctcaagagaatagaaaatcgaatatctaagcagattaaaaaacagtgaggtccatattgctatcatccaattcttgtactttcaactcataagtatattttttaaatatg

SEQ ID NO: 102379 - DNA, 386 bp, Heterodera glycines
  Promoter: Source sequence=SeqID_1192; Location=1996..2381; Strand=-; Gene=SeqID_69617
ttttttgcacttttttttcattcgtttatattttgtcattttttattgtctaatttagctacttcttttctgatattctggtgattcattatgtttttgtttgtttccatttgaagttgttttaaattgggcttttccctaagtattaatttaaacatagcgccaaatctttcccctttgggcagttaatatgtttaaggcgccattgcatgagctcgtcataatcacgcgtcaagaaatgcccacccccattccaaccactttcaccttaaattgttctttcgacaaaaaggaaccctcactttctcttccacccatcacggcactttctccacccttcgcctgagggggtggcaaattggttcttttctttttgcgttgcgatg

SEQ ID NO: 102380 - DNA, 621 bp, Heterodera glycines
  Promoter: Source sequence=SeqID_18740; Location=1328..1948; Strand=+; Gene=SeqID_83411
tttttagacaaaaaaatattttaaaaaatttttgcctgaaggaaaaatgaacaaattaggaaatatcataggtaacgaagaaagcaacccaactcatctacagcacgatgcggctctgtatcgtggcattttttgtgcatgaatgagttgggtatatggatgagttggtatagatgagttgtgaagaattttctcaaatcaactgcttttataatggaaagtttgcatacatactacatatgtagttttaagaaatactaccgccgaccgacctatttaaaaagaaaaaaatagttgcaagcgaaaaattaaattcaaatttttgttattttttcgaaccagcaaaagcctggtttttggtataataaacaaaaaaccatttttggattggcgaactttaaaaatttgaagatgatttttaaatttttcagtcactaaattttgcctacattttcggaaatcggaagacccaaaaaatttcggaaatcggaaagattactcattgcttactagtcttgtaattaacgcctttttactatcgctttccaattcgatatttgtttaagtgttaaacattcagtccattcgaataaaaatttctgtccgattctctctgaaatg

SEQ ID NO: 102381 - DNA, 189 bp, Heterodera glycines
  Promoter: Source sequence=SeqID_886; Location=3896..4084; Strand=+; Gene=SeqID_63351
acttaaatgtggaaattttgagacttaaaacttaggtggcgagatgaaaatgattaaccatccgtagaaatgaatcagtgaccaatccaggattcaggtttttggggatttggaggtaatttaatcttttgagccctttgaaattgctaaccctccatcggcggcttggatccatcccaggatggaatg

SEQ ID NO: 102382 - DNA, 505 bp, Heterodera glycines
  Promoter: Source sequence=SeqID_13306; Location=280..784; Strand=+; Gene=SeqID_77154
aattaagaaaagtcaaataaacctcaaaaaaaaatgcaataaaaaaaaagccaagcaaatgtcaacgaaaaacacaaaattatggaaaaaatacagaaaaatttacgtaaattgattaaaattttttaatcatttaaagcaaaataaaggaaataaaaacggtaatggaaaaaatgaaaaaatgtggcaaagtcaaagaaaagaataattaagaaaagttaaacaaacctcaaagaaaaacacttaaaaaatgcaaataaattaataattatacatgaatagagaaatggaaaaccaagagtacaaaatcatcccgatttgaaaattaaggaaaattaaaaacaacaagggaaaaaaagtctgtatggcgtatgcatttttttttgatcattcaatcgtgctttttttttttgcgcaggccaagcagttctgtgttgagtgcgagcatccggttgaccggcgcacgcatccgctgggctgccgcgctgtgtgtggcctgtgcatg

SEQ ID NO: 102383 - DNA, 197 bp, Heterodera glycines
  Promoter: Source sequence=SeqID_8250; Location=3776..3972; Strand=+; Gene=SeqID_67436
ttttaatgtttttttggcaatttgtgatggataatttgagtaatatataatgtttgttattaatgttaacattaaaatggcattttcattgaaattgttttatattgatttttttatgcgaaacgattaatttcgattagaattattgagggatgtctttacaaattatttttgcatgacaaatccatcaaaaaatg

SEQ ID NO: 102384 - DNA, 75 bp, Heterodera glycines
  Promoter: Source sequence=SeqID_39983; Location=1..75; Strand=+; Gene= SeqID_46612
ggggactctaagcatttattgttatcggtccaattataggcgaagtcagcttcggcgggagaattgcgaacgatg

SEQ ID NO: 102385 - DNA, 178 bp, Heterodera glycines
  Promoter: Source sequence=SeqID_12907; Location=1..178; Strand=+; Gene=SeqID_76648
tttcaaggattttaaacttagggttattcttgagcaaggttatgaaaaaaatttttgtcaaaaattttccatttttatgacttttaactaattacttacaaattagcaccaaatcaatccttttctcaatttaaaataagaaagatttgccataggtcgcagtgcgctgttcaaaatg

SEQ ID NO: 102386 - DNA, 1003 bp, Heterodera glycines
  Promoter: Source sequence=SeqID_8145; Location=899..1901; Strand=+; Gene=SeqID_67123
tagatggtcaacaaatgagataattattgttaaaaatattaacgcatttatttttaactgtttttcagtatgataaacaactaatattttgattaataaaagatataaaatattttactgatttagtatgttatagacattttgttataatttgatttaatttgaagtattaatttaatttattatttttactcctttaatgtgtagattttttctatgcaaaattaattattttaaaagttaattttatgtgattattaattaaataatattttattcgatgataattttcattttgtttttattaaaattgtataattgatggtttgcctgtatatttttatttgtttttataccctttttataagattttaatcattaaaaaaattcaattattaaatttacaaagaaattttccatgtcacacgttatcataactcgttgaatcctcctctatagacatgacaatacgaaaatgtaggagcaataatttttataaaaatatgctttatctttaacttatatagaatattttattttattttgaagattaataggaattttttgtatttaaatttatttcttgttaataaaaatttagttcacaaccataaatctattttctaaatgtatttattaaaaatacatctaaaaaaactaaattttgcactcgtcatttaagaaattgtattgagttttattattcgaatatggaaacttatgtagattcattaaatattacaaaacatataattaataataagatttttagcgaacttaacacaataataattattgattaattttgttgtctttttaaaatttaatcttattacttcttcagttaacaactgaataatttgtaatattttgtttgattttgtcctattttgaatttaaaatttatatgtttgaaaaatttatctatatttctggattaatttactactcttgaatttattttagctttaattcactaatactactgtttattttcagaatg

SEQ ID NO: 102387 - DNA, 598 bp, Heterodera glycines
  Promoter: Source sequence=SeqID_30489; Location=574..1171; Strand=-; Gene=SeqID_60894
aaaaaatcagtaaaaatgagaaatgcttatcatatatgttaatacatgtcaaattatttgccatgttatttaaactttttttataaaattcttcataacttcgcctcaaatgaacaaaattttaaaatcttgttaaaattcgatagcactaactttttcctattatcctgcaaattttcaaaaaaattcatgaagttaaaaagttctgacctgagaaactcaaaaaaccaagtttttctgaacattattagtcataattttttttgaaatttatcgaatttctttccattgggttaaaaaaattcttttcttagattccgtaagaaaattacatttaataatattataattctttttataaattctaaaattatttggcaaatttatttaatatattcaaaaaacgagcattcctagctgattcactctttcctttttgaatggaatgtgaattggacaatattttttagtgatgtaattttttagtaaataaataaataaatcagttttcgtgatattcgtacataataaaatatttgaataaaataataattacttttatatttatgaaaaaattatccatttttaagggaaaatg

SEQ ID NO: 102388 - DNA, 1003 bp, Heterodera glycines
  Promoter: Source sequence=SeqID_1512; Location=3816..4818; Strand=+; Gene=SeqID_74104
tttcacattaaatctcaaatgaaattagtttaatgtgccaattttttttttaattgcttgctcgatcaaatattctaatatttttctaaaacttttttcaccgttttttctgattctttgaatatgaatctcgttatgttttctttaatcccgaatttttattttgtttggttgtttttgatatttctatgtaattttctttttcggatattttattttgtttttaaaataattttttatgtttctttttttttctcttttcggaatcaatgtcaagaaatttttttgcctccattacttcttcctaaaattttaaacttatgtatattagtattttaaataaaattgcttttaaaactttgaaaattcaaaattatttaaagtttttttattcaacaaaaataattatgcaagataacatcgcaatattgccgtccaaactcaagcaaaataagaattttttatggcgtgaaaagactatagcgagccaaaaatgcaaaattttgacctccaaataatgcagccatttaatgattaattacttttgaaagctgtcacatttcctcacaaactttttgatttttttttttgcaatatttcagctcaaatattttaaactcaaattaacatataaatgccatcgacttcatggaaaaaaatcctatggacaaaggaaattgtctcttatttataactcaaaaattttttaattgattttcactattaaaaaatttaatttgtcttttgtatgttatttttgataagcaagttattttcttcagccaaatatatgtaatttattttgaatactcctttcaattgttaaaaataatgttttattaattgtttatagttatacgttagtagtatatgacccattaatccggtgtaaaatcccccccccccttcccttaccaaaatctcccccccgccttttcttttcctcccatcgcccttcatttccaagccagccgattcacaactcccttcctttgcgcaaatg

SEQ ID NO: 102389 - DNA, 570 bp, Heterodera glycines
  Promoter: Source sequence=SeqID_18803; Location=1..570; Strand=+; Gene=SeqID_83481
tgactgattgctggacgatttgatcatgatacatatcaattgacgatcattaaatacgaaatgagaaatataaaacgatcaaacatagaagtgatcagatcataaattatggtccatttgatagattaggcctataaattggacaccgacggaagaagagctgatttttttaaattagattatttcttgaaactaaaataatgggattaaagccttgtcaagagtgatcaaacggctttatccgttttattttccattgacacagatctaagcatgatgcggagcatccccgtgttcggttatgcccggcgcggcggtgccatggcggctggtggaacccaaggaacctttggcggcactttttctaacggtgccccgaccggctttggcactttgccaataaatggtgcggctgggtttggcggcaacagcaacaataatgataacaacaacaacaacaactgtttttttggtgccggtggtggcgaatgtgccaatgcgtggaaccaatttggtggtagtgccaacaacggcggcaacgacggggcgccaggcgatggagaagaaatg

SEQ ID NO: 102390 - DNA, 673 bp, Heterodera glycines
  Promoter: Source sequence=SeqID_342; Location=1985..2657; Strand=-; Gene=SeqID_83239
aaactatgaacactagacaagcctcagagggtcttgtctaggctctctaatttgcttttcccttccccctttgtcaccgggttccgtcgatttcagtccgtggttcacagccaatccacccaggtgcgccaatttgtcccgacttgctctggggtcgggccaaatgaattccacggtgcggggttcaggggcaggcagggacgagacacagaattaataaaaaatttattccgggaaatgacctcaaactcaaacttgggtaattaaacaaaaatttaaaaatggtgaacaaaatatcacaaaattgatcacagataaaatgccatcaccgggggattaatcacaaatgaattggggaccgggatgggacaggaaaattttcagaaaggaagcattcggtactggggcaaatgggaaatcacagaaatcaatgaatgggaccgggagaaacagaaatggagggcaccgggccatggatcaaagatcaacaatcggggggttcaaagaatgatcaaaattggggggccatcacagttaaaggcaaatggaggggcggggagagaaacggcaaaattgccaaatgaaatttggttgtgaaattgggggacatttttggccgcttaaataacaataaatttaaataaaaagtggcaaatgtgagcagaacaaaatg

SEQ ID NO: 102391 - DNA, 790 bp, Heterodera glycines
  Promoter: Source sequence=SeqID_11675; Location=1..790; Strand=+; Gene=SeqID_75142
tttttcatcaaattaccaaatcttgtggatttgtggccattcttgtaagaaaaaataggagtttcgggggcgcggcggtcccgataggcgccgccggggaaaaaattggaaatttcgatcatttataaacaggttttcactgaaaattagccaatttataggtaaaattttgaaagattttatgggaatttaatccaattcttaggggtgtaaaagtcgcgtttcgcgccaaaaagcgaaatgcgaaatgcgaaacgccaaaaaatgcgaataatgcgaaaggcgaaatgcgaaaagcgaaacctaggcacatccctggtaggtaccagggctgttgcaaaaggaaaaataaaaagcgaaaaggcgaaagcgaaatgcccaaaaaaagcgaaaaggcgaaattttttttccaaaaatagatgaatttgaaagtctcaaaaaattcaccttttaaaatgcttaactgttctgaagattgactgctctttggttttcataaattctttatgcaaagattaataaaaaagaagacgtgaatcggcatcgaactcatgagagagagtaatgtcaatgctaatgcactaaccactacaccacaatagacatttacgtagcaaagcaaatttactttatttaataaaaattttagtaaaatggttaaaaaattcaaaattttgtgtactttttctcccacgaaaattccattgtttattttaaaaatccatctttaggggtgtactttttttcgtttttctgcaaaaagcgaaaggcgaaaagcgaaagcaaaatg

SEQ ID NO: 102392 - DNA, 250 bp, Heterodera glycines
  Promoter: Source sequence=SeqID_6131; Location=150..399; Strand=+; Gene=SeqID_60459
tcttgtgccattaatggcatccgtcccgctttttgtgtgccgccccatttccggcacacttttttttgtgtgtccccaaactgccaacaaaaaggcgctttttgaaagaatgccgcatcggcacaccgcggcaaaatattttttcagttttttggtccccaatttttccgcaatttttaccgttctacggaaggtcatgctgaggaaagccatggcaaaatgggtggcaaagatttagattttggcaatg

SEQ ID NO: 102393 - DNA, 324 bp, Heterodera glycines
  Promoter: Source sequence=SeqID_4086; Location=1666..1989; Strand=+; Gene=SeqID_53128
tcgtaatgatatggtgaattaagacgtcgaaaaaatgtcgagacgaaggctttacttatggccaattcgaacctcaacacgctaacagcgagagggaccctaaggaaatggccagacaaatttatgtgcctttaaatcccaaaatcctaagatttttagtaatttgccaactaaagccacattatgggctgagtttggacttcataaactagaaattttgtggaactatgaatccaaattcaaaaatccgtttcttttttgtgtctttttaggctttaactttgtttaagaattgtccaatcgtcccgcccgtttcagcgaatg

SEQ ID NO: 102394 - DNA, 514 bp, Heterodera glycines
  Promoter: Source sequence=SeqID_7992; Location=1841..2354; Strand=-; Gene=SeqID_66614
ttttttgattgtttcgtttgttgtgttcacaacaattagagcgcctttgccccgtttaccctcaaatcgtcgccattatccgccgtttttctttgtttgaccaatttcttcaagctattgatacataaaattttagacaaatttggtttgattcattttatgatatcatttttgtcagttacaaatatatttttgcctttttttttgttgtggagcgctgtcagcaggttatattacatattctaatttgaagaacaaaagcggaatttttgtggattaataaagccgcatttttccatcattttcgaaggcggatgatagaaaattcgaaccttagttttgtgaacatttgacctcaaatccgatggaatggtagtgcatttttgtaaaccgcacaggtttggcccgcagataaacacaactcattaaattggacaattttttcgtcactttttcattaaatgacccatttaaatccaattttcagacaatatatatatttgttatcaaaatg

SEQ ID NO: 102395 - DNA, 1003 bp, Heterodera glycines
  Promoter: Source sequence=SeqID_18098; Location=97..1099; Strand=+; Gene=SeqID_82684
tacaaaaacgaataactgttttgaattatatatgtatcatttttatggaagcaaatatttgaattaattcgattttgaaaaaaattgcgtttttatttcgttttcttgaatgtaaaatgctctaaatttcagtgaaaattttgttaaaaatggtcaacatttctatttttcctccggcggcgtctatcggcaccgccgggccttccaaaacttattttttcataaaaaattggccaaaaattgtcatattttgaataaaatttttcaaaatgctgattttttgtcagccaaatgctgattttgaaaattttcagttggcagccctggtttttccgctaataaaatattgttttaagtcgatttttcatatttttattgcgtttccttcacgctactattagttttagaaaaatcttatttttggggtccgaattttagtttttgagccattttgtcttattttgaaaaaaaaacatggaaactctgttttatttacctgctgaattttccctctaaccctccccctgcggtctaaattttttttgttgtgtatcgattatttttacatgctttcggatgtgaactgtctgacttctcgctgtctccactcctacacaaacacaaaaacaaaacgaaacaaatattcataaaacaaatattgctgataatttcgcaacttttaaaaaaaatcattgttttgtttttcatttttttgaccggcaccaccggggaaataactcataaaaatagagggaaaaattggcatagatccataaatttggcaaatacctttttaaacaatatggaagtttcagcaaatttttggccaacgatttttcaaatttgaaaaggctcaaaaaatatcaaaaattatggtaaaactaaaattcgttttttttaaattttttttatcccttttataaatgcgcctcatttcagagctaattaccgaagacaaaaattttgatcaaatttccgagtgcaattttttttatataaaatg

SEQ ID NO: 102396 - DNA, 108 bp, Heterodera glycines
  Promoter: Source sequence=SeqID_10830; Location=918..1025; Strand=+; Gene=SeqID_74099
ggtaattggactcgaatagtttactcgtttttaatatagaaaattaagcggaaaagaaaggccgacggaggagggaccaatgaattggcatctgacgaaatcaaaatg

SEQ ID NO: 102397 - DNA, 964 bp, Heterodera glycines
  Promoter: Source sequence=SeqID_13425; Location=1..964; Strand=+; Gene=SeqID_77316
tgcacaaagaccgaccgacgaccgactttttgctgcatttctgacacatttcccccccccccccccaaatttcacgcgatggaagcgaaaggggggggggaggaaaagccattttcataagctaaaataggggagggaggtgaccaaatagaaaagggagggagcagcagagggaaatttgagttacacacatatttttgaaaagcaattttgccaataaccttttaggaaaaggaaaacctcgggagcaatgcacaaagcccctccccccccaaatttaaggggaaacaatttttaataatttaaatttaaaaaattaattagaagttccaattgtttttattttttgtttgtttttgctcgttttaatcgttcttttttcgtttaattatcacttcatatttcacttctctttctctccatatttcattcattttgattagaaaaatgtgtacaaagttttatcaaagttaaagtccatttccatttttgataaaagtttttgattgacggggaaaaacaattaattccccttttgtccgcaattgaaattcattttctaatcgcacacagaattaaatgatgatgatatgataataataataatacggcatccatttaattttcttctccaatatattttattattctttcaatttaaattatgcataattttcaattattattttttgcttttctttctttaattttccataaatttaaattaatattttttattttgttattttttattttgcagcaaatttatgtaaaataatctcagctatttcctattattttccaaaatttttcataattattgccataaatattttgtctaaaaagtgtccaattatttattaatcattatttttttctgttatttgtttaaaattaaagatttcaaaaaacatttggcccatttcccaatatttttctgatcagttttttgtcgacccaaatg

SEQ ID NO: 102398 - DNA, 484 bp, Heterodera glycines
  Promoter: Source sequence=SeqID_16912; Location=1..484; Strand=+; Gene=SeqID_81341
aacaacgaaaaagaattgagtctcgcgagtttaactcagcagaacaagctgagccgtaagttttttcattttcaaattttatgaatttcccgaggttggctattttttcattttccgatcgggtagcccttgtatttgtttcctcgattggtcggaataaattgcgtttggccaaaactgttcctgctaaatttgatcaactaaggaaaaagttatcttaaagttttgtctcagactcatttggccctctccgtcctcccgtctgacattcgagaaaaagctgagtaacttcaaacactaattgattttcaaatcctctgcagggtcggacttttttatttttgtccggctaatgatcgaccattacggctttacgtccgaccaataatttcttttcttagatttgatcgaattgtgtgaagaaataaagaaaaggaaaaatttaaatgcggaaatattttcaaaaaattggaacaaaaagatg

SEQ ID NO: 102399 - DNA, 470 bp, Heterodera glycines
  Promoter: Source sequence=SeqID_15905; Location=1..470; Strand=+; Gene=SeqID_80251
actcataaaggtcgattggactcataaagtgcattagagccaaatttacaagcatttcattcattattcatttgctttggggacagaaaaaacatttggccattacttttttgtatatcattataattttttttatcaaaattataatttttttaatttcgcatatttttaatttcagatatatggtcacgttgcatttgcatttttttagggaatgttttcttgctggctttatccgtgtacatttgcttgactttcgcccaaaatatatgtataatcatagggccataaatacaaagctaaattttttgtttatatgtaattataataaaaaaaattaatatttaaaactgaattttctttcattaattggtgtcttatttgtttgaatacattaaacctttttaaaaaaatatttatgaaatttttttttatacaaaattcgatttattatttcatttatgaaaatg

SEQ ID NO: 102400 - DNA, 108 bp, Heterodera glycines
  Promoter: Source sequence=SeqID_11936; Location=1..108; Strand=+; Gene=SeqID_75456
aatattaagcattacaaataatatcttcagacaatattattttattttatattatctttattcacttagaaaaaccttcaattaaatttatttattttatagaaaatg

SEQ ID NO: 102401 - DNA, 121 bp, Heterodera glycines
  Promoter: Source sequence=SeqID_4755; Location=1053..1173; Strand=-; Gene=SeqID_45890
tctttcgcccgtgcttgggtccatgaagttggtcatccaggtgagacaaattgacaaatcaattttaatgacccctttcttctccctcattaaggctgccattgtccgtattatgaaaatg

SEQ ID NO: 102402 - DNA, 59 bp, Heterodera glycines
  Promoter: Source sequence=SeqID_22661; Location=1227..1285; Strand=-; Gene=SeqID_53342
agtaatattgactatttttcaaatttgaataatttttctattttaagggaaataaaatg

SEQ ID NO: 102403 - DNA, 819 bp, Heterodera glycines
  Promoter: Source sequence=SeqID_10669; Location=156..974; Strand=-; Gene=SeqID_73916
ttttttgaccatgctcaactcagcctcaaattggcacttctttcgccctgtttcgatgcgctggtggacaaacattttcaatggcaaaacgaattgacgtaagtttcaattaaaaaaaacataatcataagaaaaattgcaaaattttctaaaaattttcattttttttgagacttacaaatgaaggcctctattttttcacttctttttgcttttgaacataaattttgtgtttaatccatatcgaaatttttggttaaatttaattcatagaaatgccgacttatcaaaaaattgcaccgaaataaaaattttccaaattcgacatttttttcttgtaaagcggatttttaggcattttgcacatatcatttttagcctttgcgattttataatttttattacttttttcagcaagtgcgcaacgacacttggtggccttttcccatcttttgaccatgctcaactcgggctcaaattggcactgctttcgccccaattcgatgcgctggcggacaacaattttgatggaccaacgaattttttttataaattcggcaagtttttttgggttttctttttgttttaattacaaatccaacaaatttttttttattttttttgtaaaagtgaataattttatatgttttttttaggattttgtgcaaaaaatacactccaattttcaatatggctcataataaaaaattttccaaattcgccgtttttttgtaaagtgtgccgggggtttttttaggctttttctgtttttttctgatttttattttcataaatttttcagcatgtgacatttggatg

SEQ ID NO: 102404 - DNA, 76 bp, Heterodera glycines
  Promoter: Source sequence=SeqID_13306; Location=1627..1702; Strand=+; Gene=SeqID_77155
atgatgattatgcggctttgcttacgcagacgaggcagaggcggcacactgcgctggcgacgaggcaggtgcaatg

SEQ ID NO: 102405 - DNA, 696 bp, Heterodera glycines
  Promoter: Source sequence=SeqID_25605; Location=1..696; Strand=+; Gene=SeqID_45945
aactacttcaactaatttcgaatccctgacccaaaatcgactaaaacagaagtcaaaaacaaatttgaaaaattgatttttgttcacttttggttcaaattcggatctggggttcggaattagtcgaaatggatctcattttacgtaatcagcgaacatgaaaacccctgaattctttttactctccctttgttcgtttgataaaaaaaaatgtccccccattgtatgcatcgcccccccctactttaaaaatgccaaatgttcttatctaagacaacatttttgaagatttttctctatcttttttaagtgttgcggcttttcggttctttaaggttaataaagctttcttagagctttcgaatggtaccaagtttattgaatttgatgacaacgaaaaacatgtcataacccaaaaaataagagctggttgaacaaagagccgaaaataaaatcaaaatgaaaaaacgaaagaattgtttgaggtgacaaataggtaaatcgattgcaacattttgtttatgtgttttttgattcgttaatattcattcaccaccggtcgaaagcagcaaaacaaaaaaaaagtggaaaggaaagctttcgtgtcgataaatttttcaaaaaacagcataaactgcgtgacatacacattgaattagtatggttaattcttcatttttattggcttatcaaatg

SEQ ID NO: 102406 - DNA, 1003 bp, Heterodera glycines
  Promoter: Source sequence=SeqID_5183; Location=1042..2044; Strand=-; Gene=SeqID_57187
ccgcggcgctatcatttttatcacaccataatatacaataaatacatcactttggctacggcgctaatatcctgattaaattgtgttttgttaagaattttttggcttgtttgttggacggacggacgaaaaaaaaattaaaaaatgacgtcctattattaaacaattattattaattatttctttatccgtccgcccctctttcgcgcaccataaaaaaagcggcatttccgtctgtctcctaaaattggcaaaacgtcgccggaggtgacggaagcagcgcatttgtttgcaggtgtttctccacaacagcttatgtcaatgtgattaattactggttatcaaattaattttaatgttttaaatttaaattcaatccgagacaaagtgtcaaccgaaccaaaaaaataacggacatttcgtcaaaaagtcgagacaataatcaatttttattcaaaaaactttacattaaattttggtccagttgaccattccggctcggcaaatctgttaaaatgtctcggaactttcgatattttgtccaattttggcaaatttagtcggtatttggtccaatatcaaaattgttgactttattatccttcacggcttttgaatcaaattttcgctatcttgttcgaaaggatgagtcctttgtattaaatttgttgatattagagatcgacctggacctggatccaggcctggatttttcctggatccaggtccaggtcattttttggcaacctggatttttcctggacctggattttcctggatttttgtccaggaaatccaggtccaacatggaatccaggtccaggtccaggcttttttcaaaatgtcgatctctagttgatattttgtccagagaattttcatgacaattttttttgacattttgcccggttttttcgtgccaaaattgtttgtcgttttgtctcagccctcccaatgaaaatacctccataaattacagccctttttgaatgccacaacaatg

SEQ ID NO: 102407 - DNA, 686 bp, Heterodera glycines
  Promoter: Source sequence=SeqID_7831; Location=2133..2818; Strand=-; Gene=SeqID_66104
atatggactaaaaaagcccgaaatatggactaaaaaggccaaatatggccaaatatggataaaaaatgccaaaatatatgttgtaaacccccaaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgttttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctaattattagacaataagttttttgtttaagttatagattagaaaatg

SEQ ID NO: 102408 - DNA, 499 bp, Heterodera glycines
  Promoter: Source sequence=SeqID_19321; Location=226..724; Strand=+; Gene=SeqID_47578
ttcttttctttgttaaaaatattttccgagttaaaataaagtaacagaaaagttgcttttcttaaaatgacagtataatgtaatgaaaatggcattagtttgaacagataggtaaaacttctttaaaaagagaacggaatgggaccattgaattcgcaaaaaaaaaagaaaagaaggaaggaaatataaattgaaaatttaaataacgctaaaaaaatttttatgaaacgaattttattttaatttgtattgaaaaaaaagaatttttcgtggttttttctttagtaagtttctgacagtgacagttatgttttggttttttagttttcaaacaaattcttttcacttgcatttacggttttttgaccattgaatccttttttcacgttgttttattttattttgataatcggtcttttacattttttctttttttcattccttttcaagaacttaatttgaggattacattgaaaataattaattagacttcaaaatg

SEQ ID NO: 102409 - DNA, 88 bp, Heterodera glycines
  Promoter: Source sequence=SeqID_5022; Location=2735..2822; Strand=-; Gene=SeqID_45959
ggtgttgtgagcggcgatggatcgaatggatgcttttccggatttccctgttataatttccctccccccatttcaggtggccgaaatg

SEQ ID NO: 102410 - DNA, 75 bp, Heterodera glycines
  Promoter: Source sequence=SeqID_42200; Location=702..776; Strand=-; Gene=SeqID_70151
atttccctcccgtttttgccattttttcagaaattcaagccggacgtcaactgatcgccatctttcatcgccatg

SEQ ID NO: 102411 - DNA, 102 bp, Heterodera glycines
  Promoter: Source sequence=SeqID_21421; Location=2235..2336; Strand=-; Gene=SeqID_52028
gcagtatcaaaaccccccaaaccgaccgcaaccaaaaaagtgtccaccgccattttcgtcgcgcaaaaatgtgtcccattcgacaaaaattgcggaaaaatg

SEQ ID NO: 102412 - DNA, 127 bp, Heterodera glycines
  Promoter: Source sequence=SeqID_19655; Location=705..831; Strand=-; Gene=SeqID_84391
aattttagataagaataaattattaaaaactatttttcgtaggatgaatcaagaaattttgtttaattatttgtccattttaaatttgaacaattatttagctaaaactgaccaattcacaaaaatg

SEQ ID NO: 102413 - DNA, 79 bp, Heterodera glycines
  Promoter: Source sequence=SeqID_28627; Location=880..958; Strand=-; Gene=SeqID_59227
ttttgttgtttgtttttgattgtgccgttttcttccgtttattatttttgcgcgttttcccccaggcgccgatcggatg

SEQ ID NO: 102414 - DNA, 353 bp, Heterodera glycines
  misc_feature (47)..(48): n is a, c, g, or t
  misc_feature (55)..(55): n is a, c, g, or t
  Promoter: Source sequence=SeqID_38293; Location=1139..1491; Strand=-; Gene=SeqID_67154
tttttttaaatgcaaaaaatgtgagcacaattactatcaatctttcnncaggatntaatcagggatggcaccatcggaaaattgtttttttgattttccctcatttttaacagattttcaccaaaataggtaattttggtggattttggaaaatttccgcgtaatattttgggaaatttttggtgaggtagaggtaggtcttggaggtgcaccaatagtaaacagttacaatgaaaaatttcttgttttttttcaaatttgattaatataaattaaacaaaattaaatttactacaattagagccctggttaaatattaaaaaaataatttctttttcaattttattcagatg

SEQ ID NO: 102415 - DNA, 68 bp, Heterodera glycines
  Promoter: Source sequence=SeqID_21626; Location=657..724; Strand=+; Gene=SeqID_52222
tggctataagatttcactaattatttattaatttacctataaatttttactgaaataaaattgaaatg

SEQ ID NO: 102416 - DNA, 509 bp, Heterodera glycines
  Promoter: Source sequence=SeqID_31; Location=2444..2952; Strand=+; Gene=SeqID_50791
tgtctcggtgacggtgccggcactaataaacaaatcaaattatttaagtcaactaaaaatgaggtagctatgaattgatctgtcccatttttcacgcaaaattatcggaatatttgggttcagattgttttacttatgttgcagaattataaattactttagaatgactcttaatacataaaatttccccgaccgtcccctaatcacaatttcaacaaattttataacacattcattaaattcaaattttgccgccgccaaatcatgtcagtggggcgcctaaagttacttattcttttgtgtccaatattcctagtactaatctttgttgatcactccccgagccaaacaaaggaagataacatctgtatggccatttggacaatgaaaagacgacaaattgacaaaagaaacaaaaatttggagaactaaagtggatgggaaagggggggggggttaagcgatcgggccatactccgctggtcatttctctgaatattcgcgccatg

SEQ ID NO: 102417 - DNA, 225 bp, Heterodera glycines
  Promoter: Source sequence=SeqID_7657; Location=2256..2480; Strand=-; Gene=SeqID_65533
ttgtatggaacagcagcaaaaacaaggacagcatgttggcacgttggaatttgtgctcacaatggaacgactccctgagctgaatggaacgaaggaccgaacaaaatacaaaaattcttcaaaaaattttcgtcggcaacagaagaattgccggaaagtcgccgcatttcagcgttggaaagcaaaatcagtggaaaagcagagcgtgcttttgacgccgccatg

SEQ ID NO: 102418 - DNA, 239 bp, Heterodera glycines
  Promoter: Source sequence=SeqID_1588; Location=827..1065; Strand=+; Gene=SeqID_74651
atttgtttgtttgaattggaataattcagggattaaattcgatctctgttcgccagtgcattttaatggatcagccgatgagattgatcattccgctgaaattgcctcagtttcggcattttttcctctttccgtgcgcggaaaaaggcttttcaaaaccaaagaacaggtggcacaaaagaagaagcactcacgcttttcttttccatttgtagcggatgtccacacaatacgccatg

SEQ ID NO: 102419 - DNA, 266 bp, Heterodera glycines
  misc_feature (78)..(78): n is a, c, g, or t
  Promoter: Source sequence=SeqID_20301; Location=747..1012; Strand=-; Gene=SeqID_50808
acccgtttcaggtagcagctgaccgagacgtattcggacgaaggagaggaggggggggggggggggaatacgggaaanctctctcgaaaattggacattatagcaaattaaattaataattgttgtaaatgttttagtaattaggcgcgtaattagcctaagattttacacataaaaaattcttttaaatgctataaaacagtttttgatttttattttttcagtctatctaaaaatgttttaaggatttgccacgtccgtccatg

SEQ ID NO: 102420 - DNA, 326 bp, Heterodera glycines
  Promoter: Source sequence=SeqID_31353; Location=590..915; Strand=-; Gene=SeqID_61721
aattaatgtttatttaattacaattttattcaaatacctttatttttattaaaatttaaaaaagaactttcgattgtctgagactgaattttttcagtgttattttatttaaaaaaaagttattaaattttcaaatttatgcaaacaaacatttcaaaaagctttttgattagagaaagcttttgaaatgattgtgtttgtttagacagtcaaaagaatcaaaaaatgcctataaaaggaaggcgatgaaaggaaaaagcacccacaggaaaatatcattttattattttaaaaaccaaaattttattttagaaaaccaaaaaatg

SEQ ID NO: 102421 - DNA, 255 bp, Heterodera glycines
  Promoter: Source sequence=SeqID_26940; Location=1..255; Strand=+; Gene=SeqID_57676
ccaaaaaaaagaagagattattataaatttctaaaaagtattctaattgatgggtcatcattttgcccaaattacttttttgccgtcaaatgccagcccataaatagaggggagattcagcgcaaaagatcaaatgttcattcattcattcatttacatgcgaagatgaattttatttccaattttcatattttttttatttaaaaattttaatttgtagccagtccaattaataccttattaattcgaaaaatg

SEQ ID NO: 102422 - DNA, 71 bp, Heterodera glycines
  Promoter: Source sequence=SeqID_13334; Location=1..71; Strand=+; Gene= SeqID_77198
cttcgtcaccgctcgaaactgactcattcaataattcctgctgatgctcaaagaacacagtgcttgaaatg

SEQ ID NO: 102423 - DNA, 268 bp, Heterodera glycines
  Promoter: Source sequence=SeqID_37469; Location=955..1222; Strand=-; Gene=SeqID_66534
tttgcctttttctgtgtttgctttctgttggggtgcaaatctgtgcaatttattgacattgagcagcaatttaatcgctttaacgaagtgatcgcattaagcggacgtaagaaaatttaattgacatttgaaaatcggtaattaaattaattaaaattaattattttattatttaatttggcaaaatgtgtcaaattggccaggccaatgtgaagttaaagctcaaagttcgactcccaagcatttttttttgttttgcaacacaatg

SEQ ID NO: 102424 - DNA, 107 bp, Heterodera glycines
  Promoter: Source sequence=SeqID_10034; Location=367..473; Strand=+; Gene=SeqID_73086
ggtaattctaattacgcaataaatatagttcttcttctaaggcttattatgaccgacttcaccctggaatgtatcgccttttctgcttcggaacttttgggaaaatg

SEQ ID NO: 102425 - DNA, 131 bp, Heterodera glycines
  Promoter: Source sequence=SeqID_16273; Location=1..131; Strand=+; Gene=SeqID_80665
tcaggtccattgataaatatcttaattaaaaactcttcctttgaaattcagaaaattcaagcggatcaagtttttttacgtctcctgttaaaaaagtgcctcgagatgattttgcatctttttcggacatg

SEQ ID NO: 102426 - DNA, 1003 bp, Heterodera glycines
  Promoter: Source sequence=SeqID_838; Location=2125..3127; Strand=+; Gene=SeqID_62544
tttgtttgccattccacctccctacccctttccccaatcatttcaaatccctccacaaaatcccatcaaatccctccacaaaatcccattgatacaacaataaccaatcactgcgcaatgaacaatatttttatttttgccgtggattgttcgccgttttttgggcgctcccaaaaaattctgtcgcttgcccatttcccgttgtcagaagagataattgcccaattctcgaccaattcggggaacaatttaatctctcaacaataataatagatccataaatttcaaaatttttgttcaaaaatgggatagaataataaaaaaaaattcttatttatttggttttggattctcaaaatttcattttattaatttggcgattccccaaattttcattgtcactttcatttttgattcccattcccgtccattagctcaatcatttgttgtttttttgggtgctccacgaccttcggggagagaaaagtcgagaatcggggaggaaattcccagaaaaatatgccggggatggctggagaattcgtcgggtagcagcagcaactcctttgttttcggggaagaaattttaataaaagtcgcaaaaaagtcttagaaaattacagccttagtttttttaattaaaatatttcaccaaagaattcaattatcttaaaattaaatcaaatgtctaaaattgcatttttgctcttcatacttttggcagtcaatgaatgtacgtcggcccaacaagttcatcccgaaccaccaaaaagtatggccatgacatggtttttaatgaatgacttttttgggaggctgcgaatggatgaaatctgtgaaaatttttttgattacgatatacagtaatctcgcagcctaattaccctaatttaccaagacccgtcttcccaaccgcttctgccacatgggcgatcccgtcgtgatgaaccagagttgacaactccaacaacaacaacacccgggaaatcgtcgacggaggatg

SEQ ID NO: 102427 - DNA, 98 bp, Heterodera glycines
  Promoter: Source sequence=SeqID_19839; Location=487..584; Strand=-; Gene=SeqID_84593
ggtaaattgaaacgaaataattattaattttgaatgcccatttaattacgccccaacttttaagccgtgtcgccatcggattcgcccccaaagaaatg

SEQ ID NO: 102428 - DNA, 175 bp, Heterodera glycines
  Promoter: Source sequence=SeqID_6399; Location=1..175; Strand=+; Gene= SeqID_61411
gctcaatcggatccaagacgcgtgggtgccgctgattaaattcaaattcgaaatcgacccgaacacttccgtcgattttgacattggactagaaacatttgcaatccatgacgaaatttttaaatccgaagagccaataaaatacgaacaatgcgacgcattgtcagcgaaaatg

SEQ ID NO: 102429 - DNA, 499 bp, Heterodera glycines
  Promoter: Source sequence=SeqID_25046; Location=577..1075; Strand=-; Gene=SeqID_55779
cccaaagccttcaacgcaaccaccacgaccctcctacacgtcatggccagactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatg

SEQ ID NO: 102430 - DNA, 250 bp, Heterodera glycines
  Promoter: Source sequence=SeqID_2814; Location=1..250; Strand=+; Gene= SeqID_81760
taaaaaaaataatttttttttaaggagtttttgggagttatttaaaaccaaccccccccccccccccccgcgggggggggatttttggggcccccgtcccccccccccgggactttgacccccgcatcccccgcccccgcgaaaagccacccccgcccgcggggctcgacccttacaataaaatgatttaaaataaatatttataaaataaaactaaatttgagtaaatgatcgtgttttgcagcaaatg

SEQ ID NO: 102431 - DNA, 87 bp, Heterodera glycines
  misc_feature (21)..(21): n is a, c, g, or t
  Promoter: Source sequence=SeqID_9915; Location=1..87; Strand=+; Gene =SeqID_72943
tttaaaatttaaattttgttntgtctattcgcttttcccgcccttttcacgtttctctccgagcaacacttttgcgtgtcgccaatg

SEQ ID NO: 102432 - DNA, 464 bp, Heterodera glycines
  Promoter: Source sequence=SeqID_9729; Location=4850..5313; Strand=-; Gene=SeqID_72505
ttcatttaaaaagcagttaattattgattattcaatatatcttttttgaaaagaaaataattaaaattttccctttgctttgtccaaatattattttgcatttaaatgatcaataaaataaagatattacaatcaataagtaactgaaaaaatctacaacagattccattccaaaaagaaataggaggttaatatattgggatttccttctttgctttatatctaacaaacgcaaaaaattaaatttctaagcaattttataaatttttcgattaatggagaaagtggcccagcagaattattatttagccgattaaaatcatcgtctttggcaagtgctgcccaaaaggagtttgacttcatccatcgtgttttgttgggcccacaacgggacaatttgacagcaattgaatatttagtggcacaaaattttagccaaaattcatcaatgatgcctgcttatg

SEQ ID NO: 102433 - DNA, 251 bp, Heterodera glycines
  Promoter: Source sequence=SeqID_567; Location=2914..3164; Strand=-; Gene=SeqID_56336
atggatgagttgggtatggatgagttggatatatggatgagttgggtacggatgagtggggtatggaagagttggatatatagatgagttgggtacggaagagttgggtatggaagagttggatatatggatgagttgggtactggatatatggacgagttgggtatggatgagttggatatatggatgagttgggtacggatgatttgggtatggaagagttggatatatagatgagttgggtacggatg

SEQ ID NO: 102434 - DNA, 1003 bp, Heterodera glycines
  Promoter: Source sequence=SeqID_67; Location=789..1791; Strand=-; Gene=SeqID_60278
acaaataaaaattggctcagaaaagaaaaaattgaaataaaatcatttgatgaaatatttggagaaaatgggcagaaaaagacgaagaaaatattaaagaaaaaagaaagaaagaacagagaaaaagaaaaataattattgaaaaacttaataagataaaataaaaagttaagcaagaaagaagaaaagattcaaaaaatgtaaaaaaattacgccgaaatcattaagaaaatcggagttagccatttcataataaaatggcatcatggatttaggtagcattttaaaaaatgaaaattaaaaatatatctatttaattttatatgattttttatatttctatcacatattgtttgcattattttttgcgtaaaatgaaaaataattttttgcaattttgtgacggccaaaattaaatgtaaagacagcaaaaaccagtgcttttgcgcaaatttgggacggggaaaaaatgaaatgagtgaacaggtctaaaccagtgcttttgcgcacaatttgatggcaaaaataaatcgtttcctgtgaagaaaaatgtaataattttaacgatggtcgaagctaaaaccaaaatgaacaaattgtcaacaaaatgattacaacaatcatattcttttgtgtaacaactcctatttggtttcatttggcctttgttgtgcctatttaaagcggtggaaattagtttttgtcacattcaactggcaaccgatcacttatattattcattaaacctaaccaagattttgccgtatgttattaagaaaattgtttaacttttgtcaaatgaaataaagtgccgagataaaaaatgccaagcttttacaattttttggtccaaagttcaagtcccttacatcccaaattcattttctcttttaatttttacaaaattccaattgaaataccacggagcattttcccattttcgttgtttttctaatttttctcttttcatttaagtaaattcatttataacaaacgaccaatg

SEQ ID NO: 102435 - DNA, 336 bp, Heterodera glycines
  Promoter: Source sequence=SeqID_5890; Location=4906..5241; Strand=-; Gene=SeqID_59579
ttcgctgaaaaatggggggggcaattagcacaatgaaaatgcacataacaaaacaattaattacctaaataaactgacgatttaagtggcggtggaggaggacgaataattaagtggatggaatgaatgaacggaatgaacgtggaaaagcaaaatgtgtgggccttaaatagcaaattttttagtcggaagagtcaaatttttcggataaattcatatataaaaggcacaaaaaattcatttggttgccatttttccattattaattatcggcaattcatcttcatcaatcatcccttctctgtgtacaacgaaaacgacgacaattgagcaatg

SEQ ID NO: 102436 - DNA, 258 bp, Heterodera glycines
  Promoter: Source sequence=SeqID_10235; Location=1041..1298; Strand=-; Gene=SeqID_73383
tttccaccccaatcactctgaccgccgcccaccaggaagacgtgaacagtaagagatcatttgcgcgggattaaccaattatttaattgacggcctaatttctgttaagttcatgtgctgttcagcggacctttgaacgagcgaggacagtatgaattcactgtagttagcaacaaccgcaattaccccgtgtacgtattcgcccgagaccccgtcagatacaaacaggtcgaattcggaggggggtggcaacggatg

SEQ ID NO: 102437 - DNA, 681 bp, Heterodera glycines
  Promoter: Source sequence=SeqID_14227; Location=1..681; Strand=+; Gene=SeqID_78243
attaaaaatgcttttatccaattcagcaatttaccccgtataccaatttttgtgttaaatattaattatactttgttctcattttaaattattttatttggcgttttgttttctcaattttcttcccatttttacttctttggattttttgattattcgtctccggtctccaaaaatcttctgcatttttgatattttgattgtgcttaaaaataagtcttctctcgcctctgacgtttgtttggattgttattttgttgttccgagctttattctaatttgttgttttgtttctcaattaaagtgattagcctaattgtgtgtctgatttggcgaattcggttgcagcagagcgaagaaaaaatattcggttgtgcattacgtggcgctcctggcagtctcgggtaagctcactgcgtttaaagtttttctatcttcgggtgaaatcgaagcgtccttgggctttttggcgttgttgaccccgaagaccgggaataacgctgcttgcagactgctcaaagactgagactgcagataaaacaaaatttgtcgaaattcgaagttgctcaaagactgaggcttgctcaccattcaactgtattatctcaaagactgagaaacgttgtgaaatttggaaatacattattgattgtaaaatgaaccaagacggttaaaagaatg

SEQ ID NO: 102438 - DNA, 676 bp, Heterodera glycines
  Promoter: Source sequence=SeqID_1743; Location=1..676; Strand=+; Gene= SeqID_75653
attcccgtccattaatttctggtcgtttctaacacctttctctctctctctctttctctccgttttttcctttcgtccatttttctattatttattttaattttacgcccttttctttgcgctgctgttatctttttttattggctggtaattgtgtgacaatttctttttcaaaaattgtctcggatgatggacgcgcaatttgcgaggattttttaacatgaaatgtttttttattaatttcattttttggtgataaaaatttttctccacccttcccaagagaaaaaaactaatgtttttttggattctggttgaggcctgcctgccttccttggtctattcatactctttctgtcttggtgtagaaaatccctaatttttcagtgcattttgtcataaaaatcctcgttttcttcaattatctttgtctctgttgatatatacataaaacgatgtatgaatgactttctaacagcgttttatacattcatgcaaaaagcgctttgttatttttgagcaattggcataaatttttgttgaaatttcaatttttttcaaatgcatttttacccacacaaaaaaaatgttactaaaaaacgacggcacatttttttaaatgcaattttgaaattcacaatttaaatttggttgtaacgtccccttcatcgggatg

SEQ ID NO: 102439 - DNA, 497 bp, Heterodera glycines
  Promoter: Source sequence=SeqID_21697; Location=1030..1526; Strand=-; Gene=SeqID_52309
atttttttcattgattattcatatatttttgttttgtcaccccccgcggctgtccccattgggacgggcgggtgggtggtggccggcgggtggccgaatgttttgaaaattaaaatgaaggaatacagtctgcccgccggccacaaaattttatatcatatttgttctccacatagccatagctggaggatatgctagtgtaagcattgctgttagatgagaaaaattacataataccatatagatgcaatgcttacactaccctgtctcccagctaaagacccctgccgttttttccctcaaatcattgaggttttttacccggcgggtcttcttctcaccccccacttcatcatttattttttttattgtgtcagcaataaatttacctgtaaattaggttacatgtttttagcaaaaggtttttaaaaaataactatgatttttacttaattttttataccactttgctaagcttttttcccttagtcgtcatg

SEQ ID NO: 102440 - DNA, 219 bp, Heterodera glycines
  Promoter: Source sequence=SeqID_6828; Location=887..1105; Strand=-; Gene=SeqID_63009
tagttggtgggcatgccctccaatgtgatggcttgggccggaaggttaaaaacacgtgtagggggtgacctatgcgcgtttttaactctccaaaaatggcccaaatcatcgccctggagaggggtcatgcccgatttttttttgatcggccattttctttgacatttttaactaaactcaatgggtgaatttttttttaatttaagaaagaaaacaatg

SEQ ID NO: 102441 - DNA, 199 bp, Heterodera glycines
  Promoter: Source sequence=SeqID_38608; Location=1..199; Strand=+; Gene=SeqID_67374
tatcttatcattaaacaacatttcgtcacaaatacaattttcccccccaattccttcatgtattaccgttcaattttttattaatatatttagatttctttcattttatatgttatttttaattttaattattttatatggcatcggaattataataaacggcgttgtaattttggtcatattaacttttaacaaaatg

SEQ ID NO: 102442 - DNA, 373 bp, Heterodera glycines
  Promoter: Source sequence=SeqID_8385; Location=1447..1819; Strand=-; Gene=SeqID_67886
aaattggagatattgttcataaaaattttgattttattcgcacattggaaaaactaaatcgtacagaaaaagaaaactaattttaaatcgcgcaaatgctgaccaattgctaacactcgttgaaatttgtctaaacatcctttgtcaacgtttcaaaatgacagctcgccagagaaagcgtctgttgccatatgccaattttgttcggagtcttgctcgacgaagaaccgagaaaggagcccgcaaacttttagttcaaaccggaggcggactaggcggggtctttgcggctctgctcactccaatattaatagatttgacgcgctccgctataaattcaagcgcaatttccgagaagtaaccagttaagatg

SEQ ID NO: 102443 - DNA, 589 bp, Heterodera glycines
  Promoter: Source sequence=SeqID_10118; Location=3033..3621; Strand=+; Gene=SeqID_73209
aacggacggatcagacggacggatcattggaagaaccgaggaaaagattttttttaggggggaagatgttgggaccggtactctattgtccgcccatattattttcattcctttatttctctccccttattctctcctctatctctcttccctgttgtcccccataaataccctgcgtcctctgacctccccgtcattcagttgtcaaccatttattttgcttatattgtctcaatcaatattcgccctttgtcctccgtccccttctctttatttatttatttgtgtctcccaacttgaataaaataattgtttattcacttcgccggtttgggattggacggcacaacattggcgacgccctgccgacatcgaactcaatcatctcgactttttgttttggttttgaacaaaacaattttgattgttcaacctttcagttgttgttcatcaattgttaatcgtcgtgagcagtgagcatcaaaaaaaaaatggccgaagcagcaattcgccaactgtccgacgtgttccagcagttcttgactgctcagcaagcaaacgcggcagcaccagcacaaccgactcaatg

SEQ ID NO: 102444 - DNA, 438 bp, Heterodera glycines
  Promoter: Source sequence=SeqID_44306; Location=869..1306; Strand=-; Gene=SeqID_71803
acgatgagcagcgcctgcgccttgcgcccgtcgtcggcgatgggtcgtcgcttcgacggaaatgctataactatccattaccaccattgccaacaacagtaacaacaacagcagatgaagcggagctgccggacagcacaacatccggcattaattcgggtggatttttgggaccagggttgaagcaataggacgagaaaatgccgggatatgtgactagaaaatgccaaaaattggggctagaaaatgcaggatttggggaaataatgtctgggattcgtggcaagcaaatgccgggattgggactgaaaatgccaagacttggggatagaaaatgtcgaggatttggggtgagaagatgccttggatttaagacggaaaaatgccgggatttgggacggaaaatgccgatattcagaccccgatttgtcctttatg

SEQ ID NO: 102445 - DNA, 631 bp, Heterodera glycines
  Promoter: Source sequence=SeqID_20643; Location=1473..2103; Strand=-; Gene=SeqID_51196
tagcaaatatatatatatatatatatatatatatatatatatatatatatatatatatatatatataaatgcaatttgatatttcacattaaacaagaaaattaaattaataatagacactgtttcaaaagcaattactatgagaagcaaagaaattgaattaatgatacagtaaattactgttatttaattaaatttttacatgagaagttggcaaactaaaatgatattatgctccatttcaaattataaacttatgatttttttgtctactttaccaactttccatgggcaaatcgtgtaaaattttgcctctattccatttcaccgcgaccacaaaaaaatagacatgaccttaaaattttttgacaaacgttaatgcattatgtataactttttttagaatcatccaaatgaataattttttgaagttttctggccattattttttttaaacagaacaaaattttttgaaattttacagactaatagaggaatcttaggactgtctaatgatactaagaatgtttaatttggatgcttctagaaagggctatgttgcattaaagcaacattttaattttaagcaattgtttattttttaattagagtaaacattttttgcattatg

SEQ ID NO: 102446 - DNA, 149 bp, Heterodera glycines
  Promoter: Source sequence=SeqID_14183; Location=1149..1297; Strand=-; Gene=SeqID_78197
aaaatacgaaatgaaaaaaaagcgaaatgcgaaacgccgtaaatgcgaaaagcgaattttttttttaaattttaccaatagcttttgaggttgtgatgcaaaaaaaaatctgcattttccggttcgatctttttctcagataaaaaatg

SEQ ID NO: 102447 - DNA, 225 bp, Heterodera glycines
  Promoter: Source sequence=SeqID_20678; Location=1931..2155; Strand=-; Gene=SeqID_51239
cttttctgtcttattttaaattttcatttagtaacaaccgtttatgtttgcatttcattgtcaaattgcgacagctgaccattgtttttcaatgaacaaaagcactcccattagctgattagatgtcctttatctgctgcaaaataacaattgctcattttgttatttctttaatttataaaaagcgaatttagaaaaaattatttaaaaattgcccaaaaaatg

SEQ ID NO: 102448 - DNA, 116 bp, Heterodera glycines
  Promoter: Source sequence=SeqID_2646; Location=1051..1166; Strand=-; Gene=SeqID_80877
gctaaagtaatttaaaattaataaaatttcattataaaaaagaaaggaaatagaaattaaaaaatgaatgcttaaaaatataaaataaataatattatgtagagattataaacatg

SEQ ID NO: 102449 - DNA, 689 bp, Heterodera glycines
  Promoter: Source sequence=SeqID_17763; Location=1..689; Strand=+; Gene=SeqID_82301
aatgaccattaaatttgatagattaaaaaccataaatggcattttcttttctttttttaaattttgttttttcctaaaaaataaatgccaatttctttccttttattttttaattttgttttttccataaaattcattcactttctcactgaactccgcttaattagcattctgttcttcttgttttcttctttatctgtcctttcacatgataaacaatttttgagaatgcacgtaattagcaaacgcaccggtgaacaatttgaaatgccattcattcggtaatttttcttttatctaaaaattttcgaatttccaaaaactaaggcctgtaacaaaaaaaatgtagttcaaaaagctgccattcaaaatttgtgaatagcccaactaatttatttcaaattccctccctcttctatcttatggtaatcacgtgcttttgccaatttgaagaatttcttttcttttttcaatttaaccattttgtcattcctttttttgaaataaatgtctattaggaaaaagctccattaattcattaaacaataagctttttcatttgtcaaatacttaaattgtgtgggtgggtgggtagtatataatatattctataaatattctgtaggatcagttaacatttactgaaatcaaatttaaatattcatcggcaaaatactacctgcaaaatg

SEQ ID NO: 102450 - DNA, 1003 bp, Heterodera glycines
  Promoter: Source sequence=SeqID_1036; Location=1975..2977; Strand=-; Gene=SeqID_66643
aaaatttaataaaaaattatatatttcgccgatatatgaattaagattttaaataaaaaagttataaatttttatttatttttagttaaaaaataaattttataatttttatctgtttgttttttcactccaattatttttagcttttgcttttcacatcgcttggaccattttttgcatcgttacttatttaaactaatacaaataacacattaacaaacaccaaaaatttgtaattagtctgctaaatggtaataatttgcaatcaccaattttttcagttttggcatttgtccgctttccattcagtttggcattcctgttggagattttaatttaattaagatatttgttttaattttaaattattatggcattttatctctatttattttatgtttgttgacctctttaatttatgtttggtacttttcacttctcattattctcattaatttgttttccaaaatttcctctctaaatttcgttctcaatttgcttcacattggtgatctcctcggacttcaaaaaaaaatattgtgtgtggctttgtcttcgtgtgtttggtctccaccccccaattcaattgaaggaaaacggtttttctttcctatttggcgctcctgaggaacagcaggtaaacggggaaaggcgagatcggaattaggtagttttgtttgaagtccgaaccggacaacaaaatcaacggaattgaattgaccctgagccagggcaaatttcaaaatttgaagaaaagaagttggagtgaagttgaagaaaagagttggagttgaagttgaaaagaagtggagttaaaaatcctgagacaggataaagggcaacaaaacgattcgagtcgaacgttttaaaattgcaacaaattcgagccgaactatcgcattcgccgtcctaatcgccacgccatcaaacgaaaaagtggaaaagtgtcgacagcggaaacttttgttttgtttttgctatacctgagccaggtgcaaaaatg

SEQ ID NO: 102451 - DNA, 992 bp, Heterodera glycines
  Promoter: Source sequence=SeqID_7657; Location=433..1424; Strand=-; Gene=SeqID_65534
aaaaagtaaaggctcaatgagtagcaccgacgaagtgaaaggacgcaaaaccgatggaaaatgagcccaaagcgctgaggacatcgcttcttagagggcgaggatgtgatatcattgttgatttaaaatatgtttggcattttgttgtttaaatttaatgtcatttttgtttgtgattttgttagtagtagttagtttatgctgtcgtcagcaatattgattgtcctcgcctattttaatttgaaattaaacgataatttttcttcggcattgtgttttatgtttgctttgggctgttgtgctttgccgtgtgctgtgcaacaacaacattattaaagtcgccctgacaacgctatctgttttttacgactctggtcagctccattggttaaataagtgaatgtaattaatattgctgttcaagactctcggtctcgagtctcgacttgagaaaagtctctggtttttttggtctcggtctcgagtctcctcgggttttcattctcggtctcggtatttgagactttcgagacgcgagaccaagacttttttacacctctaataattggctcttggtaaacttatattatataaattttaggttcttttttgttcaatttggttaacatatgcgttggtacagtgggttgggttcttggttctgttcattatttttgcaatggaaaagttacccccccccaagtatttatttttcttttcatttttcaaaattaatgtttttttttgatgagaattcaatacaaatttaacaatttttttcttctgctgcttctcctctgccctcctcctctgctgtggctgtcccccctgcttctctgccctcctcttctgctgcttctccgtgcttgccccgagcttgaccatctgctgctgctttaaaacatggggagggggtgacattttaaattacaatttgtaggaagtgacatttctcaccgaaaacataatactctaccaaggggtagagtatg

SEQ ID NO: 102452 - DNA, 80 bp, Heterodera glycines
  Promoter: Source sequence=SeqID_39575; Location=1493..1572; Strand=-; Gene=SeqID_68112
aaacttttcagatcgatgtgtccttgcattttcttctttccgtttcgccggtgatcaatcgaatgctcagcgtggacatg

SEQ ID NO: 102453 - DNA, 327 bp, Heterodera glycines
  Promoter: Source sequence=SeqID_13334; Location=528..854; Strand=-; Gene=SeqID_77199
tgtttttctgacatgaacatttattaagaaaaatcaagtacttgatgaaaaatcatacactaattcaatgatttttcgaattctggactcagatccgtaatcagcctatttttttacatagaaaactagaaaagaaaatttttaaatttatttttcgccgggacaccaattctccactattacccagcatcatgtgcagaaaatgctaatgcgcagagttaattaatcgattatttttttaaatgtcaagtatatatatatacgcacttattctatgaatttatacaggaattgcggtccattttattggatccaaactcacaaatg

SEQ ID NO: 102454 - DNA, 1003 bp, Heterodera glycines
  Promoter: Source sequence=SeqID_10526; Location=1287..2289; Strand=+; Gene=SeqID_73753
taaagatcgagcagtcccccccccccctccaagtagtagtgtttcttctaatttttaaattattcctttctcgatggaaattcactacaaatttaataattccgttagaattttctcagttgaaatcaaaatcaaacttttacataaacaaagtataggcaatattctgaaaattgcgcataaatcttttaataaataaggcccaaattccaaaatcataaaagcaaaaatttgttaggaaaagcctcaaattattaattttttaaatttatagaaacttttaatcaatttttttctcggcttcgcctctctggaaattttcgatctctaacaacataattattattatttttgattgcaaataatttttaccacccactaaattttgttagggaaaaaatattttttcaaagacttggtgcttcgaaaacttcgcgttttttggatttcgaacttcgagcttttgaaaaaaaaatgagcttcgtgtcgagcttctgctacatgtgtgaaaacttcaaaataagatataaatgaattaaattgttttttcattttgggttgatttttattttaaattttaaatagaaaacaataattctcctggctaatttcttcatttgcatgtcatttctccacatgaacaatcagcatcatatttcaatagaacaaattatttgaataattatttagaaagttatttaattaaaatgcataaataatcatggtctatattattttgttttaatttagccacttttgtgtaaatctttttttgttttaattgcatcgaattatgcttaagagaagttgatcagttgtattctttttatacaaagggttattacaattaatttttttattaatttaaatttatatcgataatgtttatttaaaaggaagctaaaatttattttaatatattcatactttttacaatattaaataattctcttttctttgtcaaaaattatgtaatattatatttatagaaatttagtcaatg

SEQ ID NO: 102455 - DNA, 1003 bp, Heterodera glycines
  Promoter: Source sequence=SeqID_1979; Location=1810..2812; Strand=-; Gene=SeqID_77142
aattaaattaaggacactgattaccaaaaaatggcggaggaaaaattccatttgaatttcccgggttgggacgcactgttcgccaagagccgcttttttttcatcaattcgctgcccgaaatcgattttgcccagtccaaaattttgaagagcgataagcgcgtcaaatttattggcggcttaaattttaaccgtccgtcggaaattgacgaaaaagcaatggaaaatgtaaaatttaaaaaatatatataaataaaaaagatgatgattaaaagtcacgagttccttgcttattggtcaaactcatttgttcttgactcaataatttttcaatttttcattactttccgtctcgagactaatttttggcttcgaaacatttgcttatgacttttaaccgccttctgtcggcttctttcattcagcagtgagatgaaattctgtgggcaaaaggccacaaaaatttgcacttcccggcagaagggggggagtcttttaagcaaagcgaatttctgtccaaaagacagaaactcacagagtccaaagggacaaattaaagggggaaggacatttggaaggagaaattcttctcctttcctttggtaagccttttctgacccaagggggtcaatggcttaatggtctgtattaaagggctcctgatgtcccttttacagacagggaaaagattaagactcttttcttaatctttattcaatttacacaattacaatttaatgcaaattgtttggacagaaaactgtccggctgacttaatcaaaaattgatcagtgaagaaaatggagaatgggccgggcttttataccctcacaaatcaatgggggcggggccaggcacgtgaaaaatgtgcacaagcaaagggaaaaattccctcaaaaatgatgactcataataaaaatgaagagagaaaaagagatgagtcataaaaaagaggagcgagcgaatgggaaaattgatcgatgaaaaggatcaaaaataaatg

SEQ ID NO: 102456 - DNA, 140 bp, Heterodera glycines
  Promoter: Source sequence=SeqID_2249; Location=4823..4962; Strand=-; Gene=SeqID_78708
tgttttggatcctacagcatcttttcaccctgctcgttcgcttattgtgttgtttttggccaagccaaaatgcaccgcagagagaagaatcccctctccttgccttccaaagtctgcctactccgcgcaggcgccaaatg

SEQ ID NO: 102457 - DNA, 431 bp, Heterodera glycines
  Promoter: Source sequence=SeqID_45273; Location=813..1243; Strand=-; Gene=SeqID_72603
gctaaataaaataaataaatattttacttttataaaatcataacattttatggctatacggtgtcaaacatcgccgaaaattttttaaaatttcaatgagttaacagatttggatcaaaacgaacttttttaaaggttgattgactcaattttctacgagtattcttcttttttttgaaaaaagtgtcatagcaaataacaaatttttggatgaaatcttgctaacttaagaaccaactataataactacaaaatgaaacatcacgaggaaaaaaaattacaaccaaaaatcctaaatttaactttttcgcgtattttataaacaactatctaattaaatagccgataattagttatataaaaatactgtagactttaatctttcgattgataccaaaatgaagcattgatcaagtaagaaaaaaattatg

SEQ ID NO: 102458 - DNA, 413 bp, Heterodera glycines
  misc_feature (54)..(56): n is a, c, g, or t
  misc_feature (58)..(58): n is a, c, g, or t
  misc_feature (60)..(60): n is a, c, g, or t
  misc_feature (64)..(64): n is a, c, g, or t
  misc_feature (66)..(67): n is a, c, g, or t
  misc_feature (70)..(70): n is a, c, g, or t
  misc_feature (91)..(91): n is a, c, g, or t
  misc_feature (98)..(98): n is a, c, g, or t
  misc_feature (113)..(114): n is a, c, g, or t
  misc_feature (125)..(125): n is a, c, g, or t
  misc_feature (179)..(179): n is a, c, g, or t
  misc_feature (210)..(210): n is a, c, g, or t
  misc_feature (229)..(229): n is a, c, g, or t
  misc_feature (233)..(234): n is a, c, g, or t
  Promoter: Source sequence=SeqID_20215; Location=1..413; Strand=+; Gene=SeqID_85012
agtcatcgttggcaaagcccccgggttccaactgctccattaagcgacgcatgnnncngnagcngnnacngcacagccaccttaaacaccngccggangccacgcaggcgccnnagcgaaggcancggcggcaaagcccccgggagccaactgctcacgggagccacgcaaggaacggnagccgaaacggcacagccaaccgaaacaccngcaggaagccacgcaggcncccnngcgccggtagctgctagtgcacagccaatagagactcattccccgaatgccacgcatgcgcctttagcgaaacgatcgttggcaaagcccccgggttccaactgctgcacgggtgccacgcatgttccggtagctgctactgcacagccaaccgaaactcctgccggatgccacgcatg

SEQ ID NO: 102459 - DNA, 285 bp, Heterodera glycines
  Promoter: Source sequence=SeqID_17302; Location=1160..1444; Strand=-; Gene=SeqID_81778
atacaaaagtgattagaagaggtgcaaccacggaagggaaaggcacaacagtgatttgaagaggtacaacagtgattagaagaggttcaacagtgattaaaagaggtacaacagtgattagaacaggttcaactgtgattagaagaggttcaactgtgattaaaagaggtacaaaagtgattagatgaggtgcaacagtgattagaaggggtataaaagtgattagaagaggtgcaacagtgattagaagaggtacaacagtgatgagaagaggtaaaacagatg

SEQ ID NO: 102460 - DNA, 767 bp, Heterodera glycines
  Promoter: Source sequence=SeqID_15681; Location=2876..3642; Strand=-; Gene=SeqID_79991
ggtttttgaaattttgaccagatcattttggtctaacattcgttcaagattccatgcggcggtagacaaagaaaggtcctttcttggatttttacaatctatgacaatttaaaatgcgtccaattgcttatcaaaatcttcgcaaaatatttgttttaacgggtctttttttataataatagataaggttcgagtctcttctacgtcacataaaattttaattataaattgttggacaaaaccaaaaattgtaggcggagctcaaggagactaaaaggtttacagcgtcccgattacttttttgggtgagcccggcccagtacattccttgactgaacattttaaagaatttgggatcactgcattttgttgtaaattctaattgaaatttcctttttttcgtaaaaaattgcataaaactattacactgacaatcaccgtacaatcattttttttaaaatatgccaaattattatattttatttgcttatttcaataaattttgggtaaatcaatgattcagtcatttgccacaatagacagatgagcattgaaaagtgcacaatttataaaaatcacatgccaaattagggcttcacaaaatgacacgcaatgcttatgctgctataatttctattttaaacaattacaaaggacattttcaaattttattttttcattttatttaatttattgcattactattttatttttaaaataatatttttttgcttttatgtatattaaaattaattaaattttagatg

SEQ ID NO: 102461 - DNA, 715 bp, Heterodera glycines
  Promoter: Source sequence=SeqID_9211; Location=2007..2721; Strand=-; Gene=SeqID_70615
acattctaaaaaacgaagaaatcccgaatataaaattaaaaaatccatccaaattcgaccatttttacaatgcggtacggtacctccccgcgcaagttcagggcgtgggtaattttttaaattattttttggccatttttgagtgcacctcctttgtgaccacccaacacagtgcaaaacccactttgtcaacgattcgtccatttggcgcagtgtttgtcggatgccgtcgaagggtttgctctgttcgcgcaaaaactcgcgcattttttccaacggttccttgtacaaatgtgtgtttgccaagtctttcatctcttgcgccgcctctttgatgtgaaacgcaacgcacgcgacgccttcgatcaccgtttcgatgtttccggtggcattttgtgccggatactttgtggggggggggggtaatcaacggacgaatgtaggtgaatgattaattgaaatccaaaaagtaattaaaaaggcattaaatcgcagccacctttttttgccataaaaacgatgccactatcaaaaactttcccatttttaaaaacaaaaaagtttgtctgacggcgattgtctcaaaagattttcatctttacgcacttggaagccccaaatgagcatcattaggacgatgatgttccggagtttgcccgtcatcagtttgggcagcgcaacgaacagaaggaaacgcaacggacggaaagcgatg

SEQ ID NO: 102462 - DNA, 605 bp, Heterodera glycines
  Promoter: Source sequence=SeqID_37888; Location=416..1020; Strand=-; Gene=SeqID_66866
tagtgccgtgttttaaaaaatattgccgaatcggcaataatgcgaaaaatggtaaaataggagcgaaaatttgaaaatcagtgcgttttttcaatgaaattaaattaaaatcgatgaaaataacttattgagaaaattaattacaaaggaattgaatttcattcttttttcgaagcaaaaaaataattggggtttctacagaaaattctttttttcagttttttgttagtttgtattcttaatcattttttcatatctttgatgaacctattcaatgttaagattttaatggttaaaaattgaatgtcaatctttgtgactagtaattttttcgaattttcaattagttatttttgtcgatggcttatagttttagtaaaacttattgataatagtggaatttttatgtatataatatttttgactgcgcggcgcaaaagtccatttttgctgggcggcgcaaatgtcgcggcgcaagtgtcgactttgctgagcggcgcaaatgtctcatcacgcatttttaacgtaaaacaaaacatttacatttttcaaatcattttttaacgcaaagcgataacaaaacgaaacgccacattcaaacgatg

SEQ ID NO: 102463 - DNA, 1003 bp, Heterodera glycines
  Promoter: Source sequence=SeqID_6665; Location=2126..3128; Strand=+; Gene=SeqID_62393
cgccgttttgtgctttttgcttctcatcgaagtcgcctttgtgccaattgtgaacagtgcgccactgtaagcactttctgtgcttaattgcctcttctatcccatttttgccttttccaaaaagtgagcgggaaaaacggctgactgccagccaattgggcaaaggcgccgtcgtcggtgccggcgtcggcttagtcggcgccgcactttacgccggcggcaaaaagttttggaacaaccgaaaagcaaatgctgcggcaggtaaaaaatggactgataaagcaaagaaaagtaattggaatttaagccgacgcaggcggagccgacgcggccaatttaaaaacaaagggccgaaaatgaaaggatgccaaagaaagacagaaaacggagagaattttaaatgaaatttatgaaaggacagataaaattttaaaggtgcaaaagttgagaatgttttaaaataagaaataaaaaaataaaaagaagaaacagcaattcattagccaattgctaaaggacttaaaatattttaagaattcattgaatcttaaaataactttattttatcttgccaaatatattcgactaaatttaataaaataattatgtttgctttaatatacaaaaaaagaaaaacttccttttttctgcccattaaaatcaaatgatggaagcgagctgagcaaaaacggccaactcagcccacagttattcctttggaggtgtctatttttgtttgtttgtgaacattgcaaatgatggacagtacgaactcattagtgggtaataatcccttgcccgtaattgtgttcgcccgctttaatggcggtgtttatgcagcgggggggggcaaaatttggccattgctaagggcgccattcgttgacgccaccttttttggccttataaataatcgcaaaagaagcgcaaatgcattcattccctcaaaagcaaagccatccatccatccgatcattcgcttcatctgccaatccgcaaaatg

SEQ ID NO: 102464 - DNA, 928 bp, Heterodera glycines
  Promoter: Source sequence=SeqID_14699; Location=1484..2411; Strand=-; Gene=SeqID_78815
cctgaatcgtttggaaaaatatgtgttagcttttttattttttgaaaattttctaccgacaatggaattgatatcccctaaatttttaaagccattttcaactaattaattttgtcgggtatttcctgaccgatccccgaattttctctccccagaggccggtagatactctaccattaagttccaaaaattacaaaacaaaattattttcttcaaaattaggcatgtaatccgcccaaaagtgtgggaagaggcaacttggcactcaaacgatggtggtgggacggccgtagttgtaaggtacaacaagcaatcaaacaatttaatggatgagataagcaccggcttttcccattttctgatttttgagatttaagcaattcacctacaaagggcagggcggcaacacaaacaatttcccatcaaagaagcattgtgtccaagtgtgcaaggtgaagttgcacggcattatccaattgagaagggcaccatgggggggggggagagggactgtttgaatgagaaaatgagagatgacgagagagtgtgtggaaaggagaggagacataagagaatccagtagttagagatcgaccagagattgggggattaaaatgagaaaaggaaagatggagagagagtgtgtgggaaggggaggagaaaataagagaatacagatagatgaagatcgaccagagattggggaattaaaatgagaaaaggaaagatggagagagagtgtgtgggaaggggaggagaaaataagagaatacagatagatgaagatcgaccagagattggggggggggactgtttaaatgagaaaacgagagatggagagagatagtgtggaaaagggaggagacataagggaatccagatagttagagatcgactaattgattgcccaattttcagccttgaaatg

SEQ ID NO: 102465 - DNA, 690 bp, Heterodera glycines
  Promoter: Source sequence=SeqID_500; Location=1702..2391; Strand=-; Gene=SeqID_54540
ggcccaacgtgaagtcaatggccaagggcgctggggcccatcgtgaagtcaatggccaagggcgctggggcccatcatgaagtcaatggccaagggcgctggggcccatcatgaagtcaaaggccaagggcgctggggcccattgtgaagtcaaaggccatgggcgctggggcccatcgtgaagtcaatggccaagggcgctggggcccatcatgaagtcaaaggccatgggcgctggggcccatcgtgaagtcaaaggccaagggcgctggggcccatcatgaagtcaaaggccaagggcgctggggcccatcatgaagtcaaaggccaagggcgctggggcccatcatgaagtcaatggccaagggcgctggggcccatcgtgaagtcaatggccaagggcgctggggcccatcgtgaagtcaaaggccaagggcgctggggcccatcgtgaagtcaaaggccaagggcgctggggcccatcatgaagtcaatggccaagggcgctggggcccatcgtgaagtcaaaggccaagggcgctggggcccaacgtgaagtcaaaggccatgggcgctggggcccatcgtgaagtcaatggacaagggcgctggggcccatcatgaagtcaaggccaagggcgctggggcccatcatgaagtcaatggccaagggcgctggggcccatcatg

SEQ ID NO: 102466 - DNA, 751 bp, Heterodera glycines
  Promoter: Source sequence=SeqID_3612; Location=1589..2339; Strand=+; Gene=SeqID_51108
ttaatcttcctctcggggaagcttcttcttctctatctcacgtccataaatttttacacgtcccctataaaaattttactgccgcaagttttttcgcgtccataaatttttcatgtctcaaaaaaatttagatgttccataaaatttttgtgcatcctataaaatttacgtgtccaaagattttcacaataaatttttactcttcacacgtttttacgcgtccataaaaatcgggctataaaattttcaaggtttttacgtcccgcggtgttacgattccataaaatttttaacgtatcataatttacgcatctcattgtttttacgtgttctacaaattttatacgtccctttaaagtttttactcgccgtttttacgagtctataaatttttcacgtcccaaaaaagtttagatgtaccattttatacgtccggtaaaattttacgcgtcccatttttttttacatattcatacacgtcataaaaaaattttaagcaccctacgctttttacatgtcccataatttttacgcgtccaaccgtttttacgtgtcttaaaatttcacacgtagtataaataccgtgtcccatagtttttatgcgtccaccttacgtgtcccatcgtatttacacgttttaacaaaaaattcttttaaaaatagataaatgaattttgttggttcatttcaatttgtaaattcaattatgaaatattataaattaataataaataaattcccaccaattatg

SEQ ID NO: 102467 - DNA, 316 bp, Heterodera glycines
  Promoter: Source sequence=SeqID_44134; Location=38..353; Strand=+; Gene=SeqID_71666
ggttggttggtggaggcgaaattaatatgaaaatggaaagaatccaaaacgccttgaaaatttgaaaaaattgaccctttttggttttttttgaacaaaccagttaatttttgctatttcgatttgattttatcaaatgaatattctaaaaaattctaaaagggtacaacattcttgggaacttttgatgaaattggtaggtatttttgcatttttaacggatgaaatttcaaaaaatcggttaaaagtcctctcaaatgcatttttctttcattaggaatcgatgggactgtccgacggcgactcggccgaaatg

SEQ ID NO: 102468 - DNA, 63 bp, Heterodera glycines
  Promoter: Source sequence=SeqID_10883; Location=1..63; Strand=+; Gene= SeqID_74164
cagcaacaggtggttatcggagtcgatcggcgtcgatgaacgtgttgaccacgcccgacaatg

SEQ ID NO: 102469 - DNA, 196 bp, Heterodera glycines
  Promoter: Source sequence=SeqID_7617; Location=1265..1460; Strand=-; Gene=SeqID_65421
actaattgaggagggaagtaattaacgtgcaaagcctcttttgcaattattattataatcataatcctattttgataaatgattccaaattaggacctcaaatccaaacacaatttgagcgccggccccccgcatcaaagttgtgaagaaagcgtgagaaatgaagtaagagtcaatggcactgagaagggaaatg

SEQ ID NO: 102470 - DNA, 183 bp, Heterodera glycines
  Promoter: Source sequence=SeqID_4372; Location=1..183; Strand=+; Gene= SeqID_45790
gagtttccaaagttggaggatgtgcatccattttactcggatctgatgaacattctctatgatcgcgaccattacaaaattgcgatgggacaaatgaacacggcacgccatttggtcgatggaatagcgcgggaatatgtccgactgatgaaatacgccgattctttgtatcgttgcaaaatg

SEQ ID NO: 102471 - DNA, 638 bp, Heterodera glycines
  Promoter: Source sequence=SeqID_17505; Location=1..638; Strand=+; Gene=SeqID_82012
aaaaaatttttaaaacagcaaaaattaataatatataaaaaaatttcatgtcttaatatctgccggattaaaatgaatgaagaaaattttaaaaataaatctccattcatagccaatattattttgtgtttgtaattcattttggccggagtttggtcgatatttggcattatggtgattcctttgatcggattagagtcaaaaacctgaaaaatttattttaattaataaattaaattttgaatttaaacataagggtgaagattttaaaaagtagtttaagaaaaaattaaaagttatatataataaaattaaaattaaatcacgcaatttattattaatcccaaggaactcattaaacttgtctctataaaagaatggatacttacatcgtttttaatttaatttcaattatatgtatgagttctgccaaaatgaaagaaattaagacgaaaaataaaacaaaagactgaagaaaataatataaaaaaacaaataaatttaatgaactgaataattaacaaaatatataatgattaacataagcagctttattttggtaatacttcaaaacttgtttaacatattcgattcatttaaaaacaaaaaaaaatagaaaaaaagaattgcataacatg

SEQ ID NO: 102472 - DNA, 162 bp, Heterodera glycines
  Promoter: Source sequence=SeqID_7072; Location=1..162; Strand=+; Gene= SeqID_63748
atttgactaaacaattgatgattgaatgggtggacaaagtgttgtatcccgctcttcgcccacaacaaaaaagtctattggttgttgacagttggacgggatggaataattttaatccaccggacggaattgaattgaaaattaaacaaattcccaaacatg

SEQ ID NO: 102473 - DNA, 376 bp, Heterodera glycines
  misc_feature (273)..(273): n is a, c, g, or t
  misc_feature (282)..(282): n is a, c, g, or t
  Promoter: Source sequence=SeqID_4117; Location=3769..4144; Strand=-; Gene=SeqID_53250
aaaattatttagaaagataaaaaaccttttccggttggaaggaaaagggaaaaatagtataaaaaaaagaaagaattatttttgggttcaattcggcatcaaaaaacgtcggccccaaccataataattttattgccccaggacggaagagataaattacttcatctttcttttcatatggcaatttaaaagtcatgacaaaatgtgacgataattatattgaaaatttttttgactttttaattatttatttgttgaaataaataagaaganccgttaatngttgtcaattagtggtcttgaaagtgttttaagagtgagtcccgagtttttgccaaattctattaattagctcattaacaatgtattatagatg

SEQ ID NO: 102474 - DNA, 647 bp, Heterodera glycines
  Promoter: Source sequence=SeqID_31120; Location=1..647; Strand=+; Gene=SeqID_61498
tagagtagagcgggaccgggaattttgggcaaaaccgggaccgggacttgccgggacctgagaagccgggaccgggacctcgatttttcttcgggaccgggaccgggaaccgggaccaaccgggaaattttaaaaattcaaaaaattcaaattttaatttatttcaagtgaaaataatacaaaattaaattattattttttatttaataaaatccgaaagttaaagctaaattaaattaaagaaaattttcaaatcaaaatttcgtcaattattttaagcaattaatcatttgggctaaatggtcgaatattatttgaaatttagatttacttatcacaccacttttttcggcgcgctttttccagaaaacttttgggaagaaaggggttcggcggtgccgataggcgccgccgggggaaattttgaaaatttaagtgcgatttgatacagattttcaacaaaaatggcttcttttttgggattattaggctcaatttgtatggattttctttaaaaaaatgataaacatgtgtcctttaaaagaaaaatataatgaatcatatttctcgataggaaaccaatgaatatacaaaaagaaaattcaaaaacccccgccccacggggctcgaaccctaatttaaatatg

SEQ ID NO: 102475 - DNA, 781 bp, Heterodera glycines
  Promoter: Source sequence=SeqID_2646; Location=1..781; Strand=+; Gene= SeqID_80878
aatttttgatggtttgatcaattttatgcgtgtttactcccattacttatttctcaatttcacatgattgttgtaccgtcctctgtttgacgcattcagaaatttccgcgtgggctaatttccgttcttgacaatgtcacgtcatcaattgtcacgttggttttgtttccgcaattgatgcagtgaaagtatttgaatttgtccgcaaatgtcctgtgctctaagcacttcccgagtctcgtaattagctaattatcgaatcagtttttcgttgtcaaagagtcctcacactttttttgtctcatgtctaaatttgtgcagcttttccaatttgttggttggcgtttggttcggtcagtcatcagttgaacaatggaattgtttaaatttaatctgccagtggtcctatcagcgatctctgcccgctgtttttgttgtctcgccgcgacgcattcatcgtcgctgcaaaatcattgctgtcatttccctatgtaattagctaatcagtgaagtgaaaaatggcttaacgcatgtggaaggccattaaaggtgtggtgataagaaagtgtgttgtgcaatgaatgcgatgataagggcaaaaagcatttaatttctctcattagttgttttaatataatttgctttgttcttcgccctaatcatttttgaattctttgcaagttttaatttttggcctttttcacataagcgaaaaatatgcctttctctcgacttgttgcttcataagaattttttctgttaaaatttatccgttaaaatg

SEQ ID NO: 102476 - DNA, 212 bp, Heterodera glycines
  Promoter: Source sequence=SeqID_14934; Location=1..212; Strand=+; Gene=SeqID_79098
aatcaaattaaaatgtgttatgtgcatataggccagcaaagtcagtagataaaagtcaattagtggtgagccgaagtgacaaaaatatcaatgtttatattatttaaaatttaattattatttttattttaattgcttaataataatcataatttagcttaaatttaatcaaatttattcatatttgaatgtagctctacatattctctatg

SEQ ID NO: 102477 - DNA, 383 bp, Heterodera glycines
  Promoter: Source sequence=SeqID_5331; Location=1451..1833; Strand=+; Gene=SeqID_57701
agtatgtggatgcgtacgcacgcatctaccgtatgtaactaaaagtattatactgtacgcattatggatttctgcgtaagcaattagaacctttctcatatagaatccggaagagacggcctgcaaaaagttttgttttgtaatcgattagtcattttttgttgccgcaggaaggtgtacaaggctatatcgattggttgattgtttataagaaggagggagttctcatttcttctcattcgttaattttttaatactaaatttcgtctcgctgtcctctatcaatattttaattaaaaaatattaagcattaaaaagcattaaatcaatgtcaactcaaccatctagctttttcaacgtcgccatgccgccccttggacatg

SEQ ID NO: 102478 - DNA, 146 bp, Heterodera glycines
  Promoter: Source sequence=SeqID_13033; Location=951..1096; Strand=+; Gene=SeqID_76814
ttatccatgcgaacaaaatgcgtttagtcaattggggaacctcggaaatgccaccttttctgagtagaaatagcaaaactatttcacacaatttcaaaataaacttttgccaaacaaaccgagtgccctcgtggtaaatgaaaatg

SEQ ID NO: 102479 - DNA, 398 bp, Heterodera glycines
  Promoter: Source sequence=SeqID_36921; Location=1..398; Strand=+; Gene=SeqID_66115
aagtgcgctaaaaatgatcaaatgattatcaatttttattttcttaattccaaaatgaattcgaacgcaaaaaattaatcataatacatgtggtaaaaatgcattaaaaataaaaaattcttgaatttgcttctgaattttttaattttaaatagaaaattactttttcgaaattttgcacaaataagaggcgaagaaattcaacgaaatttttattaggattttgatttaaaatgttgagaggtttaacaaatttgtacactgaatgttggatcgtcaacaccaatgagaaatgactaacagaaaagagggagaaaagggcgttggcttaggaaaatagcttataataaaggagagacgagcagacgatgagtgagagaaaaatagtggtaaaaatg

SEQ ID NO: 102480 - DNA, 673 bp, Heterodera glycines
  Promoter: Source sequence=SeqID_6287; Location=1..673; Strand=+; Gene= SeqID_61027
taaaaaatttaatttatattagttttatctttaccagttgaaacaaaaatcttttcggaaacctttttaatgaataattttagaaaattaatttttagcggcttttaaaaaatttcaaaaatttggagcaaactcattcagtctgcttgtatttcattcatacgtaattatgagaaaaatctaaacaatttaaaaatggcatatagttagtccgaatcaaagaataaaatgaaacttttttttggaacctttttggaaattttcaacactagtaccaaaaaaatcaatttataacgggcgccaaatagccgcgccagaaaagcaaaggccaaaaaaaccgcgccaaactgatccagacccactttggcttgatttggtattaccagtgaagaaagcaccttaatgtggataaaagctgtcccattgttcgccaaaagtgcgcctttaattgcgcaacacattgtttagcctttagatgcaaagtgatatgggaaatttttgagttccggtcccggtttaataaaatacaaaacacaaaaaaaaatatacaaaactctacttaataaattaatgaatattatgatattctatcgatgttaattaagattataataattcttttctgcatatacatatatttcttttttacaaaaatatttctcttaatgaaatg

SEQ ID NO: 102481 - DNA, 262 bp, Heterodera glycines
  Promoter: Source sequence=SeqID_6750; Location=2259..2520; Strand=-; Gene=SeqID_62738
ctttgcagttttgtaacccccatgaaattttcaattcatttcgagggtaatttgtggggctgatcacgaatgacctttgttctgctcaaaaccatctttttcatcctttttatgggaacagtaaaggcaatgattactcttcgcccataaatataaagttttttccaaaaaagcacactctcttcgctttaacattattaatgtttgctattattttctaagttttattttccttcaatcatcggctaataaaattcaaatg

SEQ ID NO: 102482 - DNA, 811 bp, Heterodera glycines
  Promoter: Source sequence=SeqID_3970; Location=893..1703; Strand=+; Gene=SeqID_52626
aattggaaaacccgaccgtgtgtcagtctgctcatcagcagggaaaggtttcgctagcatatataaatccgttctctgctcatcactcataaagcaaatgcacataatggcgccagagggacaaaagagaaaagaaaaaaaatatgagatttttaggaagggatgaagagagaaaatttcatggatttttaaaaaatttagtaatttataaagaaacaaacagttttataacagatttaattgttcgtcatctcgattctcgctgttccttattttgcgttgtgtcagttcctctccacacctccaaatagttgtttttttttctaatttgcaaaattattttcttttttacttgtaaattttgaaatttataaggtaaatggcatttctaaaaagaattaatttaaatttgatgaaaaagttgatcatttttgaacgaaaatgaaagatgcacatactcatgaccttgattgttaattaaatgatttttctgttctttctcgtcaatttcatagtcagatttaatggaaggggcaattaaaaataacattaaaacttttatttatttattatgcataagtaatttaatgcagaaatttatgtaaatttattatttgctaaaaatgagaattgcttaactatcattcgatcagtaattattattcaaaaagtggatgtatagtcaacaagaataattatttttattaaatataataatacaattttaatttatattaatttataatgaaaattatttaaaaagtaaaacatatttccttgattttttataaatttgtagaattaaaaaatg

SEQ ID NO: 102483 - DNA, 629 bp, Heterodera glycines
  Promoter: Source sequence=SeqID_19723; Location=1..629; Strand=+; Gene=SeqID_84466
cataaatcgcgaaatatggaaaatatggatatggaaacccatcctagaagcttcaaaccaagctaaaaacatgttgttcgtgcgtttcaggccctcaacagtccaggaaaaaaatatggatatccatatgattgccatccctagtgatcaatgatcagcgaattaagcttaaaaatcttaaatatcattccttgaaatgaaaatgctaattagtcattaaaacaccgcaatttgcttgaaaaatatttatttttaaattttttatataattcattatataatttaacaaaaattagtttaaaagatcctattttttgtttccaattttaaaattgatcttaaaatttccaagttttaaaagacatcaataaagcattaaaaaagtaaagtgctaattaggcaataaaactccgcatttgcgtgtaagaatttttcttttgaaaattcatttatataatttaacaaaaattagtttaaataaacctagatttggctaacaatttaaaaattacaaactctggaaccatttcagtataagcttattgcatttctcaggtacgctttacgatggtgccacacttttctccattgcgcttccggcacatttgctgctctcgatcatcccaatg

SEQ ID NO: 102484 - DNA, 124 bp, Heterodera glycines
  Promoter: Source sequence=SeqID_43901; Location=1108..1231; Strand=-; Gene=SeqID_71467
cacccgtgcttttaggttggtccgcgagctgtacggcgtcaacgtgaacatgcgcgtcggcattcacagtggcaaagcgcactgcggggtgttggggctgaagaagtggcaattcgacataatg

SEQ ID NO: 102485 - DNA, 127 bp, Heterodera glycines
  Promoter: Source sequence=SeqID_16434; Location=900..1026; Strand=+; Gene=SeqID_80844
tgtgataatttttggcattgaaacgtaaaatccccggtaatttaaggttattgttcacatttttcccgcctatactgcgatacgatggatgtctttgggaaggacattcaaacggattcgcgaaatg

SEQ ID NO: 102486 - DNA, 613 bp, Heterodera glycines
  Promoter: Source sequence=SeqID_4542; Location=914..1526; Strand=+; Gene=SeqID_54832
attgttacttcccctgatcggtcacacggggttcatttatgagcgcccatctcgccaaaattattattataaaatgggcgtggcacctggcccgacttttttgcgtataaatacgggctcaccgggtggcatttttcatttggcgtcccttttcaaattcacaattcctatggcgatcaacatctccgacaaaaaatcgttgtgcaaccaaatcctcggccaaacggacctcaccgtgacctcgagtggtataaccatcagcggtccccgcctctcgacaccccgcttcattccttttgatgaagcgggccgttgtaggtgttgtaagggaacggagtccgaaattgacactgtgatcacgaaagaaggcatcacgctttggtgcacccgcatagagaaggcccaattcatcccgttcgatgttgtgtatgatttaccgggacattgttttttccgtctgaaaaataagtctcgtgtgttcaacataccctatggcgacataccctcttctgacacgcacaccactaaacgacggacacacaccaatgaccatcagcatgaactgaagcgcaaagcaaaggtagctcttgacttagtggaggccggactaatg

SEQ ID NO: 102487 - DNA, 157 bp, Heterodera glycines
  Promoter: Source sequence=SeqID_22084; Location=862..1018; Strand=+; Gene=SeqID_52729
tgtcgaagtgaatgaaagctgtgaaatattttgtcaatctaattcaacttagtctttaatgccgacaaacttggtaaattttgtgtgataaaatgggagcttttattcgactgaatcgatggctattttcagaatcagggttttttatgcgaaaatg

SEQ ID NO: 102488 - DNA, 125 bp, Heterodera glycines
  Promoter: Source sequence=SeqID_6665; Location=4574..4698; Strand=-; Gene=SeqID_62394
ttgacaaaagtttaaacaaaaaacggcgaaaggtcagacaatttgacggaattcgaaggcgaaatggcaaataaaaggggagggaattgcgactcggacaattcattctcgtggccctcaaaatg

SEQ ID NO: 102489 - DNA, 307 bp, Heterodera glycines
  Promoter: Source sequence=SeqID_22219; Location=1251..1557; Strand=+; Gene=SeqID_52890
tagtttatttgctaaaatcaagcttacaaaaagcggttaggcatttaaaatttaagctccgtaaaaattcaattaaaaatcatcacatttatttttttaatttttcaatttttaaatttttcttttttggcgaactgtctacccttgtaacttctaaaaaaggagttgagactgaaatcccgcgccagatcccgtcccgacctgtctctgttttccatagtgaacaaataattattgttgtatttttactctttcgctgctccacacacatctctttcatgaactttagacaaaaagtattttaatg

SEQ ID NO: 102490 - DNA, 157 bp, Heterodera glycines
  Promoter: Source sequence=SeqID_12096; Location=1796..1952; Strand=-; Gene=SeqID_75655
ttttgttgagtggaaattattaagacagttttcgtttcggatttcaattggcttagcaaagatgaaaaaattatgtgaaatcgaccgtttcttttacacgaaatgtaatttttgactcgattcattaatacaaaaacatcctacagaccaaaagatg

SEQ ID NO: 102491 - DNA, 103 bp, Heterodera glycines
  misc_feature (31)..(32): n is a, c, g, or t
  misc_feature (84)..(84): n is a, c, g, or t
  Promoter: Source sequence=SeqID_8658; Location=1..103; Strand=+; Gene= SeqID_68788
aatggaagcgctgaagaaagtgatcgattgnnagcagaatgccgccattgacactgaacattcgctgtcctcaaaattgccgcncaattgttgccaggaaatg

SEQ ID NO: 102492 - DNA, 1003 bp, Heterodera glycines
  Promoter: Source sequence=SeqID_9678; Location=437..1439; Strand=-; Gene=SeqID_72305
aagaggatcagattcgtgctaatttgtaagcgcctcggattacccttgaaaataactttctcgcaatctattaaaaaaacaaatttcgggaccaataatctttaccattgcccatggacggtaaaaaacgaaaaaaattgccaaaaaataattggcgtaaaacaaaacgccaacacacgcaaaaacaaagtatatgcacttacactggtaaatgccttttttgtattttttattttgatcagccataatacgcttcattcccaacaaaaatgaacaaatttggtatctaaaaaaagattttgaaaaggagaatctttttctaagtgaatgctaagcaatttgacatctcagaaaaaagttgtgagagtttcaaatgttcatcacgttataactcaagtcctaggcagctctttctaaccaaaatgctaaatttattcttttttctattgattctaaatgttcaaagtgattttgtacccttataacaaaaattattagaattttcgaatttggtgttttttgtgtgttagagatgtgaaaatagtacgccaaaaggagaggaaaagaaatgcaaaaattttaatcactccataactttttagttaaccctttttttgctcttaaaaacccttacatttcgttcctaatttttttctctatcgatatcgcaaaatttggtgtggatttaagaaacagaaaaaaagttaaacaggatgaagtgaatcgttgctttttacataattaaaatgaagagatagtacgccaaagtgagagaaattacaaagaaaaagagaaacgacgagatagtactaggcttttctctgcacagtggagttgacccatagtgccaaccctctgtgtcggttttttttaaattggcgttttgtctcttttgctgacttaatttttctctttagcttaagcctatgctttaacaatcgcttatttttctgttcttcaaatatattttcatttccttacatttattttatcagtgctaatg

SEQ ID NO: 102493 - DNA, 82 bp, Heterodera glycines
  Promoter: Source sequence=SeqID_4318; Location=1..82; Strand=+; Gene =SeqID_54034
ctttttaatgcttttgttgaggggcccaagccaaattgttttttttatggggccgaatggacagctccacccgtcaaggatg

SEQ ID NO: 102494 - DNA, 117 bp, Heterodera glycines
  Promoter: Source sequence=SeqID_7617; Location=560..676; Strand=+; Gene=SeqID_65422
tctgaataaattattttatgtatttgttcgtttcttagaaagattctcatatttctgtcttattgtctgtctgttccttcgttccatcagttcctttaagaagaaagaaagagaatg

SEQ ID NO: 102495 - DNA, 468 bp, Heterodera glycines
  misc_feature (12)..(12): n is a, c, g, or t
  Promoter: Source sequence=SeqID_44868; Location=1..468; Strand=+; Gene=SeqID_72279
tgtccgtgtttntatgtccatattttgggtttcccataaacctctattagaatggcccccatcagttaaattgcgcttctgactactcctgatgatcagaaattttccgaaaaatcattttgaaaatttttagtttaaaataaacttacttaaaaataggtaaatttgtttgaaaaatatgcaaaaaaaaaagagaggaaaatttcggctttttgatccttttcagagctttttttccttataaacgacttttatacggtattcagccattttacatgaatttgaaggaattttggaaaatttacctctcaattcggaaaatttatgttcaatttttgcaatattatgtctatatttcgcgatttttggtcctaaccaacataattcccaaccctaaatagcatacttaaaaacgcataaaaatacttaatattgatattaaaattaataatttaattttcagtaatg

SEQ ID NO: 102496 - DNA, 71 bp, Heterodera glycines
  Promoter: Source sequence=SeqID_3023; Location=1190..1260; Strand=-; Gene=SeqID_82813
gaaacacaaaatctaataaaaacattttttgggttttaattgtcccttcccaggttattttgctccaaatg

SEQ ID NO: 102497 - DNA, 169 bp, Heterodera glycines
  Promoter: Source sequence=SeqID_16702; Location=875..1043; Strand=-; Gene=SeqID_81100
ttttgagtgggggggaaaggcattttgaggggatggcgccgacccaagtgaccgagtaaatcgggcgaattggcttccttttcttcgacgtgtctcagtttgtcaagaacagcgccaaattggtcctccacgattttatttgccattgccattggaacggcgggccatg

SEQ ID NO: 102498 - DNA, 209 bp, Heterodera glycines
  Promoter: Source sequence=SeqID_8460; Location=1315..1523; Strand=-; Gene=SeqID_68152
tttcaccaagaatgaatgttataacgactaatttcacttttatatactcaaaagttgggccacgcccatcatttagttactgattagccccgcccactctcacctaaataattcacctgactaaaaaccgaaatcattttaatttgtctgtccaaacccaaaatcatccttcattaattccaaacaccaaaattattttatacaaaatg

SEQ ID NO: 102499 - DNA, 151 bp, Heterodera glycines
  Promoter: Source sequence=SeqID_7087; Location=688..838; Strand=+; Gene=SeqID_63804
gatcagcgaaacaacaatcgaagtgtttccctgcgttccaatctccctatccaacatcagctaccgaacaacaaaggactgctacaagttcatccctgtcacaatccatctgccaaacacaacacaagacgcattcctcgacccggagatg

SEQ ID NO: 102500 - DNA, 65 bp, Heterodera glycines
  Promoter: Source sequence=SeqID_18985; Location=209..273; Strand=+; Gene=SeqID_83719
tttcccaggtgccaattccgtcctgttcaatgcgttcgtcgttcggcgtttggaacaaagagatg

SEQ ID NO: 102501 - DNA, 65 bp, Heterodera glycines
  Promoter: Source sequence=SeqID_30500; Location=1..65; Strand=+; Gene= SeqID_60901
caaaaataattgggcacatttttttgtttggcatttagcgacaattgcaacgaagcattgaaatg

SEQ ID NO: 102502 - DNA, 273 bp, Heterodera glycines
  Promoter: Source sequence=SeqID_32230; Location=1..273; Strand=+; Gene=SeqID_62556
taaaaaattttaaacattttttaacccacacatctattacaatttcagataaaaaaataccatacgaatttttaaaaacgaagtttctaattttggagatttttagcgtttttcgagtgcctctttttgcttttttaagctcttctcttgaaaaatatgaaaacgaaaattcaacaattatctattttgcaccagttttaattccatggaaacttttttgaaaattaaaagaaattaaaattatgagtaaatctccgtccatttgaggatatg

SEQ ID NO: 102503 - DNA, 1003 bp, Heterodera glycines
  Promoter: Source sequence=SeqID_11239; Location=2976..3978; Strand=-; Gene=SeqID_74599
aacaaataacaacaaaaacaaaatgatccacggaatatttatgccaaatatttccattttatttactgtttatgaaattattatttaatattatttattattccgaatgaaaaagaaattgtgagaagaaaaggccaacaaaatgaaaagtgacgaaaaaacacgatgatttgttaaattgtgattttaaattgaaatattgatatattttaattgaactttggaatttgtttcgccactcatgagaggaaaaacagcggaattcaaatcagagaaaaataaaagaatatgattaataggatgcggaaaattaagttggatcacccacctactcaagagaaaaatattaattttcttgtgaatctcagttttttacccccgtttttcctggggtccccggctgagtcatctgcgctttcttaaattcttgaatttttatttgttttcattccaagaaaaattttttttcatttttattatattatgtgtcaattatcatccttatttagtgacttattaattgttttatttttaattatacaaagcaccagtagattatttttaaattaattctataaatgtataagacacttatagaatattttctaatttaatagttacaattacacatatgtattaattataaaatataaaaattcaattcgccgcccctgctgctcttgagagactcggccccgattctggggaaattttagtctcgggtcttcatattagtcccgagtattagcactgctgcattcgtattaatattagggactaaaaactctattaaatgcggacaaaaaccaacctgaaattttccagttctttcggatgaacgaaagttcggaaaaattgtgccataaaaagaagaagaatggttggcggaaattaaagatgaggtggaaatgcaactggacaaaatgatttcacaagaagttcggattgatgagccaccgcagctcaaaaatgaggacaaatgattagaaaattgggacgaatg

SEQ ID NO: 102504 - DNA, 155 bp, Heterodera glycines
  Promoter: Source sequence=SeqID_10995; Location=1185..1339; Strand=-; Gene=SeqID_74303
cgacgacgacggaacagcggcaaaacgtggcgacagccagcaggacaggcggggaggagcaaaagcggcggcaacatcaaagacaacaattaacgcggaccaacggcaggaagaggaggaggaggagggcatttgtttaatgagtaaaacaaatg

SEQ ID NO: 102505 - DNA, 222 bp, Heterodera glycines
  Promoter: Source sequence=SeqID_374; Location=3932..4153; Strand=+; Gene=SeqID_84837
ggtatgcaatatattattttgaattttgaaaatcttttaaaatccaggacgcttgcacacggatttaaataacgttgtgcagaagttggtcggagttcattcgtgcgacatgaacgctgcgcatgtggaatgtcagcgtcttgtaactggactcaagcgacgtgctgctgagacgtgcgaagcacctgcgaccattcgtgctcaagtgcttcaaaacacatg

SEQ ID NO: 102506 - DNA, 102 bp, Heterodera glycines
  misc_feature (18)..(18): n is a, c, g, or t
  misc_feature (68)..(68): n is a, c, g, or t
  Promoter: Source sequence=SeqID_23476; Location=875..976; Strand=-; Gene=SeqID_54173
aaaaatttaggggcattngcctaaaaatagcatccctactaatcaatgactatattaggcccattaanaatttatttttagatggcatacactttgaaaatg

SEQ ID NO: 102507 - DNA, 142 bp, Heterodera glycines
  Promoter: Source sequence=SeqID_9624; Location=1117..1258; Strand=-; Gene=SeqID_72113
attgattttcttgctggtgtctcatacaattgttcgatggacccctgattttttgttattgtcaaattgttgaaattaaattgctttaagttcgaatctagtagcaaatgtgttaatttaattattatagtgaaataatatg

SEQ ID NO: 102508 - DNA, 1003 bp, Heterodera glycines
  Promoter: Source sequence=SeqID_3391; Location=1671..2673; Strand=+; Gene=SeqID_84500
caaatagagctaaaatttttagaccccctaagaatagaccccaaaaattttcagaaaatttttttaaaaggcatttgatcactgatttaattatgatcggtcggtcatttcttaattaattcatttcttcttcagctgatcactgtttttgttcgtttgtccctcactcatttcgcccttttgtgatgctttgtcccgcttcttctgccggtggcggagacaaaggccttaattaagcgcaaaattcaaattggataaaaatcaaatgctttttattgctcacccaatgcaattagtgccactaaaaagccaaatgaacacattgttacaattgttgttccaattttcatctttcttctgctgtagcttaaccgccgtggtctccgcaattttatggacataaaatagcaaaaatatggacataaattctccgaattgaggggtaaattttcaaaaatattcttcaaattcattaaattctattagaatacatctaaaatggctaaatacggtataagaactcgttttaaaagaaaaaaagctatttttaatgaaaaccaacaaaaaaaaaccgaaattttcctttttgcttatttttgacataaataaccaatttctaagaaaatttaaatttaatcaattttttcgacaaaattttgttaaaaaatgtctttttcggaaaattttccagtctttggggtcaaaacggccaatttagctgacgagggccgttctaataggggttttgtagaaaaatgccaaaatatggacataaatcgcgaaatatggaaaaatatggatatagaaatccatcctagaagcttcaaaccaagctaaaaacatgtttttcttgcgtgtccagaaaaaaaatatggatttccatataattggaagccctagtgatcagtgatcccggaaatccctgcctgaaaagtcaatttttgttgattaatggggaaagcgtaagtggtgaatgtttgccgaaaaaatccattttccaatg

SEQ ID NO: 102509 - DNA, 791 bp, Heterodera glycines
  Promoter: Source sequence=SeqID_19287; Location=610..1400; Strand=-; Gene=SeqID_84028
ttgggattttgtattttccgatcagaaaggaactgaggtaagaaaaaagagtcggacgagtggggggtaattaaagcgagtcgggtcaaacaaataatgtgccttacgtggaactgatgggactgatcgaatttcttttcaatatgggcgccgccccacgacaattgctcacttacacttctgtgatgggcaaatgaacattaaaattacatgaatttggcagataattaaattttaaaaaatccacaaaatgtacaattaaaaaatttctgtcgtattttaaaattccatcatttagccacaatttacaccctacaaatcatttataaaaaattaatgtttattattattagggattccttttttaggcacaaaatcgcgaaacaggcacttaaataggcaaataataggcgccaaaaatggagaaatagacaaaagacattttaggcatttgcctaaagaaggaatccctggttattatactatttcgtaactttcaaaaacaaaaatgataaaaaaataacaaagttaattttctatttatttttttgaattaaaaaataaaaatgtttatcttttatttttttaattaaaaaaaattgttatttaatattaaaataaatatttgaacaacataaaattatttccggggaaatgcttgaaaaataatttccggcggaaacgctgccatttcgaaaaaataaacacaataataattatgaaaataatgctataaaagcaaagtttaataaattattatttataattgaaaaattttgagaggaaatatg

SEQ ID NO: 102510 - DNA, 670 bp, Heterodera glycines
  misc_feature (13)..(13): n is a, c, g, or t
  Promoter: Source sequence=SeqID_2971; Location=1..670; Strand=+; Gene= SeqID_82576
aaaaaaaaagttnatataaatattttaataattttcagttattactttttttaattaaaataataattttttgagtttctgtttttaaaagtctcattggcaaaatcttttttagctcatttttttgactatgaacaatttattattaataataaaatatataaagttggattatcttaaattaatctctaattgaaaaaaatattattgattattttgtaaattaaaagttcactttttacaaaaaacttcgcttataataattatgggtggaacaatatggatatgcctaacaagaaaattaatttcctcaaatattaaaacatcactaaaaaaaaggaaaaaaaaggtaaaaaacaaaataaaagaaaatagaaaattaataaaatccttaaaccaaaaaaatgaaaaaaggttttttttagaaaattagaatgaagaaaaagtttggatctgctaccctttttttaatatttttttttgttttttttttggttttttttaattccttttttatttttcaatattatttctcaaataaaataaaaataataataataatttagtttattaatattacatattgcccatactcatgatttacatataatataggcaaattatttaattcgttttttttctaagataaaattcattaacaaaaaaaatg

SEQ ID NO: 102511 - DNA, 94 bp, Heterodera glycines
  Promoter: Source sequence=SeqID_14366; Location=1..94; Strand=+; Gene= SeqID_78396
tgatgagttagctttttacagtattcctacagttacatcgccatttcccatccgttggcatactgtcaaatcggcaccaattcccgtgcctatg

SEQ ID NO: 102512 - DNA, 582 bp, Heterodera glycines
  Promoter: Source sequence=SeqID_42444; Location=1..582; Strand=+; Gene=SeqID_70337
aaaaagagaaaaaagagatttccattttttggtcaagaattttttttgtttgcgtttcaaatatcgtaagattgtttgataggaccagacaagagaaggcaactgttggttcctagtttgcggtaaaaaaatgagaaaaaagatgttcctagggccagacaagagaaggcaactgtttgtaccaagtttgcggtaaaaaatgagaaaaaagagatagctattttttggtcaagaattttttttgtttgcgtttcaaatatcgtaagattgtttgatagggccagacaagagaaggcaactgttggtaccaagtttgcggtaaaaaatgagaaaaaagagatagccattttttggtcaagaattttttttgtttgcgtttcaaatatcgtaagattgtttgatagggccagacaagagaaggcaactgttggtaccaagtttgcggtaaaaaaatgagaaaaaagagatagctattttttggtcaagaattttttttgtttgcgtttcaaatatcgtaagattgtttgatagggccagacaagagaaggcaactgttggtaccaagtttgcggtaaaaaaatg

SEQ ID NO: 102513 - DNA, 510 bp, Heterodera glycines
  Promoter: Source sequence=SeqID_12430; Location=2484..2993; Strand=+; Gene=SeqID_76040
atacaaattagccaccatacccattaatctatcttctattcaaccttttttgctatatttacattacaaaattttagatgaaagttacaaaaaaaaaatcgacagaaagtggcaaaaaagcttggttgaaattacccttttgtgactttttctggggggagccaaaccgaatttttgtgcgtttcttcgcaaattacgttccgatcacaacaaatttgtagtgtttctacgtgatttggtgttttcattttttgttctatttctgtcacacattttagctgtatacctatttttgcctaacattcgaaattttctgtccataatccctattccaaacgcaagaggtgaagaaatgttgaattttattacttttacctgtattgtgaaaagaatattaaagttatcaattccaacaaattgctataattatagtttccaatgaccattacttaaatttctttcaaatattccaaagtgtatcccatttaaacaatttttggatacgcaatg

SEQ ID NO: 102514 - DNA, 412 bp, Heterodera glycines
  Promoter: Source sequence=SeqID_18114; Location=839..1250; Strand=-; Gene=SeqID_82696
tgatcagattaatgatgatttgtcggctgatttggtgtattctgttttgaactgttgtcctagtttttatgaacaaatatggacattttgtacccgcaaatgacaattaccgtgtaacaaatgatattttcgacaatagaagctcccattaaaatttgcccgggaagataatcctaactaaaattaaataatctttaaaaatgattcggcacatcatacttttcgttcacaatataacacaaagtcgctgagatttccacgcaaaagttgctcaatttgaaaaatttcttcggcgggaacatctaaaaaatataatttacaataataatctgtttttaaatctatttaaacattttttgaattgaaacttgaaaaaaatcggccacttgaaataataaattcgaaaattatg

SEQ ID NO: 102515 - DNA, 359 bp, Heterodera glycines
  Promoter: Source sequence=SeqID_7719; Location=752..1110; Strand=-; Gene=SeqID_65720
gtcattgataatggtgagtaattcattttaatttttgctttttaaagatataaaatatatttttatatcttttatttgttaggtatgcttgatcaaaatctaagctctttagactaaggctagtaggtgaaacacgaaaaattttgcgtgctatatattttgtgatatgatttttgtataaagcattttattaatcaatcattatttcaatttggtaattacgaaaatttatttgaaaattcattttaaattttttttctctttttttttgataatttagtcacaaaagtcggtccgcaaatgtcggtccgcaaaagtcggtccgcaaatgtcggtccgcaaaagtcggtccgcaaatg

SEQ ID NO: 102516 - DNA, 122 bp, Heterodera glycines
  Promoter: Source sequence=SeqID_37165; Location=509..630; Strand=-; Gene=SeqID_66312
tttttttgttgttttaggttttggctaaaaaattaagataaaacacttttaaaaacacacaataaaaataaaacaaaattttaaattaatttattattaagtgttttctgactttcgaaatg

SEQ ID NO: 102517 - DNA, 355 bp, Heterodera glycines
  misc_feature (11)..(11): n is a, c, g, or t
  misc_feature (14)..(14): n is a, c, g, or t
  misc_feature (24)..(24): n is a, c, g, or t
  Promoter: Source sequence=SeqID_20109; Location=1202..1556; Strand=-; Gene=SeqID_84898
attttgtgtcnaantttccttgcnccttaaaggttaaataaaacccataatcaacctggaataaaatttttcaaaatttctaaaacctaggaatttgtcgtgaattcaattttctaaattcttagcccaatttttgaaaaattatcgaaaaactagcattttaaaaagaaaattgtttaagctcgcgctggaaatttgactgaaacatcgtcagaactcttcttctctcttctgcttggcattgccgcggttggcaaaaaaaaatttttttttctaaatcaaactttgttaactcttgattacgatttaaaaaaagtcagtccgctaattgccgatttttcaaaaaaaaaaaatg

SEQ ID NO: 102518 - DNA, 1003 bp, Heterodera glycines
  Promoter: Source sequence=SeqID_1163; Location=1894..2896; Strand=-; Gene=SeqID_69145
acgggtgtttcccgcacgaacccaagcctatgggaggggtgcagtcctttgaagttgcgcacgggtgtttcccgcacgaacccaagcctatgggaggggtgcagccctttgaaggtgccgcccgtggacccatgcctatgggaggggtgcatccctttgaagttgccgcccacccaatccaatttcccaaatccgcacgggtgcttttttttttttgcccatccctccccgccgatgcatcgccgcgaaatgattcgataaaaataatcgataatgacactacccccatccctccccgccgatgcatcgccgcgcaaattaatcgataaaaataatcgataatgacactagcactgtcctccctatcgatgtcgctgccgcgcaaaaaaaaaattaatcgataatgagaccgccactctcatccgctccgtcgatgcgccgcgattccgagtcgtgaaaaaaaaaatcgataagcaccaaaattgtcaatgaaattcgaattaattgtatgatataggaatattaattggacaatagttgaataaataaaaattcatttaaattaatgaaattgaattttctgaaataattgatggtcttttttttttctcttccattatttcgcaatttgcacgtgactttacgatttcgcaatattgaccaaaattatgtcacctgtcaatcaaaattgattgattggttccctattttgcattttccccatcgatttcgcaatctgcacgtgactttttttttgttgcatatttcgcaatagacacgtgactttctgcccattcgtggaaaatttatcatttgtcaacgaaatattccacaatgtcaatgaaaaacagtcacgtgccaggtgtcagctgacacgaggcattctgcggccactataaaagccccccaaattcacttctccattcagttcaaccaaaagttggattttgctaaaataaaaattgtgcgctcttatttaaatatattaaatttaattaaaatg

SEQ ID NO: 102519 - DNA, 224 bp, Heterodera glycines
  Promoter: Source sequence=SeqID_4471; Location=3209..3432; Strand=+; Gene=SeqID_54564
tctaaatgactgacagggaagtgaatgataaggggcgtggcataggagggcatactgtggatggatttcgaaatcctcccgtctggaggtccctgcgtgctctcacttgagtgggcgtggcctattcccacgtgacacccccctctccatcacgtcacatacagtacccccacacttttcccttctcattttcatcttaacacacaaaaatattcctcgaaatg

SEQ ID NO: 102520 - DNA, 204 bp, Heterodera glycines
  Promoter: Source sequence=SeqID_823; Location=7269..7472; Strand=-; Gene=SeqID_62119
tgttttgctgaacattattaaaagtattcatttttattttgcaaaaaaaatcttgtgattaaaatgaagttttgcgtcatatttgcgtgcttttatatagcgaaaaggtacagtgatgcgcgctacgtgaaagacaaagttacggtgctcctacgcacatataaaagcgcttgaatgtgcacaaaatctcacttgcgcgcaatg

SEQ ID NO: 102521 - DNA, 518 bp, Heterodera glycines
  Promoter: Source sequence=SeqID_23317; Location=1..518; Strand=+; Gene=SeqID_45775
tttcattaaaactaaattaggattaaatttggtttcgttaaaataataaagacttttatgaacgggatattcaacacctgtatattctttgtccttcgcaagtgcatttttgcaaatcatggtaaaatataagcgaataaattttttttaaaaaatgataataacaaaataggtcttcacaattgccgttttagaaaaaaaaatgacgaaatgattttgcaatttgttaaagttcttaaaatttttttaagattttacattttttgacaaattttattccttctttaattttaaattaattattttcatgaagagaggtcattaaaagttaaaaaaaacccttctaaaataataatttttgtaacagaattcatacatattcatggtcagcgaccccaaaatcccttaaattttttatggcattatattttctgttactagatttttgcatcgggcaacctaaactggaaaagtgccaaatttcaattggaagttttaaatagaattttctaaaaatg

SEQ ID NO: 102522 - DNA, 74 bp, Heterodera glycines
  Promoter: Source sequence=SeqID_21212; Location=999..1072; Strand=-; Gene=SeqID_51804
ctctacttttcaggcccatgtttcgtatcatttccatgccgccaaatgggccggcactttgggtggccaaaatg

SEQ ID NO: 102523 - DNA, 360 bp, Heterodera glycines
  Promoter: Source sequence=SeqID_19431; Location=1..360; Strand=+; Gene=SeqID_47586
gcccagtgcgttggacagacatttgtacaacaactcagggtgggtgtccgtcacacagtccgtttgactataataatcaccaaatttgactaggttgaggtccaaaacacggagctgtacgacagcggaaccctctacccttacaaggcgtactcgaccaacgaactgtcctttccgaacagtgcaaagggacactttatggccagcgcgggctaccatctatcgcggaagcacgacgacgcgacggacgccggttttctggcacgctgtgcgcgcttcgcgggcggccgtaaagcacgcttcctttcccggctggacttcgacctgggcaaccaggagctgtatctgttgaacaacatg

SEQ ID NO: 102524 - DNA, 896 bp, Heterodera glycines
  Promoter: Source sequence=SeqID_5800; Location=1..896; Strand=+; Gene= SeqID_59268
tgccttagtttgtttccaatcctatttcggattcccggccataattcgatcattcgaaaaaatgaattccccatttttgttcgaaaatttgactaaaacatttcaaaaattagtcacaatattacattattataaatggtcaggttattaacttttgtttgaatacatccgcgcgggattcgtaataggccaaaatcagttgtaaaactcaattcatagaatggtcatattcgcgatcagaaccccaaagattttttcgcggctttttaaaccgaaaattttaccaaaaatttgccaattgtataaatgataattttctatttgtcagggcatgtctcgtgatcctttgaatatttggcaaaacactccaagacaaattgagcgaaagattggcgtatacaaacgaagcatcgcctgtgactgaatgtgaaaagcgaaaattgtttttctttgttgttgggcttttggttgtttaaataaataaaaaacaattctgaacacattacaccattatattgcccttatgccgttttttattcgtatttttgacttcggagatttgtcggactatttcaatttgactatgaaaagctgtttgctttagtaaggaacataaacaaatgggacaaaaatatcctggtaatggcaaaaagtgaaggacaactgccgtcttgtccctcccccccccctttccctctctcttctctctctctcctacatactctctccccctctcaatcacttgagcagttttcctgtgcattcgctttctcttttgttttatttgtgctttttccacgctcaaagtcccattcattcctttgcttttgccgatcgattgatccgaacaaaacaaaatataatcgaagtccaagagaagacgacgtaaaggaatg

SEQ ID NO: 102525 - DNA, 326 bp, Heterodera glycines
  Promoter: Source sequence=SeqID_201; Location=1751..2076; Strand=-; Gene=SeqID_77168
aaataacgtaacgattggttttcgatttttttgaacctgagcttgagcatcacaaggttctaatctaaattgggcgttatagttgattcttatcgtgaatcggaaacgaataccgggaaatcatcccgggaaccgagactgggatccgaaaaactcgggaaattctcgagtcgatgaattgcgaatcccacacatttctagtgattgtaaagcgacgttcattttcattgttcttatgttttttttcattttaatacccaatcttctacgctattagaacaacatggcaccgggggatgatgcctttttggacgacctaatctatg

SEQ ID NO: 102526 - DNA, 365 bp, Heterodera glycines
  Promoter: Source sequence=SeqID_22672; Location=921..1285; Strand=-; Gene=SeqID_53356
ttcctccataactttgtgagttcggcacggatcgagcttccggagggaccattggaaagagcagctcgagctctacaccattgtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 102527 - DNA, 262 bp, Heterodera glycines
  Promoter: Source sequence=SeqID_10691; Location=1..262; Strand=+; Gene=SeqID_73941
tgttttttcaaattaatcaaataattattcgtaaacccccaccgaaaaaattagcgtcctaaatttttttttaatattttctctacgaatcatgttctgttttaaatgttaaattagaatgaacattgacaaatgaaataaattttggaaaataaatttaatatttaaaaatttaatttcaaataaaatttaaatttaaaataaattaggctctgccaccattccaattgcgacccgatttcccaattttgggggtgccatg

SEQ ID NO: 102528 - DNA, 168 bp, Heterodera glycines
  Promoter: Source sequence=SeqID_2766; Location=4262..4429; Strand=-; Gene=SeqID_47409
ttttgggtgagaaaaaaagaaattaaaagattatcattttgtgtggaaaattattaataattttgaccattttttggtcgaaaaattaaattctttttccaactattaatggtggttaatggaaaatggaccagaaacacttgaaaattggcgtttcagtgaacaatg

SEQ ID NO: 102529 - DNA, 1003 bp, Heterodera glycines
  Promoter: Source sequence=SeqID_5218; Location=2084..3086; Strand=+; Gene=SeqID_57306
tgagtaaaaatatttctcccaaaaaaggggacaaattggtgtaggaaagcgaaagtggtgaatgaatatggagaagttattatgttacttacccttttatgaaagataataatcacatctttgttctgctactgaccgatattttaagtgtgggaaaatgttcaaaatttgtacacaaatatttgggcaaaactgctgagcaacaggagggaaatggtttaaatttgaacataaatatgagtgtacattttgccaaaaacataaataaatttgccaaaaaaaagaaaatcggtacaaaaaaatggtgggaaaaaagtgtcaaaattcgtaccggaaatcctgaacaaattggggtgaaaacaaatggaaaatgggatttgattagtcatcggcaatgtaaatatggttaaaaaacactcccagtagcagaagggcaaaatgcacaacattaattggttcgaaaaaaatcaaaaaaaaaaaaattaaattaattataatttgccaaaattaacggattgtattttgtgcaaaaaataataaaattatgcaaaataaaaattttattaaaattataaaaaaaaacgattaagggcgaatcctaaaattttaaatataataagacaaaatgaaagaaaaggcaaatagtgttacataaacggcgccaccgttttcttttcaaaaaaagggattattttttaattgctcaatttgagtgggcccatcccaattttctcagcaagaagtaatttttgtggtgggtgctgctggtatagcaccccaaatttgacaatttgagttccgttcaccgccctccgccggtggtggccgattgtcgggtacaaaacgatgacacggcacaacaaacattttttttgttggatgtcgtcctaatcccttagatccctatatttgcggtgagggttcaaacaaaaaatccgggggaaaattgcgcgcgcattttgtcggaaaacaaatctttcttttttcgaaaattttcagtatg

SEQ ID NO: 102530 - DNA, 92 bp, Heterodera glycines
  Promoter: Source sequence=SeqID_12684; Location=1083..1174; Strand=+; Gene=SeqID_76362
taaaaataggactgttatttaaaaaaaaaactcgccgaaaaattgtttaaaaaaattaaacaaaaaatttattcgaagttttgaataaaatg

SEQ ID NO: 102531 - DNA, 127 bp, Heterodera glycines
  Promoter: Source sequence=SeqID_29462; Location=1347..1473; Strand=-; Gene=SeqID_59959
tcttttacctttatggccgtgtaatttatttgacaagcgcaaaaatgatgaaatgcgaagagaagtattggcttttgtaagtcatacgcattggcattagtgagtgattggtgtggccaaggcaatg

SEQ ID NO: 102532 - DNA, 52 bp, Heterodera glycines
  Promoter: Source sequence=SeqID_324; Location=1..52; Strand=+; Gene =SeqID_82302
aaactgtcccagtggtttgcatacggattggctgcgtgatctttgcattatg

SEQ ID NO: 102533 - DNA, 313 bp, Heterodera glycines
  Promoter: Source sequence=SeqID_1475; Location=6641..6953; Strand=+; Gene=SeqID_73772
acatttggccctttttgacggtcgtcgtcggagtgatcgatgctgcccgccattttcaacattactcctccgtaaagtgactcatttcattttaatttttattcttaaaatcattttttggttattttcaatttcgatccatgacttatttctaacaataagtttggaaaattttcttgaaattccaataaaaattcataattttttttcaattgtaggaaaagactcagataaaggttgtgggaaacaaaacaattttaggcaaatttctctgactcttttgggcattttgcggtcgacagaatgccaaatg

SEQ ID NO: 102534 - DNA, 139 bp, Heterodera glycines
  Promoter: Source sequence=SeqID_28638; Location=1..139; Strand=+; Gene=SeqID_59235
cacagaacagtgcggccgggggagccaactttttggtctttttgggtcacgcttttgatcgactttttggcagccttcggtttttggtcgtccgccgattggcgttccgcccaattgttcttcggccctctcccaaatg

SEQ ID NO: 102535 - DNA, 357 bp, Heterodera glycines
  Promoter: Source sequence=SeqID_40172; Location=250..606; Strand=+; Gene=SeqID_68588
gaatatttattaaatggaacttaagaaaattaactcacaatttgcaacggaatttccttttccgttttatccgttaatttttcgccctttggacttagacaagaaaaaaggcgaaagtgagcaatgaaagctatcagaattggcaaaaaagaaagaatcattttcgaaagagaaaacatttagaaaataataaaaaagaaatatttgcaatgtttttaagggatgcaattttaattggatcgatattcaatttaagatttgccaatcacttccaccaatttagtgacgacaattatttaaaaattacactctcgcaaaatcgagacaaataattagagaccggaattctcaaaaatg

SEQ ID NO: 102536 - DNA, 314 bp, Heterodera glycines
  Promoter: Source sequence=SeqID_38304; Location=1..314; Strand=+; Gene=SeqID_67163
tgcatcaagattcgtcagctgctgaggacaactcttcttaataatattaaaataactttttataaataaaatcaaatttattttcagctattttttaatttgtttctctaaaaataattgattttttctagtctgatcttccatcagctgttttatagcttggctaaactagtccatcggagaattttttatatatattacgttagatgcccataacagtatttagccgtaattgaatttttataaatttaaacccaaagattttatagtaattattccaaaactgggccataattttttatcattcgtgaatg

SEQ ID NO: 102537 - DNA, 285 bp, Heterodera glycines
  Promoter: Source sequence=SeqID_4981; Location=2287..2571; Strand=+; Gene=SeqID_56441
taatttgacttatttgggtggatgggtatgtatgtaaggggaagtgccatttggagaaatttaaatgtaagggattggcgcgagttaaagtattgttggctttttttctaaacggtttcattaattccatctttaccctcaaattctcaaacctgaatgcaaagtttcgaaataattgaccctccccttctctaatcgctctccgctaattgaatacaacaaagctttcaaaatgtgacccctaacggctaacggggacgaaccatttgctgtccttcgcccatg

SEQ ID NO: 102538 - DNA, 409 bp, Heterodera glycines
  Promoter: Source sequence=SeqID_7681; Location=77..485; Strand=-; Gene=SeqID_65613
ttagagccgaaaagccacccccgcacacggggtccgaaggctagctcaaaccaagtggaaaattcgttttttatgcttaatatcggtagggtacgattcggtgccgccgtttcggtgcccgccgtttcggagccgtttcggtgccagggtgggttcactgccaatcaacgattatggctactcaaattctaacaaagcgtggaagaaaaaaattgttacacgatggttttctgtatgtcttcgaaaaattaaacaaacggggtgacgtcaagttttggaaatgtgaatttttcggacccaggacatcaaatgcaaatgtcgtttgcacactgatatgaatgacaatgttttggaggtttaaatatttaattattaatgttagatatgtaaattttaggcaatcggcatg

SEQ ID NO: 102539 - DNA, 895 bp, Heterodera glycines
  Promoter: Source sequence=SeqID_21024; Location=1..895; Strand=+; Gene=SeqID_51607
ttaaatagattaaaattcaaaattttcaaaagttaactcaaaaaagttcattgctcctcttcaaattgttaaggtgcgtttttgactttttgttcttatattttcataattcatactaataacaaaatgttttaagagatgagattttctcaaaatttgtcttaaaggttgaatacattcaaaagtttacaaaatgctaaaaaatatttaaatcgtctgtgaccaaagcttcatgatcaacatcagagttcggtcccaaaaaatgattggtcacaaattgcacaaatcgccttcacaccgctggcacgagcctttgccgccttaaaacggaacggatttgtcaatttatttctcatttataaaaatttcaatatttttctttacctgaaaatctgcaagttcgtgtgcccgcgatgcaacccgtcgatttcattgcgcaagtccgcaaagtaaatgaggctgaagtggcggggggggggggggggggggtggacaattaaaataatattccatgacatgaaattctggaagaaaatttcagaggaaattcaaggaaatagaatcgaccctgctctatccaatggtatataacacatatgcattttccgacttacagttcgggtggttcccttgttagattttcaaaaaagctaaaatacttttttttcttcaaattttttaatttttttttgcggcgacgttatgtcccggcgacgttttgtcggcgatgttttgtcctgatccggagcccaccttacatttttaactaaaaatatcttttttatgacttaaatttgttgaaaaacaggactgtggttacttttaaatagcttagttgaacattaaaaaagtatcacataattttatagccgattttggcgtctccgccatcatg

SEQ ID NO: 102540 - DNA, 555 bp, Heterodera glycines
  Promoter: Source sequence=SeqID_5062; Location=534..1088; Strand=-; Gene=SeqID_56766
tcagtaaagcggaaacggcgaagcaaagacatgcctaaaaagaaagcttcgaatagaactgttacaattgggcgaaaccttttggctgatagggtccattaggagtctagtgaaggaaaatcgcatcattcttttttggttaagacccacattcataaaaaagctaaaaaacacagtttaaatttatgttcaataaagattatagaaattttattatttcgcttggtttatctttccaaccccacaagaaattgctttgtcccgtgtctttttcgtttcgttaatttctctcccttttcttcttcttctatctctctctctctccatttctttcaattaaattccttctttttaaatgttttcttttctcttttccttacaaattagctttctttttctcctttttctcttctgtgaatgaataatgttttgattttgtttttgcgtttgcttgttttatcgtttcctttctttttaattcactgttttggtcaaatacacaattttttgccaaaaatttttttacatatagagagaggtttctaattataaatg

SEQ ID NO: 102541 - DNA, 1003 bp, Heterodera glycines
  Promoter: Source sequence=SeqID_20313; Location=601..1603; Strand=+; Gene=SeqID_50822
ttccttcctcgcattttcatttaaattacatgtgaaattcattcggaatactttttgaaaatgaatgaataatatgtcaataatgaaattaatttgtaagcattaaaactatagacccggataactaactgtttcgatctatcgaattaagtttttaggcttttaagtggattttaatccttgaaacaaatttaaaaaaaataaacaaacttcttattacttttttctttaatatatattttttatggtatttaaccgtaataaaataggataatttaaaaacaattactgaccaaaagcttcgttagcttaaatttgaatggaggaagcttctgccgattttcgaatttctttgtctcccataccggcaaaagtttaggttatttcatttaatcctacaaatttggatataaacggagttctaaatttaactattttggccactttttgtttcagttgtcaaatgaaccagagatgtttaaattgaatttgttcaaaattaagaagcttcaaattggcggcggcgaaatggcctcgaccctccaaaattttcgatttttgtattgtgaattataagtgccaaaagtttaatttatttcaatattaattctgtaaattataatgttaaattttttctgcttctttcaatctatgtttagttacctaattacatttaaggcacttaaacaaatttgccattcaaaattggctttattaaatttgccgacacgtaaagcacttttctttttgtacttaaaaaagatgcttaagttactgtaataatgctattatttggtttaacgcatataattatattacgcaagcattcattttttgtgccttcggccatgtcatttacaagaattttacgctcacatttaacatggacaaattaagaaactctaacccattcattagtcgcctaatgaggaaagcggcgcttaaaaattaatgaaaaaatggatgaattcattttgggataaattcagaaaaatttccaatg

SEQ ID NO: 102542 - DNA, 366 bp, Heterodera glycines
  Promoter: Source sequence=SeqID_9151; Location=2425..2790; Strand=-; Gene=SeqID_70412
tttttgccaaaaaatttggtggaacactttttattatttacaaaataattatatatatactttttaattcattattttgcaattcaataatttaaaaaaattgcttttttccacatttttctgcaattattaataaagatttattaaaataatattctaatttattttatgagtttttaacaattggtcatgtagtgatcagtaaaaaataataattaataataaataaatttaaatatttaattaacacaaattaattaattaattaatttaatttttattctttttaaacacattttttttgccaaattggtcagacttttcaagccgccgcgtaattacccgcgcccgttgcaggacaatatg

SEQ ID NO: 102543 - DNA, 86 bp, Heterodera glycines
  Promoter: Source sequence=SeqID_22506; Location=1..86; Strand=+; Gene= SeqID_53175
ccccataaatgtttgagtaccccaaacgggacacttgaaaaaatcgattttttttgtttcataaatatttttttcagaaagtcatg

SEQ ID NO: 102544 - DNA, 852 bp, Heterodera glycines
  Promoter: Source sequence=SeqID_11333; Location=1813..2664; Strand=+; Gene=SeqID_74718
tatttcacgtgcctaaaatagaatacttactgataaattttgtaaaaattaataagttattaccaccaggaacgcattttcagttttttaataatttttttctgcagttttttgactcccctaaaaattctcaatgatatatcgaaaaaaaagaaatttgaattcctgggcggtcagacttccataaatccaagatatttctcgcttcagattctcgacaaatccatctgttcatttcatagttttattgcttaaattcaccaattcttagacattgattaaattttttaccaacaacttttatattttgtgtgtgtttttaacttctttcataaagcttaaaaattatttttggttttttatgaaataaacgcaattaaaatttatttcatatttatgagtttattttatttgggcattgaagcgcatttattatattttattgtttgaatttaatttgaaaaaaattattcacaacggataaaaagttcatgttgacgagatttgctcatatttaaacaaaaaaaatgcagcacaattaggcacggtttctatttatattaattttaaacatttgaaaataatttttattcaattccaaaagaaaaaaaaattcgaacaaaaattaattttactataaatttacctaaaaaaattcttaataattaaaaaaaaatattaaaatgattttgagtgcaaatgtagatgctatttaattttcgaccaattatgtttaacgaaggattttgaattaattttaaacatttaaaacaatttttattcaatttaaataaatcttcgaaaaaacaaataaaggttatcattccattcttaatcactttttaagcgatg

SEQ ID NO: 102545 - DNA, 544 bp, Heterodera glycines
  misc_feature (48)..(48): n is a, c, g, or t
  Promoter: Source sequence=SeqID_28810; Location=1..544; Strand=+; Gene=SeqID_59385
catttttatcaagaaggccataatataaaaaacgatcaaatgaaaatntaatagccctaagagttctctaatagcctgaaaatttcaaggaaacgctaattttcaaaatagttatgacaaaaatatttgaaaacctggttccatgtgtactttttgctataactttgttcaagcataacgaaattttttgaaattttgcatactattagagaactcttaaggctattgaatgatatcaagattcaaaaattagttgcttttaagcaatgttatgggtaattatttgttgaaaattttcatttggtggttttttatataaacgccctttttgagtgttcatttaacgatatttcacccccaggggaaggccacgatgggaagagggggaggaaggatcgataaatgaccaccgaagagagaaggtcaacaacaaatgtcaaacttttaacaaattgcttcaaaaacaaaaattttcccggcggcgcctgtggacaccgccggacaaaaatccccgaaattattttaaaaaattggcttcaatatg

SEQ ID NO: 102546 - DNA, 362 bp, Heterodera glycines
  Promoter: Source sequence=SeqID_23914; Location=248..609; Strand=+; Gene=SeqID_45824
ttttttcgtcgcatttcgcaaccaaaacattcgcagaaactcacgcaaaggattttgccggtcactacagctttacaaattgggaacacttctcaaattggagaaacaaaaagtgttcatttgaggaaaggttcgtggcattgtgtttaaataacttttcaaatcttttccaatttaggtgaagatgggttcggtttcacttatgcgggacgcgaatctttcgcaaataatcgcaaggaaaacctttactatgtgaagggtttgcgcaaagagtgtggaggaattgccattggcgacagaattttgcaggcatttaaagaaacttttaaagaaatgttttgatctttcagattgatcaaatg

SEQ ID NO: 102547 - DNA, 186 bp, Heterodera glycines
  Promoter: Source sequence=SeqID_7201; Location=1640..1825; Strand=-; Gene=SeqID_64123
gaaagattttgagaattatgggacagtaatttgtgaaaatttgcaaaacattcaaaaaactcggcgatgaaagtgtattcattttggcattcgttggctcaactgtacaacaaaaaaagaactcagaaaaaacgacccgacaaaattggcattgttcatttgttggcaaaaaacctgggcacaatg

SEQ ID NO: 102548 - DNA, 550 bp, Heterodera glycines
  Promoter: Source sequence=SeqID_19854; Location=1543..2092; Strand=-; Gene=SeqID_84608
aagaaaataataaaaaacaaagaaaatataaaaaaataaaatgaaaacaaaaaaaataaatgttttgtggtttgtacaacttgaatgtattataatgaatagtttttagtatttaaattattttatataaatagctttttcattagaatttgtgatgtggtttgggtggactcaatgtctgctacctcctcgtggttgagtctggaaacagagttaatttcctatcatttaagtgaggcattttaactctggccaaagcagacaaattttttttctttttcattggggcgcaaatgtggcacaaccagtattatgtataattttttcaaattaaaaactaatgggatattgacatgtcgacgaataaacaagaacaaattggtcaaacattccaaaacttaaataatattaataaattttatttcttaataggttataattcttaaaatgatttaaagatagaaaatctcttaacatgaatcaaacagtcttcctaattaagaacatttatttttaattacctaaaattaatatcaattataaaactatg

SEQ ID NO: 102549 - DNA, 69 bp, Heterodera glycines
  Promoter: Source sequence=SeqID_18366; Location=923..991; Strand=+; Gene=SeqID_82968
cgtaagcatttttagcgtaaaaaagttattaaaattttaaattgcatcaaatttgaggctttatctatg

SEQ ID NO: 102550 - DNA, 91 bp, Heterodera glycines
  misc_feature (27)..(27): n is a, c, g, or t
  Promoter: Source sequence=SeqID_40309; Location=572..662; Strand=-; Gene=SeqID_68681
tcggaatgggtacaatttaaacccttnaacgagtatctatgagagggcaagtctggtgccagcagccgcggtaattccagctctcaaaatg

SEQ ID NO: 102551 - DNA, 730 bp, Heterodera glycines
  misc_feature (80)..(80): n is a, c, g, or t
  Promoter: Source sequence=SeqID_44145; Location=1..730; Strand=+; Gene=SeqID_71674
aatttgaatcggcactaatcccatgagtaatgtcggctaaatttgcatttcctccgtgcatatcaagtgctttcctgacnaatatataaaaagtaataaaaagttttgaaaaacaaattaaaaattttggaatttttttattaaaaaaccaattaactaaaaactcaaattcaattcaaattcataacttttgcagcgtctctttcattcctagcccactcagcagaaagtctccggaaaattatttaatagacaatcaatcaagaccaatctgtcagtgaagaacaattcgtcagtaatgaaaactccgttttacaaaatattttgcgatttaaaaaaattactgaattttggggttcacttcggttgagccccagccatgtaggctaatagagcatgtgaagagctttcgattgatacaaacaatgttgggtttggttgacaaagaaaaagttagagttcggggccaaacacttcggggcccaactgacggagtccggaactttgtcatcatttttttaaattaataatttaatttattaacatcttaaaaactttttaattaaaaatgatttttcactattaaaatagctttttaatcaaatacttatttttctagattttaaaataaaatctgtcgttagaaaataattttgttgacggattgtccactgactaatttttttctcagagtgatgaatttttcacataaaaataatttacctagatg

SEQ ID NO: 102552 - DNA, 58 bp, Heterodera glycines
  Promoter: Source sequence=SeqID_15; Location=5475..5532; Strand=-; Gene=SeqID_74198
agtttgcctcatatttttgccatcttttattggaagagtcattttgttttttcagatg

SEQ ID NO: 102553 - DNA, 800 bp, Heterodera glycines
  Promoter: Source sequence=SeqID_2848; Location=3287..4086; Strand=-; Gene=SeqID_81925
aatcggcacttaatgttgccggtgctaattttgtgtgtcgcaaatcccgcgtcaaaatcccgaaaattaattgtcacaagtttcaaggagaaattcatacattcgatagatagcaaaccggtactagtacagtttgggtcctatattttggtcaaattaaaaaaaaaatttttttttgtttttattgtcgcaattgctttaaataacaaataaaaggagatttatgtgattattgggtacaattccgcgatttgggtccacaaattataaaaaatgtccggtcctccaaattgcttacgccacaaaaaatcagaaatgtatgtggaaaaaagtgatctgtgactgccaaatctcgttttgtgttcctgcttgaacttctgccacgtcgattcaattgtgtttgtatgctgcccagtgacaggatcaaatttttaagcttttccatcaatctaaaaagcaattgcgacaataaaagaaaaaaaaatttttgaaaaaatttgacccaaaagggggacccaaacttaactagtaccgaaaataggtgctaataactcgaaaagcacaggaaaccggttccagacccggaaatttgaaaatccggttgatgagttttccggtttgcccggttttcgagagtccggacccgtaaaccggttgtttttggaaatttcggctcggaccagtccggctgatttgaaaatctcgttctctacttttttttcgtaacgtgtaaaatcccagccatagtcaataaacattttagaaccatcatccatcaccattctacataataagaaatg

SEQ ID NO: 102554 - DNA, 108 bp, Heterodera glycines
  Promoter: Source sequence=SeqID_15578; Location=1394..1501; Strand=-; Gene=SeqID_79868
attaactaattcccttttaataatgtcaattaacgtaagaatatttacttttaaattgaaattattaaataaaaatataaatatagataatcactgaggaggtaaatg

SEQ ID NO: 102555 - DNA, 771 bp, Heterodera glycines
  Promoter: Source sequence=SeqID_35475; Location=1..771; Strand=+; Gene=SeqID_65019
atgcgaataaaatacacaagtaaaaagaaattgaaaatagtaaattgaaaatataaatattttttaacttgtataaaaaatgcatatgcaattatctaaaatacaataaaaatacacacaattaatcatttatcggccagggcatagtggaaaaactttaaaatcacaatattatagaatttccaaatgaataaagtcagaataaaataatttgcttaaataaatatagacccactgaatcaaccaaataaattattataaaatttaaaaaattaagaaatattaaatttaattggataaacgtctatacttgacacatataatcaacaattatttagattttacaattatccctcgtacggcaaaaaaaaaagattttcgacacaaattccattacaaccgagtcaattttgagcctccaattcagaaaagatttgaatgtatggcaaagttgtttttgtaagatagtaaaaaaaacaaagggcgaaggttcgagtccgctcctcaacattaatatttttatttatttgtccaaaaaattttaaaaaatgacaattgtaaaaaaacgattgaaggtttttcccaaccaacttgggcaaactttgtatcaatcaaaatctcttgacgaggtgaagcttttaagcaaatgctatgcaatctactaagtttagggatgggacaattatcaataggctataattttcagaaaaaaatcatattttctgcataaacatttcgaaatctttataatttcagagttgcctatgtatg

SEQ ID NO: 102556 - DNA, 213 bp, Heterodera glycines
  Promoter: Source sequence=SeqID_16555; Location=1457..1669; Strand=-; Gene=SeqID_80962
ttatattataagcatcagttcattaattgtgttttcttcagacataatcccttctctcatgtcctgtaatctgttaattaaaaaaaaaactgtgtgaaggaattctgttatttttttcaaatattacgattagcattttgactattaaatatttttttattagctatataaacaaaatacataattattttttagtccatttccgcgcgaatg

SEQ ID NO: 102557 - DNA, 1003 bp, Heterodera glycines
  Promoter: Source sequence=SeqID_10258; Location=786..1788; Strand=-; Gene=SeqID_73416
atttatggactataaacagatttgattcctgacctctctttaccgtctgagcccttcgaaaaatctttgtcgacccatcagccccttttaatgcaattggaaatttttttgaaatttaattgaaatttttaagaacatttaagataaatctaaattagaagatttctgataaatcagaacaggtgcgatccctatctagcggttcgttgtaactcttaatttttgtgggaggggatcccgcggggttaatcccactgtgataatattgagatttaaatatatattggcgttttgttattttaatttgtgtcatttttgtttgtgattttgttagattatgcagtcgtcagttttcctattgatttgtcttcgccttatttaattttgaaataaataattgtcttcgacattgggctgtgttttggttttgctttgggctgttgtctttgctgtgtgctgtgcaacaacaacattattaaagcccccctgacaacaaccatatttgttttttacgacttggcgctcctggcaccggtgaatcagcagtggacaaaaacaattggacgtggcctcgaattgaaaatagggaaaagtaaatccctcgacaagtgtggacaaatcggaaaaaagggaaaacaaattcccagcaagagaagagtcgaatcagccgattgtggacagctaaattttgtaaaagggtaaagtaaaacccgcgaaaagacgagccctaacggttgaattgattggaaaacgggagacaaatccctcagttttcaacggactgtcgacggaaaacctaaaagggtgaacaaaacccagaaaggacgcgaggagcagacgaacaaggcgaattttttttttttttgaaaacgggaaaagcaaatcccctcttcacttcaggaattcgtgaaacaaatcacgcattttgtcagttcggtaaagcaattccgtcgacaaaactgactataaaaacgggaaaagtaaatcccatttcgacattatg

SEQ ID NO: 102558 - DNA, 125 bp, Heterodera glycines
  Promoter: Source sequence=SeqID_20056; Location=1..125; Strand=+; Gene=SeqID_84835
tggtgcattgttaacattattcgcattgctcggggctcttcattcgccgctacgaatccgccatttgacaaacagtcacttgagtgaatgtaacggccgagctgaaaaaggggtgggacacaatg

SEQ ID NO: 102559 - DNA, 726 bp, Heterodera glycines
  Promoter: Source sequence=SeqID_38619; Location=1..726; Strand=+; Gene=SeqID_67381
tcctttttgtagtgctcaaacagatagtcgagcagttcgcgctggtggcgactgcacagcaccagcacagcctggaccaggggtgttttccgggttaagacaatgtccaaaaagtaggggttttggattcggggcccgagcgtaacttggaccgtcccggcttctgtgtatcaaccaatgatcgatgagtgatcaacaaattaggcaaaactctcagcgaccaatctattttgatcatttgatcggaaattaagcttatgaaaaggttggaaccgaagcaaaggactaaactaacaataacaatttggaacacacaccttttggcagaagaggaacagaagaagcgtaaagcttagcaacagcaccggcggaggggcgaaacaaagcgtttttttggaagtgctaaagccgcgacagcttttcatttccaattcactttttcacaaataattttttgaaatgagaaagggaataatggaaaatggaggcattaaattgtgcaatggacggaattttgaattttgagagtgcttaaacgctttctgaagagggcttattgggcaaaagcggaggaggggggggggacgaaggggcaaagataaaatggggccaaagggacggaagacggaccaacggccgaaaagcagcgaaataggaggaaaatgaagggagacaggcgcaaaaaatggggtgggggtaatgggataattagccaataaaaaaatg

SEQ ID NO: 102560 - DNA, 1003 bp, Heterodera glycines
  Promoter: Source sequence=SeqID_15282; Location=766..1768; Strand=-; Gene=SeqID_79496
caaaaataaaataaaagttacaatacaattatatataaggttcattttttgaagttttgaaaattgaaagtgtcacattaacaaacaaaaatatttaagattaacaatcaaaaataaaatattcacaacatcaaatacggtaaaagcaggcaggtactgtagaacaaaaataattttttctttccacgcgcaaatattaatattttgaatacaaattaaggaggcgataaaaatggaaaatacgaattgcaaaaatatgtttttcaacaaataaatttatgcgaatacaaataaaatgcaaaaaatccaaattaaaggtcaaaacataaacgaaaaaataagaaatatcgtcgacacaaaattaaatccaccaaaaataaaatcgctcaaaatatgtattaattaacaaaattaaaaatgctgaggtcaattgcaaagataaaacaccaagcaaatacaaatcaaaatcagcttaacaccacagcaaaactccaattgttcgttcgaagattctttgatccctcgcgcttggcaatttctgtttgaatgaaagaaggagagactataggaggagtttaaaagttctcattttttcgcgaaattttttttcaaagaaatctcgtgagtgtactgtagcgtaaagtagcccggaatcgggtccttgaccccgaaaacctctgggcaaccggttctggactgatcaaatttgtacaatattaaaggcaataaaatcgaaggcccattgattcattgcgtggcatttcctacgcaaaagcataagtaaatgcgcataatgcaaatgatgcttgccaaacagccacacatatatgtacatatgcacatacatacacttacatatttccatgttggatttatacaaaattacgcaatgtttttaattgcatgaaatattaaaaaatttaatgaaatataataaattatcattatttctttttttgatttcattttcttgctcaaatttaattggcaacagattaagatg

SEQ ID NO: 102561 - DNA, 181 bp, Heterodera glycines
  Promoter: Source sequence=SeqID_1475; Location=7298..7478; Strand=+; Gene=SeqID_73773
attttggaattaatttaatttatcccacaatttcaaatggatttgtaaatcagtcaaacagttcttgttttttttaaattagcatatccatctgaatgactttctgcgaattctttgcaaaattggctctgttctcgtggaaatattgtgtatttaccacgcaattttgaaatttcacatg

SEQ ID NO: 102562 - DNA, 179 bp, Heterodera glycines
  Promoter: Source sequence=SeqID_3081; Location=1824..2002; Strand=+; Gene=SeqID_83117
ggtccagctattggggggggggagttgcaatgggaacacccaaaaacgggagacagtccatcaaacatttagagaccgtgataaatgccaagaggaaaagtccgccttggacctgacagttacaaccgaccaagagggcaattactacatcttatttttgtatttaggagtccctaatg

SEQ ID NO: 102563 - DNA, 639 bp, Heterodera glycines
  Promoter: Source sequence=SeqID_13699; Location=1..639; Strand=+; Gene=SeqID_77614
tgaattagaggagaagggaaggtatttgcatgtgaaattcgtcattttcgaaccaaaatatggaaatgacgctctattcaaaaatagcgttaaaaacttatggcgttttattttatttttttttcttcagcacaattcctttccccatctgatttccattttcattttaatttcgtcctcagtttttgtcttgcatttgatttatggggaatttcctcttcccccgtttatttttctctttttatccgagttctacttaactttctttgttggtacactttcattacaaaacagtacattcaattcgaatacgaatttgaacaaaaagtcgaaggttcaaattctggaacttaacatttttcttataaaagtacttaaatgacttttttttgcagggagtgatggctttcagtttgcttccgtgtattagccgttcttagactaaaaatacaaaattctaattttgaactttcggttttttgttcgacttcatgttcgggattcaaaattactaaaatgggtgtcatatttgttttcaccatgcctggaaagccccactgaaattgttttaattccaagtcaccaaccaatcaaatattttccccattttttcaggtgcatttaatttgtaaaaaaatg

SEQ ID NO: 102564 - DNA, 215 bp, Heterodera glycines
  Promoter: Source sequence=SeqID_17080; Location=1..215; Strand=+; Gene=SeqID_81510
ttgaaaaatacacccctaaaatcaattttttgtcattttttatatattttcaaaaaaaaaaaaaatttgtttgccgaaagtaaccaatcgattcttaattttcattggagaactttcaatttataaaataatttattggaaaaaagattaattttaccttcaaacacttgaaaggtatttgatttgcgattgcgctggcgaaaatgataaaaatg

SEQ ID NO: 102565 - DNA, 441 bp, Heterodera glycines
  Promoter: Source sequence=SeqID_20692; Location=758..1198; Strand=-; Gene=SeqID_51250
aatgtcagatcttggcttagtaggcgaaatgtcatcgtgccttcaaaaaggtttcgttaagtttcaagaaagttatgaccaaaaatgttgtaaaaaacttggttttttgagcttctcaagttataacttttttgaaacttaacgtaactttttgaaactttataggctaataaaaaacggttgggcctattgaatgatatcaatattttaaaatttggtttcattttgggtgaagttatgaataattttctgtcaaaaattttccattttttggaaaaaattcgttaaatgtgattttggtgcttcttcatcaaatacaatccgtaaaaaaataggaaaaccctaaaaaccaggttttatccaacgcaattaattaattattctgctatttgtttgacctcattcggaactcggccaaattgtgctaattaccaaaaaatg

SEQ ID NO: 102566 - DNA, 167 bp, Heterodera glycines
  Promoter: Source sequence=SeqID_43213; Location=771..937; Strand=+; Gene=SeqID_70936
tatttggggataggattttaaaattaaaaatgttaaaaacaaaatgccaaagttgcgagaaatgccgaaattatacaaatatatgttgttaattagcgcactaattaagtgtaattttgggaattaattagggggatgagttggacccgtcggacaacacactgatg

SEQ ID NO: 102567 - DNA, 663 bp, Heterodera glycines
  Promoter: Source sequence=SeqID_71; Location=9283..9945; Strand=-; Gene=SeqID_62105
aaagttatttgcagggaatggatttttaggtgctaaaaataacgcgaaataggtacctaaatagttgctaaaaaactgaaaaatgccaaaatatttgctaaaaaagttgccaaaaattggaaaaacatgtcaataaatgtgtgaattttccaaaatttcctcatctttgtccttttcggttgcacaaattgtaaatcaaacatatttgaagattttgcatttttcataataattttttgttgaaaagcatgaatagttgaaaaaatagtttttttttttaattttacaagcaaaaatagttgctaaaaagtcgctcttctaaatcgaaaagtgatcgaaaaatgtgtgtttttttgcgcttatctcacatatgctattcgcaaaaaaaaaataggtgaaaacctaaaaatccgttcattggttatttgacaaataaatttaattgagtttttaagacgaaaattggagttgcaaatgttcggcaattcttcgaattgtttcacaaatggcggattaccgaagagaatacagtgaccaattttttaacaacaaatccaacagctggggatatgacaatttcatttcatttacggtgagtgccaattcaaataaataaatgcccaaataaaaattaaatgatcattaattaataaggaactgatg

SEQ ID NO: 102568 - DNA, 603 bp, Heterodera glycines
  Promoter: Source sequence=SeqID_19895; Location=1119..1721; Strand=+; Gene=SeqID_84657
aatttattgccaattgaaaatgaaattctgtattttattatttttatttttgattgccctaattattccaattgaatcagaaaagaaaaaacttcagcagaaatcatttgatgcaatatttggagaaaaatgggaagaaaaagaagataaaagggaaataattgaaaaatattataaaataaaagagaaaataaagcaaaagggaagaaaatattcaacaaaagaatgggataaaattaatttgaaaattgcattaatttttctaaaatctctttacattgtgaatttattttatttttattgaaaatatgtttattattttcgaatgagctccagtagaaagtaataaaattttatttaatcattaatttaccaattggcaattattttgtcattaagataaaattattattattatttctttgcaattaaacaggatttccttattttattaagtaaaataatgatttattcagttttttaatcagaaaaaaaatcatttaaatgcctcaaaaatgaattgccatttaattgaagaaaaataaaatcttgaaaatgaaattctgtattttattatttttatttttgattgccctaattatg

SEQ ID NO: 102569 - DNA, 1003 bp, Heterodera glycines
  Promoter: Source sequence=SeqID_10544; Location=173..1175; Strand=+; Gene=SeqID_73778
gtgtgttatctttttatggctcttttcggtgccaacgagcatttttattttgtttttactgaaaatgttgagttgaagagtttttatagattttttggaatttacagactttttggaaacaaatgatggcatcctttttctgtttccaaaatttgttaacaatcgcagaaaatttcaaaaatttaacccgagggcacttaacggcaccgccgaaccaacaattgctttggttcttcaaaatttgagttaaaaaagctcacatattagtcattttcatgaaaattcaaaaattacatttgtacattatctttagtgtcaggaatttaacaccaaaacaaaaacgcggttttccatttaaagcattaattaagaaagttctcaaatttttattaaaggacattgctttgaaaattgcctcccatcaattcgcttcattttttgagtcaaatttttgttggacacattacatttttggtgatctcacaaattctttatggccaatcattcttcaaatctatccaatttctttactttgtttatttaatttgtaaaattattttagatataatttaaatttagtttaaaaaaaactgatcactgatttgtgtgtcctgccaaaaattgtgacgcaaaagacccaattccgatcagcagcaggggcatttttcccatctttttgaaaggttttaaaaaaatattttttaattaagggagtttaaaaagaaaactataaaccttttttgtcatttttaatgataaaacaaaggataatattacatgtaaaataatttcaatttttcccattatgtgcccctttaaatgagttaaattatttaattgagcaaatatttattttggttattcagcgcctttttaaaaattttatagttttttaattttttaataaaaacaaatcgacaaaacaaaataaacttattttatttgtttatcgagaaaaaaacattattattctttaaggtactttttttttggaaataaaatg

SEQ ID NO: 102570 - DNA, 1003 bp, Heterodera glycines
  misc_feature (70)..(70): n is a, c, g, or t
  Promoter: Source sequence=SeqID_17317; Location=420..1422; Strand=+; Gene=SeqID_81790
tcacatttaattgtcccataatgtcttttttaaaaagatgtggatcggaactggaaatttcggaattttntccctttaagtattattttatttatttcttgaaacttcacctgcgtccattgttatgactcggacattcatgctttgaagactttttgatgacacttagaattttacacaaaatttttgaagctaaaaattgaaaatttttattttatgacgaattatgactttggaaaaggcggattgatttcacaaagcaattaacaaaatgcagcgaggggagtggagtgctaaatccataccaaaagacagtgggaaaacgaaatgaaaattttaaattccagtcatagaggttggccaatttaagtctcgcttgctatcccgcggaatgtgcgaattaatttcttttccagcaatttaaatgaaaaataaaaggaatttacataaaaagttacattatttaatcggccaaatttgggttttcaaatttttttttatttaaatgaatgatgtgttaatgagtggagggattggaaagctgaatcagccaaaattttaaaaagagagaaaactcgtcgtaaaatatggcccttcaatttgtcgttgttctcttatcttcactcttgacaaataattgtcggatactccggtcgatgtgtggtggtactaaaaacacaacaaattgattcatcgttcgtccctctccccttcttcacaaacactttttctaatgaaaatgaatggaacggaacggacgaacaacgaaagaatgaaaatgaatgaatcatcaatgctgaatgaggagagagcagcactatttatcgcataattggaatgcctatcaaattttttaaaattgtgctttttgtccgggagaaagcccctctcccgccccccttcctcaaaaaggtggtcagagaatgagtgcaaattttaagaaaaaatctctcctcgaactgtacttgcatataataaaaacatatatatttttaagagaatg

SEQ ID NO: 102571 - DNA, 875 bp, Heterodera glycines
  Promoter: Source sequence=SeqID_11784; Location=1075..1949; Strand=-; Gene=SeqID_75283
attttttattttaagttatctgaacagaaatatacatggcgcggggagcacatggtgagaattcaataggtttttttattaatgaagcagggaaattgttgaaaagccgggacctgcactaccatggactagaaaaagtccgggtctcagttttcaattggaatctggaaaaaagcgacattttttcgtggaaaattttaattttatttttcaaatttaaaattgatattcaaaatgagcattttcttcttttttgcaatagagatttatttataaaaagggtttgaaatatcgaaaattttaaaggattatctgagaaattttgatcaaaaacaatatcaaaaaccctaaaataaaaagaggaaaacaatcaaccttgatgtctattgtggcaaaaaaaaaatttgcctatgactttgctcagaagcaaccaaatttggaactcatgatatcttcgaaagccttaaatgtttctgtttgccatgaaaatttcaaaaaatttcgttgttttcaaaagtttatgactaataatcagggaacggatttatatgtttttacatgttttttttgcgcatatgctatcacatgaaaagctcaaaaatagcaatgttacctgttttctctgaaagtcaattcgtcccagcaccgtcataacgcttttttaagttcccatttcccgttaaataattttttttctctcaaaagtacgtgaatgaaattacacatgcatgaattggggtggaggatatatgagtgaaaagatggaatctaaacatatacaacagatttattgtagcatattttgcgcagacaattaatgttctaataaataagtgacctttaaaattcttaatttaaggctgtttttgaatatg

SEQ ID NO: 102572 - DNA, 417 bp, Heterodera glycines
  Promoter: Source sequence=SeqID_6693; Location=993..1409; Strand=+; Gene=SeqID_62516
ttcttctcaaccccaactcctcctgccataatcaaagcaattcaattttttctctttggaaacatttgaaaataaaatgtcttaataaatgcatttcgccaaaataaaatgttttttaatttttttctaatttttcgtaaaaatcttcctctttcccggcgagatttcctttaaaaattgacgatattttacggggtcggaagaaaggtgggaatctcgttcccgtcccgctttgaaaatagatacctacctaatttttattcacaagtttaggttttgactaaagacaaacaataaatttataaaagactgcattcaaactaatctttttttctctagctttgttgttccatttttgactttaatttgtattttattttgcgtctattcttcaccatttgttcgaatttaaaaatg

SEQ ID NO: 102573 - DNA, 173 bp, Heterodera glycines
  Promoter: Source sequence=SeqID_5997; Location=3988..4160; Strand=-; Gene=SeqID_59968
tacttattattgccaataatttgttcagtagaacaaaatttattaaaatcttaataaattttatttacattaaattatttttttatgtttgtaaaagcagaagatttagatttatattatttataaaaataaaaaattaccaaatttatttttgagaatttaagaagaaaatg

SEQ ID NO: 102574 - DNA, 149 bp, Heterodera glycines
  Promoter: Source sequence=SeqID_3643; Location=5899..6047; Strand=-; Gene=SeqID_51253
tcttattatatttaccaaataaaacttcttttatttattcggtattttttccccccttattcaccccgccctctctccctcgcgcccttccatttttgcccccctttgccgcccgagttaacaagtggtgccgttagcaatcaaagatg

SEQ ID NO: 102575 - DNA, 1003 bp, Heterodera glycines
  Promoter: Source sequence=SeqID_4956; Location=1337..2339; Strand=+; Gene=SeqID_56362
ttaaaaacaaagttgtgtcaaaatgtttccatcccttccatttttggcaataatttttcgtctcccattggcacattgtctaacccatcggtccattttcgtgccttttttcaatttttgatgcctattatatgtaaatagtccttttttcgcgattttttggtgcctttttagtcgtgtctacaaataacttattgaattaataatcaattcgaccagttcacgggaagcggttaaattctgaaaatggggtgtgtcctgattttaatgacaagcactgtactgttattggaactataaattgcgtatgaaaaacttcacaccctgaatttttctttttaattgatacataccagggatggcattccgaggccctaaaaattttcgaaaatcggaattccgaccccaaaaatgtcggaattccgtgccatccctggtacatacccatgggatgcatcgagacgagagagaaaatttatattttaacggaaaacaacaacaaatcagagagtaaaaacgagcataaaaaatggtcagatcactcttattcatcaccataattcaaaatgatcgaacatttctcaaatgcattaaatcaccttcaaataattggacaccatttgcgacgtggcgacaaaggcctaaaaattcgggaaccgcccaactcgtcgcggccaactcgccgcggggccaactcgccgcgcgctttctcgccgcgaggccaactcgccgcgccttgttttttggcaatctcgccgccagaattttttcgtttaataatacattaaaagcaaactttattatgtatttaataagttatatttcatcaaagtttctctccaatttaatatgcttcaaattgaaagtcaacaaaggaagcaaaaattgcagaacgaatgattcctctatattttcgaaatttaatgtggatatctcatgactagggatgatatttttaggctctaaaaatcggaattcagcctaattgtgctacaaaaacatg

SEQ ID NO: 102576 - DNA, 401 bp, Heterodera glycines
  Promoter: Source sequence=SeqID_18947; Location=508..908; Strand=-; Gene=SeqID_83678
agattaatcagaggcacctcttttttggacttttcacagctcaactcggccatgtacaaaccctgtgcaacattccttcgaataaaataattgaaaatgggactttcgaacaaattttatttatagcgaggcatggccagaaagaattcccaggcttttggcctgggaatctgtaggaggtgagctgtgcccttgtccctttataatctgattattttacattttgcttttgtactttgcgctttctgttgaatcctttgacgtaatttctatattttctgtttggtcattttgtctttacgcacttttaaacgtaatatttgcttcgctatatatatatatattttttttttctcaaatcaatttatctgcatttctgataggttttagaatttccaatg

SEQ ID NO: 102577 - DNA, 52 bp, Heterodera glycines
  misc_feature (18)..(19): n is a, c, g, or t
  Promoter: Source sequence=SeqID_20063; Location=1889..1940; Strand=-; Gene=SeqID_84846
aagaaatcattcatttanntctatggctaattttgcatttaggcctgagatg

SEQ ID NO: 102578 - DNA, 55 bp, Heterodera glycines; identical to SEQ ID NO: 99576
  Promoter: Source sequence=SeqID_5873; Location=912..966; Strand=-; Gene=SeqID_59512

SEQ ID NO: 102579 - DNA, 491 bp, Heterodera glycines
  Promoter: Source sequence=SeqID_3429; Location=1878..2368; Strand=-; Gene=SeqID_84653
tgcctgcaattagcgctatctagaagatgtatattaatgtctaattgaaaaaaataaatgataaagtgcgggagaggaatgtaaaacgttatgaatttatacgaagtcaagttgtccatccagttgtaagtgtattaggctacgagatcgctaaaatgttaatgagcaacaaataaatgagcggatttgaagacggaatgaaaaaatttctatgtgacttcatttctctctacccctttgttaattttactacacactactcgattggtaaaccaatgtacatgtgctgaatgaataagtcgagttaaatacccggaagataaacactaccccttgacaatactcaaagttttggatgatttctttagaaaattcgatattctgttttgcccgtcaaagtgaatagtaggctctgattctctttatttatgaagtgcaccaaaaacaatcaaaaaggcaggatagacgtaaatacatatgcaaacataatg

SEQ ID NO: 102580 - DNA, 448 bp, Heterodera glycines
  misc_feature (32)..(32): n is a, c, g, or t
  misc_feature (90)..(90): n is a, c, g, or t
  Promoter: Source sequence=SeqID_30196; Location=618..1065; Strand=-; Gene=SeqID_60631
tatttatgaattaattttgcaaaataataatnaagtaatgaaaagtcagatttcgaaaaatttaaaaacaacaagcgtgggcatttttcnaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaatttcgaaaaattttaaaaacaacaagcgttggcattttttcaggttaagttagtcctttacaatg

SEQ ID NO: 102581 - DNA, 77 bp, Heterodera glycines
  Promoter: Source sequence=SeqID_12728; Location=1..77; Strand=+; Gene= SeqID_76427
cctcatccattatatcgtgagaggccgagaattcgaattcaactcacagacgaaaaagggagaatataaatttgatg

SEQ ID NO: 102582 - DNA, 402 bp, Heterodera glycines
  Promoter: Source sequence=SeqID_33785; Location=694..1095; Strand=-; Gene=SeqID_63737
aaattttttcccccaaatttttttcttacaaaatttttggtttaaaaattcaaatttttgtaaaaaaaattaagaaaaggaatgtacctcattgtaactgcaatcaagggaataaaagattttttgctcaatttttggctgaaaaattttggtcactattcgtcactattttggactttttttcactattttgtcactattttggcactttttcatcactattttagttaactatttcgggatttttcgtcactaaaaagtcggttccctattaattaaggatgcgcgatcagtgcgcgatgttgagcaaatcaaacagcgatacaaaaaaaaaatcccccaaccggcggaggaaaagcgccggaaagaaaaccattttatgagatatttgaccgatttatg

SEQ ID NO: 102583 - DNA, 854 bp, Heterodera glycines
  Promoter: Source sequence=SeqID_13843; Location=1984..2837; Strand=-; Gene=SeqID_77784
aagctttcataggtttttcaaatgtttttaaatcaattttttatgcttatcgcagcaaaaagtaccctaaattatactttattcattgtttttgaattgtttttctcctaagaatacctttgaatttttattgctttttgtaaccaattatctttgggattattaaaaacaaaattttgattataccccaaaaaagttctaaaaatgctcagaagtgaagcatataaaagctatatacggccacatttagagtatgaaatttggaatcctcagaagaaagatcttatatgtagaattgaaagaatccaaaaatattttacaaggattgcctttaaaagatgtggattagtcccaaaatcttatgaacacagattagaaattgacttaaaaagttagaaataaggagaactgctacagacttagtcatggtccaaaaaattctaagagggtatacacaccttaagcaaatgaactattttataataacaaaccgaaacaatagaaaaccccttttgcttcagcaaaagaaatatatttctaaaacaaaaaataacttttttaatagaaccgtatcttttggaataagctgcctaaagaggcaatgcaaattcagaaatataagattttcagaaactatctcctagaaacactaaattcttaatgctattgttgtttccttaaacattgggttcctttagcattaattttttaatttgcaccactgtaaatgtactttttagtaccttgtggttgctcgataaataaatttaaaaaataaataaataaaatatacataaaaaataataactcgaaaaagttggccaaatttttccgaattttcttttaaaaaaatg

SEQ ID NO: 102584 - DNA, 109 bp, Heterodera glycines
  Promoter: Source sequence=SeqID_9388; Location=1923..2031; Strand=-; Gene=SeqID_71220
caccgctgcagatgccgcggcggcggcttttgtcgagccgtcgctgtccgttgagtaaacaaaggaagcggcggaatgatggacagaatgttggcacaacgtgaagatg

SEQ ID NO: 102585 - DNA, 137 bp, Heterodera glycines
  misc_feature (120)..(120): n is a, c, g, or t
  Promoter: Source sequence=SeqID_6975; Location=1..137; Strand=+; Gene= SeqID_63453
gaagcatcacaaaggtatgaaattcgtggtactacatttgcagactgacactgttctaaatgtaaaatcttattgctttttggggaaccgcacagtttggcgggcgcgggtttttttgcncaggccttatgaaaatg

SEQ ID NO: 102586 - DNA, 78 bp, Heterodera glycines
  Promoter: Source sequence=SeqID_12389; Location=1..78; Strand=+; Gene= SeqID_75993
aaaaacccgatcaaattaggtaaataaactaaattgatctgctcttattaagaacatccactgcttaaatatgcaatg

SEQ ID NO: 102587 - DNA, 129 bp, Heterodera glycines
  Promoter: Source sequence=SeqID_10544; Location=2793..2921; Strand=-; Gene=SeqID_73779
ttttgattgttgattaaaccgcacccagcggaactttacaccacccaggtgatcagtttttgtcgatgagaaaccgcacccagcggaacttacaccacccaggtgatcagtttttattgatgtccgatg

SEQ ID NO: 102588 - DNA, 562 bp, Heterodera glycines
  misc_feature (41)..(41): n is a, c, g, or t
  Promoter: Source sequence=SeqID_14422; Location=905..1466; Strand=-; Gene=SeqID_78467
cctcatcaacttctgcaacttttgacatttcgttccccttntaaaaagtttaattgtcgcgccaaaatggttgggtagattggctggtgttgagagaaattgttcggaagaaaatagtcactgcggagaatgatgttctcgcgaatttcatccctttttatagagattttttttacaggaaaattgataagtaaagtgttcgtataaaatgtaaaatttttaatttttctccccatttatagttatttttgtagtcagtcttagtgcagcagaaaagtcatgaatttagtaaatggattacggaagattttcttaaactgctataaagcaaattttcatattttgttttaatggcatttaaattgaaaattccccacccctccaaaaatacacccctaaaaatcgaatttttgacttcagccccccccccccccgcccccgaagccaagggtctggctacgcccttgttttgcgcttgcataaaagaaataattaaaaaatgaatgcagtgtcagtgtccgaatgaattatgatttccagattttattttccatttgtgatg

SEQ ID NO: 102589 - DNA, 308 bp, Heterodera glycines
  misc_feature (212)..(212): n is a, c, g, or t
  Promoter: Source sequence=SeqID_10226; Location=704..1011; Strand=+; Gene=SeqID_73373
aataattgttggaatattttcttgtaattttatatttgcaataaaaaaaattgtaaaattcgaaattttaatgctttttgaaaaattttttaagaggaattttgggtacatataaaattggcccagtaaatggcacgaaatattttaataccataatgtgtccaagaaattttgacatttcgttaccgtgaattattttcgattttccgtanattgtttgccaaattatgtgtttaaaatttaaaaatatatatataaacatattttaaacattaaaaataattatttcccaatgttttaaggtcatg

SEQ ID NO: 102590 - DNA, 186 bp, Heterodera glycines
  Promoter: Source sequence=SeqID_1278; Location=860..1045; Strand=+; Gene=SeqID_71324
aacgcagtttatgtgactaatattttgtacatttgtaaatgcctcgtcctaaattaaattaaaaaaaaaaaaaaaaaaatctttacattaaacatttttgttgattgggaccgtccacaaattagtaaaaccttactttcctcttttagatttttttcaatttgataaaacattaatttcgccatg

SEQ ID NO: 102591 - DNA, 510 bp, Heterodera glycines
  Promoter: Source sequence=SeqID_6628; Location=4042..4551; Strand=+; Gene=SeqID_62260
aaagacaaatctctttcaatttatttccgattttattttattttgtcgcataataaatttggtttccgatttatgtgcaattataataatttttgtcaccaaataaattctgtttgattacataacgaattggatgatttggtatttcttccactccttccgcctttgtatgaacagtaattttaaacaaaaagttatctacttatattatctaatatgttaatccaataaaagcggcaaatttatttgatgcataagtccgccggccaaatgaccttgttttccgattctcctcccattcaccaccaaataaatatgcataaaaagcacctatcgtcttactccattcatttccgtttgccaaaatagtaaataatttggggttaatatttagaaatgaaaattaatcgccgcttcaccagtaagccgagtcgcgcggaaacgagaccccttttccaaattaaaataaaaaataagaccaacaaagggttggtggcctcaaaaataatg

SEQ ID NO: 102592 - DNA, 315 bp, Heterodera glycines
  Promoter: Source sequence=SeqID_30339; Location=1..315; Strand=+; Gene=SeqID_60757
atttagtgcggaaatggcttttttaattttgcaaaacaataaaaaaatttataaataaaagattttataatttgtataaaatatataatattcaaaaaattgagttttttctttttaatttaaagatttaaaatttttttttgtaattctgcaaaactttttaaatttacattaatgggctcaattaatttaattgttaagcttaatgaataaatttcattgaattatataaatttatatgctttgatgtttttgtttgtttattttactcacatttattttatctaatttattttttattttttcagctaaatg

SEQ ID NO: 102593 - DNA, 669 bp, Heterodera glycines
  Promoter: Source sequence=SeqID_2557; Location=1..669; Strand=+; Gene= SeqID_80407
atggaattatgacccattaacttacatttgcattggtgtccctccctttttttgaccattcgaaaatttgaaactaacaaaaaaaaatttttgttttagtggcataattgaggagaatatcagcattagcgggggctatcggccgccacggatattcgacactttggcggtgcaattggtgggcaaaaacgggggacaatgagactttatgcaacaaaaaacaaccctttttagttgttttttccgataattggggcgaaactgatagcggtaagtgtcgaaggttgtcggtatttcaaataaaaagtgccaaaaaacatttcttccatattttggtgtcatatttacagtggtggtcccgctgggcattcaaattttggatacgccggcagccctacgacgaggaggccaagctgtacatgatcaggaagaacttgaagcagtccgaggagcaatttcaggtgcagcaaatggcacaattatccccgggaaaatttctcaagctataaataattcaagaggcattttccactaattttaagacaccggaaatattttattcccaaaatttaaaaaaatgcgaaatttaaattgattttggcttttctatttgcttttaaaatcaatttccgttacttcccggcacaggcaacggagccaaagctgatg

SEQ ID NO: 102594 - DNA, 956 bp, Heterodera glycines
  Promoter: Source sequence=SeqID_11383; Location=577..1532; Strand=-; Gene=SeqID_74777
tataattgtctggtgagaagaggcaaaatgaccaagggacacaatttggtgggaaaaagtaaaattattttcaagaaaaaatgggaaaattaatttagtcatttgttaacaaatcgcattaaaaatacaaaattttccccaacggcgccctattggcaccccccagaccccccccccctcccccccattttcccagaaaattttgaaaaaacgcgctgcaaaaaaaggtgtaataaataatcccttttccaaaaatgttctaaaaaattttgatgaaataaatcattgaatattttttaaacaaatatagaaatatacgataaaaaaaatcaccttttaattggttaagaatattaaaatttagcctattaaaatatttagaaaatttcattatattttatatttttttaaattttccgattccgtttttcgaaaattttttgggcctcggaatgccatccgtggtgccaatgtttgtttgttaattaatgcattaatttggactccataaatctgtccattttttcgctgattttcataagtgtgcattttccccctttctgcgcattgtcagatttctgatgtccccctgccatttcattaaccttgctcaacttgatcatctttttgcggtcgaacagtgcaaaatgcataaagcagaaattacgcgactctttggagaaactttacgaaaagtgagcaaaaaataaattaaaatattaagacaataattttaaaaattgattttagaaaccgaaatttataatcaaacaaaaaaaaagggaattttcaaagtttttacgaaatttaccccttataattgtgttttaattctttttttaatttggcatttccaccaccatttgcttagaacaaagatctcttctccgacttttatgcgatgcgcatttcggatgaggaatttgccggattaatgggcattattttttgggatg

SEQ ID NO: 102595 - DNA, 1003 bp, Heterodera glycines
  Promoter: Source sequence=SeqID_21143; Location=568..1570; Strand=+; Gene=SeqID_51726
catgaagatccccttttttctattaacatgtggaatcattgttaggaccacaagtcaaaacaagaatgaatttataatactttttaatatcagagtcattaatgattgttctgaagaaaggagagcggattgaatgagttgaaccaactcagaggatagtattcgagaaagaaaaaaacataaagagacaagatttgtttttagaacagagcccggaattttaaatcatatttttctatgcgttattatggcgagagaagcccaaaatattttctcagaacatttttatttagggctacttataaaaaaataaaaaccgcccgaccctaaaaatgcatattttcttgaaaaaatttgctcaaaatctgttaacaaatcgcatttgaataatttcatgaaaatcaatgaattattaaaattttattacatttttattttttcaaaaattttcaatttataaagacttccagtttccagcagggtttgatttcgctttcacccttttggagtgaaagattttccgggaaccgggaccaaccgggaatttttaaaaattcaaaaaaattcaaaaatttttaaaaaaattcaaattttaatttttttcaactgaaaatgatacaaaattaaatttttattttgttttttatttaataaaatccaaaggttaaagctaaattaaattaatgaaaattttcaaacaaatttctttaattatttcaaacaattaatcatttttggactaaatgatcgaatattatagaaattcagatctccagaattaaacttgaaagcattatttgtgctgtaaatatttaaattattcggttgtccttaatgctttttgatacattgcacccgttggcccttgggaaaggccttttctcttttttataatgatttaatttcatttttttttgaaattgtgtatatcctcaaatgtcgggtcctcaaaaatcgggtcctcaaatgtcgggaatatccgcaaaagtcgggtcctcaaatg

SEQ ID NO: 102596 - DNA, 294 bp, Heterodera glycines
  misc_feature (36)..(36): n is a, c, g, or t
  misc_feature (48)..(49): n is a, c, g, or t
  Promoter: Source sequence=SeqID_14087; Location=1..294; Strand=+; Gene=SeqID_78061
ttaaatgactcaaaaataaaaaaaattctaagaaanagttggatgctnncaataggcagattcattaggcacttattaccaattatgtaggatcattaaaggcattttccttggctgaattatccctttttatccaatttatttatttatgaaaatttccttattttttgagaaaatgatggaacgcttctccgcttcatttttttgctgcttatttctcccactttttctctcaacatttgaacttggcactgctgtgacaagtaaatattaattgaatgaaagaatgaaatg

SEQ ID NO: 102597 - DNA, 448 bp, Heterodera glycines
  Promoter: Source sequence=SeqID_1466; Location=1..448; Strand=+; Gene= SeqID_73720
aaaaacatttcctcataattgttgccacttttaaaatcccccgctaatttgtcataatatctcaatcatattgaggctcctacagtgatcaacaatagcttcactattttctgtttcatgaaatgtcgagaatctctatcaccaactgacctaaccataatttccttaatctatcccgaagagacagttggccaattagcgctaatttggccttaaacacctcattaaatgccgaatgttttaagaacggttccgctaatttgtttatttgggagctaccggaaaataaaaaataaaaaaaataagcaggactaaggccggccaaatcggtcttatttttggacaaattaaaattgtagaattagttttggccaagtcagtgccgatgcctttacactaattgctgttccattaattcctgcctaatcccaaattgtgcagcagaatg

SEQ ID NO: 102598 - DNA, 569 bp, Heterodera glycines
  Promoter: Source sequence=SeqID_41488; Location=542..1110; Strand=-; Gene=SeqID_69592
ttacggggcagctgcctcacgagccatgcttttggggtgcttccatacgttggagctgtggtataccgctcagtgctgcacgtgtgaaagcctgtgtatggctgctgcgtggcaatgtgtcggtggcgggccgcctcgcttggctggttcgctgcgccaatgtgggatgcacgctcgtggggcgacctaacggctgtgctggcgtctgtgcgtcgttgagcggttgttgtggcaggcacataacacactgactggggatggtggtttcgttcccggtcttacgtgccgtaactagcggtgtgtttgtgcttgctgctacgtccgtggccgtgatgagacgacgcggtagtgcccgtgcttggcctagcacgtggcttaagactcaatgagtgtcagctcgggcaccgccagctttttctttttttttcattatttttttttacacttctgttgaagaatgaattctagtcttatcggtggatcactcggctcgtggatcgatgaagaacgcagccaactgcgataattagtgcgaactgcagaaaccttgaacacaaaacattcgaatg

SEQ ID NO: 102599 - DNA, 417 bp, Heterodera glycines
  Promoter: Source sequence=SeqID_39181; Location=1..417; Strand=+; Gene=SeqID_67811
acaaattccacctgggtgagcacacatttcagataccctccctatcattatttcttagaaataactaataatctgttgcacagttatttcaaaataaattcgaatatattagcttattatgcatcttcagtgtgcattctaaaataaaatcattttttgttctaattttatgatttatttgtttctgttgactaaatagtcggttcttatagcaaatattaatttatatttgcgtagcttcaaatgagcattctgccttcaatttcgaagggaagtgaatttttttataataaattgatagagagcaaaaagcacgattgtataatattcaaaaaatttatctatgcatttgttgaatgttcctaaacccgatcaaattttaaaacctttatatgaaaacatttattgcaggaaatg

SEQ ID NO: 102600 - DNA, 764 bp, Heterodera glycines
  Promoter: Source sequence=SeqID_8193; Location=1440..2203; Strand=-; Gene=SeqID_46563
aaaaattttcaaaaaaaaggatttttgctttagatttttgctattaaaaaaaatgtagaaaattttgggtttcgcattattttcatttcgcattttttattttgcaaattcgcgtttcgcattttattttccaatttggcccatccttggtgggaccccccccccccaagaaaatttaaattttctagaaaaatctggcaatttttaaaaattttattcactttttcttaacaaaatgcattaaaattgcaaagtttttaaaaaggttgctgccgaaacttctgccgcaaaaatttttgttattgggtaacgcgtagatttaaaaaatgaatttttgtgacaatttttttttgttcttcgcggtgttttgtttttgtaaaaatcaacgaaattgaaaataaacgaaaataacaccgtttatcagttaaaataaaaatatttggatacttattttaatttgatttttgtacaataagctactaataaaacgcatttaatgcattatccttaagactcgaaaattttttatgaaaatttttcaaaaaaatctctaatcatatatctcatcatcttattgtaaggatgagcgatcggtttttcgcttgaacttaatcttttgttagttagaccccgctggaaaagattatttttgtaaaccaattagcgaaaattatcacttgaagaaatttacaaaacaaagtgatatgaaatgggaaacttggaaaagatttctaaaattaccacattttgtattttagattatg

SEQ ID NO: 102601 - DNA, 430 bp, Heterodera glycines
  Promoter: Source sequence=SeqID_30511; Location=574..1003; Strand=-; Gene=SeqID_60913
ttagtacatatttgggcatttttcgggtttttagagcatattttgaggatttttagtgcatatttaatgcgcatatttggcattttttagtgcagcaacttcaaacccaaataattagtatatttgacactctgtccataattttttttattgttttaagcttcttttataacttcttttgaaaaaattttaatcattcaaaaccaaatgattggcttctttggcgcgagtaaatatcttgcattatttaactgattaaaacttttaattgcactgttttgtcaaaatgattttcaaatgaaaagccccgtttagcagtgacaccaggtcaatttttatcccacctccaaaaacaggaccggtaataacggcaaagttcttttaatgataataatttttacgattaaatattggaaatataccgaaaatg

SEQ ID NO: 102602 - DNA, 344 bp, Heterodera glycines
  Promoter: Source sequence=SeqID_32241; Location=627..970; Strand=-; Gene=SeqID_62565
atttccttttgacttttaatataaattcaaaaaatagatcgtttccgcttccgttgacgaagtcacggtgaaattcatcatgccaagcggaagatcaatttgcattagcgccaatattatggtttgctaatttcaaatacaatttgcatttggcaattaaaagatgattaaatttcaaattttccattttaaaattgttttcttttctcaatcaatgccctttactaacagtaaatgccactttttaggagaattatcctcgcgaggcgccaatttggttctgtgagtcggaagagcccaccgttttgccactgctcgcgcagctcaccggccaacaagagatg

SEQ ID NO: 102603 - DNA, 230 bp, Heterodera glycines
  Promoter: Source sequence=SeqID_8814; Location=1117..1346; Strand=-; Gene=SeqID_69298
aggtctgcggttgtttttttaggaaaatcactgtcattttagggttccgattcactcgcagaaagggaaggtggttccgctgctccaaccgggactgtgaggcaactgcagcattgagtaaagaaggcggaactaatggtgtgctcggaagaaaagagcacaaccatctgccggacccagcgtgcttccacgcggaggtaaaacgcaacggaattaagacgacaacgatg

SEQ ID NO: 102604 - DNA, 373 bp, Heterodera glycines
  Promoter: Source sequence=SeqID_17522; Location=1650..2022; Strand=-; Gene=SeqID_47454
taggaatttctactttattttttgcagaaatacccagaatattcgtacactgagatgtatcaaaaaacaatggactcgacttttcaacagtccccgggacaacaaagggaccttatgaatttgcccatttattacggccatttggccgatcggatccttccggtcagttgtccaaatgcgaaatgtgcatcgaagtgatggaaaagtttttagctaattgatgtcattttccaacgtgccttggaggtggatattggcccgaaagtgttggactcttttctacgcaatttcggccctctctaccgcctccaccgtataaatcactgaaataatagtaattacccaacttaatttgaatttagcgcagccaatg

SEQ ID NO: 102605 - DNA, 188 bp, Heterodera glycines
  Promoter: Source sequence=SeqID_41907; Location=1..188; Strand=+; Gene=SeqID_69942
aaaataacatttaaatacgccttacactctacagcagaaccccagcaagcgtccctccccagctccccacagagcatcggtgtgaaaattcacatttaaatttatttattaaataacaacatttaaatttaaaaatatatatttaaataacaatatttaaatattaataaaaagtcttacaccctatg

SEQ ID NO: 102606 - DNA, 717 bp, Heterodera glycines
  Promoter: Source sequence=SeqID_23488; Location=1..717; Strand=+; Gene=SeqID_54182
tacgaagatacaatattaaaggtcaataatttgtgcaattttatttaacaattcaaatgactaatttcaaaaggacaaaaaataaaataaaaatacatccattggacaagtcagtggatcaaacctatcctatctttggatcaaagttattatgaagagggaaggctcacaaatgaagacaaatcggaaaccaattacaacaaatctacccaaaactccatggacacttgaggcctctcttttgttagaaaattaatgttggagccgaggggaatggtgagggtgggatccagggacggtcccaggatttcggcttccgcctgctcaggcggcgacttgcctttttttctcttcctctattatgttacccttttctcactcttctctttatttctctctctatcatattgttttctctgtcctccttctctttctctcttcttcctcttttatttcctttgtcttacggaccaaaatatgtctaaccaattctatttcatttttatttttctcttccctcccatgcatatttttagcattgagaaatcaataccgaaattttgaaaaaatggactgacatgaaacaaaacgaaggaataggtaatggtcatttatttttatttgtcttttttctttttcatttattcaatagtaacatttttatataatgaaaacttaaatttaaatctttttttagagtaccaaaactcaaaaatg

SEQ ID NO: 102607 - DNA, 417 bp, Heterodera glycines
  Promoter: Source sequence=SeqID_13162; Location=1..417; Strand=+; Gene=SeqID_76981
attaagaaatagttttaaaaattattattcttaaatagactactacagtttttaaaaagctattcaattttataagcaatacatttagctaattttttgaactttagtgcgctgttataatgtcaaaaactttaatctgagtaaattatgatcaattaattagtaaatacttctaaagatttgaccgaatagcctgaaataagtgttataaaagctaaacaaaaagtataaatattaaacaatcggaataagagctggagtttaagtccattaagaaagccgcacattcacccattctctaatatatttaattaagttatttattattttgtgggtccttagtctgtgggtcgtttgatactgcacccttactgcaaaagtgccaaaaactgtctaataatttgcattaacaaaatg

SEQ ID NO: 102608 - DNA, 252 bp, Heterodera glycines
  Promoter: Source sequence=SeqID_26216; Location=978..1229; Strand=-; Gene=SeqID_56968
tttttatacaaaaattttccctgaaattttgtatttgacagttttaacaaaaaaaccgaatcgtgacaaaaagctaacaaataagcatatagcatttaatcattcaacaattgtattgttctgcaatgcccatttctccaacaacgagcttagtcgctgatcacgaatatgaaacaaaaatgtcaaaaaaaatttgaatgccgatttttgttcgacaaattcaggtccccgtatacggaatctgacaaaatg

SEQ ID NO: 102609 - DNA, 126 bp, Heterodera glycines
  Promoter: Source sequence=SeqID_28334; Location=1966..2091; Strand=-; Gene=SeqID_58968
caatttgaaggatttctagtccaataaattttgaaatttttgaattttattatgttgtaataagcatgtttatttatttttcttgactcttaagatgatgacgagggcgtggtccaaattcgcatg

SEQ ID NO: 102610 - DNA, 1003 bp, Heterodera glycines
  Promoter: Source sequence=SeqID_3011; Location=987..1989; Strand=+; Gene=SeqID_82751
aaaaaaatccaaaatttcggcaaatatttgtacatattttcatttttttacatattttgaaaatttataaagaaaaaataagtttgaaaatgttgcctaaaaataccaaaaaaagtaatttttatgtcattttgtggccatttcatattttacggggattttctttcccaaaaaataccattaaaaaaattttatttacatatttggagttttttgtacatattttgggatttttcttacatatttatgtacatatttggaccactttttgtacatatttttggcagccctagccattacacccctaaatatgaaagtttttagcaactatttacccatttttagcaactattttatggggtttttagaaactaaaaactaattattttggcagtttttatcaactataaatataagccctaataaagacactttgttttctttttaaatctttggcattttgttttttacgccaacaattttctccgtttttttaccatccatgacttaacttcaaaaaattatccttaaacaattttaatggtttttttcatgttctaaaacagggattgcacagaattccgacttacagacattttggggtcggaattccgatttccaaaatttgaaaaatgtcggaattttttaactttttttttggattttgccttcaaaaggattattgtaaaattataaatttattaatttagtataggtatactttttactttattcacagctattgtatttcaatttcaattctttttattccaattttccgcactttcgcaaatgccaaaatcgaagcgcgacagagttggtcagcaatttattattcttcagccaaatttgtccataattttcttcaatttgttttttccttcagtttctctcacaaaagtgaagaagaagagccgcgagggcaaagaaaacattttgaaagaggcgggaaaaaaatttgtttttttttgaaaattccaacaaaaatttaggtcagagaatg

SEQ ID NO: 102611 - DNA, 215 bp, Heterodera glycines
  Promoter: Source sequence=SeqID_3781; Location=1198..1412; Strand=-; Gene=SeqID_51852
attaattcaaattgagaaattgcattaattaaataatgttaacgttacttattttagcaattatcacttgcatctgatggtgtaaagggtgacgttgaggtgattataaatatgaaaattaaagtctgcttaaacggtttaatttgtctaatttattgcactaattatctggatttattttgaatttattaaaaggataggtcactccaaagatg

SEQ ID NO: 102612 - DNA, 283 bp, Heterodera glycines
  Promoter: Source sequence=SeqID_40148; Location=552..834; Strand=+; Gene=SeqID_68570
aaggcattaaaaaattaaatttaattgaaatttcactcccagcggggcggctaattaggaaaatttggaaatgaagtgcaaaaaaaaattcttgaatcggagtttttttctaaagaacggcttgtgaaaaaactaaattcacgggtccactaagtttccttctatggattttttaaaaagcccaaatttttagttttataactttcttagaggtttttttaaattttttacaaatatttcaaagaaattttccgtttttattttactaaaataaaactctatg

SEQ ID NO: 102613 - DNA, 1003 bp, Heterodera glycines
  Promoter: Source sequence=SeqID_18131; Location=64..1066; Strand=+; Gene=SeqID_82715
ttgaaccctttttttggcgggggatggcctcccccgactgtccctcgttttttcttttttccacatttattcattgtccttcttcgatcaactttgagtttcaattgcggagagtgaaaatattatctattatttattttttcaaaatgaggctttttgaacttaaattaggcaattaaaaattttcacttaacatccatgatttgagcattaaaacaaatatttttttttctaatgagcaaattaatttttgctttttttatattattttgcctaatttttgaataggttccgaaaacctggcattcactcctttttggtggttttgccaattttactgtttttcatttaaatgtcttattattggccctttacaatgggcacttttacaaatttatcccaatgtttcttcgtcgtttcgatgttttataattttgcattttttgccaaagaaaaattcttaatgaatttttccactattttctttttcttttttctgctaaacttcaattcggttcaaccatgtggttggctgaaaaatgggccccccacggtgattcaaaggccaatttggacagactcggcaagttacaatggcctggtcagtaaatgaataattttgaattttatttaatctaaattatggtgacatgacaattcgtaccaaagcgtacttgcgccaatggtcttttattaattttttaaatttttatgcattattttgtatgagttgatgctgaccccatcttcgtggcatggcgcatgtgaaattgttatttggggacctctatatttagtaattcattttaactcaaattgacaaagtttttaattaacttaattaatctcaatcattgaaaagcaagaaaatgcttcagtggtccttgagaagaactttacaactctgtcttagattaagatttgcttggttttccttttgtacgggttgttaggaggttgctctgccaatggtcccatttcataccattagaacgcaacgatg

SEQ ID NO: 102614 - DNA, 970 bp, Heterodera glycines
  Promoter: Source sequence=SeqID_25327; Location=311..1280; Strand=+; Gene=SeqID_56079
ggtgggaattccccgacaaaatttgttctttatagcaaatgcgtagaaaaatatgcaaaagcataaaatttaatattgcgacgccaaaatgtcccgcgtcaaagtgacccgacccattaaattaatgattagggttgtaaattatatggattaacatattttttctgcgcatatgctatgaagaaaggggcttaaaaatagcatttctgcgttaaaattttttgatttggtgaaggtttttagtccatataaatccatattttgggggttttcgggaataaatccatatttcgccatttttgggtttttagtccatattttggccattttttggaaattttcacaagaaaaatgaaaaaaaacgaaaaatacacccctaaagatcaactttttggaaatttttaaaaattacaccccacaaaacacgaaaaatttgagttttcgtcgtcattttggcattttcaataaatattttcgtcatttttttgcgaacatttctttttttttaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttggcctttttagtccatatttcgggcttttttagtccatatttaatgtccatatttcgcgttttttagtccatataatttacaaccctattaatgatgaattaattcaaatgaatactaataattagggatgcaatttttaggctctaaaaattgccaaaataggtaggctttgggttctaaaaaaccccaaaaattggctctaaaaacctcatttttaggggtgtaaaatg

SEQ ID NO: 102615 - DNA, 170 bp, Heterodera glycines
  Promoter: Source sequence=SeqID_15936; Location=691..860; Strand=-; Gene=SeqID_80286
tataaacaaaattgtgtaaagcttctttataagaacattgtccgagctgctaaaaattggcaaaagccattaacaatagggcaaacggactttaatttctcacattcaaattatgttttaattgaaaagcaccgattgttaaggcaaaaaacttatttcttcacaaaatg

SEQ ID NO: 102616 - DNA, 54 bp, Heterodera glycines
  Promoter: Source sequence=SeqID_11981; Location=3645..3698; Strand=-; Gene=SeqID_75498
tttttcctttttggggctcatctttcttcccatttgtttattccctcgcaaatg

SEQ ID NO: 102617 - DNA, 1003 bp, Heterodera glycines
  Promoter: Source sequence=SeqID_9963; Location=866..1868; Strand=-; Gene=SeqID_73004
cagtgaaaatcacaaaaaaattaacaattctttttgaatcattttttaattgctccctcagtttagccaaattccaaaatgcctttttccgctaattgcataattatgataaatgcctttatgtcttgagcaagtaaatgaataaagttggtgtgtttaaatttaaaaatcatcgaagataagttgaaaaagcgactttattgggtttaattcctaattaatcatacggaataaaagaggtgctattcttaaattacgtaattaaaaggtgcttttactggtattgaatatatatttcttcgagagtttgcttgaaattctttcttattgtcaaatagccgaaacatttactggtacaaatataatagtactgtaaaggtttgggttgtgccatgaaatgacgaaaaccattttcaataatcgcctcaatgccccgtgtttgaacctgtgggttttgatcggatccgtaaactgcagaagagccacttctcattgcttatcgaattttgatcgtttaatttattaattattacacttaaatttttgattattatttttgtaaaagcaatcgtaatttttgaggaaaaccttccaaaaaaggaaagtgcgaaatacataatttgtgtatttaatttgctttctcttcttcctttgcccattcatagcaaccggaattgctgcgaatgcttctgctttccgtccgatcggttctctgtttgttttccgtccctccaaaatgtccaaatgtttgatcagtgaaaatttcactcgccaactccaaaaaaaaaaacatatttttatttttttgctcggcttcatctcagatcaacaaatatcatttgcaacttttatgaattttaatgttaattatggccgacgaataattgaagaaaaatttaacacaaataaactaatcggcactgtttttcccccgttaattccctcttttagtcgttttgctaatgagccgcccaattttttgacgctttttcccctttaaatg

SEQ ID NO: 102618 - DNA, 53 bp, Heterodera glycines
  Promoter: Source sequence=SeqID_1278; Location=1..53; Strand=+; Gene =SeqID_71325
aaaagtcggaagaaatcgaaaattttgtcaaagagtgtaatatttgccaaatg

SEQ ID NO: 102619 - DNA, 627 bp, Heterodera glycines
  Promoter: Source sequence=SeqID_4577; Location=2267..2893; Strand=-; Gene=SeqID_54962
attattcattcattcattcattaatcatttataatttttgctgatggttttgatggtttcccatcatttggtgacaaatcagttgttacatacatatcagtcaaaaccattttttgattaaatataatggacttactaaattactaaaatcctaatgagaatcattgagattgaatttaaatgcaaaaaattgaaatggttttataacacatataagaaatgttgaaaactattctgataggaatttttatagtatggtgacaattttttttagaaaacttggattttttatttgattttttatcaaaaaatatgaattttttgctagcttttttcaaatttatgcttttttatccttttcattactttttttatgtgtttcaatcttttttgtgcctttcgcatttatttcgtaaaatatttacggaaaatccaccaaaaacaaaatgcattcattcccaatgaatcatctccatcattctgtcacaatttctattcaccacttattcgatctgctgcaaaaccaaatggattcattttacgattaattaaaaaaattaaaataaaattgtaaaaaatattaattttagaaaaaaaaacatcattagaaaaaaaccatctcaaatg

SEQ ID NO: 102620 - DNA, 1003 bp, Heterodera glycines
  misc_feature (75)..(75): n is a, c, g, or t
  Promoter: Source sequence=SeqID_22684; Location=1325..2327; Strand=-; Gene=SeqID_53368
ttttctcaggtcaaacattgaaactaggcctaggcctatccaaaatgttggtacttgttgaaaaaaacatttttntaaaaattatattatcaaaatcgcaaaatccagaccccctgttgtgattgttatcagcggagcgaccggcttgaacacgccgcttagcatcggctgcatcattttgccgtgttaattgccgccattctttccgttgaagtaaattcagtaataaaaacagtaactgaatcaggttaataaatttgtataagcgccatcttaaaaaagagaatctgtaatatattatttattttgcagtaatataaggcaatgaattgcatatatcaaatgcacagaagcgcttaattaagcttttccacggcttaacgcaaagataaaagttagaaaaattgctgtattgttggatcattaatgaaaaaatactgtagcaatgactcattaatcatttcatttttccgaatttgtcaagtggttctgattggattaaaggaagaagaaaagggggaatgtaaagacagaacgaacgaacaattaaaactaactttttttgtcattaagaatgaatggaaaatattttgttcaattcataaattaaaatataaaatttattttatttaaaaaaaacttttaaggggggcatgactttctaaaataaatctccgaattgtcgtcggacacggaatataaaaatatttttcacttttaagcaggatttgtcaaatggttctgatcgaataaaagaaagaagattcaaagaatggaaagaaagaacaatgctaaactatttgtaaaaaatgggaaaataaaagcaatattttattcggttaaaaaattttattcaagagacaagaaaaatatatttataaaatttattttttatttacgggtcttaatttcatataaataaataataatttccctttttttggaattttcactaaacaaaaaaacgaaaaaatttattatacatttacgttataaaacaatg

SEQ ID NO: 102621 - DNA, 725 bp, Heterodera glycines
  Promoter: Source sequence=SeqID_9780; Location=1675..2399; Strand=-; Gene=SeqID_72667
tgttcaagtggataccaaagatagaggaaccattattcgtcccttagatgcgtcattctcacaacccgcattttcgtggcacttatactggatttcaacttttcaggaatatttaataaaacaaattcggctgtataagtgccaatttccgaatatttttcaattcaaagtttcatgggggaaaaagctcgcttctgacttatcacaattttgtctggtcctttttatggctttttgtcgttgtgtgggcatacgatagagttttgctttgttcttaaaactttctttctctgcaatgtgtagtctctatacaactttttaaagaaatttatctgtttatatcgaatcacaattaaaaaagagaccgacgaattattcggtttattccaaatattgtctccgatatacaaataatttctataaacaaattttgcctgtttatacctttttaagttgtcagttttaatgtctaacataacacctggaaacacaacacagactcagagaggttttgtaggataaaattcctttctgatttatccaatggttaaggagagggaggaggtgacctcagcgcagataaagtggagtttttgtggtgaattaagatgaataattgtttggtctttcagcttagggaaatcaactctctgattgcggcatttccgagttccattggacaaacgccgcctgattccgcgcttggcacagcactgaacaatatg

SEQ ID NO: 102622 - DNA, 1003 bp, Heterodera glycines
  Promoter: Source sequence=SeqID_453; Location=784..1786; Strand=-; Gene=SeqID_53089
aagcaaaagtttaacattaataattataaaaaggtttcttaaatatatttattttgataagtagtcgataatttttttaaattttgataaaaaagttttttttcaataattaaacaaattcaagtaaaaaacaatgcaaatgaaaacgggggagggtaatttttatttcggaataaatttaataggaaaaaaaacatgaacagaatttttacagcgttggaaaaagataaagaaaaatacctacctattaaaagatttaaaaaatcaatatatcataaaaaagttttaaaaaaataattgatcaaaataaaaaaatattaattcatacaaatcaatgtagacaaaatctgtgttcaaaagtttaataattgttgtcgcggaaagcgacataaaattcattcaccatttaattagttttttgttcattaatttgtcgatcaatttgctctcggtcgcttctattatgagtcatccttttcccccttcattcattttccctatgaatcatccatcgatcgattttttgtatgcacatttgttcacgtgatttcctccgccccattgatttgtgagggtataaaagcccgccccattttcattctcttcacttcttctgctcagcacagaattatatttgtttaatcgaataaagagtaagagaaaagctcttctctcaatctgtaaaggggacattcaggagccctttcatacagaccattaaattgacccccgttgggtcattaagagggttaaagagaactctcagtttcagtgtccacatttgggcactgaaatcatcacttgcattttttcaacactgtccccgtcggacagggaaaggaaagaattcccttagagggaaagatttcctttccagtgattttttgtccattccgcgacaaaaattggagccccataggggtcaagctccagtcgtagcttaccccctcaatgagagaagtccaagctttgaataaagcttgtccaacattcgtaagagatg

SEQ ID NO: 102623 - DNA, 1003 bp, Heterodera glycines
  Promoter: Source sequence=SeqID_5246; Location=1346..2348; Strand=-; Gene=SeqID_46006
ttttcaccaaaattcacgttcattgctcaaaatatttttaggggttttccgggtcgggaaaaccgattctgacatacaaatttgaaataattgaagcgattttgtgcataaaatgtgaattttcttgaaaaatggaatttgacttttttgttcgaatccgggttcggggttcgaattgggtcaaaacagatgccagaatcggttttcccgaccccgaaaacctataaaacgaatttatctaaaaaaaaatttttgaaaatctggacaccgataattaacaagtacccattttacattaattatttggtaccgataagaaaaaagctatagccaaaaacatggtggggcccaaaagagaggggccaaccaaagtgaaccgataggggaagagggagtttcttaagatggtccaaatttattcactagtgtcttcacacctctattttagggccgtcattttagcgtggattacgattaaaaatcattttgaatttgaaaataaaggggaatccgaacctgaccccatcccagcagaattctgctgcttctgtagcctaaccaaaaaatcgccgaaaaatttattaggtcataacttttctctctgttaaccaaaaaaagagcttttaaaatttgcttatttaaatagttttaaagtttttttttattttttcgagggaagaagtgtgcactctttaaataaacaaccaataatgccgaatttgtgaacaaattttctggcggacatacgacttcaattccagtggaaagcatgacaagtaatttaagtgtattatgccgcaaaacaaaacttttttttctacaattagtgctggattatatcataaacatatggccctaattaactgttcaaatataacaattgattacaacaccgtggatgattgctttaaagaaatgagaggacatgggtactgtgtattgacctacaattgccccctaattattggattaaaatattccccttttttcaatttcagggatg

SEQ ID NO: 102624 - DNA, 69 bp, Heterodera glycines
  Promoter: Source sequence=SeqID_29473; Location=1..69; Strand=+; Gene= SeqID_59971
tcatctttccaccgggatttttggggtcactgatccgtgataatgacccccccccctccccgaaaaatg

SEQ ID NO: 102625 - DNA, 478 bp, Heterodera glycines
  Promoter: Source sequence=SeqID_4123; Location=659..1136; Strand=-; Gene=SeqID_53262
tggcacagagttacggttttgtgcaatgaataaaaagcattgctcagtccacagagacgaggcagactcatttcagctcaaatcaggccttttaaaaatcgaacattctattgaaaaacacatttaatgtgccaatccttatattttttataaaaataaaatagtcattatctaattaaccaattgttgcattattatatcagttacttactatgctatcttttttattggcttgttcctcaacctttgttcagtgccaaatttaatgccaaatgttgtctcaaattgaggaccatctcttcctcagtttttggattgaatatgctcaaaagtatttgattgatgctaaggtgataaatgggttttgttgtgtcttgtttcttccacttttttgattggccgtgttctcactgttgcacttgaccatattccccaaattcggcaccttcaaaatgtggagtaccgacacattcgaatg

SEQ ID NO: 102626 - DNA, 305 bp, Heterodera glycines
  Promoter: Source sequence=SeqID_8767; Location=1..305; Strand=+; Gene= SeqID_69155
tatgaatgtgaagctggcggcaccgccttttgtatatggagcccattgttcggacacttttctactgatcgttgacagaattgtaagtaatctgtcggataaatgggtcacttggccatcatttcccttctccaataaatattttgtactttttttcgcttttctaataatttccccatagacgaatgaataaccccactaatttttcttggctgctcgtcaacaattgcgtttgtcctgtgaaggacaacttatgttaccattttccgggctataaaaagccggtgatttgtgcccataaaatg

SEQ ID NO: 102627 - DNA, 248 bp, Heterodera glycines
  Promoter: Source sequence=SeqID_12562; Location=1..248; Strand=+; Gene=SeqID_76220
aaatgccaaatgtggttaaaatttacatatatgtggaaggaaaggccccaatcgttagtttcactttgctttcaattttacctttatttcctaaacccaaaatggattattataattatgaccgattaatgaccgaatgtcccaatgaaattgaggcaatcaaatttttccaaaccaatggcctgctacacgcgcaaatgtccggggcgcaaatgtggggcaaccattgaattgtacgatccaagatg

SEQ ID NO: 102628 - DNA, 141 bp, Heterodera glycines
  misc_feature (76)..(76): n is a, c, g, or t
  misc_feature (86)..(86): n is a, c, g, or t
  Promoter: Source sequence=SeqID_14799; Location=1402..1542; Strand=-; Gene=SeqID_78948
aaacgactatgctaaaacggggaactaaactgtattaatattttacaattttgccgcccttttcgcctaccctgtnaagagaatcnttaattcactaaataatttctcaattttcttctataacagattactctttacatg

SEQ ID NO: 102629 - DNA, 215 bp, Heterodera glycines
  Promoter: Source sequence=SeqID_5094; Location=1..215; Strand=+; Gene= SeqID_56879
tggggggggggggggaaaacccccgcgcattttttatgaggaaattcattttttgaaattataaattttaaaaaaaattgtgtaaaataccgtaccccgcttgaaatgcctatcgttggcacagtaccgtacctcgcttatgtttgccttcacaaacagatcgccaatacgaactgatcagaatagcaaacgcggcgatcgacatctacagtatg

SEQ ID NO: 102630 - DNA, 68 bp, Heterodera glycines
  Promoter: Source sequence=SeqID_18559; Location=1..68; Strand=+; Gene= SeqID_83186
gtttaattaattgttcaattaactcaatttggcttaatttgtttgactgttccgatcaacaacaaatg

SEQ ID NO: 102631 - DNA, 272 bp, Heterodera glycines
  Promoter: Source sequence=SeqID_20327; Location=1..272; Strand=+; Gene=SeqID_45572
atttgagaacgacggaagagagaaagatgatgatgggctttcgaagatttgagcttatgaaggagcgatataacgaaaaataccgtatcgcaaatctgatcactgaagcattgggacagtattcagaatgagaattcacttttttgaaagtttatcatttttttatccatgaaaaaagtaaagtaacggaataaacattctttttacagtttttcgtcttcatactttaatagcaattaataaattcattcggctctctatttttccagatg

SEQ ID NO: 102632 - DNA, 250 bp, Heterodera glycines
  Promoter: Source sequence=SeqID_1626; Location=595..844; Strand=-; Gene=SeqID_74922
taatgcggtgccgcgagtaataatgggccacaacgcaaacattgtaggggcgcctcaggttaccataagcaagcattgagtcggcgccctcttccgtgagtccagcaaagaaggcgtgtgggtgaagccattacggtcggagtatgtagtgatgagcttacgatgcgcaaattccttcaacaatttttctcgatccgcaacgctagcacaaattcgcgcgcccacttcttcaggggaacagtccaaaatg

SEQ ID NO: 102633 - DNA, 461 bp, Heterodera glycines
  Promoter: Source sequence=SeqID_9175; Location=1..461; Strand=+; Gene= SeqID_70494
aattatcttaacaaaaaagccgtaaaacgaaaaatacatccatagcatttacctcgaaaacgtttgaaatattcgtaattttgcaactgctaattatgaataaaaaaaattgtttttttttttttgcatttttttcgtgtttcatatcaattagaatggaatcttcatttttttgttttgtttctttacgtttacatttgttatttgatcaacattttcataaatcatttttttttgtaaaaaaatgatatgtcagaaatttttattaaaaagaattcaaagtgtttagtgtatggtgtttcatatatttaattacgtaaaattcctccgataaacaaaataattacttcgttttttttaaattacattgaatttattacacatatcaaaaattttatcagttaacattttgtatttaattgattcaacattatttacttgcagaagacatgttcaaaatg

SEQ ID NO: 102634 - DNA, 381 bp, Heterodera glycines
  misc_feature (265)..(266): n is a, c, g, or t
  Promoter: Source sequence=SeqID_37491; Location=110..490; Strand=+; Gene=SeqID_66553
ggtcgatctctagttttgaaattatctttttatatgaattataataatttgtcaatttaaaacattataattttttattttttcttaatcatttcattttgcttattgattatccatcctttatttaaaatttataattgtatgaatataatcttttctttacattctaatattctattaaatttttttcttcgttctcattgtttgctatgatcatgcttttttctctctttttttttttttgcgttgcccaattccccccccnncccccacccattttcatttttcattttattaatatgccttttttaataatactttttttttgcccttttgcattttcttaaatttattttcattttaggctaaagaaaaaaaatg

SEQ ID NO: 102635 - DNA, 160 bp, Heterodera glycines
  Promoter: Source sequence=SeqID_2508; Location=1144..1303; Strand=+; Gene=SeqID_80125
atattaataaatcaatttcctttcctgcgcaatcccaatcaggataataaatgataaaacaacctgatgcgcaatgcctatataaggcagcccctttttctatataccgcataattttatttcgcaatgtatcctttgtatcctactgtattgaaacatg

SEQ ID NO: 102636 - DNA, 104 bp, Heterodera glycines
  Promoter: Source sequence=SeqID_19415; Location=149..252; Strand=+; Gene=SeqID_47583
ttttggcactgtcggccaccgcatttaagcgccttggggccaacaaaaaggcattcaatcccaactccccataatcctcctcttcccttcctaggtcaataatg

SEQ ID NO: 102637 - DNA, 149 bp, Heterodera glycines
  Promoter: Source sequence=SeqID_28821; Location=1..149; Strand=+; Gene=SeqID_59392
ttcgcgattttatatccatattttgacagccctagttatggccattatttttggccagcagaccattttaatcttccttttcgcatccctttcaaatatataatgaggtcaaaaagactttttcattcataatacatatcgcaaaaatg

SEQ ID NO: 102638 - DNA, 73 bp, Heterodera glycines
  Promoter: Source sequence=SeqID_39044; Location=300..372; Strand=+; Gene=SeqID_67709
ttttggatgccttttgaacaatttgtgttttatttcgacgcggtcgacattacgcagctgagagaacatcatg

SEQ ID NO: 102639 - DNA, 777 bp, Heterodera glycines
  Promoter: Source sequence=SeqID_7233; Location=1..777; Strand=+; Gene= SeqID_64210
ctatttttacaagttttttgccttaaaacggccaaaatttggtcatttttagtgaaaaagtaagtgcagttgttacccagcagtggaaaaaaagttattggttaaatagcaaaaaaaaaaaaaaaaggttttcaggttcgggtcccccccccccccgaaaaaattgttttagatacgcccctgcggtcaaccaatggcacttcgtacaattttttgttttaaattttagaagaatgttttgctttttttttaaatcacattttgattaattaaaaatttttctacggacttccataacatcacaattcgaatgccatacataaaattgcctataatattccatggccattaattttaaaaattgtttaaaaatttttaaaaaattaaacccaaaaattatttgaattgttgtattaattcacaagaaaaaaaagtccgcgttacttagaggtaatcaattctttctctaactgtcagttctcttcttttcccacactctttcaccctctcactatactcttctgtaggaggggcaaaaaataaccaaaacatttggctatttccatcactgattttttttttttgttgcttttgtttttaaaaaagaatttccatccaaaacctttgggttggaattttaaaatattttcttctggcgtaattgctaaaaatgccaaatttccaattaggtattttatgtaaaaatttaaaaattaaatttgaattccaaatactcccataattgtttttttccccaaaaggtatgcccgtgacatg

SEQ ID NO: 102640 - DNA, 201 bp, Heterodera glycines
  Promoter: Source sequence=SeqID_20043; Location=1..201; Strand=+; Gene=SeqID_84817
tgataatgaatgaattaatcaattgactgattggtcggcccttccttttcaactttcgtatattttgtaaccttttgaaattaatttccattttatgttattttattaaaaattttattatttttttttctttcattttaatggctgccttttaatttttattttctccatattttcttctcacactttttcaaattaatg

SEQ ID NO: 102641 - DNA, 512 bp, Heterodera glycines
  Promoter: Source sequence=SeqID_9925; Location=776..1287; Strand=-; Gene=SeqID_72957
agtctctcctttctcttcgcgttcacacttttctttcttgtcctcctttgatacttctttctctttcttggcaaataaatctgatcttccgtgccccaattaattttagtcttactcgttctaacatttttttttacttattcctctttcttttctctcttccatgaccttattttcaccttttccatcaaatattattttaaatgaggaccagagacggtcctgttgttggtgtgaggggctgagggcgaaagctcatatctaaactaaacaaattaatgttccgcatggctacggccgcttaaattacgacacaacggctacggccacctaaaaatctcaaaattgtggaaggtgtggcgatttctgatgaatttaagttcagatctaaaacaaataaaattctgatggactccgtcgccgtgccttttcttttggacaacgtcccgtctttcaagtttttctccaggagctttgtcctttccaatcacttcgtccacactttcaacatg

SEQ ID NO: 102642 - DNA, 89 bp, Heterodera glycines
  Promoter: Source sequence=SeqID_27929; Location=461..549; Strand=-; Gene=SeqID_58593
aatagcttctgagataataaggtttatcataaaatttcatttaaaaataaaccctcaattattggtatgaacgatactttccaaacatg

SEQ ID NO: 102643 - DNA, 355 bp, Heterodera glycines
  misc_feature (56)..(56): n is a, c, g, or t
  misc_feature (93)..(93): n is a, c, g, or t
  Promoter: Source sequence=SeqID_18962; Location=1..355; Strand=+; Gene=SeqID_83694
gggggggggaaaatataattttgttttagaaaaacactgaaaatcaattaataatntaaaggaaaaataaagtttgtttatctgtagaaattntaaaagaatttcttgaatttttaacttaaattaaattttagaaatgattttaaatgtaaaataaaattatattattattatttaataattgttgtgcaaatttaattagtgcatttcattatttatgtaatttccaattcttgtaatatttttttgctagacaaaagtcaaaaatgataaacaaaatttgtttatcccaattaaacttatcaaatgacactataaaaacaattttgtcaaggcaagtaaatgtgcagggatg

SEQ ID NO: 102644 - DNA, 666 bp, Heterodera glycines
  Promoter: Source sequence=SeqID_11206; Location=886..1551; Strand=-; Gene=SeqID_74564
tttggacagaatttgatcatcaatcgtgccagagcacataagagcgaaatcgatcgaatgcaattgatcaagatcagtgagaattgtcggtgaagtgcggcgacgcaaattgtccaaagcatcgccactggtaaagcccagtgcacacttcagatttttgttgtttttttaatatgggttcaatcccatatgcccacactttattttaccgttttttcatttaatttactattttaattactaaatctgttaacaaattacactaaaattttcaaaattttccccagcggcgcctatcggcaccgccgggcccacccaagttccccaagttttctgaaaaaatgcgccgcaaaaaaattgtttaaaatctgatttatttaaccctataaatgatgggagaatgtcttgaattcaattgatcaagatcagtgagaattgttggtgaagtgcgacgacgcaaattgtccaaatattatgtaaaaattaattttaggaatttttgcaaatttgaccattttcatcgatttttcggaattttgatcgtttttttctgatcacttttggcgcggagccaaaagaagccgaaaattcaaaatagtaaatcgactatgcctctacacgataaaagtggttataaagtgatttggacatttacagtttgatatg

SEQ ID NO: 102645 - DNA, 98 bp, Heterodera glycines
  Promoter: Source sequence=SeqID_44156; Location=1..98; Strand=+; Gene= SeqID_71683
caaatcttaatatctggtgaaatttgagcaatttaatatcccccaccattttttgtcgattttgaaattccgtttccatatttagtagagtccgcatg

SEQ ID NO: 102646 - DNA, 226 bp, Heterodera glycines
  misc_feature (24)..(24): n is a, c, g, or t
  Promoter: Source sequence=SeqID_29788; Location=1..226; Strand=+; Gene=SeqID_60247
ccgatttgctccggaacaatttancaaatcggcagaatccattcctatttttcacaaaagggtctatctttgagtccgaacaattgagactcgagcaaagtttaaaagacatgtcaaatcggatgatgcgtcccgagttggattttactgatgtgagatttatggacttaaacctcacggaggcacacggagattcggtagccggacgccccctgaggaccgaatg

SEQ ID NO: 102647 - DNA, 55 bp, Heterodera glycines
  Promoter: Source sequence=SeqID_35486; Location=1..55; Strand=+; Gene= SeqID_65026
atttcatactttaattttcctcaatcttattttacgatttttattgaaaaaaatg

SEQ ID NO: 102648 - DNA, 446 bp, Heterodera glycines
  Promoter: Source sequence=SeqID_41184; Location=658..1103; Strand=-; Gene=SeqID_69371
gtacttttctgttttgtcacaagccttggatttttttcatttagatttttaggggtaatttgaactgctgagaaatgcaatacaattatgattccgactccgtaatgtttgaatgtcctaaccaaatcgaaccatcaaattttttcactcaataaaagacattttggcgtaaaatgctgtagcttcttcataaggtgctagtaccttccctaaatccgccatcaggcatatgatgtgtagtaaataaatatggactaatttattatttattgcacaaattggcggaatttaggaaatgtcccaacacggcttcatatccagggaggggggggggggggacaaaatagaaaagtatgcagtcttatcatagcataagcttcattttttataagaattatttggttaaaatctcaacccaactaaacaaaataaattaaaattgcatg

SEQ ID NO: 102649 - DNA, 1003 bp, Heterodera glycines
  Promoter: Source sequence=SeqID_354; Location=409..1411; Strand=+; Gene=SeqID_84015
aaatttatggaaaaaccaggggaacaattccataaattcatgaaccaaataaataatttaaaattatttttttagaaaaattacccttgtgttgggtactaaaatttgtattccgaaatagaggctttttaaataaatatatggaaaacccagaggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgttgggtactaaaatttgtattccgaaatagaggctttttaaataaatatatggaaaaaccaggggaacaattccataaattcatgaaccaaataaataatttaaaattattttttagaaaaattacccttgtgtttgtcgcgactcacgtcacgagaaataaaatggaaatgataaattttataagcatgatgcaatttcattaaaaatggggaaaaccttaatttaattggaaatgttccccctcttcgtcgttctattcaaaaaatatttgtttgtttacattcaattcttattcatttctcacacaaaaatgtattaatcagcgaatgacaccctatttaagtcgtggaattgttattgaaatgggttcagtcggaataaaacatcattcccctgcttgtctactgtttgtcccaatttctattttgccaaaatttttgccgggccgaatttgcctctgtttggtcccgacaagtggtgcaacggccgggaacctctgcactgatgaatg

SEQ ID NO: 102650 - DNA, 137 bp, Heterodera glycines
  Promoter: Source sequence=SeqID_8435; Location=2486..2622; Strand=-; Gene=SeqID_68058
atgcgatacttcgaaaaaaggtgcaaattaactgttaattagtactaattaacagcaataattaataccccattaagattcgctttggcgttgctacgttcgttcggcaacttttcgaattatctcgcaaaaaaatg

SEQ ID NO: 102651 - DNA, 202 bp, Heterodera glycines
  Promoter: Source sequence=SeqID_17094; Location=618..819; Strand=+; Gene=SeqID_81529
tcgcgatacttctttttctgtgcaccatcatgcaccaatttatcattatttagttttgtttaattacttgctgctggttcatttgtagttaataaaagcttaactgtcaaaacattaaaagtaattttaaaaaattaacaaattatttgaatgcaatttttttttgcatatccactcgtacgaaaacggcggtacgaaaatg

SEQ ID NO: 102652 - DNA, 682 bp, Heterodera glycines
  misc_feature (52)..(52): n is a, c, g, or t
  misc_feature (73)..(73): n is a, c, g, or t
  misc_feature (91)..(91): n is a, c, g, or t
  misc_feature (99)..(99): n is a, c, g, or t
  Promoter: Source sequence=SeqID_30755; Location=900..1581; Strand=-; Gene=SeqID_61150
agacttattttttaattaaaaataagtgttatattatctcccatgatccagncaatataaaaaattgtttttntattccttttttatatgntaaaatgncaaaacaaattttatatgtggtgttgttttgctaatacaatattttgatatttgctttcatgcccttgaaatggaaatttttaatggttatgcgaaatatttgcaaattcttactataacagtatttgtttatgttatcaatatgattaaattcgttttaagacacgcttgttgtatttttggcccagttcgttccgctcaaatgggccgagtaccgtagtgtcgtggtgtgttgcgtttccacaatgtccatggcctggttactgtatgcaatggtgcactttgactcgctctttgccgattacattctttacattgtgctttatatgttttacaatacgctcaatgccatttccaggtcactatggcgccaaaaattttcggcaatttgaaattcgatgattcaaaaaatttcggaaattctacccccaaaaatgccgggcaatcctataaataaaaaacccgcatcttttattgactatattttaggttattttgaacaaaattaaaaaaatcttaggtggattattaccaaattctaaaagaattaagccgggagattgagtttcaacaattaaaaatg

SEQ ID NO: 102653 - DNA, 1003 bp, Heterodera glycines
  Promoter: Source sequence=SeqID_108; Location=4821..5823; Strand=-; Gene=SeqID_70625
ttagccgcccattgatcctccgattttggagaaagaagaaaacggaggggagccagccgcaaaaagaacgaaagcaaacgacgaatgaaggaacaaaagggaaagaaaagggcacggcaaaatttgacagaaaatccattgccataatgtttttttggattgtttaaataaagcgtaaattaaatgattttaaaataaaatttgttgatgtaattttctcgcattttcttgagtctgaagtataacaccaggcaaggcattccgagctccaaaaattttcaaaattctgaatttcgtgccatccctggtatgcaccagccatttggtccagtggtagggaaagggacaaatgggcgaaagtttccttttattttgggtacaataattggagaaagaaatggattcatttgccataacttttttctgagtgcaaattgacaaggaataattattgcataattggcgactctttgtggaaaatgcgcagatgatacggtgttccaaaacttaagtatactgtagttggtataccgtaggtagttttgtttcctctccatccaagtcacacaaaaattcagatcaccaaaactgactgcccatccctattttgtaccgtataccattttttccattagcaccatacataattttatcattttttgcactgcctttgcaccgagcgaaccggaggaaattcaaattcagagcgtgaatttctgaatatctggcaatcatgtcgatcattggtccggaaatttttttctgtaaattctaataacatgtttataggggtgttttgaggcgctgagcacgaacccggcctccatttcgaccattcagaaaaaaattaagaaaaaatttcgagacaaatgatcgacatgattgccaaactcttttccatatgccgtaattgtgccgttaatttcggcgggtgcgaatttaacttcggggaccgtttttccaatttttctgcgttcgacaccctttcctcttacgttcaatg

SEQ ID NO: 102654 - DNA, 453 bp, Heterodera glycines
  Promoter: Source sequence=SeqID_15833; Location=467..919; Strand=-; Gene=SeqID_80157
ttttaacaatatttattctgaattaatggagattaacaccaaacttatttagtgaatgttaacgtaaattcatcaaaatcatatttgttatgtaacggcattttatgtagtgccccagcttcagtgaagcagttaaaaacaggatttcattgttaaagtatactgtatatatatatatatgtctgggatcgactcatttccttaccaccgtttccttaccaccggttccttaccaccgtttccttaccaaccgtttccttaccagccgtttccttaccaaccgtttccttaccaccgtttccttacccacgtatttggttcatttccataccaaaaaaagtttcacaaattttggtaaaaatttcaaaaatagaaaagatttccagcggttggatgcttatcatgaattagaataaaatcgacttaatttctaatgttacagctaagaaaatg

SEQ ID NO: 102655 - DNA, 118 bp, Heterodera glycines
  Promoter: Source sequence=SeqID_25029; Location=977..1094; Strand=+; Gene=SeqID_55762
gctaaacaaaaaaaaataacaaaataaaaaaggcatttgatgaccggctatgaaaacttcgaacaaaatttcgcctttcacttctgccatatcaccgcagtacaaatagaaaagaatg

SEQ ID NO: 102656 - DNA, 120 bp, Heterodera glycines
  Promoter: Source sequence=SeqID_29068; Location=279..398; Strand=+; Gene=SeqID_59632
tttcttcggcgcaaaactgaggcatccgatcacgaaattggcgacgcttaaagaacaaaatctgttagtggaaattgtttaatcttaatttttaatccgcgactttgtttgctcgaaatg

SEQ ID NO: 102657 - DNA, 702 bp, Heterodera glycines
  Promoter: Source sequence=SeqID_35629; Location=259..960; Strand=-; Gene=SeqID_65149
ccgccggggaaaattttgaaaatttgagtgtgatttgttaacaaatttcaacaaaaaaaggctggtttatgagattactaggctcaatttgtatggattttctttaaaaaatgataaaatacaatttaaaaaattaagaatcatattttgtcgataggaaacccacgagtatacaaaaaaagaaaattcaaaatattttaatttctgtagagggattgaaccaggtggaagaagaagggaaagtcaaggagactagccattaagccacttgcacactttagcagtgttacttttaaagaatatattaatttttttttcctttgactctaattttcatcactaatttttccataattttttggaaaaattctcaaatgtgtttggcttagaatttagggagaaaacgatgaatcaagtttgggactgacttacacgcttccacgctaactctcgaaaaaatgaattgcccaattcagtccgggcacattaaaactcaaacaaaccgaattattacatatttcgggtatttaaaactattttttgggagaaaaatattgtaaggaaatgaggttgggctttttaacctgcaacaatagttttgttgacaacctcgtgagcctttaacaaggaataaaaaatttttaaatttaaaataatgccaaataaaatttaaatctctttctaaagggtcttgaaccaatg

SEQ ID NO: 102658 - DNA, 217 bp, Heterodera glycines
  Promoter: Source sequence=SeqID_39597; Location=367..583; Strand=+; Gene=SeqID_68129
ggttattactaataaataccccccatttatgtctgtccaattttgtcttttttagcgattgtactttaactaacaatttgggcaaaaatggaccctccgccctagccaaaatattattacataaatctgtttaatcctccacggttcttcactttaagccaattcgtcgtcaaatccgcgcaccgttctcgatgagagtggtggaccgaaaaagatg

SEQ ID NO: 102659 - DNA, 911 bp, Heterodera glycines
  Promoter: Source sequence=SeqID_10569; Location=1193..2103; Strand=-; Gene=SeqID_73809
gtatgtgatgggaaatgaggcgagagtttgcgatttttggtcaagctgtgagaaaattagtggagaaacaaaaaaaacaacaaaaattcaatttaaaaatgcataaaattggaaattgttttggtattataggaaaaaatttttgaactcgatgaaattagaaaggttgattatttttaattcgattaaaatagaaatttaaatacaataaatttaatttatatttatttttaattgatattttaacaattaaaatttactattattattttttaattattttattatgttaaaattatttaaccgaattaagaaggaatttaaatcatattaattttcaatttattaaaatttatttttaattattatttttaatatattaaaaaaaactttatttaaaattattacttagatcagaaatatatgtatattttttaaaaaaacatatttatttataacattaatttaaccaataaaataaatattattttgataaaaaaaagaaaattcaaagaaatttttctctgtataaatttatacaatttataattaaattaaaatatttttaaaaataacttttaatgcccaattttatatttttttaaccttcaaattcgttcacaatttttcgtcatgtcagcagtcatttccattcattgtttgttattcattcattcattctcgtaaatttttggatttttacaactaattttacattgccttttatggttggttgtttgtttatttttgattatgatcggatcaatgaccataattttgtttatatttttttgaaccttttttttgacaaaaaatttgttgaaatattatatttttatctatattcatttttttaaaaatttcattttaattgaaaaaaacagatggaaaatgaaaatttttgaataatg

SEQ ID NO: 102660 - DNA, 841 bp, Heterodera glycines
  misc_feature (11)..(11): n is a, c, g, or t
  Promoter: Source sequence=SeqID_22518; Location=1..841; Strand=+; Gene=SeqID_53184
ccaaaatatanaggaaaaattttttaaaacattttttctccatcttcctttttgatactaaagcatcagagtgctaaaattaagttctaaataaaatctgggcgcatcggttcgggggaaaatatccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacatttatg

SEQ ID NO: 102661 - DNA, 1003 bp, Heterodera glycines
  Promoter: Source sequence=SeqID_2325; Location=1760..2762; Strand=-; Gene=SeqID_79136
tcaattttaattacagtcacggtcaaaagtattggagcgaaaaacaattttttttttaaatccgattttctcaaaaatgaatggtggcaaaaaacttataactcaattttttattgagataaaattctgaaaaaattcctgctaagctaacttttgacactgatcagaaaaggcttttacaccaacttgatcagatcactccttcatggtgatctgaaaagccaaaaatggcttgaaatcggggaaattttcgaaaaaaattcctaggaggttaggaaaatttttctggaaaatttgagtaggcctatgaaaaagagcacaaaattctctacaaaattgtcttttggatggtgagtctacgatgaatacccgcagagcaagagagggtgtcaaaattgactaccataaaaatgactgattttctaccattttcccttgaaatacggtagaaatccagtagagatgtgccgtgattcacggtcacggtcacggttaccgtgaatttcacgggttttttcactcacggtcacgattcacggtaccaattcacggttattccgtgaaaaatttacactggataaaattgaatatttatgaaataatttttttctatagagaaatttggtcttttttttgggaaatttttggtaagaaacagagtaaaattttcaaaaatttccccggcggcgcctatcggcaccgccggcccaatctctattccggaaactttttgagcaaagtcaaaaacaatattgtgcgaaaacaaataaaaagcaaagtttcaagtacatatgagcccatttaaattaaaaaattcattaagtttattaaaaaaattcgctcgaaataaagttattttgggtaaaatcagttaataaatcacattttctaaaagtttccactaaaacccatatttttcttaaaaattgggtaaatatgtctcacaaaaccatttataaaaggtcggattcaatttagaacgtccacaattatgcgaaaaatg

SEQ ID NO: 102662 - DNA, 166 bp, Heterodera glycines
  Promoter: Source sequence=SeqID_13517; Location=912..1077; Strand=-; Gene=SeqID_77416
tttatttctccttttctctctctctgtctcttcatttgtttttgtcgtcccacgtttatttttatttttgataaaattaaaattcggaaatccattgaatttaaaaaacaaaattaatttattatcttcctctgtccaatttgtctccttttgctccccccaaatg

SEQ ID NO: 102663 - DNA, 648 bp, Heterodera glycines
  Promoter: Source sequence=SeqID_21878; Location=1..648; Strand=+; Gene=SeqID_52518
ttctgtaaaatgaaaaaaagtcaaacattgcaacaaaaaaaaaaaaaacacatgcctcagaaattacgagtgaacagttggtggtgttggcaaaagtgaatgtgaatgaagcaggttgcttttatatacactttaggcgcgcagttaaaatccaaaaatcgcatccctactaataaatgaaaaattttctcaaaaatttgtctccaaaatttattaattttcttggcaaattttgatattaaaaaataatataactacgatttggcataagtttgttcattttataattttgtcattttacacccctaaatttgatgtttatttgtgcctattttgcatttttttagtgtctatttttgggttttttttagaacctaaagcctgttttccagaaaactcattcttgcatttgaccgagagactcgaatgataataacatttttagggtttgataaggcacatctattcattaatttacagattttgacaaataatctcgcaacactaacattttcagtttgactcttaaaagttgcttttattacctatatttttgtaatttatttcaacacacaaatttttgttacagattcgtgtacaattatttaaagaaaacagcgctttctgttcttttctcgcttcaaaatg

SEQ ID NO: 102664 - DNA, 165 bp, Heterodera glycines
  Promoter: Source sequence=SeqID_5594; Location=2750..2914; Strand=+; Gene=SeqID_46077
tgttcatccattgatcatttgtttggatttcctgcattatttcgaacctcctctttttgctttcttttgtccaatttgtttttgctgcaaaatggaatatttcactaaaattttgtcattagtcttaattacagaattaagaaattgagttgttttcttgcgatg

SEQ ID NO: 102665 - DNA, 1003 bp, Heterodera glycines
  Promoter: Source sequence=SeqID_6104; Location=2179..3181; Strand=+; Gene=SeqID_60348
ggccaactcgtactgctccaatgttttcggcaacgcctttcggcactgccggaaccctcctttcaggagaaatttaaaaaaatactttgcaaaaatttttcaagcaattcgtttaatgtgtataaatttttggttttttggtgtaaatcttttaaaaaacagtgccaaaattcgtcaccaaaaatttccctcttatttttaacttaactcaaaaacgtgaaagagaatttataaaattttcaactttgaaaacccatatggatttaatttcgataatcgaacatttttctaattatattgcttcggggaaaagtgacaattttttgggttttgttccaagtcttgggcaattctcagtctcgaacataacgaaaatttagacatgttcgtgcaacatgggctcaacattgcaccaaataagtagtataaggtcccaggggccggggtccagacccctgtccctgcttaaaaaaacacccatttttgcttttcatgattttgccccatgtgccggggtccaaatccatgagaggattaattaattaaattaattcatccagaggcagagggactcgaacccaagaggtctaagccaaagcactaccactgggtcaacgatacagttatccgaaaaaggataattagcaattatatatatatatataatttaaaatcgattaaataattcaccaatgggagggggattcgaacccaagaggtcaaatccaacgcacaaccaattgaccgaggaacataatcatccgaaaaaggatatttgtcagttatgtagtaaaaaaagtgtcgcaagagtcaaaaatggacgggagaggggatgcaggcgacattctcccttttgcctatataaagggatatttgtaagcaaaaaaagcacaaataaaaatttttttaaatgttcaacgcaccgtttacattaattttatccggcgctacgggaagtggaaaaactcaatggctattgaaacttttaaaacattacagtatg

SEQ ID NO: 102666 - DNA, 996 bp, Heterodera glycines
  Promoter: Source sequence=SeqID_3677; Location=1191..2186; Strand=+; Gene=SeqID_51423
aaattttcggtttatttttgtgatgggatgtaaagaggggaagggaacattcatgtcattcattaattaagccccacgcgctctcgcttttctctcatttcttttaccttttctactgcactattttcttacaccgtctgtctggcaaagagaacgctcattaattaagcgtttttctctcgcttttctctcatttcttcccttatctattgtactattttctttcactgtctgtctgacaatgacaagaaaaaaacattaagcggggccaggccgttttcgtacgggccgttttcgtacgaacacatgtttttggactataacttttttctttgccaaccaaatccaacattgttggtatcattcgatagccctatgtatcctctattagcctgcaaaatttcgaaaaatttcgttaaggttcaaaaaaagttcgagccaaaaaatttggaaaatttggttttttgaattctcatctgtctgctggtacgagaagttcaaggcgttataatttttttctttattaaataaattcaacaaaattggtatcatttattaaaaagctgtgaatgattagaagtttgcaattttcaagttttaatttattattattttgtgtcaacaaaactgtcatttttgaatgttgtgcaattcgaattctgatcattttttaatgtaaatgatgattgacgaaaattcggctttttaaatctgaaaggattaaattatgcattatttggcaaatgataaaatgattaaaaaaacaaaattcttaattcaattttaaaatattaataataattaataataatcgttcattaattaattaaaaattgggaataattcacaattacttttcgtttgtttgttcatttatcagtcaattcagtgatcgattatttcatttcagttccaacttccagcattccatgacctcaaattgatttatttctaaaatatttttgaaaatttttgttcatacgcatcggaaaaatg

SEQ ID NO: 102667 - DNA, 1003 bp, Heterodera glycines
  misc_feature (371)..(372): n is a, c, g, or t
  misc_feature (385)..(385): n is a, c, g, or t
  Promoter: Source sequence=SeqID_4993; Location=891..1893; Strand=+; Gene=SeqID_56469
atgccaggcgctggaatttacttgcggggaagataatcttcatcaaatgaagtagacatattcttgaactttgccggaaatttttggttttggggcaatggtaaagaattgtggttcctaattattaaaaaaactttattttgggctcgaaaccaactttataagggattttcgagggtgctgattacgaatcttaactcggatttatccaattccaaacacccgaattcgaacaaaaacgaaatttttttgcgttgatccatttttctggggtaaaaagcttctaattcattcaacaattattaattctgatgtaaaacaatgcttcaattgttattatttatatggtccctaaactgcatatgaaccannataaaatgtctcnaaaagtatttatttttcaaaaaaatcaacgcggcaaaatttcaccgccaatttttaaacttcaaatttaattcataaagcgaaaaagtatatgaaaatcatgagttgtcattaattttaaaggtacttatgcagtttacggggcagatttaacatacattttttaatgcctataaaggtattcattttacatgcataaaaacataaaatacggaatttgaatatttattcacgaaatttgataaacagaagcaacttgagtccaaaatttgtcctttttgtcgttgaaatatagttgcatgtcttttccgcattcacaaattttttttgagtgaagtaatttgcattctcggagccattactcagcgtctggtttttgcagaagagtaaataaatcatgaatattgaaagtcttttaaagtttccatgctcaaaataaaaatgtaaaatgaataaggcattaaaaaatttcttcgacgtatttcgactcgtgagtttaatgaatgcaaagagacgcgaattgcatagtttttattccatctaacatttgtccttcatctatttttaaatatttaattttgatcaatataaaagtatttccgatcaaattcctaaaatg

SEQ ID NO: 102668 - DNA, 583 bp, Heterodera glycines
  misc_feature (26)..(26): n is a, c, g, or t
  misc_feature (155)..(155): n is a, c, g, or t
  Promoter: Source sequence=SeqID_12444; Location=1176..1758; Strand=-; Gene=SeqID_76072
ttaataaaaaaatgaagaactcaatncaagaaatcagtttttgattttattaatcactatttaaaaatttttttctaaattctgagaaaaattgatttttaaaaattacggattacggattgcggattacgggaaattacggggtttttggaccnccgtaattacggattacggatttccgtaactgagaaaatcgccgtaattacggattacggatttccgtaattgcaaatccagttgcatgcagccctgtgtccaacacaaacaaaaaagcataagaggggtaatattttgtaaaaaaggatagataaaatttagcatattgtaaaaaaaatgccaataaactatcattgatttttttttgctttatacacttatcatcaaaaatataaatacatattttaaataaattttatttttatcgatattttggctataatttttattttattttattttatgtctctctttaacaaatatcattatttgtttttttcttcttactttagtccaattaaaaaacatatttctaacttgggttgttaaacatttatttgacaaggcaatccttttatagaaaatg

SEQ ID NO: 102669 - DNA, 1003 bp, Heterodera glycines
  Promoter: Source sequence=SeqID_4820; Location=6391..7393; Strand=-; Gene=SeqID_55844
ccccccccccccaattcgtccgttttttgccctttctctcgagactctcgacaacgattgtaaaacaataataatgataatattttgttgttgttctgcatagattagtgtgtttgtgtagtggttgttggttttgacaacaaaaaggccgaacaaaaaaattgcctattgttttgttctgttgagggtcgaccgtttgtctcgttgagtgtggcactttgtgaacgaacagcagagagcggcacagaatatacatataattagcaataagccacacttttttttggtgaagccttcagtagacggagacagtttttgggactacaaaatcggtaattgtgtgatattttaaagttttaagcccttggggttcaacttgaaaaacaccttactaaattacgaaaattttttgctttttggttcgattccggagtggcctgaaagcacgaaaaacatactttgggtggttgttaagttacttttcgaattattagggcctattttctaggtttttatttttagtcttaaaaacgtcaaaaaaattttaataacctattttgatcttttttggcgttttgttcaaaatttattaacaaaaatgcaataaaacgaaaaaaaacatctcctaagaatcggccctaaaatttccagaaaaaatacaccccttaagaaatgaaaatttttccaattctcgaaaatttatttttattttgacaaaattttttatgtatcgcaagcttaattttgttcgctttttaaataaaattttgtcattttctaatcccctaaatttgagaatttttaaagcctattttcttttttttaagtgcctattttttattttagagcctaaaacctaattattttggcaatttttagagcctaaaatataagccctaaacataataaattttttacaatttgtgccagttttttttaatttagcaatttttttcatttttggtggctgttattgctcaacatcaatatcaatatcatcatg

SEQ ID NO: 102670 - DNA, 269 bp, Heterodera glycines
  Promoter: Source sequence=SeqID_6497; Location=1773..2041; Strand=+; Gene=SeqID_61794
aaagaaaagggggagatcagtgatcagtggatgtgatctgtctgctgctgatcatttggccaatttccaatcagcaaatttattttttttaattttaagggtgtcactgttttatgtaagtccctctcatatttgtatttttaacgcctcatacaccagcatggactatataattttttggctaaaaatacaaaaatatctctcccctaaatagacaaaagtgatgcaagaaggaacggagtgtgggagaaagtgggataaaggacatg

SEQ ID NO: 102671 - DNA, 951 bp, Heterodera glycines
  Promoter: Source sequence=SeqID_4436; Location=317..1267; Strand=-; Gene=SeqID_54439
taattcaagtacacactatagggaatctactccctaaggcatcggtctccgcataaatctaggcgcatcgagttcggggcagttgccccgaacacaaacatatcattctttccaattgtctcgtttggggtgctccaccaattatgggcagcgagaattcgtcgcagaattaaagtgcagaatatagcaacactattcccaaagaattcagtctccccataaatctgggggcatagattcgggggcctcccccccccccgaaacccaaaagtaaaaattttcagcaaaatttcttaataaattgcattaaaataatcaaaaattttcccggtggcgcctatcagcaccgccggacccccataaaaatgatctgatttaatttaatattttttcaaaaaaattatttctaccgtcacttatctgtttagcccattttatttaacttttaaaagtcatataaaaacgcgttcaattaaacaaattatcactcttaataataagtattattcccaggctcacaattaaggccactatttttagtaattttttttaggtttttgagatcataaattttcgtgacttatgggcaacatatctatttttaggagcaaagattgccaacatgaaagaaaaaatgagaaaaaggacataaaaaatctccaaattctatttaaaatatttttttggacctcgaagaaatttttcgaaatttagcattattttattcaaaaattgaaatgagcttattttctttgattgttgtttttattttggtgcttttgacaagcaaaagttgtcaggtccaacctcaaggtatttaattatttgaattttaaatattttattattattattattatctatttttttaaataagttttttccaaccaattgtcgccaattaagttctttttgaattatttaattaattaatattcagccgtggaaatg

SEQ ID NO: 102672 - DNA, 189 bp, Heterodera glycines
  Promoter: Source sequence=SeqID_35905; Location=1330..1518; Strand=-; Gene=SeqID_65355
gggatcctctaatggtcattcaaaattcaaaaataattttattaaagaaaaattacatccgaaattaattaaattaattcgtcaaatttaaaaaaaaagaatgagcagaaagaggcggaaaaaatatatgagcacgccaaacaggaatattttcaagtgatttgggccacgaagaataaaaatgcaatg

SEQ ID NO: 102673 - DNA, 284 bp, Heterodera glycines
  Promoter: Source sequence=SeqID_9890; Location=3437..3720; Strand=-; Gene=SeqID_72919
tatgaatgtttttaagaaatgatttctttctcgtgaattaattatgcatgcctcaataaatgaaaatcgtttgttattttgtctgttatccaaatgtttttttcttgtctcggtctcgacttattcttcgaagccaatgtcaggattcggtccgtagtttggaattgacacaaaatcgccctaattttaaaattgttctgaggaaaatgtaattttggctttctcgtgcgatgcgatatattcgcataaaaattttaacattattataatattaaacaaaaatg

SEQ ID NO: 102674 - DNA, 1003 bp, Heterodera glycines
  Promoter: Source sequence=SeqID_10648; Location=813..1815; Strand=+; Gene=SeqID_73889
caattctcttcttctgctattagcctttttaagccgagatgtattgtcctttatatgtaaaaatttgttttttattttcgaatcaccgaaagtctgaccccgagaaattaattttatcaattgtgtcgctttttgttttttcatttaacacatttggcttttattcttcctgtggtccattttattccataagataaacttttctattctcttttttgactgattgcttcagcaaaaataagttatccaataagatttttttaaacatttcttagattttcccattccttagcattctccttgtctttttcctttttttggcattttcttattgcaggtcatttcttcttaaccttataatcggaattaaatcccttcttttataagaaaatattttaaatctgaaggactggcagaaatcattattttaataattggttatcttcgaaaaagaattaataattatttcttggaaatttttacaaatttcataaaaaattaatttcccagcggttcctattggcattgcggcaaaaaattatggccgtaaagctttcacttttttcgagcatttcggctccaatttatttttggaactcaatataatttcaattttgctaactctgttaaaactttgtcctattaaatataaaaattgtttaatttggttgcttaaaattggcggcgccaaacatatcccttcccctcaaaaaccacgaaagttggtcagtttttttgtattttggcattttgtgccttattgcatgcttttctaagaatttattgttaaaaacgcataatgtttattaaaacattcacatatgtattttggtaatatttcgacattttttgtaagtatttatgcacatattttatgaatttcttaaataaaattttacatttctacttagaatactaattaagaataaatgacaaaatcaatttttttttcattcaataaaataataatttaatgtttttgctttaattggtcagcaaaatg

SEQ ID NO: 102675 - DNA, 164 bp, Heterodera glycines
  Promoter: Source sequence=SeqID_14968; Location=508..671; Strand=+; Gene=SeqID_47254
ttttctttttgtttgtcgatgtgttggaatgacctttgaaaaaattgtcagctttttgcactttggaaagatgcaaccggataagctcgtaaacaattttataaaaagcataattttcaaagaatataaataataacaaacagcgaaagtatcaattaaagatg

SEQ ID NO: 102676 - DNA, 417 bp, Heterodera glycines
  Promoter: Source sequence=SeqID_23148; Location=804..1220; Strand=-; Gene=SeqID_53853
agcagaatgaaaactgattgggacaaaaaaaactaattttacccccgaacgcctcgaaagttggcttctttttaataatagaatttgtaagcatttgccctctcattttacaatttcattaccactttcgaaaacgaaaaaattcttaccacaaaaatctttgttcaatttaaattagcaaatttaaagtgaatttttaattctttttagataatgaataagttattctttcaactagtaaatctttacaaggataattgtctccaactgatgcagaaaagctgaaaaaccaacaattggacacttgggaacaactgcaaaatgccattttgaaagaaaaggaagcgaggtaaaaatggggaaatgaattacatattataaaaaataaaaaaattaatttaaagagagcaaaaaatg

SEQ ID NO: 102677 - DNA, 102 bp, Heterodera glycines
  Promoter: Source sequence=SeqID_5393; Location=699..800; Strand=+; Gene=SeqID_57874
ttttgccatcgttaaaagtgcgccatcgtccgctgtttcatctcttattttgtcatttttcgcttttgcttaggctgtgccgaactgctgctgaccggcatg

SEQ ID NO: 102678 - DNA, 95 bp, Heterodera glycines
  Promoter: Source sequence=SeqID_13070; Location=1449..1543; Strand=-; Gene=SeqID_76857
aaatacataaaaattataatcattataattaaatggattatctttccagttaatgacccaaacattgccaatgctcaaaacgaagaagaaaaatg

SEQ ID NO: 102679 - DNA, 711 bp, Heterodera glycines
  misc_feature (50)..(51): n is a, c, g, or t
  misc_feature (70)..(70): n is a, c, g, or t
  Promoter: Source sequence=SeqID_2001; Location=1..711; Strand=+; Gene= SeqID_77273
cccccccccattcctcaaattgtatttatatttctatttactccccgatnntaattgctgtcttttcttnacatcatttttgatagtttgctccctttttcccactcttttccttttgctgtggtgaaaagagtgcagcactttgcatttgctaattgtcaattactcaaattgtctttaattcttgtgaattttaattgtttttatttcataattccatagaatttcgtcatagtctaatagtcgcatttttcttcatagcctgaatctcctctctctcctcatcattcattctttctctcttttctctctcttttctcaattcgtcgttcattttgcccatccctcattattactgcgtttgtgttacaggcaaaatccttttgtttattcccttcctttccttgtgaggcccaaaataatttgggtaatactaccaccgaacgatggttacactcccccttttcgaaaaaaataattcaaaatctttttatttttaaataaagttttaatcggttttttggtcgaaaaatccgttccgacatccatttctaactctggacctgtgatttgaacaaaattcaattttcaactaattcaaagagtatgcaattacctaattttgactggattgatttcgtttattttccggttttttttatttgttataaatttagctttgtccaaacttgtggaattattttcctaatg

SEQ ID NO: 102680 - DNA, 87 bp, Heterodera glycines
  misc_feature (5)..(5): n is a, c, g, or t
  Promoter: Source sequence=SeqID_17996; Location=1..87; Strand=+; Gene= SeqID_47491
ttttntgggaaaatttacaaaatttttttttttttttccctcactagggggctaattaatcccttctcccccttttgtttcctgatg

SEQ ID NO: 102681 - DNA, 52 bp, Heterodera glycines
  misc_feature (16)..(17): n is a, c, g, or t
  Promoter: Source sequence=SeqID_15573; Location=1794..1845; Strand=-; Gene=SeqID_79858
tcaaaatgtcaatatnntagcacaatttgaaaatctgctgcttgcgagaatg

SEQ ID NO: 102682 - DNA, 210 bp, Heterodera glycines
  Promoter: Source sequence=SeqID_26404; Location=1..210; Strand=+; Gene=SeqID_57136
gaagcggacgagcaaatggtggcgatgcgcaatgagacagggtcgaaaaagacagggaaaactgaacacaaatgaacggtttcagcgcaacgaccggtggacgtggacaattggacgtacaaggcgaggaacgtggtgctgttcaaccatttggcggaggccccgctgacgatgggcgaacacatcgaaagggccaagcagcgcgaaatg

SEQ ID NO: 102683 - DNA, 183 bp, Heterodera glycines
  Promoter: Source sequence=SeqID_17688; Location=1173..1355; Strand=-; Gene=SeqID_82220
aagcgaaacggagacgaaagcaacaaaattagaaaagaaaacgcactgtttgaacattggataaacaattatttaaacaaatgtgacacccttttccactcacttttggtttttgttccatttttactttttcttttccctttaattttttattcgttcaatcccttctttctttttgcaatg

SEQ ID NO: 102684 - DNA, 100 bp, Heterodera glycines
  Promoter: Source sequence=SeqID_4279; Location=1130..1229; Strand=-; Gene=SeqID_53861
agggattggaacgagatataatattactgtaaaaccctgcaaattttcaaagtttataaacattgctggccctaatgttccatttttgaacaataaaatg

SEQ ID NO: 102685 - DNA, 265 bp, Heterodera glycines
  Promoter: Source sequence=SeqID_23075; Location=1198..1462; Strand=-; Gene=SeqID_53775
ggtagactaatggagactaagagattatttttcggctgatttatttagtggaaaatttttgaaatttttttgaacatgtcgccaaaaaatgtcatcgcgtcaaaaaaaatcatatttattgcatttttgttaaagaacttctgaaaattgacaccaaaaatggcaaaaatgttattttttgcttccggtatgcataaaaatgggaatttttaatgaaaagttcagaaaatatggaatcgttttgctgtttgtaaagcaatttatg

SEQ ID NO: 102686 - DNA, 288 bp, Heterodera glycines
  Promoter: Source sequence=SeqID_37735; Location=185..472; Strand=-; Gene=SeqID_66731
gatccagagaagcaatatgttaaaaatgaaatgggacatcacttttgtgctcctatattttgatcaaattgtgaatatggtaaaataaatcaaataaatgtttatgtcacaaatgcaaatatggtatcattggaaagcccataaaaaatgatatccaatggtatgttacttatctgttgaaattggaaaatgacaattttatacgcaattttttttttcaaagcatgatgggacaacacttatgaccatgactgtattttttgcagccctagtgatttggcatttatg

SEQ ID NO: 102687 - DNA, 115 bp, Heterodera glycines
  Promoter: Source sequence=SeqID_543; Location=1..115; Strand=+; Gene =SeqID_55814
cccaccaactttcaatgacattccaatcgctgggactcaatccaccagcatttcaatctttagggactcaaatctccggcattccaaacactgggactcaacccaactttcaatg

SEQ ID NO: 102688 - DNA, 452 bp, Heterodera glycines
  Promoter: Source sequence=SeqID_3015; Location=2505..2956; Strand=+; Gene=SeqID_82796
tttccccagcaaaatgttttggatggagaattggacacgcttttttggtcggcacgggatggagccgcttattgcaaattattactagtaaattcgaaaaaattttgactcactaaatttgtccaaaacttatttcaaactccataaattctgaattttcacagaataatagaaaaatgtttgagctatcttttcgtaaatcctccaaaaaaaaggtcaaatgtctcacatgttttaagacaatgatgatatcggtattcggcttggtcgtcttgaaaatttctcaacccatcgatcaacgccacaattgtcgagcggctgggtcgccttgagcagcttatacagaaacggtcaatgacaacacaaaaaataatcgatccggggactcaatgtccttctccacctcctcacccagtgttctctgtggtcaaccgccgcctcacatcggaatg

SEQ ID NO: 102689 - DNA, 749 bp, Heterodera glycines
  Promoter: Source sequence=SeqID_45295; Location=324..1072; Strand=-; Gene=SeqID_72621
cgttggatttttgctccccataattgtttgagtaccccaaacggacacttgaaaaaatcgatttatttttgttttcggggcagtccccccgaaccgatgcgcccagatttatggggagaccgaatccttcgggaatagctttcctatagcctgtactttaattctgcgttggatttttgctccccataattgtttgagtaccccaaacggacacttgaaaaaatcaattttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttcgggagtagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttgtccttatattttggttatatcgtttgcttttggtggggtgcttggaacagtggaatcatg

SEQ ID NO: 102690 - DNA, 1003 bp, Heterodera glycines
  Promoter: Source sequence=SeqID_5594; Location=1128..2130; Strand=+; Gene=SeqID_46078
aggaaattggtgaagaaggagaaatttttgagaaaaaattaaattttatttcatttagtcatgggattacacacatgcacatgtggtgtagtggttaaactttctacctttcataatttttcgcctgggttcaattccccacttggatagaatattcctcacattttctttaccattattttaattaaaattttaatttaaaaaaatattccaacttttttctttcatgttaagcatcctaaaaacccaaaacttaatcaattggtcatttttttttacaaattctgttaacaaatcgcattaaaaattacaaaattttttcccggcggcgcctatcggcaccgccggccctccttgtcccccaaaagtcttggaaaaaacgtgccgcgtaaaaagcggtgttgaaagcaaaaaaggtcattgatttacattaatttacatggccggaaaccccttcgcaaaattggaaaattggctgctgatcccttgttttgcaataatctgaattttgaggtctatatctgaattttagtgttctatgtactgaatttgaaaaaaaaaacttggtcaacctaatatacatatacttctgaacaattctaatgctaaaaaacaggtactcgcgcgaaaactgaataaaaattttgtatttggaaaattttgtccaaaaatttttatgttctaaaattaccggtttttaccagtaccggtaccggtaccggttgaaaaagttggtaccggtaccggtaccggttttttcagtaccggtcagtaccggtaccggtttttttgcaattaccgattaccgctcaactctaatgaaaacgaaacttaatctggacaaaaaacaaaaacgatcgataaacaaaacgattttttaaatgaacacatagatatagattaatttccaaaataggcttacagtatttaacgactaatcattattagtcttaaaattacagaatttttaaggaccattcaacaaatttaattttcaacaatg

SEQ ID NO: 102691 - DNA, 273 bp, Heterodera glycines
  Promoter: Source sequence=SeqID_10948; Location=1220..1492; Strand=-; Gene=SeqID_74255
cgactgccagacggaaaatgatcgccaaaacaatcatcaaaattacactttttttttttttgccatttttgttttttgagcatattttatgtataataaataatggcttgttttgctcattgggtcagtaaaaaaaataatattaaatggttttgcccattttccacacattttaaatttaaattgaacttttttttatttaatttaatttattgtttttacaaactaaattagttttattattttacaatgtttcaattattttcttcgatg

SEQ ID NO: 102692 - DNA, 89 bp, Heterodera glycines; identical to SEQ ID NO: 100234
  Promoter: Source sequence=SeqID_1993; Location=3085..3173; Strand=-; Gene=SeqID_77230

SEQ ID NO: 102693 - DNA, 501 bp, Heterodera glycines
  misc_feature (49)..(49): n is a, c, g, or t
  Promoter: Source sequence=SeqID_28202; Location=992..1492; Strand=-; Gene=SeqID_58848
gtcaagggtacgcaaaaaccaatgggtttaatgatgtatacttttacanttgtgaaacaacacaactatgcgccatcaccaactcgaaccgaagattttcatcaagtttttttattttaatttatattttgcttccatttattttaatccgaggaaaatgtggatgagttgcctgtggatgacgtgccactgtgcttttaattcacttgaaaatattgtataggttaaatgcttttaaaatatttgcgtccaaaaattatgtataaaagcaatatttccgttattcatttttcatttaccacaaaatattacaaatctccggcatagtattaaaatgactgacgacagagaaccgatagcgacagcgagtgccaatgaccaacaatcagcgactgctcatacccgtagacatggccacagagtgcgtccgagaaagcgtcaatcgtcgatcaaaagccacaaggacatccttccggtgcttcgtatttcactcagagaatg

SEQ ID NO: 102694 - DNA, 1003 bp, Heterodera glycines
  Promoter: Source sequence=SeqID_11406; Location=1152..2154; Strand=-; Gene=SeqID_74799
cattttaaaacaatttgtattccttttatagcatcgtggttcaagcgatgacactgtacaagcttttgttggtaatttttaatttttttttatttattaaaaaaattatttttaatttgtacaattatggcgccaattaaagtcgcatatttttaattttattaaaaggcttttagtttgaaaaatttttctgcgattttcgtggatggtctctccctgatcatgaatctgaaagatattttaaccaattctgattttttaacctaaattttgaaaaaaaaacataataaactaaaaattttaatttaacaaattttcaagagttattattagggtgatgatttatatttacaaaaaatcccgaaaaatttaaataaatatttaagaaaaaatgccaaaatatttttaaaaatattgaccaaaaatgagaaatttagagcaataaaaattgaaaattttcttctaattcaaatataaaaacaaaaaagtgaaaaaaaaaattcttcaatgttgcatttgcaaattaattacatttcaagtgtttcagaggtaaagttcatacgatttaagacaaaatatttttaagattgggtgcgacttttttcaaatcttttttgttttgtttttttttaaattttattttaaaaaattttatttttcctaaagtcaatttttatggagtatttttcgtttttactgcattttgttaagaaaaatttcaaaaaacgcaaaatatttatcaaaatattgataaaaatgcaaaatggttttgtaaatttttatagtgtatataagtctaaaatatttttttatatttatgggtattgaagttaaagcaaaatcggctaaaaatgatgtttttcgtgcatttctcatcaaaataaagctgcagaaaaaaaggtttttttgcgtgccaaaaggccccactttgatttaataaaattcaaaatatataataacttttaacactagcacctaattatatataggtgccgatctgatg

SEQ ID NO: 102695 - DNA, 1003 bp, Heterodera glycines
  Promoter: Source sequence=SeqID_6104; Location=772..1774; Strand=-; Gene=SeqID_60349
atttggaattttgagcgcgatttgttaaaaattttgtcaaaaaaaatgattttgactgaggatttttcgaaaaaatgtttaagatttgaagaaaaagttcgaacattttgccaaataaaaaaaaatcatgcatttttgtcacttttttgtcaaaagaccacaaaaatactcaaatttctcaaaagaccacaaaaatacgcaaatcctcatttttcaaaaaaatcctctttgaccctctaaaagaccacaaaatgagtaaaaatactcagatatcgcagctctgatttaatcgcgtatcgtacgtgataattttcgattttacatcaaattaggtacctaactaattttattcaaacgattcgaccaattttttgattttaagggattttaatgtggaactaaattcactcatacgaattaaagggagaaattatacaacacttgagcatttgcaattttctgctgctgctgtgtttctctttctttttcgttttcatttttacgaatctcgcaaacgagagaaagagataaaacgaaagaacgtgtgagtttttgtctgtcagagaaaggaaaaaagcagcaattgcatgtggacaaaaatgttgttggcttaggatggaatcttctcgaatgaggggcaaatctctctgcgttgagggagatagagaagggaagaaaaatgtttccttctttgctaaaaagaaagaaaatccaagtgcctaaattaattttaaattgcctaatttaaatcagtcacaatgttattgtatgtacatacttttttctaatatttctattatttctttttagcatttcatcgttaaattaacagtaattttactttggaatttgaacgtaacaatttctcgtcaaaatgtttggtggcggaggagaccccttcagaaacccatttgagtaagacagacaaaaaattcaaataagcacaatcagtacttaattaactaacctttgattttcattaagtcaaatgcaccaacaaatg

SEQ ID NO: 102696 - DNA, 133 bp, Heterodera glycines
  Promoter: Source sequence=SeqID_2393; Location=1901..2033; Strand=+; Gene=SeqID_79500
atagcgaagaattcgtcagtgtcttttccaaaaataaaggtgaagacggggtgaagataaatggaaaattgggccccttctatgtttcaagtcgttgtattggataaacaaaaacaccttttgtttgtttatg

SEQ ID NO: 102697 - DNA, 846 bp, Heterodera glycines
  Promoter: Source sequence=SeqID_9659; Location=3373..4218; Strand=-; Gene=SeqID_72227
ttacaattatcaaaaaggaaagttcaaaagattatttctggtctgtctgtatatttgaaaaggaatttgtgattttgaagtgatagcactgatttttatctaccagaagtagtcatatttcgttcaaattttttaactattaacattatgccagattaaaaaagtgacaaatttaatttaaaaatacccattaaaaaatttttcaatttgttctttccctgggaattcatatctgcattttttgctgttggggcactccgaaaaaaaccacagggtgagggccctttttttcgtgaaaacttgttttatgggttttcgggagtagctaatcacgaatcttataccaattttgacaaatctcttacccgaactcgagtgaaatagaaaactaagtttttcggagtttgcttttttgcttgaatttaggttagacattcaaaattggatataatggatgtcagatccctggttagtgcctcccgagaacccttcagaatttgggaaccaaatatacaaacaataagtattatatgttaggtttccttacagtttttcaattctgttttgtttaagcgtaatttttaaattaaaaacggcaaggtcgcagaaaaaatcagtaaaaacttataaatccggtccctaaattataatttatcccacaacaactcctcgttatattttcattctctgactgccccatgttttttgattcttaggtcaacccgattttggttaatccgccagcccctaactcaaaccaatctctccctttcctttttgtctgactaattttcaaacaaaaaaataaaataaattaattgctttctttttattaagcaaaaaatg

SEQ ID NO: 102698 - DNA, 83 bp, Heterodera glycines
  Promoter: Source sequence=SeqID_16737; Location=1..83; Strand=+; Gene= SeqID_81135
acactgactgaccttagaacatgtaatccggcatttttactgatcgacgacttaccgctggatcacaaattgcggaaggaatg

SEQ ID NO: 102699 - DNA, 299 bp, Heterodera glycines
  Promoter: Source sequence=SeqID_8222; Location=1..299; Strand=+; Gene= SeqID_67348
ccaaagatcactcaatattacaaaatccctgaattttcgaaaaatatcacttcggcttcctcaaaacacataattatgccaaatgatagcgaacatttaaaatcgaaaaacaaagcaaaaaataaataaaagtcttgtgaaatgttaacgatttctttctcgtccctctaaatcttcacaataacttcttgaatgatttgtgttgcgtcattttgttgaccatcttttgcacatcgtcactttcaaaattgtatctcatgtaattggagtcgttcgttgccgcaacaattttgaaaatg

SEQ ID NO: 102700 - DNA, 539 bp, Heterodera glycines
  misc_feature (6)..(6): n is a, c, g, or t
  Promoter: Source sequence=SeqID_797; Location=4873..5411; Strand=-; Gene=SeqID_61504
agtccntttaaaaaaataatttaattagaaaatatacatgaaaaacattagtttgtcaatccaaacacatcacaagttgttaaactataaaatgacaagaatttattaaatatataataaattcatttttgaaatgtatttttaaataaaactaaaacccttctaaagcaaacttttaaattaaaaaaaaaattaagaacgctaaaagaattcttgttttaaaatatgaaattacataatataaattaaaacattttaacaaaaaacaaattgtagtgctgcaacgaaaacaattacacttggattttcagctcaccaagaaaaattaaaaatatacacaatacaatttaagaaaatgtttagtattatatagaaaaacaataaatttataatattctttaaataagaaattctcacaaaataatgcaaataaatcacgtagacatccaactacaccaagggtaaatcccagtagaccaataagagatttattttaaactgttgagattaattattattattattttagtaaaaaaatg

SEQ ID NO: 102701 - DNA, 1003 bp, Heterodera glycines
  Promoter: Source sequence=SeqID_16249; Location=54..1056; Strand=+; Gene=SeqID_80631
gtgcaattagtggacgcgaccgttgctcccccctcccctttttctctccccaattcactaccaaccgctctctaacaaatttgttatggcaatttgcatactttcgaggatactctctccctgtgcttttaatagccgaaaccgcgcggcctttccattttctatgttttcatcgccattcttcgctgttttgttttattatgtatgtgttttgcttcacttatccgggccatcaaatcgtatgcgatacattcattcatttcattttgctatgttctcttaaaaaagcacaacggacagataataattgttaaaacagcgtcaattccgtcgtcgtcactttttattattatttttttgcaattaaaaaatgtccgttgtgccgattgttcaatttttattcttcttcgacggtgtttagttttatatatttctttctgttgttcgtccgaccgacatttttggcatattgtttagtgtttgcaaatacattcattcttttttaattgtgctttttatttggacacttttcgcctaaggcatttccattttttgtcgtgttttttttactgtgctttctctcccttctcccagagtttctccattagttgggccaccttcgtcccttctctcattcgattagttactgtccttaccgacatcatttactgtatcatctacgattagtgactgattgtttttattttataatttctctctctttctgcatatttctctgcctcgtagtctctctctctctctgattgtcatctctgttagaggatatttacctttcgatttgttgtcagaatatctctctttctctctctctgctcattggtctttggtcgtcaccatcgcttaacgttgcaactcggttctttaccggaaacactgtctttgtttggtaaaatacggttacaaggttttaatattgtaaaggatctgataaaagtgattttctttgagagttggttctaattatcggtcgtcgacggaaatg

SEQ ID NO: 102702 - DNA, 1003 bp, Heterodera glycines
  Promoter: Source sequence=SeqID_773; Location=1284..2286; Strand=-; Gene=SeqID_46220
ccaagcctaaaaatgtcggaatctgaaatcggcattctggcatttttttttattcttcgatttggcgcagtttatgaaaaaggttttgatttgatgttcctgctgatttcgacgttggatttgcttcaaaataaaaaagtttttaacacgaatgttttcaaagaaatagtacataaaattgccattagagaaacaaaggaaaaatgaatgacaaagagaagaagaagaagttgcgtccttttttgagaactaggtaatccgctgcagaattatgtttataaattcgcgaccaaatcccattttttgccattatttacttttttgaaaacttcactttctatgccgtgccgtttttttttttattatcttcaataatcaaattttccatgtgcctaaatgcactttgttcatcattttaaattagttatgtatttaatttgaatcacaaaaacataaacttaggaatatgctattgctaattgctagcatagactgcccttttttcaattgctcgtgctctagtgaattttaggcatcacaattgactgttagaagtccaatcttcagtttcgtttgccataacttttttcttactcggacaatacctacattcttggtatcaagcaagagcttgaagtctagcaaattatttttgatatattctaaaaacggctgctttcgtatctcgttgtaatttttttcttaatgtcagtatttactcgttcttgtgtttatgaaatttcagaggactttcaactttcctttgatgccaagaatgtaggtatgaccaagagaaagttatggcctaaactggacttctaacagtagattggacgcttaaagtgcacttgaacccaaatttagcaattttttgttttccaaaactgcaactataaaattatagtgattaatgacaacaaaacgcttttcaatgcttttcagcgatacttaagcacatatatttgtcttctaatttactgttgtcagctgccaatcaaggatg

SEQ ID NO: 102703 - DNA, 488 bp, Heterodera glycines
  Promoter: Source sequence=SeqID_28345; Location=843..1330; Strand=-; Gene=SeqID_58979
ttttttgttttaggggcagtccccccgaaccgatgcgcccagatttatggggagcccgaatccttcgggaataacttccgtatagccagtgctttaattatgcgtcggatcttatgctccttcatatatgaatgagaatcccgaacgggcactaaatagtacatattctcttgtatttgagtattccagcgggtaaaatcacatagctgtgagcgcaacaaaattatgaaatcatcccgataaaaaacgtcaaaataaattcattaaatcaaacttaaaattgcttgcgataagtcgtaattttctcacctatatatttttcatttattctacgacacatttttattctgctgaacagtcgtcagaataaattatttcaatcttctgacagtttgaacaaataaaaccaggaggcttaagcgcaagaaaatgaggggtgtcaaaggaggtatagcaatatcaaaaaacaaaaaaaaattggagccatg

SEQ ID NO: 102704 - DNA, 326 bp, Heterodera glycines
  Promoter: Source sequence=SeqID_3042; Location=1..326; Strand=+; Gene= SeqID_82925
ttccagtctcgaattctgtaaaattttgtccccaattccctgccaatttctcgtacaattagcttcagctgtttacaattgtaaatgtcattgtttttcaatatttctctccttttgtcaaattctttgattatttctaatatttcttgttcatcaaaatgatcagaatggtagcttcagtctgtggaatctccctgcgttatacgagcgctttcttcatattcgttaaacattgacttctcagtgatcgtatcatttgtttttatcgggaatgctcactaattcaatgcgattcttaggatttatcttttttatttataggaatg

SEQ ID NO: 102705 - DNA, 1003 bp, Heterodera glycines
  Promoter: Source sequence=SeqID_18147; Location=248..1250; Strand=+; Gene=SeqID_82733
aaaagcttttgtatgttaatgtttgctttttcattatattgtaaaaaaaaagacatggataatacttataatccatgttaagtgaaatttaatgataaatcgaaaatgttgtaaaattcattatttaatacaattaaaaaacattaaactgaaaaacatattttttaatttaataaatacaattaagctctattaaattatttttcatttttatatatgaaaatatttaatggttccattaagcatattgggaaaaatatgattattactaaaatatagttaaacttcaaattgtttatccttataatagaattttcaattaataagtgaaatattaaaaattattctataagcgtaatctggagtttttaaaaatgaaaaaacctcgaagcacaataaataaaaagaaaaaagatatattcaacggtttttgaagtgttgcaaatgcaaaaaatgcaaaaaaaattagaacaattaaatttttaataatcattaaagttatggcttaatgaaaatattgaaaatgtataatcgatttaatctaggaagataaattaatttaaaattttatatttatttaaacgaaaattatattttaaaacctgtttaaatataattcatttacgaataagacaaaaagaaaatatacaataaaagaaataataaatatacttttttcattaaacataaattttttaatcaataatatgcaaataataaacctattaagttttaaaatttggaatgtaaacttatcgtaagcaaaaaaaaacgcgacaagagatgaattaaaaataaagcaaagttatatagaaattacaatggttgtactaaaaatgaaaaaaggcattaatcaagaaaatagctaattcatttttataattatttaactgtaaaaatttatgaatatttgaaagaattttaaaagtaatttattttctaataacaaaataattcataggtaaaaaatttttctgtcaggccttctaatgtttttagaatg

SEQ ID NO: 102706 - DNA, 827 bp, Heterodera glycines
  Promoter: Source sequence=SeqID_25338; Location=797..1623; Strand=-; Gene=SeqID_45923
ctgaatccgatgactttgttgggaaacggatttcgcgggattggcaatggatttccaaaggcggatttgacaatttgcattttctttgtgccattttcttcgatgtccaattgcataataagcaatttgttgttcaatttccatttgcgtgtcttgaagtgttcgtccacgtaaaagtcaaagcggcggctaatcagtgcaattccaaggccaagctgagaaggcgcaagaaaatcgaacaccaaaagccaacaatcgccgcagacaaagttgaaaaactgaagaatttttatgaaatatatatggacaaattttggcaaaaaaattaattttcggaaaagcataaaaacggcaattggcgattataaaagccgtacattctatttctgacttttttttaaatttgggttcatgctgtttatgttctgtttgtggttgattaggccatcctcgacaattagtttattccgggactgaattttacgttaatgttttttaaactttattttataggcgtccatttcagtcccaaaaaggcataatttttcagttgattttttctttttccatcgaaaagaatttccatcaaaatgagttgaccctctcagaattcttatttaaataccgacatttttcgttttgcacacattttagagtggtgctgccactttgtgaaaatttgtgtataaaaggaacacattttgtccattgtattcactttctaacaaattaatttcggcatcgctattattattttgttcaacaccttccgttgccatccatttggcaatcgctggggctcgtctacgcggacgaatttttcaatg

SEQ ID NO: 102707 - DNA, 253 bp, Heterodera glycines
  Promoter: Source sequence=SeqID_43748; Location=1..253; Strand=+; Gene=SeqID_71351
aaaaatggtgtaagtaaaaatcgtaattacgctcaaaaagcttctcaaacaattttagcgcatccaattccttctacaatcgcctttatacatcccattatgaacgctaaaattatcagagtgccgaaaatcctgtaatctacgcctagaaaaaaatggtgtaagtaaaaattgtaattacgctcaaaaagctcctcaaacaattttagcgcttccaattccttctacaatcgcctttatacatcccattatg

SEQ ID NO: 102708 - DNA, 169 bp, Heterodera glycines
  Promoter: Source sequence=SeqID_18874; Location=1..169; Strand=+; Gene=SeqID_83578
tcccccaccctattaattacccctttaattaattgcccttttaccgctttctttttaattgccccccttttctgttacttaaggtgcgcccgagtcggaagtgcacaaatatttcggcactttgctcaaatcgatcgcaagtggacagaacagcaacactttggagatg

SEQ ID NO: 102709 - DNA, 118 bp, Heterodera glycines
  Promoter: Source sequence=SeqID_1251; Location=825..942; Strand=-; Gene=SeqID_70871
tgccgaccaaacggaagccgcggcgaaaacatttcgcacattcactgcgcacagcgcactaattttgttggccgccgaaacggaggaggagagcacgaaatacgacattttggtgatg

SEQ ID NO: 102710 - DNA, 844 bp, Heterodera glycines
  Promoter: Source sequence=SeqID_252; Location=1492..2335; Strand=-; Gene=SeqID_79767
tgatgatccgaggatctgggaagccgtataattgagcacttaggcattttaaaaaacattaatttacttcacatttattagacttacatattttaactcactaattaggaacaaagtgacgaatgagagcaaaacaacaaacacttaattgataacactgataagaaaagacttttaattgcttcaaaattcgctaaaatataactttttctttttgaatattataaaaacaaatatttgttttagaaataattttgaatatttggcttttgaatatgaattatcgaaattctttgcttttccatccgccacatttttgacaattttgccctctgtccgttaattacttcgtttaatcttttccccctgccaattagcgatgctttcgactcaattgtcccatgctttttccgattgctttctttgctccctgctgaagatgcttcagcttatcacttctcttttcctggtccgttcctccaatttccgatcacttttctctcccctcaggtgatctctctccataaaatcagttacaattggatttttctcatcgcttttcttgcgctgccctttttcggcctttatttgcttttcggtcctaacaaaaattgccgttcattcaaaagggagtaaaggagcagaagtcggcacagaattgacttggcaatctgtgtagcaatggcactgttactcagaatttgttttaattgtgtccattaattaattcttccctcaggcgaccgtttgtttgctttttgccaccgttcttttcgttgggtattttcaggcaataaatttaaattttccatttcgaaatcaaaatttgaagatacattcaatg

SEQ ID NO: 102711 - DNA, 421 bp, Heterodera glycines
  Promoter: Source sequence=SeqID_8539; Location=862..1282; Strand=-; Gene=SeqID_68442
aacttgtttctgatacctattcaaacgagatattttgtattcatttgaaatcgcaagttttcgtatttcctttgttagtagatcaatatttttgtcatattggtaaaattttgttttgcgcgaattggaaacggatgttaatttctgaaaaaaaaacaatttaatgttctaagtggtatttaaaactaacagtatttaaccgaagaaatataaaagcttagtgaatccatattaatttatttgaattaaaattattaaatttccgaaacgaatgcctttttaaaagtaacttttggtctctgattatccatttttcggttagcaaaattcttaatgttgatcggcaaaattcattttttttattattatgcaattcatatttcaaaaatattgtttttctttcacttcaattttagaaatg

SEQ ID NO: 102712 - DNA, 317 bp, Heterodera glycines
  Promoter: Source sequence=SeqID_42061; Location=1..317; Strand=+; Gene=SeqID_70055
ctcagattcatgatcattgatcagcaccccaaaaagacagcgggacttggagattacagccccattgtttttcacagcgcgtagacagaaaacttttttgaacactcttaagttgaaatgaagaattttaaagaattaaatgttccgacggtgagacggtatccaccgaagaattttttttttggaaaatttaagaaaattttaagagattcttgacaatcagctaaaaataattaattcaaaaatggaagttgaaatcaatttgaaattgtttagtacggattggcggcggtgatggtaaatcagcagatccaatg

SEQ ID NO: 102713 - DNA, 171 bp, Heterodera glycines
  Promoter: Source sequence=SeqID_3877; Location=1830..2000; Strand=-; Gene=SeqID_52254
attgttgaccatttcggatatgtacagaaataatttgtcaatttttgacttaaaaatgttttgtttttttgctgatcaatgatgacgtttctgaaacgaattttatatccaaaaatataaaaaaaaatttttttttaaagaatccccagcgaaattaggtaaaccgcaatg

SEQ ID NO: 102714 - DNA, 162 bp, Heterodera glycines
  Promoter: Source sequence=SeqID_12001; Location=1264..1425; Strand=-; Gene=SeqID_75523
ggtgaaaatcggcgtggcatttcaagatcttgaggggagttaagcattttgaactaaatttgccaatggcattttcaaacacacaaaaaattttttatatgaattataaaaaattggaaggaataaatttcatcattcatttaagaaattttgaaaaaaatg

SEQ ID NO: 102715 - DNA, 461 bp, Heterodera glycines
  misc_feature (26)..(26): n is a, c, g, or t
  Promoter: Source sequence=SeqID_21244; Location=1..461; Strand=+; Gene=SeqID_51837
gaaaaagtaaaaataaaagaagaaancaattgaattaataaaaaacaaaactttttaaaagcacataacaattgaattaatctcacagcttgagaactgataagtcgagcacaaatgatctctaattcttcaattttaattattttttccttttcaaattttatttttgatttcaaaagttaaacattcgttataaaaaatgtaataattacatttaattcctgtgtatttcacttaatttttgagtctttttcaataatcgaaattcaactccccgaggggtttcaaactcctcctccgcagtccgtgccatgccaacgcatcagttcccaaaaagcagtaaagtcgcgcagccaattaggaattttccctactatgggaaaacggcgcaattaaaaataaaacatttctgactcaccggacttagtttcggatgaatacctttgctttaactcattatg

SEQ ID NO: 102716 - DNA, 953 bp, Heterodera glycines
  Promoter: Source sequence=SeqID_495; Location=315..1267; Strand=+; Gene=SeqID_54341
ttttgtagagaattttgtgctctttcccataggtctactaaattttccagaaaaattttcctaacaccctaggaatttttttcgaaaatttcctcgatttcaagccatttttggtttttcagatcaccatgaaggagtgatctgatcaagttggtgtaaaagatttttttgttcagcatcaaaagttagcttagcatgaattttttcagaattttctgccaacttggaaattgaatttttggcgattaactattttgtccataaacatatgaccacctaaaatgggcgctatgcctattcactcacgtgtcattttgttaataattattatttcagaaattgatttataggtttagaaagcccataaaaaatgctacaaaaaatgacaaaacattagttcgtttcagatttattcaagcaaaagggcaactatttttctcgatttatcatttgtccataaacatatgaccatgactgtatatgatgtcgctcctgtacttgctgatagggacagatattgttcacattagaaataactttttatgattgtacattgtcagaaaatgcataattttatcaatcattaataaaattcaaattagttaacttattacaagttagcttattaattttataaattgtacaaaatttttttttttttacaaaatcattattaaattaaaattaataaatttatttattattttcttatactttccctttagaaataaacttaattttttagataattgtaaatctcgaattttctgctttttattacctttttaatttgagtataatataatttttttctcacgtttcttaatataattctactaataaattattctttatttaaactttatctgtcgaagtgacaacagacgtttcgatactctaaaaaatagttttatttattaaaacataaatgagaagaaaatagtagaaaaatg

SEQ ID NO: 102717 - DNA, 313 bp, Heterodera glycines
  Promoter: Source sequence=SeqID_15130; Location=1398..1710; Strand=-; Gene=SeqID_79317
tttttttaaattggcaaatttaattcgaaaaaaaacattaaaatcaaataaactaaaaactgaaaaaaaaattttaatttaaatttaaattcgacccttaaaaggtcaaattaaatgcttaaaaggattaaaaattggatcatttaatatcaaaaataattttaaaaaatttttaaatttaaaatcacaaaagaaaaaaaagttgataatttttatttaaaaattaaaattcggtccttagctggtcatcaatttagcaacggtccgacgtcaaaaattcatgcaaatttgcacaagtttgatggcacaaatg

SEQ ID NO: 102718 - DNA, 102 bp, Heterodera glycines
  Promoter: Source sequence=SeqID_1855; Location=1176..1277; Strand=+; Gene=SeqID_76388
ggtgagtttgagtgagggacactgaggaggcgcctggtgtgatgaaaaggagaaaaagaaaaacgcttcggcgatttaaaatgcccccggggatgaaaaatg

SEQ ID NO: 102719 - DNA, 851 bp, Heterodera glycines
  Promoter: Source sequence=SeqID_3433; Location=1488..2338; Strand=-; Gene=SeqID_84668
tatgtgtgatatatagagaacgaagacatatgccttttattctgcgactagtttcgatgtattaagcttaaataacacattttcactttgtttgaagcttctacgatgacttttattatgcctttttggaattttccgaaaaatgcttaacaaaattcaataaaaaagaaaaatacacccctaagaaatgacccgacaaaaatttcagaaaatacaccccttaaaaattgaaaaatttctcaaaaattgatcgccaaaatttaatttttttttcttgataagttttgctccctaaaaacgtttaaattttttaaatgccttttttgggatttttgtgccttttaatgcctttttttattttttggtgctattatagtgcctttttcgagagcaagaaacaaaaaagttatgtggcctcaaaaacgaaattttaggctaagcagctttattcactttctatgaattcccaatcacatttattattatttttgcttatttttactaaagaataactatcatacagttttttagtttaaaaaatgattttttatattatacattaattaaaatttatttgtttttatgttgggtttgaaccccaaaaatgcgaaattaaccaactaagtgaaaacatagccaaaatttcaatttttgaggcttcataacttttttgtttcttgactatgggcccgtaatattagaaattcacaatagaagtcgaccctgctctatccactggtataaaaaaaatttgcaaaaatttttctggtggcgtctatcggaggcgaactcaagccagaggtgatatatttcttaagcagaagaatttttacgagtgctataataaaatg

SEQ ID NO: 102720 - DNA, 933 bp, Heterodera glycines
  Promoter: Source sequence=SeqID_3155; Location=1095..2027; Strand=+; Gene=SeqID_83453
ttcactaaatttccaatttataattaataaattaaatttttaatttgaagactcgcctcttttgcgtctccgtcgcccaccaaaaaataaacatccgcgtcctcacgcgtgctcaacaaatgcttcatccgatcaagcactgattgggacatgataagcaatatgaaaatcgtatttatctattaatgtaatgaaatgaaataatgggaattaagtgaattaagatattcaaaattggcaataaaataaataacaaaatcggctaaatccttatgattttactggactattcagctggctaatcatatgccaagcccataaacaacgaatgagtgaatggtgaaggcttcccctatttttggggggaagatttaaaaatcgcaaacattttaattaatttatttttcaatttgtatgtaaaaacaaattaaaaaaagtaaagggtggaaaatccttacccgatttgaactttcattcatggaaattggaaattgaactcccaaatcatcggaaaattatttacttttacccatcatcttccatccaaagctcattcaaaacaatatgcaattgtcagaagagtgtaatgttttgttgttcccatcctcccgtatttttttcatttattcatcgctttgcccctcggggtaaaaaattgatccaaatcaatacaaagaaacattgtagaaaatggtgtgtacataggttgaataaattatattaatattaatgaaacagataatttataattttggattagaataaagcgtaaaattaatttaattttatgggtcagccttttattcgtaaagtttttgtttaaaaataaaaactgaaaaggaaataagaggatcatgttaggtaatggaaaaaatcataaatgtatatttaattaagtaaattaattaggaaaaaattgcagagaacaaaatg

SEQ ID NO: 102721 - DNA, 199 bp, Heterodera glycines
  Promoter: Source sequence=SeqID_362; Location=4743..4941; Strand=+; Gene=SeqID_84439
tttgtgatcaaaccaaaagcagctaggaatgattatttatttgaatagtatttttttattaagagaaattttattggattgccaaaactgattttggaacgagtatttatagggcgacgaaacggaaaaattttgacaatttaaaattttgatgaattcgccaaacattttgattgttcagcttgcgcatgcactaatg

SEQ ID NO: 102722 - DNA, 794 bp, Heterodera glycines
  misc_feature (45)..(46): n is a, c, g, or t
  misc_feature (55)..(55): n is a, c, g, or t
  misc_feature (58)..(58): n is a, c, g, or t
  misc_feature (61)..(61): n is a, c, g, or t
  misc_feature (87)..(87): n is a, c, g, or t
  Promoter: Source sequence=SeqID_28660; Location=1059..1852; Strand=-; Gene=SeqID_59249
gcttaaaaaatacacaaaaaaaaaaaaatttttcgttaaagatgnnaaggaaggngancgngatttgacgctcccttttggacttgnaactctcggatttgaggtcgctgaccattggcaagaaattcaaaactttttcggtgcaggcaatttcaaagggtaattaattaatatgtatattactactattaattttactaaattaattttggcataggttcaaatagtaattaattaatatattaattaatattaattttacgaataattttggcttggtttcaaataccttatttgtaaagctcagtattttgtaaaaagaacctggagctgggtttcatgtgatctagacccggatttcctggacaaaattcaggtccaggaaaaatccagtcaattcatgtcaatctttttttgcttttcaaaacactttttacggccagttttttcaaacaaatttttaataagagggggaggtcgggcggtgcagataggcgcccgctttgcaaaattttgtaattttaatgcgatttattaacgattttgttcaagaaatgacaaaatttcgagattttgagccattttttgaagagaattaaaatttttagggccgtcgagaaatttttttagatttaatacccattttaaatatatttcgccataaaaagacggaaaaaaaattatccccgaaatccatgtttttgatgcctagacctggattaccaaattgatctggacttggatttgctgaataaaatccaggaaagtccaggtccaagaaaaatccatgcatg

SEQ ID NO: 102723 - DNA, 455 bp, Heterodera glycines
  Promoter: Source sequence=SeqID_11746; Location=1542..1996; Strand=-; Gene=SeqID_75236
ccgatagatcctatagatatacatatattagcctttaaaatttgaaaacaattagttaatattcaaaatattcagcagacgaacacaagaaaagagaaaagttttttgaatatttttggtcataactttcttgaaacttaacgaatctttttgaaattttacatgataatagaaaaaacttagggctatcgaatgttatatagaattaaaaattttgaatgtttttcagcaaaattatatgaaaattttttttaatttgatggtttttgagtaatttcataagtcataatatgtacatacgtacttttgtgttgttggctgcgtagaaacgacacaaaatttgaacaagttttgaaagtgccaaaattgaataaatattctgtttgttttttattcattttttctacacataaatccttcctaataaataaaagctacagtatcattaggacatg

SEQ ID NO: 102724 - DNA, 1003 bp, Heterodera glycines
  Promoter: Source sequence=SeqID_5488; Location=1244..2246; Strand=+; Gene=SeqID_58231
gctttccgcagttatgcaaatatcgcttttcttcttttgaaaattaattttaattcttttttataatttaatgcgttaaaaagaaaaaaaattctttcgttttcattggtttttcattaagcttttttcacaatttgtatcattaaaaagccaaaaatgtgttgttgcgggcgctgtgattgtgggcaattatttgctgctgcccttcgtcggtgtcttttcgtttgttcccaacggcagaagaagaagatcacttggcgctctcataaataatcccgttggaattagccaacaaattttgaaacaacgcaaaaagcgtgcgaaaagcccaaaaaatggtcaaattgaaatgactaaagattttttaaataaatttgttttttaattttattttttcctttaaagttgtcactattgcgtgaaatgtttccaattcttccgttcacttcgcttcacaatctctgtctgacccatccaaatttcaattccaatctgagcaaaccaaataaaatcaaatactaatttcaatacgatttcgattccctctgatgcttctcactttcccttcacatccgtcgatgcgtccatcccaaccgaaacgaaaacattcaaactttttgaggggaggcggcggtgggtcactcattcgcttccccccggggggtcattctccccccccccccccccgctgtgatccagcggagggagaggaggagaagaagcaataatcggtatctcactccttctttgcccatcggcaaataaccaaatgaccctttaaattgtcagtttgatggcatcattttttttacaaattaaatccacattttgtcggtataaaagctgtacctttgcccatcaaaataaaaaaaaatgaaatataaaattaccttctaaatatttagtgaaaatgtgactaattattttataaaatatgttcttacatttattttagttgttattttatttctttcattttatcgacaaaattaatttcaaaatg

SEQ ID NO: 102725 - DNA, 619 bp, Heterodera glycines
  Promoter: Source sequence=SeqID_7729; Location=2078..2696; Strand=-; Gene=SeqID_65764
ttcggaaaacgaaaatatattattaaagtcatttgcgaaaaaaattattaaggcatttaattgcatgccggaagaccaaccgggcgacagtcgcacgatttaacttttacgtgcatctacacaagaaaacgtgaaatacaaattacaattcatttttgggaacatttcacttttaagtgcacatgtacactaaaaacgtgaaatacaattcattttttggtttttacacaataaaacgtgaagtcgcgattaggtaattttctgtgtttttgtacactaaaaacgtgaaattacaattttgtgggtctaaaacgatttaacttttacgtgcatctacacaagaaaacgtgaaatacaaattacaattcatttttgggaacatttcacttttaagtgcacatgtacactaaaaacgtgaaatacaattcattttttggtttttacacaataaaacgtgaagtcgcgattaggtaattttctgtgtttttgtacactaaaaacgtgaaattacaattttgtgggtctaaaacgatttaacttttacgtgcatctacacaagaaaacgtgaaatacaaattacaattcatttttgggaacatttcacttttaagtgcacatg

SEQ ID NO: 102726 - DNA, 313 bp, Heterodera glycines
  Promoter: Source sequence=SeqID_5123; Location=1607..1919; Strand=-; Gene=SeqID_56990
aaaatagaaatttttttaattcattggggaaaaaatgttcacttaaagaatggcaatttaaaaagaaaagtaaaatgaaaatttggcaaaaatcaaaatttaaattttgtaaaaatataattatcattaataaattttaaattttatttagataaaatattaataataataatatgcaaaaaaaaatatgcataacatatttcatcaatatttaaaattaatatgaggaggaaaaatgaattttcataaaatcaatgagaataaaagcaattaataaaatgaatttctaatcatttttattttatgaaaaatg

SEQ ID NO: 102727 - DNA, 275 bp, Heterodera glycines
  Promoter: Source sequence=SeqID_17310; Location=500..774; Strand=+; Gene=SeqID_81787
ttttggttaaattgctgaatagtcgccgcaaaaaaaaaatttaattttttccttgaatttttttagtaaatttttttcaaattttttagaattttttcgaaccagactcagtagttgatcagtaattttttccagaaaatctaaaaaaatttcctgtttgaggttttataaagtattttcatattgaacccgaccgagtatttttgtgtcaaccaccgcccttggaaattcataaaattttgctgcactttcttcgatcgatatgtaataatatg

SEQ ID NO: 102728 - DNA, 152 bp, Heterodera glycines
  Promoter: Source sequence=SeqID_25661; Location=1268..1419; Strand=-; Gene=SeqID_56413
ggtgaaagtggaaatagaattttaagaaacaaaaatttagagttgagcaaaatttaatgaggacaaataacagcatcgaggggtggcatcgctctttcaatagccaattccgcttccttcatccgccattaagttattttgtcaaaaaaatg

SEQ ID NO: 102729 - DNA, 329 bp, Heterodera glycines
  misc_feature (25)..(25): n is a, c, g, or t
  Promoter: Source sequence=SeqID_20339; Location=1..329; Strand=+; Gene=SeqID_50854
tatccaatgagtttttaaaaatttncgagtcacaactctcacatgagaaaaataattaggaagaaaaatgtattacgcccttcatactgtttgtgaaccatgcaatattttcagttgagtgttttataagattacaatataaaaatagtaaaaaagagaaaaaaaaccaaaattcaaagtaaaaaacatggattattgaaaggtcatttttgaatggaattatgcatattttaacacttatgtattgagaaagcaattttcaataaaaaaatacccaaacaaacagtcaaacagtaattgattaatgagcattttgaagtaacagcatg

SEQ ID NO: 102730 - DNA, 78 bp, Heterodera glycines
  Promoter: Source sequence=SeqID_1664; Location=1..78; Strand=+; Gene =SeqID_75184
atctccgactggtacggaaaccaaaaatggtcctgtttttggcccaaaacggtggcatttgccaactcgcccaaaatg

SEQ ID NO: 102731 - DNA, 77 bp, Heterodera glycines
  Promoter: Source sequence=SeqID_2366; Location=1976..2052; Strand=-; Gene=SeqID_79353
ggtggaattgtccaagaagaatgaaatggattagatttgaatttgggccatttcaggtggatttggacgacacaatg

SEQ ID NO: 102732 - DNA, 684 bp, Heterodera glycines
  Promoter: Source sequence=SeqID_23936; Location=421..1104; Strand=+; Gene=SeqID_54624
ttcaatttaattcacttttaaattaaaagttttaatttaaaatacttttttttattggaaccaatacaaaatgaacggcggttaaactgttggcattccaaaaaattacaaaatttaattcggcccatttttattttcgttttgtttgggttccgtccgcctccttcgacggaagacaaatcaaatggttttgaattaaaatggcaataaatcactgacaaaaagattgattgatcggtgtctatactcaacttaattatttcaaaaattatttttaattagtgaaatttctctcaaatttcagaattttaacctttcatttgacgaattgttttgtttcaattagcgacgcattttaaattgttttttttccaaactgataaaagttaaatctttttggcgtcagtttaattctttaaaaaaaattcataaattctgaattatttttgtgcaatttgttaatcataaatggacgcaaattccctttatttttaaatttaccacaaattaaagaaagtctttggccataatacgtttataattaaattcatttttaaatttttttacacaatttttacattatttggctttccatgcaaattaagcccaaaatctcgggcttttaaaagaaaatgttgccctaattgaagaagattcgaaactgtttgttttttgttacaaatg

SEQ ID NO: 102733 - DNA, 442 bp, Heterodera glycines
  Promoter: Source sequence=SeqID_965; Location=755..1196; Strand=-; Gene=SeqID_65065
ttggctcctctcattaatggtgccggttaaaagggtcctgtggttgttaacgcaccataacagcaccggcacaaagttcgtcagcttcagctattcgccccccccccccctcttcgccattcacttttttctttttgtttccctcaattgaccaattttatttttgtaaaaattaaattattatgtaatgctctttccatttcattttatgcaatatgtaattgagaaaagaaacaaagcttttcaaacaacttttgtttattttgagtgggttttctttactgaacaattcaaaaagcaaaattgaaaagctaaactattactacatatagcctgaggacaaatgcaataattaagtgaattaaatgtgccgtttttctcttttgggctttttgggtcattcacgagattaataaatcatagtccgcttttcaacaaaatg

SEQ ID NO: 102734 - DNA, 856 bp, Heterodera glycines
  Promoter: Source sequence=SeqID_637; Location=2221..3076; Strand=+; Gene=SeqID_57909
ttttaccacgaaataattattcggtgttttttgtttccggagattttggtgaatttaaatattataattagagccatttttagtcaaaaaaaatcgcgaaataggcattacattaattaggcacaaaaaaaggcaaataacattttttattaacactttttaggtagcaaaacatataaaaattaatcaaaaaacttaattttgcttatatttcaactattttaacgttttttaaataaagacaatttttaaaccaaaatttttgtcaagaaaatataattaatttttgggaatcagtttttgtgaaaacttttttcaattcttagggggtgtatttttcatttttcttgcatttttgttaaggatttttccgaaaattctgaaaaaggcgccaaaagtggcgaaatagtcacaaaaattggaatttaggcattagcacaaaaattccaaaataggcaaagttaggcattataaaagtcatcgtaaacaccccaaacctagcgaaaacgcgtttttcgtgcttatctatgcgtatcaagtgcgcagaaatttaggcatttgactaaaaatcgaagcactaattttaatccctttttaatatttaaataaaagaaaaaattaatattttatttattagggctgaaatagttttaccgagtaccgagaccgaagaatgacaatgagtaaaaaaccgagaccaagaaacgtgaaatcataaaatccgatattaactttttagtttttagcaattttcaattttagtacattgtagaatttctcctctcggtgatttcaaaaacccgagaaagaggagtgaaaaatcgagaaccaaaccatcccgaacagccctaaaatg

SEQ ID NO: 102735 - DNA, 991 bp, Heterodera glycines
  Promoter: Source sequence=SeqID_26653; Location=668..1658; Strand=-; Gene=SeqID_57408
cagcagatgaaaagcatcaccataaaaattttaccttttcttcgctcgaatatgctgcgataaaacaatgtaagaatctagaaaaaaatattttatataataaaaaatttacaaaaatctatattatttaaataaaaagctaaattattttaagcaattctttccaaagcttcatgggtctttgtttcggaagagcttaaaaaaagtaattatgctaaataaaattgtaatcatttaactttactttcattgacctaatataaaatttaactagagatctgatttttatggatttccatatttttttttgcacattattttggcctaataccacatgaatagttttttgcttagtttatgttttaggatgcattttatttccatatttcggatttttgtccatatttccatattttggcattttcatataacaaatcgagaatttcatcccctaaagatggaaaattttggaagatacgctcataaaatccaaaaattttgaaaaaatataaaaattgtgcaaacattttttattaataacgtttgtataaaaatgagttttaaagaaaattacaatttttgcaatttttctaaattcaatatttcagtaaataataaataagaattatagttctcaattgtgaaattctataattcatgaattaaaatggtttttccttcttgacaaaaaaatatgggtttatgaatttttaaaaattcaatccaattttctgaaattattagtcaatattttcatgtttttgtccatattataaccatattttggattttttatccataaaatccgggccctaatataaccgatacacaacatttttaatttagtcttttattctaatgagcagacaggagaagtcgaaaatgaaattaaaatcttacatcgacgtttgtacgaagacgaaaacttgtgagattttaaaattttcacaattaaattaaaattcttagatgttggctaaaaacaattatg

SEQ ID NO: 102736 - DNA, 151 bp, Heterodera glycines
  misc_feature (31)..(31): n is a, c, g, or t
  misc_feature (122)..(122): n is a, c, g, or t
  Promoter: Source sequence=SeqID_38469; Location=1084..1234; Strand=-; Gene=SeqID_67269
ttttcgtgccatatttttggcagccctaatngatgtgtgtatgagtaaaagtgatatatactgtacaattaatgttgccaagtcaacctattattaaaaaatcattttttgcaataaaatgncatagtgaattatagctaagtaaattatg

SEQ ID NO: 102737 - DNA, 492 bp, Heterodera glycines
  Promoter: Source sequence=SeqID_15043; Location=911..1402; Strand=-; Gene=SeqID_79216
gagataaatttattgttttttattttggagattggtcatgaaatatttgagttcccgatgcaatgattaaacaaaatgatagtttctgggcttggacgtttgcaacccacagacttagtgtctttttgcacataataagtgcctcttatcccattgactttttcaagggtaattccaatcgtccacaaaaagatatatgtgatgtttttgagcagttctgcaatgtaatttcaggttatcgaaaaacaactcacgctttgacaatgtattaaatgcaataagcaatttggatggtaattttgagaataagcaaattatttcacaaatttagggtccaaaattaatgtcagatgaatgataatcattttcgaataactctgagcacatcgcaaaaccgctaaaaacagaatgacaatcccatggaatttaccatcttttgattagtgttttattgtatccgtcttcttgtcgctagcaaattgcaacataatg

SEQ ID NO: 102738 - DNA, 145 bp, Heterodera glycines
  Promoter: Source sequence=SeqID_23605; Location=881..1025; Strand=-; Gene=SeqID_54301
ataatgaaattatttattaaaaaaaatttaaaatttacaaccaatcttcaaattaattaaaagcattgaaaaataactcaaaaataaatagaaaaataatgttacaccgtccggattcgaacttggcccccctcccctcaaaatg

SEQ ID NO: 102739 - DNA, 56 bp, Heterodera glycines
  misc_feature (45)..(45): n is a, c, g, or t
  Promoter: Source sequence=SeqID_15617; Location=1..56; Strand=+; Gene= SeqID_79906
ggaccatccctcaaaaatatcagcaaaaaatacttctttccaggngagatagaatg

SEQ ID NO: 102740 - DNA, 841 bp, Heterodera glycines
  Promoter: Source sequence=SeqID_29799; Location=1..841; Strand=+; Gene=SeqID_60258
tcagaattatcttcctcttgtaacattaattattttttctttataataaaaacgatttcttcactttgggagtgttttttttttaaattttgtaaaaaacatatttatttatttattagtgagtgttttttataattgggacaattttgggtcggttttaattatatttttcggatatttaattgccttctcttcttcttatcgttatttaattcatttttggattttatttttcattaaaattgtccgacgatttccctttccttcggccgaccacaatttgttgcaatttctcaatttgaattcaattgaatgaatggaatggctcctcttctcttccttcgcttttccgtttttgcggtgttttttttgatcatttgtccgtcccatcgttcgctttttcttttctcccattcgttcgttcgtccgttcgtttccctttctttgtccatttctcccccttattttttccaatggaatttaaattcatcggacaaaaaatggcaatattttttctgccgtccgtccgccgattcattcattgaataatccaacatttgtccatcattccgtccgctgatgcccacaaaaagccattttgcagaacaaaaattttcatatttccgctcactcagtgccaagggacaaataaaaaacactccaaaaaatgaaaggccccaaaaagctgcagaattttgtttttgcaatttaaaaaaaataaataaattttctttgtaataattttctttctttttttgataggaaaatgattactgtgaaagtaaacattctgttcaccagctacaatggcttctgccagcccagcggagagcacaaaatg

SEQ ID NO: 102741 - DNA, 947 bp, Heterodera glycines
  Promoter: Source sequence=SeqID_3374; Location=1860..2806; Strand=-; Gene=SeqID_84442
acattttaattgctctgcccccccccatcgaatcgctctttgccttaggctttcccccgcgggcgctgcccattgatcagctgctgctgctgaaaaccccaaaaaagtcgcgcactgcgctcctcccgcccgccccccccccctcccataatttgagatcatcgctcaaagtacagctccacgggcgaacaaatgcaccaccacaaaactccgtcattcattcactcccagtcattcagtgctcgcgccgttggtttaagtgtttaggacacgttaaacaacaagctaaaaattgcttataaaaaggcaacaaattaattaatttttaaatgcacacactttatttaccacttaattaaaaatgactacgattagtgttcccatccccgttaataatgaaatatttaaattcaattaggttaatcgccttttgtttcccgaacctggagttggtcactaaaaaattgcttataaaatggcaacaaattaattaacttttaaatgcgcacattttatttgccaattaaatgccaacataatgtttacgattagtgtccccccattaaagtgtaataccctatttaaattcaattaagttaatgccgcctcttttgcccgaacttttgagttggtcatttccgaaatatcagttgaacatttaaatgaaaaatctcaaaaatcaaaatacacctctccgatccgaagcaatttgggattaattgtcaccactccctcgaccctcgcacgcccattgaccgccccatccccgacaagcgcccgcccgaagaattgttagcctaatttaatttttaagatttttcaaatctgtttcacttaactgctaaaaatatctctttttgattcaataatttatttcataaatcccccaatttttttttgttctttttaaatgactttttcagttagccgactgaattatcaaaatg

SEQ ID NO: 102742 - DNA, 427 bp, Heterodera glycines
  Promoter: Source sequence=SeqID_35497; Location=1..427; Strand=+; Gene=SeqID_65037
attggaaactctgctgaattccgagtccaaaataactttttgatgagttgtccaatagtttagtattgtaatagcttaaacatggattagcagtacaaatcagtcatcgagagtttgagttcaattgaatggccgctttaaccatttggctgccctaaattaagtcttcgacagccaaacttcgagtttacaaaaaaaaaccatcttttaacaaattttaaagcaaaagatttcttgaaatttcaaattcaaaaattagactaaaattttgaaaatggattgatttccgtacagttttgcccaaaagtcggtcaccggctgcttcctgctgctgcttctgctttgggtgggtcgagagccgggcttcatgcccggcttcggcgcactgttccccgccgacttctacaccgactccacctcggccatg

SEQ ID NO: 102743 - DNA, 542 bp, Heterodera glycines
  Promoter: Source sequence=SeqID_39436; Location=1..542; Strand=+; Gene=SeqID_68002
ggacaaaaaaaaatcaaacaaattatgcgattataaaagtcaattttgtatgcctgttaccgcgggataaaaccgatttcgcaattctagacaacaatatatacttgattcgatcagacctttgcatttataaatatagaattgttgaccgtcaagttgaactaaagtttgtggtcaatagtagtagcgcgaaattcaactttttattatttaaagaataccgcgacgacgccaataataataatatacttcaagcaggctctcaaacgcctcagttaaaattattgttaggggttgcttatacatttgacgtactactgatcataatttgtgcatttgccgtaaaacagatccgccgagcgagcagcagaagtaacacatcttccgaaaatcttggcatgttcgacctagtggaattggcagcgcttacaaataattccaaagaactggtgtacacgcccacaacagtagtcaaagagaggagtatttaaggcaactattctggccatcagcgctcatttcgtacactaaaccactatatg

SEQ ID NO: 102744 - DNA, 391 bp, Heterodera glycines
  Promoter: Source sequence=SeqID_4754; Location=324..714; Strand=+; Gene=SeqID_55618
tttcgttggtccgttcgttcgtcaaaaaaaaatccatcccatctcagcaaggcttggtttttatctttagggatgtcaattttgtaaatataaatttttttttcctggaatcttcatagctaaataatagagtgccacgggaccgggaattttgggcaaacccgggaccgggaccttttcgggttgaaaaaccgggaatttttggctgggaaaaccgggaaaaacccgggactagtcccggtcccggtcaaaaccgggaccttggtactcagttgtactcagttgtccgctaccaggtcccggtcccgtggcactctactaaataatatgaaaaaaatttttggtcatgtaattctgtttctttatttttaagctttattccactaacatg

SEQ ID NO: 102745 - DNA, 52 bp, Heterodera glycines
  Promoter: Source sequence=SeqID_2752; Location=229..280; Strand=+; Gene=SeqID_81413
agtccgttcatttgtctttctttttggcattttcacttaggtgctcaaaatg

SEQ ID NO: 102746 - DNA, 1003 bp, Heterodera glycines
  Promoter: Source sequence=SeqID_5770; Location=2809..3811; Strand=-; Gene=SeqID_59172
aaaagcaatttttaaccattatttttctatttaattggataatattacaggttattttaaaaaattattggaactcataatgtagaaaacacaaaataaacgtcaaaggaaaagatttatggcaaaggcaaaaatattccagaaattcttggcaaaacgccattctcgtggaatgatgaatgaatcggtgcataatatgcacaaatttacaatttacaacaagcattagcctttttatgcttttgttactaaatcttttcactgttttttctccctttttcaatttgaaattgtaaaaatattcataaataaaaaaattacagtaacccacgcatcgaaagtgaacagttaaagtaatgccacacattttttcaacatttattgctttgttccttctcttacggcttaatggcatctccggggtcactttgtccgccggctcccacttggacatgagtgtaattgtcacagtgcagaaaaactatacgggggacaattgtcaagcagcgatggcacaatgggacgcaggcgaagggaaagacgccgaaaaaggcactaaaaatcaaaaacaaaattcaatttatggcatttcgtaatttacattaaacgccccaattggcacggttggtttcagttttattgttaataggctttgtccaaaaatacaattttttcaaatgtttttctgctaaagaagattatttgaaaaatttaaaacaaaattgtttaattgaaatttatcaaatttcataatttttttaaattttgaccccataaaaaggaattaaattaaaatatttattttttcctattgtgtacataaattgtgcagaatgtctgtggcgaaagtgtacacagcaggtgcagtacaaagtcgatttgggctacagtaaggttagtctgtgcatgctgtatatcagaatattatactttttgtaactgtagaaattgattgaaatttaatattttatttttcaaaagtataaaatgaaaggtcagaatg

SEQ ID NO: 102747 - DNA, 158 bp, Heterodera glycines
  Promoter: Source sequence=SeqID_34358; Location=1..158; Strand=+; Gene=SeqID_64177
gaattatgcaaaggccgaaaagccttgaaaactgagactttggcatttgccaagcttaacaaggttttctaacgagtttaatggagggtaaccaacacgaacccccctgggactttccctggaagctaatttgtgctaattgccctcattataggatg

SEQ ID NO: 102748 - DNA, 165 bp, Heterodera glycines
  Promoter: Source sequence=SeqID_25913; Location=414..578; Strand=-; Gene=SeqID_56682
agcacgggcggcataactttgagcggcccccgcctgtctgttccccgtttcattccgtttgaggaaaacgggcgttgccgcgcgtaaagcgttccatacagcgaactgtcgtcctcagacaggtgcaccaagcctctaccaccaccatcaccaccaccaccaatg

SEQ ID NO: 102749 - DNA, 112 bp, Heterodera glycines
  Promoter: Source sequence=SeqID_42162; Location=922..1033; Strand=-; Gene=SeqID_70123
tgtactcggcatgcggaacggtttcaaacgacacttggtgctgttggcatttctccaaaacaatatttcttaccgccctagcggttcgtccattaccatcgccccaaacatg

SEQ ID NO: 102750 - DNA, 371 bp, Heterodera glycines
  Promoter: Source sequence=SeqID_12189; Location=1..371; Strand=+; Gene=SeqID_75765
gttttaaaatttttataaaaaattttttatgggaccttctatgcacaagtaccacaaaatcttttatcaaataaaaactatagggcttgcatgactggaacaccttcacaaatttttttaaaaagttagaaaatttgagcttttaagtgcgcgattcgcgaccgcgggatttttctgtccgcgccccactcactgctgtataaccgaaaaggaattcatgctttttaaccgcaaaatatcatttttatgtttggtagtcgaatgatcattttgatttttttcatctgcgagcgaactgatttagacttttcaacaaaaaattctaccaaaatttcttagatttaaatttcggagttcgcttttcaaaaatg

SEQ ID NO: 102751 - DNA, 1003 bp, Heterodera glycines
  Promoter: Source sequence=SeqID_15850; Location=798..1800; Strand=+; Gene=SeqID_80180
gcctagtaagccgagattcgcgaaaaatgggcgaaaaaggaaaatattacgaatctgataaagcattctgggttttcgaatctattgaaataaaagcaaaatgaaagtcatggccagcattccgacaaattatgccacaaaaataaaatttgaaattttcttcttccattttttacaaagaatttcaaaaattttctattggtttcctcacaattaagaaaagttacggttataagcagatgagttttatcagcagctgatcaaataccaaaaccaaattagtcaactccatgaaaaatcataaatgtttaattatgaaaacaataaaaaattatatgtttttaattcgcaatgtttttgatcatagcccccaaacgaaaattaaatcggcaagagataatttctcaattttttattcttttttattttgtacaagtagcaaaagcgaagaaatgaatgaatgaatgaatgactttacaatttgtcatccgttcttcgtccgttcattcgttgggcgcgaggacataaaaggcgaatgatttgtcatttgtaattaattagcaaaaattacctaataaattaaataataattgccaatcatttttctggtgtttttattttttatttaaactttgaaaaaaggttttctttttcgcaaattgatgaaatgataataaaacgagtttatttttgtgctcatttatttcctttttattttattgcaaaattaaaatattattctttgggcatataaataaataaagaagttggaaagaaattatcattttgcatttgtatcactttatttggagaagaatatggttaatttattgaggctttttttacgtgtaataaaatttaaaaaattaaaaaacgcatatatttaacaaatttaccattcattgcttatcaccgtaatttcgaaatgaattgaccttttgaatttattaattaataattaatgttataaggcaccactaattttaaatctattcttaaaatg

SEQ ID NO: 102752 - DNA, 1003 bp, Heterodera glycines
  Promoter: Source sequence=SeqID_1094; Location=2028..3030; Strand=-; Gene=SeqID_67695
taattttatttgctgaataataaatcataacttagcttaaactttgtcaaattaaagatcttgagcgatagctttaggtgtcctcctctattataagtagggatgatatttttaggtgctaaaaactgccaaaataggtaggttttaggttctaaaaacccccaaaataggtgctaaaaatgggaaaataggtgccaaaaagttccaaaattaggggtgtaaaattgaaaatttccttcaaaaagcaaagatattatgccaaatgattaatgagatatatcaaaaattctaacaagaaaataaataaataaattttgaagatgaatttttgagaaatttttcatttctcatcaggggtgtgtttttgaaaattttcgggtcgattcttaggggtgtatttttcgtttttattgcatttttgttaacaaattttgggcaaaacgccaaaataggtgaaaattacggggagctcaggaaaaaatagtgaaaaacctaaaaatatcatccctaattataagtaattaaaaatttaaacaaaatttttacaaaaaattctaaccaaaaaatttcgacaaatttatactcaattatctttgccccgaactttttaaaaaattaataaaaaaattttgaactttaactgaaatatagaaaaatctttaggcaaattatacttataaagaaaaaaaaattggttatctcaattctaggggtatgtatttttcgcttttactgcatttttaagaaatttccaaaaacccaaaatgtcaaaatatttaattctctaatttattaaaattcctcacaaaatcaacaaaaattaaatacctatttgaaatattaaatgaatttataattcattattttagaaggaaatttaaaatgagatatttatttaatgaaaataattatttaaagaaattaaaataaaataaacaacaaaatctccactctgattattagatagccaagacaaattgtatccagattttaatatttaatg

SEQ ID NO: 102753 - DNA, 115 bp, Heterodera glycines
  misc_feature (7)..(7): n is a, c, g, or t
  Promoter: Source sequence=SeqID_29079; Location=715..829; Strand=-; Gene=SeqID_59640
attttanttaattcctttgattggattaggtaatttatacagctaaaattatagataaatatatatatatatatttaaaatatatttaaatgcaggtggaattaatccggcaatg

SEQ ID NO: 102754 - DNA, 53 bp, Heterodera glycines
  Promoter: Source sequence=SeqID_10592; Location=1962..2014; Strand=-; Gene=SeqID_73826
attatttgtaaataaaaaattattattttttcgtcgcaattccgccaaaaatg

SEQ ID NO: 102755 - DNA, 198 bp, Heterodera glycines
  Promoter: Source sequence=SeqID_8337; Location=1..198; Strand=+; Gene= SeqID_67727
ataaaaggcgagcaaatggcataaccaattcgttggtgttattcattataatgaaatttcataaaatatttaaagaagagtttctgttgccaataaaaaataactttaatttaatttattttattttattttcatttaatttaatttcctttagcagatccaatttctaattcaatccttctactacttcccaaaatg

SEQ ID NO: 102756 - DNA, 158 bp, Heterodera glycines
  Promoter: Source sequence=SeqID_15345; Location=1551..1708; Strand=-; Gene=SeqID_47288
gccgcaaatgtctggacaccaaagtttacattgtctagccccttaaaactttttaatattttatttttgcgtcgatgtttgtggatgcatctcccctatttcctgtttataaatttccctcctaatttgtaagggaagtgtaccacaccccgcggatg

SEQ ID NO: 102757 - DNA, 139 bp, Heterodera glycines
  Promoter: Source sequence=SeqID_26095; Location=1011..1149; Strand=-; Gene=SeqID_56841
tctttcaaagagcgcctcccctaagtatgtttgtttgttttttttgaaagtgtactgtcgaattttttttgttatttaaactttttttgacttttccccagactttttccattttggcatttttttagcaataaacatg

SEQ ID NO: 102758 - DNA, 948 bp, Heterodera glycines
  misc_feature (876)..(876): n is a, c, g, or t
  Promoter: Source sequence=SeqID_20553; Location=869..1816; Strand=+; Gene=SeqID_51099
aattttaggaggggacttttcgacagaaaaagtaattaactttcaaattaaggggcgtaaaatcgtaaaattttttccaaaacaacaaaatgaagccaaaccagtattgaaataaataatttataaaatctaaaatcctttacctagaaaataaatttaaaaaaattggacatgaatttttaagaaaattgtttcattcttcctaggagtgtattttgaaaatttaaggaccggttcttaaaggtgttttttctaaaaaaaattttcccaggtaaaaaacgtatctctagtaattctaatttagcaatccatatttgtatgttaatttaaaagaaatttagtaaaattgacaagcaatataatttattttaataagaattatttgtttttatatttactgtcgaaaagtccgggagcccacaaatcaggggtgagacgcggccgtaatccgcgcttttaatttgaatcctcgaaccgcgaccgcgggattttttgggacaaaattataaagaaaatttgaagcgattgtcttttttgaatattcaaattttaaataaattttttgaaaagttggattatttttctcaaaaaattcgtttaaaaattctcttttttcctcgacggagctgaatacctttaatttttctttaaaaaattgtatctaaatcaaaaaataaggtgattttttaaaaatcttttaccaatttgcaatcaaattttttaaaatttttcgtgcggcccatatcggcacattataaggaaattttaaaaaattaaaaaaaagttaatgtgaaaaagttggaaaatttttgagtttttaaatacgcgatccacgatgcgcggtaatttttttgcgcaatccgagaccgcgggatnattctgtccgtgccccacccctggcccaaatccgaaaatgcaaatgcctttgttactgattagagttccatg

SEQ ID NO: 102759 - DNA, 66 bp, Heterodera glycines
  Promoter: Source sequence=SeqID_341; Location=2082..2147; Strand=+; Gene=SeqID_83237
aatttataaaatgtcgatgaattggatgtgcatggaccaagtgggcaccgaattgctgtggaaatg

SEQ ID NO: 102760 - DNA, 268 bp, Heterodera glycines
  Promoter: Source sequence=SeqID_6743; Location=3683..3950; Strand=-; Gene=SeqID_62716
ggtgaatttaattaaatatcaaaattccaaaatttaatttaatatgtattttggtgttgaagtcttttttctttttttgcatcctcacttcaactcttgaaaatattatagttttgtaagaaaaattctgtttggcaaatctgcaaaaaaaaaatggatttggatattttatatgtcttgagtcccttcgtaaaattaggcttcgccctctccccccttttttaacgtatgccctcgaaccaaacaaaatatgtaattcaggtggatg

SEQ ID NO: 102761 - DNA, 614 bp, Heterodera glycines
  Promoter: Source sequence=SeqID_2930; Location=559..1172; Strand=+; Gene=SeqID_82393
aaactcctcatattccctttcacgctcatagcaaaaaaaataaataaataaaattttaatagttattttgtatgttaaaaaagcgtgttttgtaataggtaattatcattgatcaacactgacgtggaggagttaataaatgcttttatcgttcaatttctgtttgatacgcgaatttgacatcgaagctttttctgtcatcaatcatgtttttacgggcaattgtgcaaaggatttaaatcggcttttgaactggtcaaaactcggaaaatggactatgtgctatctgagaggttttgatcccgttcaaacacaaggaatttccaaaaaaggaatttattttggcagagccgaaggcataaagtcacttcgttttttgtgctaaaatattagaaaattcaagtaagttgcggcaggcactttaaaccggtttgaatttgaaatggcaaactttgcatttaaaatatgctgttgaagatctaagtagtgtagaaatgagggggagagaggaagaaagaggattttctgtgatggattttgggggcacagtcccatcgacttttatgcgtccaatcaaatttttcattaaaataaatccattaaaacaaaaaatg

SEQ ID NO: 102762 - DNA, 202 bp, Heterodera glycines
  misc_feature (7)..(7): n is a, c, g, or t
  Promoter: Source sequence=SeqID_30981; Location=1..202; Strand=+; Gene=SeqID_61335
ctccctntttgatagaaaaagcatcagagagccttatttaacttttaattaacatttggtgcgtttcagagcacgttctaaaaaatatttatgaattaattttgcaaaataataaataagtaatgaaaaagtcagaatttcgaaaaattttaaaaacaacaagcgttggcattttttcaggttaagttagtcctttacaatg

SEQ ID NO: 102763 - DNA, 653 bp, Heterodera glycines
  Promoter: Source sequence=SeqID_18222; Location=604..1256; Strand=-; Gene=SeqID_82818
ataaaatcgaaaattcaaaataaaaatggtccaatgaaaggcgagctaaactgggaaaataacatgtgaaaataaattaatgaaattctatttataaaattagtgattaattcgattaaattttaatctaagaaaataaaagttttccagtaaaactaaaagaacaaattaatacacaaataaagaatattgattaagcaacattgtgtagactcgaatatattggtaatggaattgaaaataaaactaatttaggaattaatatgccttttaaatgagaaattcatacataatataaaatcacacaagaaatttttggaaaattattttttaaaacgacattggttgtctgcccctcaagaaaggcacggatcaaataaaatattaactggtaaaatttaaacgtttgacgtcctttcaaggacggatacctcccctgtcataatatcgctatattcctgtacaagctgatcagagaaaaaactctttggacttgcaaagagcaaattttgcacgcaaaaaggacagaattgccaacgttaatggaaaaatccgatgttttggtacacaaaaaattgccaatactctgtaaaagctgtgaacaagggtccatttctttttttgtaaccagtgcgccgttcggatttaacatg

SEQ ID NO: 102764 - DNA, 323 bp, Heterodera glycines
  Promoter: Source sequence=SeqID_97; Location=5155..5477; Strand=+; Gene=SeqID_66809
cctaaaaattcgaaaattataaaaaaaaatttatattatttatgctttttttgaaaaatagaatttttaattcaaaattttcttaaaatgacacctttcaaaataattaaaaaaatataatataatttcatttaatcaaaatgagtataatttataaaaaataaaacattaataagtagaatttcgaaaaaatgtaaacattattttaaaaaataagtagatttgctgagtaaagctatgcaataaatcagcataaatatgggaataaaaatgaattcgtaaaagtatttctaatcattttaatgggtttattaagaaatatg

SEQ ID NO: 102765 - DNA, 478 bp, Heterodera glycines
  Promoter: Source sequence=SeqID_12462; Location=1..478; Strand=+; Gene=SeqID_76094
ctaaggacaaaacgccaaaaaaccccactaatttaaaaatttgccgagattttcccttgtaaaaactgaagagccgatctcgagttaaaaaagaaactttcaaataacaaaagaaaattcgatagaaaagaccaaaaaattcacttaggcaaaatttcaataaaattggtcaataggaaaaattttttttcaaggacaaagttttttctttttctctcattttgacgcactatttccatgtctctaacatataagataacacatggttcattttcttgctaataaactattttttcaaatttttatttaactttgaaatattcttaagaattttcccatcaaaatgagcacaaaatggttttgtttggtttacccttcaccaagttataagtattagaaatttagttgacacgtagttgtccaataagtccttaagatcgcaaaaaacaacaaatttctttcctaattaatcgaaatg

SEQ ID NO: 102766 - DNA, 824 bp, Heterodera glycines
  misc_feature (6)..(6): n is a, c, g, or t
  Promoter: Source sequence=SeqID_22082; Location=368..1191; Strand=+; Gene=SeqID_52724
aattgngaattggaatagttaaaattaatttttcacctgtattatccaaaatcgatttagcactaaatgaccataaatccttattttctattatattccatgtatctgactcgattttggatcataaatatgaattttggtgaaaaattagttttcgacttttgttcgaaatcgggtccggggttcggaattgatcaaaacagttctttggttcgtgattagcgaccccgaaaacccgtggaaaagcttttttgacaattttttcaaaatttttacaaaaaaaaaattgttcgagttcgggaccggaattgaaatttgtcgaaacggatgtcatattcgtgatttctgggctaatccttgtcccattcattcatttgccccatattttccggcattttaaagccaatttttttttggcacacaagggggttttgggtttctaatttaacttttctaaaatttgatatatctgtggttctaaaatagtgccggtgcctgaacacggatttaaattttgttttatcattgtctccgtcatattcaatttcacaattcttaaatgatcaaaatgattatttaagcactgaaatttaattagacaattacccaatttttgtgaacgttaataccttttaattcatcaaatgcaaaaagcgttatttaataataaaaattgctatttgaattgacatttcttcatcataatttcttatccattaaagccattgtccttaaatgaggctttatggcagcgaaatgagacttttcaaaaatttttcatcttcgagccatgagtttactggtaccataaaaaagcaaaaatg

SEQ ID NO: 102767 - DNA, 340 bp, Heterodera glycines
  Promoter: Source sequence=SeqID_6073; Location=1238..1577; Strand=+; Gene=SeqID_60218
actgttcatttttataacagcagttttaagtcaagggtaatcaaagatggtatgatcagggatggcagatgtgaggctttagcctcattttgtgggtttttgataggtcaatgaggctttgaggctttttgtggttttttgagaaattttgaggctttttgtggttttttgagaaattttgaggctttttgtggttttttgagaaattttgaggcttttttggttttttgagaaaaactgcttatttctaaattgatcatggacaatcaaaaatataatatttgaacattttaaacgtgtttagaatacatgtaaaaatgaggctttttgacccaaaatg

SEQ ID NO: 102768 - DNA, 147 bp, Heterodera glycines
  Promoter: Source sequence=SeqID_27074; Location=706..852; Strand=+; Gene=SeqID_57793
aatgatccgacagatcatcaaatagaaaatattttaaataaatattttaattaattaagatctaattttttgacgtaaagtccgctcataattattaaattgataaaaacaaatttaaaaattaaccaaatcaggaaaattgggatg

SEQ ID NO: 102769 - DNA, 106 bp, Heterodera glycines
  Promoter: Source sequence=SeqID_11298; Location=311..416; Strand=+; Gene=SeqID_74673
tttctttttctatacctaaaacaaattatgtaaataagataattaatatttctttattatgacaattaaaacaattattattatcagtttaaaaactgaccaaatg

SEQ ID NO: 102770 - DNA, 402 bp, Heterodera glycines
  Promoter: Source sequence=SeqID_17766; Location=1085..1486; Strand=-; Gene=SeqID_47480
tatataattttcaaaaattttctttttttttttgtatgtattgttgtgtgtctctttatgtaaatctgctataatctcgtgcctatgaataaattggattggataaagatcccgatcatttaaaattattctgttaaatggccaaattgatcatcaaattattagttgctgttttatttttgtttgaaaaataaacaaggcgccaaaatgaaatgccaaataacttaatttaaaaaaatttttccttgcaaaaaagtcaaccaacaaaatgatggatttggactgtgttgaaactatggttctattgaaaatttcataaaatatgtgcctaaaaatggttaataataataaaaaaaacaatttttcgaccgtttacaaatctgaaaattttaacgcggaatg

SEQ ID NO: 102771 - DNA, 191 bp, Heterodera glycines
  Promoter: Source sequence=SeqID_16263; Location=429..619; Strand=+; Gene=SeqID_80648
ttttgccaaaattagattcaaatcgaattaatttgccgatcagagcggaagggacgagtccggctggcagtgatgtgctcaaccttttctcccatggcaatttgcttctgttcggcgctcgagtcgaaccttcgctagtttatcagcgccaattcatcgaagccttcaatgacacggcaatcaacaaaatg

SEQ ID NO: 102772 - DNA, 809 bp, Heterodera glycines
  Promoter: Source sequence=SeqID_26239; Location=778..1586; Strand=-; Gene=SeqID_56985
gggggggggggggcaatcggagaaggggcgggaaaatggcaggcacaaagcgacgcgcaaaattgggcagaatgggcggagtgtttgtttgtcttatgaaaaaacggctgaatgatcggcggtcggtcggctgtcaccaaaagggcgcctttaaaggagcaaaagatggcaaagtgtgggcagaagaagcactacaacagacataaaataaacatcgaaatgaccttttcccgacagaatccattcacaacaaatgatcagcgcaaaaaggcctaattaaaagataattgccacatttagccaattagttcacttaattacgccgcgctttttcctaaatgattggccattttccctccgcaaatcccattgatcagcagccaatttcaacgacaaagcaattatttcagttctcttcattaataggacaggtgacaaaattaatgaaaaatcaaccatttttatgcctctaattggcatttcatattttaattagtttttgggttggggttttgtgaaattaatttgcaaatgattgttttgtttcgtcttcgtgtttcctcaatcagttcaatgtttggcaaatgtcgtcacggagagaagtgtaattaaatgcaaacaaaagtgacgaaatttggggaggggggggggaggggaggggtgccaccattacaattcaaaacgaattaattagcatttgataaatacttctccgtgcctcttaaaagggcagagtcaaccaattgggtggcattttcatcaacggtcgtccgctgccccaccaaactcggcttcacatcatccaaatg

SEQ ID NO: 102773 - DNA, 235 bp, Heterodera glycines
  Promoter: Source sequence=SeqID_12093; Location=1..235; Strand=+; Gene=SeqID_75649
aatcatttactctttttctcattgtctctactttttttttctctcccttttctttgcttatagccatatgacaatttgctgtggggcggtccttccctttgtctcctcccccaatgtgcttgtatatgcttttcctttgtccatacacacatcactccacctggccgttggattcggatcccgacccccctcactccccgctccgaatcgggaaagctcaccattgttaaacatg

SEQ ID NO: 102774 - DNA, 135 bp, Heterodera glycines
  Promoter: Source sequence=SeqID_4874; Location=1..135; Strand=+; Gene= SeqID_56039
aaatcgctagaaaagggtttcaaaaatttgtttttaatttttttgcgagttaagcgccagtcactacaatttttgaccaatgggccgttcttcattagtttattgtagttttcttcaaaaatgccaaactgaatg

SEQ ID NO: 102775 - DNA, 187 bp, Heterodera glycines
  misc_feature (44)..(44): n is a, c, g, or t
  misc_feature (72)..(72): n is a, c, g, or t
  Promoter: Source sequence=SeqID_35916; Location=1..187; Strand=+; Gene=SeqID_65371
aaaatcgcaaaatatggaccataaaatggcaaaaatcgcaaaantatggacataaaatggcaaaaatcgcgnaaatatggacataaatggcaaaaatcgcgaaatatggacataaatggcaaaatttcgccgtgccaccacttctgtcagttaccatattaaactttatttttgggtggaacaaatg

SEQ ID NO: 102776 - DNA, 68 bp, Heterodera glycines
  Promoter: Source sequence=SeqID_10668; Location=974..1041; Strand=+; Gene=SeqID_73915
tggtcgcaaagcagaccggcgtgagcactacatatcatggtcgctaagcagaccgatatgttgccatg

SEQ ID NO: 102777 - DNA, 527 bp, Heterodera glycines
  Promoter: Source sequence=SeqID_13092; Location=1720..2246; Strand=-; Gene=SeqID_76881
taatgattcattgtcaattcaagcggttcagcccaatctcttctctcacctgacttgatgaggttgtccaacctctgggcacgttctctggccgtctcattggaccgattggggttggtcaacgggttgttgtggccgtcgtcaaaaagtcccgttgtctcaaaatccatgaaaatataggtctcaatatgacacatccttacaccacacgccccccgctttaattcgatcttatggttattatttgtaagtgtgaaagatatctgaatattttatatcaactaatggaaaacaaaaatatatgtatttctattttaataataataaatatataagcagcaaataagcgtggaagaacaaaacaaaaacccgtctgtatttaaacggtgcaatctgaacggttaagcagcatcatgtccataatacaaaacgagatgaaatgtcagtatttaaattttaaataatcaaaaatcaagtctgattgtgagtctttttggaggaggtgtagaagcagtcggggaaagatg

SEQ ID NO: 102778 - DNA, 210 bp, Heterodera glycines
  Promoter: Source sequence=SeqID_2043; Location=3383..3592; Strand=-; Gene=SeqID_77486
tgatttgtgagggtcgtaagttatgaatggcgcgaagattttcgccaattgtcagggtcagaggggggaaatgccagattttggattcacaaagggataattaatgctcaagcagtcgttactgtctgcgcacctaatcccccacagcagcccactcatcagccaggaattgtcatcgaagtacggtacgacaacaaaaagaaacgcatg

SEQ ID NO: 102779 - DNA, 248 bp, Heterodera glycines
  Promoter: Source sequence=SeqID_38819; Location=1028..1275; Strand=-; Gene=SeqID_67527
taaatttattaaggactacttcccaagcaagaattcatatttatgggtggttgcaacaagttactaatgataaacaaaataagctactatattctgataccggttaaaaaaaactaagttcaacttaaagtgttattttttagatagtgtcatttacaaacatcccaagggcaaaactcctatagaatttggcgaattccttgggtaatttcaagcattttttttaaatataattttttagtcaaatg

SEQ ID NO: 102780 - DNA, 1003 bp, Heterodera glycines
  Promoter: Source sequence=SeqID_9430; Location=3487..4489; Strand=+; Gene=SeqID_71386
tttgtccgatggcatttgcttttcggtgcctgctctgaacaaatcctttaaacttgtgtccaattgtctgtttttgtgaccgcattttctattccgtttagtttattacaaataaatgccgggggattatttttctgaaaaatattttttagccaaaaaaccaaattttaattttaaattgggatccctccccggcactccatcggtggcaaagatggtgcgaatcggtattttgggtatggaagtccagggtctgatcagggacagtaataggccgagaattggagacccctcccgccggggtaatgagggatttcaaattattttccaaaccggcaaattataaatccggcactctaattaggtatcattcattttttcatgatattttatttttaaattaatttcgacattaaagttaatctcaattttatttctttaattcaattgacatgggaattgatcagctaaattttcacctttttccttcaatgttcgtcttcttcgcagttctgaccaccgcatttatgtgattaattaacaaaaatattttatttatttgcatgaaaaaaaataaaaaattaaatgttttaattgctcaaattaatttttagttttggcgtcggcggatatgaaccgatgaagtgtttagtaagttaatgtttttccaaaatgggatgtgagcttcgtttaccattcgtttccgcttttcttttctttttttggcttttcccatcgcttcaaattttgcattttgggcattctcaccgctcttaatttatttcttcttttagcattcatcaaaaagcaaaaccgaccattttgggttcaatgtgtgtgaagtgctcaatgaggacggaacaacacaatcgaatcaccaaaacaattcagcaatttttttctacgaggtaaaaatgattaaaaaataaaataaataataatatattttaccaattttgctttattaattttacctcaatttgttcagtttttgccggtaatg

SEQ ID NO: 102781 - DNA, 717 bp, Heterodera glycines
  Promoter: Source sequence=SeqID_18888; Location=1..717; Strand=+; Gene=SeqID_83592
cttcaaaatttcgacttttggcaatttcatgtataccttttttggtaattgtctaatcatgaatcaatagcttagaaaaatcttctaaagatgttaagctttcgaatgataccaacaatgttggatttggatggcaaagaaaaaaatttatagaaagttatagtggaaaagcatgctggcgaccaacgtgagcgtccaactgagatagaagtaaatagctttttcctcttatcctcacttctcgtgtctttctatttgactttccttttctctcttttctctttcattttctctctcggtttactttttgttcttacttcgccccctcgctctccatttccactttctctctccctctctctctctctttgtctctcctctctctttctctctctctctctttctctctctctctctttagttttctctttttctccgtccatttgactctcttctctcttatttctctcctctttcctttgtacgaatctctttcttctttgacgtacgcactcgcagccaatgggtgtataaataaaactcaatttaccttcgtttgcttcgtttatcttgtcattttaaaatctcccattttattttttaaaacaaataaaatttaatttaaaaacaatgttttctttcatttaattttattcgctcgatttcaattatcttgccatcatttttttattttaagtgtttagcctggaaatgatg

SEQ ID NO: 102782 - DNA, 355 bp, Heterodera glycines
  Promoter: Source sequence=SeqID_17704; Location=465..819; Strand=-; Gene=SeqID_82236
gaatttgaaattttaaaatttaaatgtatttattatttttatttttattaaaggaaagtgaatttgaacgtgaaaaaagtggcggagaaggaagtgcccgattaacacaagaagtcagatatttgttttatgatggcatatttggaaataaattaaaatttttgaatttaaattttggaaataaattaaataaaattaaatttttgaattttaaagataaaataaattaaatccaaatttaaaaaaatgaattttggaaataaaattaaacaattttaaattttgaaaataaataaattaaaattaaagttttgaaaattaaattttaattattccatccattcccaaggagatg

SEQ ID NO: 102783 - DNA, 718 bp, Heterodera glycines
  Promoter: Source sequence=SeqID_3320; Location=3120..3837; Strand=-; Gene=SeqID_84195
atcataatccttggtcacgagcccggtttttaaagttaatttctttatttttgaacgattggatttacacaaaatatttccgtgcgtttgcgccaactgtgaaattgttccattgcgaagcacaacgccaagaaaattaacgggacaaataaatctcttgacacatactgcttaaactactgattttaaaataattagttgttttttaattgatccatgaagccgttgaaaatgccattggcaaatatcgtcttgccgtgtccaataaatttgacgttttgaaggtagccgcccccaaattcattaatgtttaattggatttttaatttttaaaagtgagtacccgtaatgtccgtttccgcgagtgatgcgacaatttgttcgaaatgattgaggatgaggattaacagcaaaaacagttacatttatggtgaataattatcaaatacaaaaaaaaaaattaaaataaaataaattatgccatttttatgggaaaagcgctttcgttgatgaatcagcagaaaaatgatgttaataaagcaaaaaaaacagtgggatggattcattttcactttcatttattccattttctcatttgttcattttttaaattgtataattcgaagcaaaataaaagtaaaagaaattcaattaattagttaattacataattccttttttaggtaattattcttttttaaatccccccgtaaaaatg

SEQ ID NO: 102784 - DNA, 1003 bp, Heterodera glycines
  Promoter: Source sequence=SeqID_910; Location=970..1972; Strand=-; Gene=SeqID_63769
ttttttttgtaaaatttttgatcatatttttaccttttttaatttttggcttcgcgccaaaacgtgggcgccaaaacgaccctggcgccaaaaagtgggcgccaaaacgtgggcgccaaatcgtcggcgccaaaacgtgggcgccaaaacgacccagtcccgcatttttatgcggcgcgcttttacaaaaaactctggaaatatggggtcagaggcggggcctttagacgcttccgggaaaagttatgtaaaattttagacaattttttaatagaatttgtccaaattgattaaagttcaacgctttttggggtgtttttgaaccatctttaaaaatagaaagataggttccgtcgacgccgacaatttttgttgaatttcttgaaatataaccgtacgaaaaagtgccgtttcctttttggttctttttcgttaaaaaagcagagggttttaagagtaccatcgttttgcccttatttcggaatttttgacatttttttattaagcaaatgcttgaaacactgaaaaaaaacatttttcaaaatggcttttcaggttcatgaacagagagtctccgattcccaaacctatccatttccactgtgttttttgttctttcatattaacctaataacaaaagttagatacatataatcaatttcttctatttatttagaagtaaaattttcgtcaaaaaaatgcttcaaaatcaagtggacgttgttggcctaggcgttgtgaacaggaggggttcgagaccgtttggtatgttttacaccaaaaaaaaattaaagtttatgctcagggcaaagggacataatttcgtattgggcgggggtggggggaggcaacccaacaaagtgccgtttgccccgcactggtttttgcattacgagacacggaaaggggagaaagtgcagtaaaacggggcgggggggggaggaaggaagagaagcagggttaccgcgggatgagaaaaatatcgagattcttgcccgggatg

SEQ ID NO: 102785 - DNA, 209 bp, Heterodera glycines
  Promoter: Source sequence=SeqID_15101; Location=480..688; Strand=+; Gene=SeqID_79279
aaaaaaacgatgaacgtggaaatgatccaaaaatgtaccaccaaagaacaaatggataaatttattactttacgacaataaaaattaatccataagggaaaaaagagcacaacacactaattgaacataattagccactttatgcccgaggcgatcattaattatgtatcattatcagaataattggtcatttgtttaaaataaacatg

SEQ ID NO: 102786 - DNA, 100 bp, Heterodera glycines
  Promoter: Source sequence=SeqID_18802; Location=190..289; Strand=+; Gene=SeqID_83480
ttgtttgtcggcaccgccggtggcgtccattttcgctcatttattttttcttcggcatttcttctattccaacaactactgccttttcgtgttcagaatg

SEQ ID NO: 102787 - DNA, 314 bp, Heterodera glycines
  Promoter: Source sequence=SeqID_11431; Location=293..606; Strand=+; Gene=SeqID_74824
ggtcagagagggccaactggagggggtggagcagacggcaatgaaagtttttttccagataaaactcaagcaacagcagcaaggcatgccctatttcccgaacctggacccatccgttcgtaccgaaaactgggacccgtccattatctctgcgttgtccggttcctcctcggtgatgcccacctcgcggcaccatcgcacggcggcaagcggtagaaaatgtgatgtgccaacaatggtcggggaattttttcttggcagatttcgatccgcctctgtcttccgcgaccggttgcgacaccaccccactgatg

SEQ ID NO: 102788 - DNA, 870 bp, Heterodera glycines
  Promoter: Source sequence=SeqID_3706; Location=83..952; Strand=+; Gene=SeqID_51549
tgggacccaagacgtccgcctcaatgaatgaatggaatttggattttgataaaatttgttgttttaattttttgaattgataagggttaaatcccgttacctaaattgtttgaaaattattaaaattttaagaaattagatgctaaacctaacctttgacaaagattatgaaaaaatgaaaagaaatgacgaaatttttggaatgttccttctttttattatctatggattttttttcatgtgcattattttggtgctagtaagatattgccgaatgaattaattggtttttctcttcattttaaaacatttcacgtccccatgccctgcccacttcccgcggaattgatcaaggaaataattgacgctctcccccctccaaaaacacatcggcttttgcgcgtaaattttgttttggcatactttgttaaatgtcggttttattccatgatgagaagattgtttcgcccagagcatatttcaataccaatggcccgaagaaccggaatttatttctttttcgatgtttgtactccccctatttattttccactctaccaataataacatttaaataaaattataattttttatttcttatttgattaatttcgatcaatattttttgataattaaacaaattgtatttttcaaaaaagacctttctcgcagtagcaactcatcggcttttttttactcccttcataaaatgtctcgcttttgccctatcgcccaaatcaaggaatcgggccggcttaacacaccaaaggggaaatttagtgagttccaaacctaccaaattaaataaaaaattttgataatcgttttaggtcttttttacgctctggaaaatgctcgaaactaccaatg

SEQ ID NO: 102789 - DNA, 467 bp, Heterodera glycines
  Promoter: Source sequence=SeqID_31802; Location=1..467; Strand=+; Gene=SeqID_62091
ccattgacaacggcacaattaggacaattagtaccaggggcacttaaacaggcgtgtgactttgtgcacacagttttgatgagtcatcaaattgccggcgcggataattttggcaaaaattggatagttttgtttacattaattaacatgaagttgttgtgagcgtgggaaaacggggcggaaattgtgaatgaagtgttgatattttgggcttctttccattctgaaaaaatggcaccggcaaaattctgtgaatggcatggacaaaaatgttgaggcctccggcataaaaaggtgcgcgcaagaggtaaaaatgggcaaaagtcaaacattggcataacaccgcgcgtataaatagcggataagtgtaaaggaaaagccaccaattacgtcccagttggatcatccccaaaatatcaaaatatccattaatttggttccaaaaatcccattaccacactactatg

SEQ ID NO: 102790 - DNA, 119 bp, Heterodera glycines
  Promoter: Source sequence=SeqID_9124; Location=1545..1663; Strand=+; Gene=SeqID_70328
actgaagggaaaacacaggggaaaattagggtttttgaggcctcataacttttttatttttcgctataggcacgtaaaattaaaaattcacaataaagtcgaccctgctctatcgaatg

SEQ ID NO: 102791 - DNA, 73 bp, Heterodera glycines
  Promoter: Source sequence=SeqID_8541; Location=3080..3152; Strand=+; Gene=SeqID_68464
ttttggcccctgttgttttgctcccacagcattttcagctcccatagctattttcgatcagccattacaaatg

SEQ ID NO: 102792 - DNA, 500 bp, Heterodera glycines
  Promoter: Source sequence=SeqID_19384; Location=2418..2917; Strand=-; Gene=SeqID_84108
tcacattcttagcactggcatgacaaatgcaaaaagtgtgaaaaccccccaaaatcagaggtcagccggggatggatgcgtggagcgtatttatcatttccatcattttggacaggttatttggtgggccaagaatttgcatgggcaaattcgaaattggcgacacggggcagcccccgggggggggggggggggggagggaagctgtgtatgttaactagttttgacaccagaaaagggtccggcacttctttatgactctttttttcattttttctgaacaaacgtttgcgatcattcattttttacaccacattcttggcttatgtaataagacaattgacttttttcgggtgggtttacaaatcttaaatgaaaaaattttataaatttagaaagaaaaagtcattttgcccgaacttttgctggaaatggacaaattttgagggaaaattgaacaacgaaaaagtgaaaggttttatggtgcagatttggcaatg

SEQ ID NO: 102793 - DNA, 270 bp, Heterodera glycines
  Promoter: Source sequence=SeqID_44901; Location=1..270; Strand=+; Gene=SeqID_72304
ttatataaattaattaattcaaattatattacttaacttcaattactataaattccattttttgcataatttcctgattaacatatgatatgacgtcagaaatagttgcaaaatcaaatagaaatttgaaaaatatgacgtcagatcagtgatatgacggaaattgaaattggttccggacaatctattaaatttattaaattggtttaattacccaagtttgaggtccatattcactaaattttctctataaatcgattatcgacaatg

SEQ ID NO: 102794 - DNA, 351 bp, Heterodera glycines
  Promoter: Source sequence=SeqID_1315; Location=5704..6054; Strand=-; Gene=SeqID_72416
aaaagtgcgatggagaagagtaggaagggaagaggagagacaaggggatgaagagaggaagggagagggggaaggaggtaaaggagagaagggggaacggagggagaataatggaggggagaagggaaagaaagggagggaaggaggggagaagaggagggaaggaggggagaggagagaggagggggagggagacggagggatgggggagaggagtggtgaagttgtgttatcggaaaagaaaaagagaatggaaaataaaaggaagattgattaaatagctatgaaaacgcaacgcctgaggctgtgcaacggtcagcgaaacatgccaatgcgcatggctttattatg

SEQ ID NO: 102795 - DNA, 754 bp, Heterodera glycines
  Promoter: Source sequence=SeqID_13574; Location=670..1423; Strand=-; Gene=SeqID_77478
tgtccattttctgtttaatttctctccccactaatgctgttgggcatatatttgtgggcagtgattgtcttcgcacacatattattattaatatttcaaaatatttcattttgttttacttaagtgattgttttatgttattaatttaaaaaatatgatacatacaaatgtagtttgggttcacataggaaaaataataatcaatttttcattatttcaagaaaaaacatgaggcaaagtacaaaatatgttttttaaatcaatgaaatttcgtaaataaaactgtaaaaaatattttgaaacagtgccatttatgaaacccgacaaaactcatggtaacagaaaatgttgttttccgaatgaaatgtttttccctatttttatatgttttcttctagggttaagccccgaaacttggagagagaaaagtcggggaacggggaggaaattccaagataaattttgtcagtgatggctggagaatttaagaatgtcggggagattaccttcgtcaggaagtaaatttttatgaagattcaaaaaaatgtaacagaaaatttttacaacaatatttttgtggctacaaaatggcaaaatttgatgggtttctcgccatttgatagttttttagcaaatatatcctgatttcaacaataaatacatttcataaactattaatccattaacttgagtgctaattaagctgctataagagccataccctttgattgaaagccgctttacccatcgaatg

SEQ ID NO: 102796 - DNA, 638 bp, Heterodera glycines
  Promoter: Source sequence=SeqID_39751; Location=178..815; Strand=-; Gene=SeqID_68248
atcggtcaaaatggatgttggacttgtgatcagcggccctgaaaccccctagaaacatgtttttatgattttttgaaagttgaaaaaattttttaaaaaagggggggtaccatctaaactattccccaaaagggtccccccgtttgtttttactttttgatagaattcaaaatcggtaactttttaactagcgccttaatttttttgaataatgtatttattaagaattaaatattttttttaatcgtttctgctttgctacctaaaattcattactaaaaattgatgatttacctattttggtgcctgtcaatacatagcttttgaattcatattttcgtgcgtttttactagttgtatgattcagtccagagtactgattttttggacaccacccaaaatttatccaaaaatttatttatctcagcaaatttgtgacagtgaccaacgaataatgcttaaagtgataggcaacaaaaatcaattcgaagcattcgtttcgtccaccgaaggggaaaggttcatttctccgaatttccttccatttgtccttttgtaattgtagcaaaagatcgctttttgtgcacttttccgccccttgggcctcctcttgcgcgcagttggacgatttgctgatg

SEQ ID NO: 102797 - DNA, 71 bp, Heterodera glycines
  Promoter: Source sequence=SeqID_20606; Location=1..71; Strand=+; Gene= SeqID_51158
aaaagtgtgtgaaaagttaggcgtagcactgagaagcatttttaattggaaaaaacaaattggcaagaatg

SEQ ID NO: 102798 - DNA, 325 bp, Heterodera glycines
  Promoter: Source sequence=SeqID_9035; Location=1..325; Strand=+; Gene= SeqID_70072
agcagaaatcgggcggccgcatgttgtcaatatttgctgttggatttgcttttttgtgtccgattcgcatggcttttgcttttgtgggatattcctcccccctaaaatgttgtgttgatatttcatctctcatttttcgttttccgttttttacacttccattaatttcgtcttacgacaaaggcttcgaattcttcaatttcgacatttttcactattgttttttacatatatatttatttattctgctaatatcttcatttaatcttcgttttttctattctaccaaatatttcttagtctgttttttcccactttttcaatg

SEQ ID NO: 102799 - DNA, 127 bp, Heterodera glycines
  Promoter: Source sequence=SeqID_13198; Location=1..127; Strand=+; Gene=SeqID_77026
atttaagaagtgggaccgggtgaaacagcgcattcggtcggcactgtcctcacaaaaactgctcgccgcttccgtgcacatcgaaggcgggatggtcgagggccaaatgctgcagcaaaacaccatg

SEQ ID NO: 102800 - DNA, 458 bp, Heterodera glycines
  misc_feature (43)..(43): n is a, c, g, or t
  misc_feature (60)..(62): n is a, c, g, or t
  misc_feature (83)..(83): n is a, c, g, or t
  misc_feature (116)..(116): n is a, c, g, or t
  Promoter: Source sequence=SeqID_15691; Location=1..458; Strand=+; Gene=SeqID_80002
gtagaaaattaacgacaaaaattccaaaattacgaatttttanattttaaaaaatgaatnnntagggtccttgctgaattacnagggttatcgtcttaccaagaaaacatggcatntatcaagttcttggtttctgtagccatgaaatacacccttttttcattttcatgttttctgtttattcacgttataatatttggattcattcaaaaaattttaaatttttagaaaatattttaaattattatttttaatttaggggtcaaaatgttgcaaatctgtttcataaaaaataatgaaaaaaagtttaatacaaattttatgccccatttgaaactttttcatcatttgacctattttttacaagtttgggcaattgtttgataatgattaattaattagttaactaattacattttctattacaaaaatttggccaaaaaaaaatgaaaaatatg

SEQ ID NO: 102801 - DNA, 476 bp, Heterodera glycines
  Promoter: Source sequence=SeqID_9914; Location=638..1113; Strand=+; Gene=SeqID_72942
tcgcgggaaatgaggcccatccatttttgtagactgacgggaccaaattctctaaggatccgtctaaaattcacaataaataaaaaagggctcacgaatgtcttcaatcaattttaataaatacatctgttgtgtccccgggtttaaggcttaagccatttcaaattaccttttttagagagaggaatttattgaaggaaaagcattaacaaaatatttatgtattctaaaccgggaataagtttgatcaacaacaacctcagagcattttgggtaggtcagtgcaattggttatttgggaaaggatcgatgcccaaaggcaaagaacagcactgaacagactgacccactgcatacatctcgcagcccccgagggggaaattgggaggacttatatactggcacaatgggggtggactctggatagaatgaggagtatgacggcataaacacaaagggaataagagaaatggatg

SEQ ID NO: 102802 - DNA, 1003 bp, Heterodera glycines
  Promoter: Source sequence=SeqID_66; Location=805..1807; Strand=+; Gene=SeqID_60276
taaaacaataaaaaaatataaagttgggagtttaattttatctgtactgcttggtcttattgtattagtttttgttaaaataaaaaataatttgtttgctcacaatttgcaaccggcaaaaaagaaaaaaaagacctgatcaaaataaatggtcaattttgaagtaattataaaagcattttatgtaataaaatgattaaaaaaactataaaattaaaataattttacaattcccacttctttctccagcactttcactgttttttgtcattgtcaactttgacactactgaattattgaatttttacgccactttaactcttaggcaattaaatcttgccttttttgatgttttgtttaataaatgataactttggttttttaaatactattcagaaaattttttcataaatattccattaaataaatctctaaaaaatccccccgtcttcatttattatcggaaaaatcaaaatttaatttccccattagtaaatttgcttcgactaattcccatttttttttttttgcaatttttaaatttaactctggcttttgacgaatatttccacattttacccgccagcgaaaaacgaacggagcggcaaaaccctcgccccgtcaaaccaatgccccagggcaaaagtgaaaggggcagcgaaccgccgccccgccagcgcaaaaagaaaaatcacgaaaaaatgttataatattttaaaaactgggttttatgatattaaatattaaatcattgcatcgcccaatgcactgaaacagcaaatttagtagcaaatgcataaaaaattacaaaattcaaccattaaaatttggattggtgggggtattcaatttaagttaaaaatttattttctgtaaattcttggaaaagcaaaaaagtttttgagaacttggggggaggaggtccagcggttccgataggcgccgccgtagaaaattttgaatatttaagggtgatttgttaacagattttcaccaaaaaatg

SEQ ID NO: 102803 - DNA, 66 bp, Heterodera glycines
  Promoter: Source sequence=SeqID_10417; Location=1..66; Strand=+; Gene= SeqID_73612
ccgcccggcggctacgggcccccgggcgagcaggggccttccagagagccgggatggcatggaatg

SEQ ID NO: 102804 - DNA, 799 bp, Heterodera glycines
  Promoter: Source sequence=SeqID_31082; Location=436..1234; Strand=-; Gene=SeqID_61456
atcagtgccaaaaagtgttgtaccgtaccttccttttattaccgtgtgcaaacaacaaaaagtaaaaaataaaaaatatttaaaaaaaataataaacaataaattcacaaaaggatttctacgacacaagttgaagcacctgtgcaagcggtactttgaggtgagacggactttttgttaggtcgagaggggtgccatgccattcttggccatcatttattaattcggcgaggcgagtggattcgggctttcaattaggattaaccaaaaattcgatttgctcttaaatttcggctttatttcactcaggcttcattaaatgagctattcagatataaacttcaaaatttttcaaaaaaaattttttaaagttttttttaaaagaattatatttttggaacaacttagtaagtaattcatttcatcataaaattgaaaaatcgcttaaaattttccaaaattttcgaaagagatattttcaaaggaaaatgtataaaaatgaataatttttgactggattggatcataaactggtcaaaaacggtcaaaaatagccggttccgggccagttaggcattttcaaaaacgaccggtttctgggcccggcctctcaaaaactgttcaaaccggatttttcgaaaaatcaccggtttcggttcagattttaaaaatcattgattttgccaaaaaatgtcaaaatttgattgaaatctttgtaccagttttttcatcttcatccttttaattttattgcttttccatccttttaaagtaccgtcgccactgtctggtcacaatg

SEQ ID NO: 102805 - DNA, 200 bp, Heterodera glycines
  Promoter: Source sequence=SeqID_28290; Location=338..537; Strand=+; Gene=SeqID_58914
aattctaaaatgtataggcatttgttattttaagacaattgaacccaatggcaatataaaaaatggttttctccaagagaatgatgtgaccttacagagacagcaacagcaaatggccgtcagttctccctctggtgggttcagcaattttttacaatagtctaagaaatgttcagtgagttcaactgtagattgtaatg

SEQ ID NO: 102806 - DNA, 951 bp, Heterodera glycines
  Promoter: Source sequence=SeqID_12866; Location=799..1749; Strand=-; Gene=SeqID_76595
atttttttcaaataacaaactacagacaccagttacatttaaaaaaatatatatttttaaacccgagcccatttattagttacgaagaaaaaatgtttttccaattttaattgaccgtcgttgacacaaatttatgtacaaaatatttattttgctgataaaatggccatttttgtaaacgcgtcacttttttaaaatcatttttatcaaagacatttttccattgactaatttggtacagataaattacataattttccaaaagataaaaatattattgggtaattttctaaaatttctaccaaatagccaaaaaaaaaatggaagaaaaagtccacaaaatgtagagcccggaacttggatttttggtactgattgtgatttcgggatgttcgcacaaactcaaaaatgttcattaaaccgttacaaaacagagagatgaaccaaaaaatggagagtgcacagaaaaatacaccgctcattttggcgtactattttttttctctgctaacagagaaaacacgaatttttgtacttcaccacattaacaaatttttttctactttttttggtattaaacaaaagcctaatatgtcctgggaattcaaaaatataattggttctattgcactttatgagtccaattaattgacaatacttgatttttatacaataactttgttcatgttcgaacaaaccttctatttttggtatcattcgaacgcacacgaaaattctaatacatatgtatttaaagaaagttacaaatgttaataatcaaaaattaatcaattaatcaaatctttgggtggtgttcaaattttgcacatttaaatttccgtttatttcatcaaaatttgtccaaattttcctcttttttagcaattttttttttactattggtgctattttggtgctgtttctgtgctggctggcgacgacttaaaaatg

SEQ ID NO: 102807 - DNA, 687 bp, Heterodera glycines
  Promoter: Source sequence=SeqID_22195; Location=1..687; Strand=+; Gene=SeqID_52859
tagaacgtgcatattcataaattctctatacttatgaaatgacatattcataagcatagaaaatttatatccataactacacccattcatagagctgggaatattcataaactgcattttttatgttaagccatacgtattgcattgttggctattgttgaggtgtgcgtgcgctgccccacccttaaatttgtatatgttcataaatatatatacacatgagatcgcatatgaatagaaaatttgtatacataactcataacactcatagggatgggcatgcatattcacaaaaaataaattattgattttaaaatattagagaatacgtattttattgttggccattagcgtgcgtgcgctgcaatcattataaaagcggactggtgggatatgcatataaatgtgcaatacgcaagtaatttatttatttatgaacatccttatttaagatgataacgcataaaaatatagcatatacctatctacctattcataaaaaggcatacacacagaaaatccacgtagcttatgattggcaaaattgggcaagcgcgctctttttataaaagcatagagcgagtggggaagaatcacattaaaacaaatacaacaaaatttggcatttttcttttttaaaaaattatagttcggctgaaaattaatgagtcattgggccccagcatg

SEQ ID NO: 102808 - DNA, 404 bp, Heterodera glycines
  Promoter: Source sequence=SeqID_297; Location=2314..2717; Strand=-; Gene=SeqID_81647
tcctacaatattttttacatgggtaggtgtaccagaaaaaatttcctaggggactgaaaaaattttcgcggaaacgaatgttatggatggaaagaacagcacaaaattttgctacagaatgcaaaaggttccatgtctctaccactttttgccatagagagaaacaaagtctgaaattcgagaatcccggaaagtacagtataccaaggcaaaaaggcttaaaccccgaaaaattcgagaaatttgtctatgcaaagccaactgtctcgaacaccactgaatttttgaaaacttttacatattaaaattgcattcatcaaaattttccatgcttaagattgttgatcaacaacatttttggcattttgttttaaaatttgtacggcataaaaccggtaaaaatg

SEQ ID NO: 102809 - DNA, 205 bp, Heterodera glycines
  misc_feature (31)..(31): n is a, c, g, or t
  Promoter: Source sequence=SeqID_8564; Location=1748..1952; Strand=-; Gene=SeqID_68539
ataatgagttttgaatctatttaatcatttntttgaaaaaaaacatcggtcacttgaaataataaattctaaaattttgtccaggaaaatccaggtttttcgtgttttgcctggacctggattttttttcacatttgacctggatttcctggacaaaaatccaggaaaatccaggtccaggaaaaatccaggttgccgaaaaatg

SEQ ID NO: 102810 - DNA, 71 bp, Heterodera glycines
  Promoter: Source sequence=SeqID_15265; Location=3193..3263; Strand=+; Gene=SeqID_79477
tttggatggcatggtgaagtgaattttctaaaaacaatatgcaaatgcaattgcatttttagtttgctatg

SEQ ID NO: 102811 - DNA, 228 bp, Heterodera glycines
  Promoter: Source sequence=SeqID_10276; Location=1304..1531; Strand=-; Gene=SeqID_73436
tttttttaaactattataaattggggaggaggcggcatgacctggtaaaagtcccggcttgggctttggttcgactttttacgaaaattgaactgaatttcgagactccctaataccccgggatattgtgcctttgttcaatttcaagtttaactaatttatgatcaatttggaacaattaccagctgatcacagaagaagcttggttaaatatttgccctccccatg

SEQ ID NO: 102812 - DNA, 80 bp, Heterodera glycines
  Promoter: Source sequence=SeqID_13399; Location=2417..2496; Strand=+; Gene=SeqID_77286
aattcaaataattaaaattaaacaaccaaaaagtgaattgaattttaaacattttttgttcatttaaagattacaacatg

SEQ ID NO: 102813 - DNA, 1003 bp, Heterodera glycines
  Promoter: Source sequence=SeqID_7348; Location=1134..2136; Strand=-; Gene=SeqID_64548
aaatagtaaatatgtctttttaatgctttctggcgctgttaaatgcaaccattttggatcagcttaatccacgattaaaaaattaatttgtgcaagagacgacaagaaaaggggaaatccttcagcctcaattcgatcagtttaaccgtttcaactccgatcagagattgattaaataaaattcatttcgtcaccttttttcgacattttcattaattgatatatttgctttaaattttaaattgtgcttaaaatcttaaaaatttattttgtccttatttgaaagaaatgttctctgattttgagataatgactgaccaaatttgtttttttttcataatcttttcagggtatttggactaatttgttaccaaatttagtcttttaatttatcgctaaaattctttaaataatcatgggaggcgaaaataccaaattttatactatatttaatttacccaaacgctttaaagctattttgccgaatattcttggttttttttgccattatcttttgatttcaaagatttttcgatgctatccctattttcatgtttacgttttttaatgtcaaataaaaatttgtaattaaaaaagatttaaaatttacaataatacaaaaacgtaataaaaacattggaaagagaaaattcaatcaaaatgtttctgttcttttccattttgttgggtcatcgttttgccgttaattgttttatgcccctctcattaatattaattattattagtgacctatcagggacagcaaaaggttcatttctccttcattttttctttcttaattctttttcagataaattaaaaaaagaagtaaatagttaagtatttacgcgtcccatggtattttttcgtcccatggcataactttttatataattttcatgaaaaaagccctttcagctgtaaaagtgccgaaactgtcttaataatttgcctcaacaaatgttagaaattattcgaattcggagcaaaattggagagaatg

SEQ ID NO: 102814 - DNA, 54 bp, Heterodera glycines
  Promoter: Source sequence=SeqID_15147; Location=1..54; Strand=+; Gene= SeqID_79338
actctgttaacaagctaggcgctgttagcaatatatttgtgaacgacaaaaatg

SEQ ID NO: 102815 - DNA, 186 bp, Heterodera glycines
  Promoter: Source sequence=SeqID_18364; Location=701..886; Strand=-; Gene=SeqID_82963
aacattaaaaaatgaaaatatataataaagcttttatggctaaaaataaaatgactaataattatacaaaaattggaatgacataaaaattggaattgctcagtgggtaaagatttttttaaaagtctcctttgggttttattttatacatttttgaatttttaatatttaaggcacaatgacatg

SEQ ID NO: 102816 - DNA, 569 bp, Heterodera glycines
  Promoter: Source sequence=SeqID_31225; Location=1..569; Strand=+; Gene=SeqID_61598
tctctttgcttcttcttttctcccccccccccccctaacttttggcctcacttaaatgtgattttcttctccatccaatttttgtttgctttttgtgctcttttcgttccaatttccttcttccttccgttcaccaaatggcctcattttgcgctgattcgatgcgcaaacacttttcaaaagtgccgttcgtccgtctgtgccttttcactgtcttttttctttggctgtgcctttatttgcatatttttttgtctaatttcaccaaattttacttcaatttttgatcgttaaccgatttaaacattaattaataaaaatttatttttattctgtattgtgatttcaataatgctttattgtctcttggcacttctcaattgctttttcacatttcttcttgtgccaaatgcatattcggatcgattaccaaagtaaataaaataaaacaaatgtaaattaattttgttttcaatttaatcaatgatagggcaacgggtaaatttgttctgttcaccgactttcacattgacaatcattatgacccgcgaggcgacccgaccaaaatg

SEQ ID NO: 102817 - DNA, 448 bp, Heterodera glycines
  Promoter: Source sequence=SeqID_3473; Location=1177..1624; Strand=-; Gene=SeqID_84809
ttcttctgccttcctttcttcgacgcaaaagggacaaactcaaactgtgagaggggaggggggggcaaaagtgacggacgaaatgaacggaaattggagggaaagaggggataagagaggggggagagagaggaagagagagaagggaacaatcggagtcatggcaaaattaaagaaaccattttgatgccaaacgaaaggggacgaaaagagaaacaaaggaaataaaaaaggggaatttacaaacaaaagttattgcgatgagatgcaatcgctcaacaattgttcttttttgccttttttaatcattttctccccctttttcacctcataatttgtcctctccgtttcctccgatgtctccgaatcgaaatccatcgaaattgtccgtgaagaattgccgccaaaggttctcttccgcgcaagcatttgcctgacggcacgaatg

SEQ ID NO: 102818 - DNA, 171 bp, Heterodera glycines
  Promoter: Source sequence=SeqID_37341; Location=1..171; Strand=+; Gene=SeqID_66436
atgtgaatacgggtagcatcggattctccggttctccttcaatcgcttcaattgttgttgctcttttgcttctgtcgctgttgtcggaccattttgtgctgtttacggtgcagcgggtacggtggaggcgacggaaacggtgccagcggtgggcccgcggcggcgaccatg

SEQ ID NO: 102819 - DNA, 79 bp, Heterodera glycines
  Promoter: Source sequence=SeqID_8828; Location=1190..1268; Strand=-; Gene=SeqID_69343
tttggttttggtaattactttaatatattaattttataattgaataaattatttggcaggtgcaatttacacttcaatg

SEQ ID NO: 102820 - DNA, 288 bp, Heterodera glycines
  Promoter: Source sequence=SeqID_13763; Location=353..640; Strand=-; Gene=SeqID_77681
tgatgttggaggagattgagtgtattaattaggcccgtacccagaaaatgttcacaaaatctaataattttaatgaggaagggagaaaacttaaatcgggtcgtgccaaatcgtccgccccttttttggtattcccttagaaagcacccatccgaccgccgtttggcatcccttgattaaatttctaaactttcccgataatttattttctgggtgcaggcattattagattttgcttacttcttccgctttccaaattttgtcaattcataagtcatttgcatcatg

SEQ ID NO: 102821 - DNA, 167 bp, Heterodera glycines
  Promoter: Source sequence=SeqID_746; Location=1..167; Strand=+; Gene =SeqID_60384
taataatgcaatagtcatcttttttaatggaaccaaaacggccgcgccaattccttcgactcatcctttttaaaaatttattgtcataaacaaaataagtatcttacagagacaatttatttaatctttttgaaagtatcttaaaaaatatttttgtgcaaacaatg

SEQ ID NO: 102822 - DNA, 325 bp, Heterodera glycines
  Promoter: Source sequence=SeqID_28671; Location=1..325; Strand=+; Gene=SeqID_59260
aaaaaatgtacgctcaagtgcaagccttttgactaaacattacaaggattgaattatgttattgtaaattttaaatagttaattgttacacgttacatgtcaggcctctgaattctataaaagtgcatcaagtattgcaaaaagtgttcattttttattatgcaattcagttcttacatgttacatgttacatgttagtttactcatttctttttctaatcaaattgtatacgtacacaattattaaaatatgtacgattccttcagggtattaaacaaaaaaaaataaaatttgctatccgagggccggccagccagccatatg

SEQ ID NO: 102823 - DNA, 368 bp, Heterodera glycines
  Promoter: Source sequence=SeqID_6862; Location=562..929; Strand=-; Gene=SeqID_63137
ttccattctttcgttgttttatgtcattgcctttccaatgccattaaaaaaaacattttaataatatgccaagaaagaaattgcttctttttttgccaaataaataaaaatgatgatttttaagtatttatgtgcaaccaatttgcaaccaaccaacaactaatatttctaataaatgcataaaaatgaattttgagcacaactgctgagtgagagtcacctttgactcacaaaactcattaatgttctctgtccaatcaaattgccttaattagttccgataattgtccgtctgcccatgggaattttcttataaaagggtagtgaaatttcgacaaatatcaaattcaccttctaataacaaaatg

SEQ ID NO: 102824 - DNA, 266 bp, Heterodera glycines
  Promoter: Source sequence=SeqID_7758; Location=2309..2574; Strand=-; Gene=SeqID_65846
atccggcaaattccggaagaaatggcaggtggagttggtgtgcagggcacgaaccagtgtgccggtgccgtcatcagcgatggaaaaaagacgaagccttgaggaagcaaagcaggagtaaagctaatgcattgccaaacaaattaaaagcccaaggcatgtgaatttcgtatcgccaaatataccaaaattgtgccaattcccgagaattggaaccgtaaaaattaccgaaattgtaccgattcccgaaattgatataaaatatg

SEQ ID NO: 102825 - DNA, 1003 bp, Heterodera glycines
  misc_feature (43)..(43): n is a, c, g, or t
  misc_feature (97)..(97): n is a, c, g, or t
  Promoter: Source sequence=SeqID_14833; Location=560..1562; Strand=-; Gene=SeqID_78985
gcgcatacaaaaattgaactcggatttgcacgcacagcccagngaaatgactaaggcatacctaattgtcaaaataaatgaagaaagaaaaaattanacaaatatttggatgagtaaaagaacaattgaaagatggccacggaaaattgacaccaatagatttcattaatttacttttttcttaattatttatttttttgaatatagacaagacgaaaaaccttcaagtttaaaaatgacctaaataggcttaaaagcaccctttttactatctcttttttgaaaaaaacgatttttaggggtatattttcaaaaaaaattttaaatttttcatatgaaatttctatcacttctcaaaaatcctaaaaatatgtacaaaaaattgtgaaattttggggttttttttggggacatttaatgaaaatttccttaaaaaatcctcaaaaatttcaaaatatgttcgaaaaaatgcgaaaaagtccaaaatatgtataaaaatatgtacattatatgtaatatgtagaaaaatcccgaaatatgtaaaaatatgtaaataaaagtccaacttttgttcgcaaacacaaaaaagaaagtgtttttcctactaattaggctatggacaggaaaaaaacaagtatttacataaaaaagaatccctggtaataagtatggatttttaattgaatctatctgttgattagaaaaacaattcagaaaagggaaaattatttatttattttttaaatttattaattggtttacttgttttcatttttattgcgcagtttgtcatacttgattttttcatgtgaaaaataccttttttttccttcaccggacttcctgtttacaaaatttaaaatttccacgtatttccggcaaaaatatttaatggaaaagttgcatataaaaacggcaaaaattttcataaaactcatcatcaaaaattcattcaaccatagaatttattcatttcctaatataagtttttttgtacaaaatg

SEQ ID NO: 102826 - DNA, 150 bp, Heterodera glycines
  Promoter: Source sequence=SeqID_10916; Location=2042..2191; Strand=-; Gene=SeqID_74219
ttgtagcagaacaaatgagacatagctgacaaattgccggggcttttatactccccggaaaattaggccacgcccactttttaaagctatttaagccaagattttctcgcacaatcaaatcagtcttgcaaaatttcatcaacaacaatg

SEQ ID NO: 102827 - DNA, 163 bp, Heterodera glycines
  Promoter: Source sequence=SeqID_23436; Location=1170..1332; Strand=-; Gene=SeqID_54148
gttctgattaataaataaataataaacttatttgcgcttggagcccaaaattgactcgccgtgttaatcgaaatttttcttttttctgattttttcttccctattgttttgtgtaaatgaattctctggtcgactatttgctcacaaagctgcaacagcaatg

SEQ ID NO: 102828 - DNA, 113 bp, Heterodera glycines
  Promoter: Source sequence=SeqID_35336; Location=765..877; Strand=-; Gene=SeqID_64913
taataaagtgagtaaagcagtgaaaatatgagcgaatattaagctatttataagatttcttgttgtatttctgtgttaaacaaataataaactgtataaaaacggaaatcatg

SEQ ID NO: 102829 - DNA, 91 bp, Heterodera glycines
  Promoter: Source sequence=SeqID_1006; Location=1572..1662; Strand=-; Gene=SeqID_65888
aataatgctacattcatttattaattggtgcgttttagcactttgtatttttttcagtttattttaataaacttttttgtctgcagcaatg

SEQ ID NO: 102830 - DNA, 1003 bp, Heterodera glycines
  Promoter: Source sequence=SeqID_19893; Location=376..1378; Strand=+; Gene=SeqID_84650
ggttttccggtttttggcaccctatgtttgaattccattgttttttgttgtccaataaatgtgtattcgttcagttctgactcttccgattctatgcaccattttcgtattcggagagcatcttttaatgagcaaaacaagtaaaatgcatttttaaaaagggaaaaaacaataaaacatttgttgctttgacagcgtttccaaattggaagaaattgtgcctgcctcgctatggcctgacccacggtttttccacggcttttccttttttcgacgtcaacgcgacccgatgttgcccagaggctattttcagaaagtaattgttttttttatcaatcacaatattctgccatatccctctcccaagagcattgttctcgtcagtgttctaccattggttacactttttcaacgtgttctttacgaggtggcattggcatttttcacaagtggcgaaactgcaattgaaacaggtctcttctatctctctctctttttgtgatcagcccgtgtaacataaaaaaacaaaaaattagagcgggaacccgaaggcatttttctaatcttcggccctttaaaacctgtatccgtgactaccgataaaggccgcctcgaagaagtttttttgtgttggaaatttatccaaatttccaaaaaatgcaattcctactccgctccctaaataagacgggcgtctgtgattaatacatttttgtcaaaattaattcattaatttaaatatttctgtcacagtgtgtttcaaattgaccggcattggcctccgcctacaaaagttggatgtccactttcattgccgttgtttgatctccattttcattatacaattcctgacattaggaattccgacggtcatggatttttgtctaaggtccgaaatacgaaaagaataccgtagcaggggcttttcaaccagagaaaatttttttaaaagttttcatggtttttaaacagttattacttgctccgttatgggtaaagaatg

SEQ ID NO: 102831 - DNA, 308 bp, Heterodera glycines
  Promoter: Source sequence=SeqID_5470; Location=1795..2102; Strand=+; Gene=SeqID_58173
agaatgaatgaatgatgtgtgatgatcattgtgttggggagcgggaaaaattggtgatggtgtttattttaaaaattgaaataaaaagttttgggaaaattggaaaataattttgtttgctcatccgctgatcggtcagacgggggctcatttatgagcgcccatcccgcccgctttgctgttaacattataaaagtgggcgtggcgtggcaccacacaacttttgtggcccaactttttgcgtataaatacgggcgcatcgggtggcacatttttcatttggcatcccattttcactcattcccatg

SEQ ID NO: 102832 - DNA, 339 bp, Heterodera glycines
  Promoter: Source sequence=SeqID_23616; Location=977..1315; Strand=-; Gene=SeqID_54315
tttttatcgggttattattgccgttgaacattttgtttgggtatcttaattttgttaacctttaattggagaaaagacaattaacaataattagttaaattaacaattaatggaaaaagcatttaaatgaaaaattatttttgcatttagaagatttattttaaaaatgtggaactgtttctggccttttccgctctaaatttttaagaaaacttattttattttgtaattaaaatgtttagaaaagaattgaaaacaatgttaattttattatttaaatttcatttattatacgtaataaatgagattctaaattatccataacgcaagtttaaaatg

SEQ ID NO: 102833 - DNA, 59 bp, Heterodera glycines
  misc_feature (28)..(28): n is a, c, g, or t
  misc_feature (34)..(34): n is a, c, g, or t
  misc_feature (52)..(52): n is a, c, g, or t
  Promoter: Source sequence=SeqID_43074; Location=917..975; Strand=-; Gene=SeqID_70839
ggtaaaagataattaatttaaaataacnttaagnaaataactttatttttanaactatg

SEQ ID NO: 102834 - DNA, 807 bp, Heterodera glycines
  Promoter: Source sequence=SeqID_24937; Location=1..807; Strand=+; Gene=SeqID_55675
ctttttagtgcctattttacgggttttttgagcctaaagcctacctattttggcagttttagagccaaaaaatattatccctactctattattgctacttataagaatgatttaaccaggtacaatataatcgtcaataaataattactaattaccttgcgaattaattgtccaccattattcattgagcatttcgcaaaacaatgttcagccaatcaagacgtattgttttattggttttgatcaacatatgcttttctggtgaagacaatgtgaatgcaatgcaatattggaataataacaattataatcataattataccaattttaattatgctaatgattctaatgagttgagcaacaatactgaatcaatatcatcacaaattttcatgggaaacattcaaatacgaaaaataaactctaaaaatatatggaaatacgaaccagctaaaaaagtggtaaatgaaattactgaattaaaataacttttaatttaatactttaaatcttgattttttttcattatcaattttagtgtattgaacttttttgtggataaaatcatataaacaatggaatttttactgatcaagaaggtaaatttgaaaaaatttggtctgatgaacaaattgaaaaacttgaaaagtgcaaatttaatattcacattggattctacaaacaaagagtaagaataatgcaacaaatttaaaataataattattattagttatttagttaaatgttttcaatctttcaaataatgaaaaaacaacaaaaaattttaaggaaacgagtttacaaatg

SEQ ID NO: 102835 - DNA, 691 bp, Heterodera glycines
  misc_feature (36)..(37): n is a, c, g, or t
  misc_feature (132)..(132): n is a, c, g, or t
  misc_feature (164)..(165): n is a, c, g, or t
  Promoter: Source sequence=SeqID_35508; Location=1..691; Strand=+; Gene=SeqID_65050
atatatttacttaatagttttttgtaaatcaatatnnttcatttaatattttaaatgattaaataattaaattttaaaaattttttttcacagaactcatcgatttatttgttgtaaattttcggatttttntaaagataaaatttatttaacaccaaaatcannaatttattaactattttatttaaaaattttgctcgcgccgatttcgaaatttttttgccgatcaaataaacattttcggattatttcgatttcaatttcatcaacgcatcaccgctcacaaaatttatgcaaattcattaaatatgtgtggatgatcgaaaattttttacacaatctttaaatttatcatcgtaaaaacatggatttgcatattatttaatggataatgaataatgataaatacacatttatttttgcgtataataacaacaccaacaacaaattggcgtcaaagttgaatcaacagcaaggctaaattcatatattaaaaggcaaaattttttggtgtcatttcgcattattttttcaaaatttggaaaaatatatcttattttcggactatataattatttgcaagtttttgggattattcacgctggtcccgccatcaaaattttgattctcaattccgcagcgagatcagaaaatttaaaatttccagtctctaattaataccactaccatg

SEQ ID NO: 102836 - DNA, 66 bp, Heterodera glycines
  Promoter: Source sequence=SeqID_9540; Location=1..66; Strand=+; Gene =SeqID_71800
ctatctcaaataattagcatttttacgctgaagaatttgctgagtgtcgtgccaacgaaacgaatg

SEQ ID NO: 102837 - DNA, 603 bp, Heterodera glycines
  misc_feature (38)..(38): n is a, c, g, or t
  misc_feature (71)..(71): n is a, c, g, or t
  misc_feature (76)..(76): n is a, c, g, or t
  Promoter: Source sequence=SeqID_803; Location=1367..1969; Strand=-; Gene=SeqID_61591
cgagactctgaaatatttttgcgatatcaaagagtctnggttcaagaaaattatcataaagatagaacganaattntaaggcacaataaaacaagaaaaaagggtgcagaaaatgaaatttttttgaaaatttgaaaaataaataacaaggaaaaaagagggaagaagatataaatgcttcatgaaaagtatgaagaaaatgaaaaataaatatatgatttgattaggtaaaatagggtatatatttcaatgtgcaaaagtcatatttattgtaattattaattattctctacataccttgtatgtattattgtatttgacacttacatacagcaaggaacttagaaaaactcgcaaaattaatttggcaatatttaaaaattcgaaatgccaaaaatggcggaatcggggaaagcttcctcgagtttaatggctgaagaatttcttttgacataacaaatgaatttttttgtgaatatttgcgaatttccctgtgattctacagtatcgacccattaaagagggggtgtgatggtacgtacggtacatattgtgcagagagtgcgaaagcagaaaaaatggaatgaactataattgagtatg

SEQ ID NO: 102838 - DNA, 409 bp, Heterodera glycines
  Promoter: Source sequence=SeqID_45145; Location=1..409; Strand=+; Gene=SeqID_72508
gatgccgccggactctacaaaagacatttaccggtgtaaatttaaaattagcgcgcaaaaatttacgccaattacgctatttggcgttatgagaattttgtctaacactgggcttgacccatagtgagaaagttataaacgaaaatgatcagcaattacttatgtgattggtaattgcctaaacgctgcgattttatatatttcaacttctttagactttgagctgctctaaaaccccggataacaaattttcatggttttttatcacaaaaaaattttgcaaaacaaaagggccctcccttattgtttttaataaaattcaaaaggttcttctttaaagtagcgcccaattttcataccaatttaaatactaagtattatttatttgtatttatttttaaaggaaatg

SEQ ID NO: 102839 - DNA, 168 bp, Heterodera glycines
  Promoter: Source sequence=SeqID_20913; Location=1065..1232; Strand=-; Gene=SeqID_51497
tttttgtcatgaacccgctccattaaatccttcccaccccctctaaatcggcctgacaacccgcttcagtttctgcaaaatcttttagcccaatctgttacagaatcggagcttttcatatttaattattcaggtcttaaaatctgagaattaaaattttgtggaatg

SEQ ID NO: 102840 - DNA, 310 bp, Heterodera glycines
  Promoter: Source sequence=SeqID_3634; Location=633..942; Strand=+; Gene=SeqID_51206
tttttcgtttctctgaatatagaaaattccatttttcacctcaaaattaaaaaaaaaaaccccaaaaattcactaaaaattataccgaagcaatcgcttcaaaacaaaaatttgcagttcagttttaggcaaaattttttgttttgatttcaatggacggaattttttgtttcgcaatgccttcgggcgacaactttttgctcttttgcgcgatttgccgccaattgcccacggcacggcgctccgttgagggtgtccatttcatttttcatttttttcacccatttcaatgccgtcgcctctcaaaatg

SEQ ID NO: 102841 - DNA, 316 bp, Heterodera glycines
  Promoter: Source sequence=SeqID_12212; Location=2097..2412; Strand=-; Gene=SeqID_75791
ttttatcatattaaccgccgcaaaactcctttcaaattcatccgatctccgcgctgtattattttatttatttaagttatatttcttgatttttatattaaaacccaatagaaatggaattttaattaatgagaatttttattaatattatttgcaattgagtaggcttttcttatttttcgttaaatcaatagaattatggttatctgccagcattttaatcagaaaattaattttttttcatttatatgtccatgaaaatatattgcgtttaaattaaaaaaaaccaaaaacaattttgagacgataaaaaatg

SEQ ID NO: 102842 - DNA, 915 bp, Heterodera glycines
  Promoter: Source sequence=SeqID_15867; Location=1..915; Strand=+; Gene=SeqID_80196
tttttttccaaaaaatttccagaattttcagtgtagttggcgtcccgatcgctatgaaggagtgatctgatcaaaattgctgttaaagacttttttgatcagcatcaacagttagcatggcagggattttttcagaatttttggcccacaagatattgattttattaaagaactaaaaagtgagtctaaacatatgactaccaaaaatgggggtgaagttgacttttgttttgtaattattagcgatgagaagaaattaggctgtaaacatacgaccatgactgtataaagcaattacaaatttatgttaaattttaaattgacctcgtggtggtgaacctgcaccgtttgtaacattggcaaaaatgatcacaattattaacgaaattattaaaatttgcatttttatcattttaatttgtttttttgagagttaattataattatgaaaaatatttcttattcgacaaaataaatagcgatttttttttttgcatttccgttgtttattattgcatcattaaaattattttacgttgccattgcaaaaatcaataaacaattcatgatttaaaaataaggaatattattttttgcaaattttttttatatgtaaacaaatgatgaatattttaaaatctttgggattgataattctttggatatttccatttttttatgagctcctagggacttgaaaagtaaaaaaaaaacttagcttaaaattatgtctatcaaattgagaaattagcgaaaattatcgaatttgtttaacgaaattggattgtttttaacttggtttgaagctgctaggatggatttcggtactcattaagtttgtatcccccttttgggtcaaattttttcaaaatttttttttcttttttattgtcgcaattgctttttagattgatg

SEQ ID NO: 102843 - DNA, 260 bp, Heterodera glycines
  Promoter: Source sequence=SeqID_941; Location=4109..4368; Strand=+; Gene=SeqID_46406
ctcatataaaaatggcgttaaaacaatttccttaacattgaaatgcgacgcaaaagaatacatataaaagagaggtttttattcagtccttaattcattcgcattattaaaaattttttgtccaattacaattaaaatgacaacatttattctatttaaatttttgtcaaattatattagctctaccgaacacatatatacatattatacaataatccatctctgcaaacacattgtttcaatggcccgcagatcgaatg

SEQ ID NO: 102844 - DNA, 760 bp, Heterodera glycines
  Promoter: Source sequence=SeqID_41349; Location=648..1407; Strand=-; Gene=SeqID_69497
aacaattaaaaaaaacatttcctctcgccatgtctcaaattctcttaaacaatttcattttttggccgaaacgccgaaaattcccggctcaattaatcaaagaatttaaaatcgcagccttatcggtgaacaaatccaatcgcaaacaaattcagttcgctttggaccacaaattgggatcttcccacggcgcctcgcgcatcattcggcttactcacagtcagccccattgggttcgactcgcgcaagacgcgttccgggaatgggacggactgcacaaattggatggcggggaggcgctgtacatgtacagaaaatagaattcataaattacccataatatttatgcataaatatttagtttaccaaattatttgtgcaactaaaacggagaaattatcagattttgagcaaagccaagaaatgctaaattttaaaaacgtaaaaataatttaaattttgataatccaaaatattttggtaatttaaattaaaatatttcaaaattgtttaaaaaaaggaaattgtccctcctcttaatatttaaaaatttgatgctctttttgaaaaaaggaagaacggcttgttgacattggacccggattggtctcagactcagctgcgcgcttcggtccttcgtcagttcggtgtgccacaccaagtgttccgtgggggcagtgccattcagcgacgcttcccgcatttgcacaattatgacgaacgatggtcggcactgtacgagcctggtgccggcacaatg

SEQ ID NO: 102845 - DNA, 54 bp, Heterodera glycines
  Promoter: Source sequence=SeqID_10617; Location=1..54; Strand=+; Gene= SeqID_73848
acgattgcttcttgcccatttttgatgactcacccttttttggtattaaaaatg

SEQ ID NO: 102846 - DNA, 268 bp, Heterodera glycines
  Promoter: Source sequence=SeqID_8167; Location=876..1143; Strand=+; Gene=SeqID_67190
cctaaaaaagaacaataagaatttgattggtgctaaaacattgggtgtactgctcgaattccaaggctgagcaaagccaagtcaaagtaatccaaaagttattaacaggtaaagaaattttatccatcttgtcatggaaaaaattcgacaaatttgcttggccccgccctgtcttcccctattttattttgcattttccccgtcccatggcacttacttgaccaccttgacctgcgtgttgcaccaattctccgcaatcggcaacatg

SEQ ID NO: 102847 - DNA, 626 bp, Heterodera glycines
  Promoter: Source sequence=SeqID_7558; Location=1554..2179; Strand=+; Gene=SeqID_65208
atcagacaaacattggaaaccgacgaagagaaatgccaaagtaaaaaagacgaaagaaattgtatgtaaattatttttatggcaccaaattaaaaatttcgaacatttcatgtccaatttccttcccttctctctgtctctctttgcttttttcatttgcccttcggcgtgctctttcctttttgtatttctttgctcatttggacaggttttatctgcatttagctgcttcaccttttgtggtggatgaatcatcgtccattgcattttaatgctcagagaaagagagaggaaaaaagagagagagagagagacattttgggaagagtgagagagtctttccttggaggaggggggggggcactttcctttaggggtgactaattgttgtaggccgcctaatgaatgcatttctgtgcgcaaaagccactcatccgcggtcctttgaaagcaacaaccggtcgtttgatcgttctttcgatttgcttctcccattgatcgtcgcaaaagtccgtttccctccaaaagctttgtataagccaaaaatataaaagacgagcgatcaaagccaaatcatttgtttaacaaattcaaaattgacttttgaactgccaatctccaaaatg

SEQ ID NO: 102848 - DNA, 453 bp, Heterodera glycines
  Promoter: Source sequence=SeqID_28772; Location=1..453; Strand=+; Gene=SeqID_59347
cagggatgacacggaattccgatttccgtcatttttggggtcggaattccgatttccgacgtttttgggcctcggaatgccatccctgatagtgatgttcttgagtgggagaggaagcggttctctgctgcactttatgagtagtctaaatgcattttttgagtccaatcaattaaccatacctggttttttatacaataatttttgttcatgttcgaataaaccctttttttgttaacaattcgaaaagcataaagcctaaagaagctaaaataccgtatataaaatttcagcgtatgataattgccaaaaaagatatgattaaattaattgtttgtaacttttttttaaacatagatattctcttatttttcatatttctcatatgatttccttattcatactttgtgctttcgaatgacaccaaaaaacataggattttgttcaaacatg

SEQ ID NO: 102849 - DNA, 145 bp, Heterodera glycines
  Promoter: Source sequence=SeqID_7101; Location=672..816; Strand=-; Gene=SeqID_63847
aaatttggataaattagcgggaaacaaaaaggagcaaatgaaaagtgatcagagaagaggcattgagctgatcagtaaacaaattcatagcagaaaatttggcagagcaatcattggaggaaaagtaaaaaattgggccaaaatg

SEQ ID NO: 102850 - DNA, 230 bp, Heterodera glycines
  Promoter: Source sequence=SeqID_1944; Location=1..230; Strand=+; Gene= SeqID_76930
tttcgccatcaaattcttttcctttattcgtccaatttggctgagaatctcgaaaaaactgatcaatcgaatccctattcaaaaaccattctcccaacaaaattcgtctttttcaaaaatttcaaactagtcctttccctcaaaacacgcggcggaaagtcccagtggtgatgcgacatttgcagcgctggcatttgcggcgccgacacttgcggcgcccagtcaaaatg

SEQ ID NO: 102851 - DNA, 107 bp, Heterodera glycines
  Promoter: Source sequence=SeqID_21990; Location=250..356; Strand=+; Gene=SeqID_52632
tttacggaacaatgaaaaaataggtggacaaggacaatgttccgatcagttctgtgcttgcactcggtgctgtccaccaatgtttgatcaaacagcgcctccgaatg

SEQ ID NO: 102852 - DNA, 188 bp, Heterodera glycines
  Promoter: Source sequence=SeqID_3414; Location=402..589; Strand=-; Gene=SeqID_84586
agaagaatgatgatgacggcaagctcatgataaacgatatccttgttgaatttagcatagaaaaatatgttgtggagcgcaatttgcacttttcatagcagacaagaaggcattttgaaattgcccaatttattgacacatgcaattacaactatatatttttgtttctttttaaccacaaagcaatg

SEQ ID NO: 102853 - DNA, 62 bp, Heterodera glycines
  Promoter: Source sequence=SeqID_1915; Location=822..883; Strand=+; Gene=SeqID_76781
cctttaaaatatagaatttttctccctatgaaagttaaaataaaataatttaaatttgcatg

SEQ ID NO: 102854 - DNA, 81 bp, Heterodera glycines
  Promoter: Source sequence=SeqID_34931; Location=1395..1475; Strand=-; Gene=SeqID_64615
aaattaaaaacattaagttgcaaacggacgcgaacatttccaatttcgttggagaaaataacagacataacatattggatg

SEQ ID NO: 102855 - DNA, 355 bp, Heterodera glycines
  Promoter: Source sequence=SeqID_5963; Location=2119..2473; Strand=-; Gene=SeqID_59854
ttttttattattttattgttatttgactcttcgtaaataaattattttatttgttggtctttctcactcggacaaaagacacaacaaatttggcgcagtcagcagtcgtcttcaaccaaacagaagaccccggactgcacagcaacaaaaccaatagaccctaggcgggtgaggtctgcaaattctgcagtttttcgtcatcaacaaaaccaatagtccctaggcgggtgaggtctgcacatattgcagttaattcgccgaaaaaccaaaagacctgagaaaggttgcggttccgcaatacgcggtttttcgattttggacactcaaattcggcaccggcaaacacttcggcatg

SEQ ID NO: 102856 - DNA, 270 bp, Heterodera glycines
  Promoter: Source sequence=SeqID_2733; Location=1..270; Strand=+; Gene= SeqID_81330
tgtacgacgcgtccaaccccacccaaactaaataaataataggcaaacattaacaactatgataccgtatcgggtgttcaataagccaacggctacaaacttctctgaaaaagcaattccaatcaatcagaactctctcagacaatcgagtgatctgtatttgtgtgtgaattgggagaccttaataggttattacagccttattttgcattaagctcaacttagtgcccaacaatatcccaagagtagcccctttctaagttggaaatg

SEQ ID NO: 102857 - DNA, 770 bp, Heterodera glycines
  Promoter: Source sequence=SeqID_36790; Location=501..1270; Strand=-; Gene=SeqID_66018
aagagaaattaggagtttttggagtccgcgttgggaaaatttttaggattttaatgaattttgttaagaaattttgttaaaattcaataatttttctcttctcccacctcccccccccaatggtcgtacttaacagtgtaaaaatttctcggtttccgaaactaaaaaaccgagacctagaagttaggtacagtaatctgatttaagtattcttaccaaaattattaaattcaattaaaatattaaaaaaacactaaataaatgtattaaaaatgatattgtttggtaatttagacttaaaagcgattttaaaactttaatattttccgctttttaaaataattttaatatttaatagactttttttaatcataaaatgctggcctgtcatttttatgttatttttgactaatatacaattttattatttgtttgccaatcagtcatatcggagaaaaacatttatttcttcatttttccactttttcagttttttcttccatacagaatttttgttactaatggcccttcaatgcttttatttgtcaatcagtcacattcgtcgaaacatttacgttgccattttcacgcatattaattatttcacaaattaatgtgttactaatggcatgggtgtgagagcaaaagccaaaacagccctttaaaaagcgcacaaattggagcaccaaatcattcattccgctcaaaaattaccaatttcctttccacaaaattacccaattctcattaacaaacctacgaaaaaaatg

SEQ ID NO: 102858 - DNA, 350 bp, Heterodera glycines
  Promoter: Source sequence=SeqID_12060; Location=2868..3217; Strand=-; Gene=SeqID_75591
aaataaccattttaaaaattttatttacatatttggtacatatttcgggatttttttttacatatttatgtacatattttgaccactttttgtacatatttttgacatccctaatgattaaaaggaaattttccaaacttttttttttgctgaaaaatattaaatattttttgaaattttcttcccaattaacggaattaattaccttgaatttatgttgtttttgcttatttttaacaaataatttaaagattaatttcgaaaatgaatctgcttgggcgacgtttgaccaattgctttcaacatttttgatttggaagcaaaataataaactgacgatcggacaaatg

SEQ ID NO: 102859 - DNA, 847 bp, Heterodera glycines
  Promoter: Source sequence=SeqID_3586; Location=1986..2832; Strand=+; Gene=SeqID_50973
agaaacactgaggatccgacaatctgagctttaaattcacacacacacacacacacacacacatatatcattttgcattttcatataatcatttttaattgcattttcatataatcatttttaaattgcattttcatacatcattttcaaattgaaatttccatatacgcattgaaataaaaatttgaactcaatataatgacaaataattagctaagattatggtatgattaattaattttgtccaatggtagaccagaaagggtccatatttaatcattaaaagtgaattttgaattttgggctttgtgtaaatgattcataaataagcagtttgcacacgatgggatgttttgcatagtaaaatgggtcacctttagggatcatacacccaaaatttgaattctgagctgcacatttgaataattaatcgcgcaaataacgaaaatgttgatgggcatcggggagaatttgggtcatcaatcggcacgcgagaacatattgtcggcatataaaggcggaaatcccctgtgttatcctcatttttaaatgaacattcgtccacaatattgtccataattttaatttattttttgcacaattaaatttaataaaaataaatatcttattttcaatttttttttaatttattaaactaatttgaatcattaattaaaagagaaaattttacttcataatttgcaggtcgtttccctgaatctcaatttatcccaacattatcaaaaatgtccaactcttcttcaaaaaatggtaaaatagctcaatctctcccttcacaattaacaatctgtcaccttcagtaccggacgaaatcgactgcgaaatg

SEQ ID NO: 102860 - DNA, 386 bp, Heterodera glycines
  Promoter: Source sequence=SeqID_42488; Location=1..386; Strand=+; Gene=SeqID_70365
aaatgcagatgatggcgaggctcgtttttaggggcgataaattttaaattaaaaaaaaaaagttatcccaactctcaaaaacctattttttactaaaatagaaaatcttgaaaattaaatttagcataattttcttatcatatttcattaaaatttccaaaaaaaaatttcagggcgcctaaaggacaccgccgaacaccttataccttatttttttttgaaaatttgatttataaatggcaaaaattgtctttttcgatgcaccactaaaaattcctgcttttctccccggcgctgaaattttttgtaaaataataatttcattttaaacaattatcagccatttttttacttaaaataattaaagattggaccacaatgtgatg

SEQ ID NO: 102861 - DNA, 442 bp, Heterodera glycines
  misc_feature (75)..(75): n is a, c, g, or t
  Promoter: Source sequence=SeqID_16190; Location=2841..3282; Strand=-; Gene=SeqID_80554
ccccgcttttccttgacaatttgacgtaacacctatttttattaattgaactgaaagcaaccaacgggtgaagcncgctaattgcacgcgcaattgtgtatattttgtaggcaaaacacgcaattgttaccatatgcctccgctaaatcgatcgtaattagtgcaaaatcagaaaaaaagttcactagaaacaaatgcgtttcgtgctatgcatctaacttttagctttaaaaaggccaattacttgataattctcagagaatttacccaattggccgtttgacacattttaaatttcaagaaaatttattaaaaaaaattaaaattaatttgtttaataatttaagattcatcagatttaattaacctaaaaagtaattgtatcaatttccaaaataaaagatttttgccaaaactgtgatcattttgtgtgtccaaaatg

SEQ ID NO: 102862 - DNA, 216 bp, Heterodera glycines
  misc_feature (77)..(77): n is a, c, g, or t
  misc_feature (127)..(127): n is a, c, g, or t
  misc_feature (152)..(152): n is a, c, g, or t
  misc_feature (159)..(159): n is a, c, g, or t
  Promoter: Source sequence=SeqID_4076; Location=6577..6792; Strand=-; Gene=SeqID_53071
aaatttggtacagcacaaatggcacaagctcattcagaagtagcttcatgcctttgaagtgaaatcaatgatttaantcagtatcaaagtattaaattggggttgtgggattgggaggaaatagtcntttgtattccaagggatgtccttgnaaatagnccatgtaatgaactgccattatatcgctaaatgagagtgcaataacatttaataatg

SEQ ID NO: 102863 - DNA, 459 bp, Heterodera glycines
  Promoter: Source sequence=SeqID_5799; Location=653..1111; Strand=+; Gene=SeqID_59267
ttgtatgagaaaaatttaactaaaattgaaagattaactaaaattatatggaaaaaaatataaattaacaaagttcaatagattcgaatgttttttagaaaagcattatagggaatttactctaaaattgaccgagaaaataaaactactaaaatgatagagttagaatttgcggttgaaaaaacattattttaggggaaaaaatcataatctcaaaaaattgacactcaaactcaaaacagagatttttaagaaatctaattctttctctgctttttctttttttcataataatttcttttagtttggcgtattatctcttcatttttaatagaaaaacagaatttactctatgcatgaatacctcaattagttacctaaaattactagataaataggtattcaaattatttaactaattttcagcacatttttcagataaatttattaagaacaatg

SEQ ID NO: 102864 - DNA, 278 bp, Heterodera glycines
  Promoter: Source sequence=SeqID_23174; Location=400..677; Strand=+; Gene=SeqID_53876
ggtgattatagccgtacttaaaacagatttatggcagggtattgggcaaaatattgttgacttttttgtattttttttaagttatgccgtctcactttgtctctgctgcgcactttgctctccctgcactgtgaggatttgctgtggtgcgcggtgttccgccatttgatgccgttcattccgctcggcagaccccgccggtccaaccaaagccgtcgcttcgacattaacgtgtcgttggacgccgccgctttctttctcaaaagtgtcccggaatg

SEQ ID NO: 102865 - DNA, 336 bp, Heterodera glycines
  Promoter: Source sequence=SeqID_5451; Location=1..336; Strand=+; Gene= SeqID_58095
tctcgccgggacaaaatctcgccgcaaaaatttaaaaaaaattcaaaaattgatttttttcaaggaaaaaatcttagaaaaatttattataagaaaatataagaaagaaaattattgttaagtttttcttgaaaattgcgcggccaaatttggaagttccatgccataaaaaagcaattttttgtaaattttgaaagtttttatttttagtagaaaacttttggttttgtgtagcattctctaagagattttggtcaaaaactttttgtcaaaaacttattgctcacttttccgctatttattaattttcataatttcagttggtttgcagcgatg

SEQ ID NO: 102866 - DNA, 1003 bp, Heterodera glycines
  Promoter: Source sequence=SeqID_29914; Location=118..1120; Strand=-; Gene=SeqID_60378
cttttaaacaggccaaaaagtttagctttacttttttttcagaacctgatcagaagcgcaccaaactttgcagggatactgaagggaagagaaatagcctattttaaatattatctagtcagttcatttaaataatttttatccaaaaaattttttttgggttttcggggcagtccccctgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaaatttttaaaaaatttttccttatattttggttatatcgttttgcttttggtggggtgcttggaacagtggaatcatg

SEQ ID NO: 102867 - DNA, 618 bp, Heterodera glycines
  Promoter: Source sequence=SeqID_2077; Location=495..1112; Strand=-; Gene=SeqID_77714
ttttttgagtgattttcttattaaatatgcatgccaatttttgctcatattttaactcctaatagtgccgcccccgccgattttagtttccaaaaaatgattatcatgttggtactgaagccgtactcaaaaaccatcaaatggaaaatttttgggaaaaaattattctttgcttaaaaggaaccaaatttttaattttttaaatcattcggtagctctaggttttctcaattagcctataaaatatcaaaaaatttcgtttacttttaaaaaagtcattgccagaggaataaaaaccaactttttcaaacattttttgggcattactttttggaaagacgaaattttttaaaatttggcaggaaaatagagaacatttaggtctatcgaatgatatgaataattaaaaatattgtaaagcttataagtaaaaattttaatttgatagtttaacgcccattttgatagtttttgaggtgccacaacaccatcattttaatattatgataaaaattatttaaataaaaaacaaatatcctaatggtaacacaccatatgagggttatacggtaacggtaaaaaaaaattgtttacaggtttcgaacaacagttagtatg

SEQ ID NO: 102868 - DNA, 681 bp, Heterodera glycines
  Promoter: Source sequence=SeqID_21942; Location=1481..2161; Strand=-; Gene=SeqID_52581
attacagggtaaatttatcacggaaaacccttaaagctatcccgtgaatcataaccgcgattcaaaatttaaatttacttaaggtcagtcaggttaagtttatcagaatttggtttttaaatttaaatattgccaagattcaaatataataacttaaaaatgcaaaaaatggcaaattttaaaagatgaactttcaggcgtaattaataatgccgtaaattttcaatcatttattcgagcataaataaatttcccaagaaaatgatgttattttcaaaacataatataatttaataaaattatacattagaagtccccatataaaactaggtgtatgaatactaatgaaaacttttttacaaaaactataatattttatgctaaaataaaaatttaattttataattcagtaataattttatcatttttttctgtcaataagttataaaatttctttctattgtttcttattttaaatctgcatcgtcaaataataaatcaataattatatatatttatctatctcaatttcttataattttataaaatttacattcattattaaatattaaatattttttatattagtaataaatataaacattaatattacactggtaaaacataaattaatttttgtaaaatcatttgaaatttaaaatcgtatcagaaattcaaatg

SEQ ID NO: 102869 - DNA, 58 bp, Heterodera glycines
  misc_feature (52)..(52): n is a, c, g, or t
  Promoter: Source sequence=SeqID_17722; Location=1..58; Strand=+; Gene= SeqID_82257
ggatttcaaaaatcttttctacaacaaagctcacggcttttggtacgattcnaacatg

SEQ ID NO: 102870 - DNA, 68 bp, Heterodera glycines
  Promoter: Source sequence=SeqID_645; Location=146..213; Strand=+; Gene=SeqID_46038
ggtaaaagttaaaaagagtaaattagggaattgacaatgtttaagaattccaacggttcttcgatatg

SEQ ID NO: 102871 - DNA, 1003 bp, Heterodera glycines
  Promoter: Source sequence=SeqID_941; Location=1224..2226; Strand=-; Gene=SeqID_46407
tttctggtttattttctaagaattgaggcctgactcatttccaatttttttttggccttccaggcatttcctagcaattttacttcactataacaaaaattattaatttttgtcatccatttcaggacaatcccctggccactttgggctgctcatgtggtgcaagttttgcaccgaaaaatcaaatcgaataagcaaaggacggaaacggggcttcgtttttatggtcattgcttttttacttttattattattttatttgtttcaatgtttttgtgtgcatttcactgccggtgtatttgtagggaataaaattcggatttaatgttcctgttttcttttttcgttttgaacggttttttccccctatttttttgatcatttttctttggattcgtccattaatttgcctttttcttcgctttttccgatgaatttcgttgtccgtttgcctttgtctcccttgaaatcgtttcttttgccccgcctttggccccccttttgctgctgctccgtctcttcttcttccgtttgttctgttcctctgttcgcccatccttcgctcgtttcttttccgtctcccgtcgccgcatttttgtgccaacgcgcggccgtcgccggacaatcggtgaaaaaatgcaaaaacgaaatcaaatatacatcgaattgggaattgtcctattttcccattagtgatctttggcgatggctttttcttataggtcataactatattttggcagtttttttaccttaaaatgcggtccaaattttgcatttaaattcaatgatcaaatgccttttattaggttcaatttttgacttttttcccatttcattctcttctccctccttttgacagttgcccctccgcctctttgacgtccgttctcgtcaaaaacagcacaattaccaccaccaccatggcactttctcggcccgcttctccgcctttttgcgccgtttgtttccctttggccgtggcggtgccgtcgttctgatg

SEQ ID NO: 102872 - DNA, 86 bp, Heterodera glycines
  Promoter: Source sequence=SeqID_24198; Location=1..86; Strand=+; Gene= SeqID_54910
tttcgggtcatttcaaaatttttagctcatctcactgatattttgctttatctctctctatctcaaccaacaacaacaactcaatg

SEQ ID NO: 102873 - DNA, 81 bp, Heterodera glycines
  Promoter: Source sequence=SeqID_15483; Location=1..81; Strand=+; Gene= SeqID_79757
aaatcccaccaaaatgcagtcaatcaacagcagctaggaatgaatgggatgtttgcacctccggttttgtggccacagatg

SEQ ID NO: 102874 - DNA, 126 bp, Heterodera glycines
  misc_feature (64)..(64): n is a, c, g, or t
  Promoter: Source sequence=SeqID_29268; Location=1164..1289; Strand=-; Gene=SeqID_59797
aaaaattcttcttaaaatttttttgaacccaattcaaaaaaggaaaaaaaatttgcagtcaaanaattattcgaatttctccaattttgtttccataatttccgaaagttattcggtatcataatg

SEQ ID NO: 102875 - DNA, 380 bp, Heterodera glycines
  Promoter: Source sequence=SeqID_20863; Location=1215..1594; Strand=-; Gene=SeqID_51448
gctgggggataagctaatggcagaaatgagcttggaaaagaatgtctattctttggctggagggggggaggaggaaatggtaggaaaatcggcaaaaccggcacttttaggctaccgatgtgccaaatttcaattggcgatagtcccaagcgaaaataacttttctgtttttctcaaatgtctgaatatctgggctaaaggtaaactttgaaaaagacgaacatttggcacagtctaattgattaattaacgctaattaactaattaatgaatgccaatttgcattgcttcgtctgctaattgccattccccgctgttcagtccgtctcatttatggcggccttttcggctttttcaacggcgtctctttgtcacttatg

SEQ ID NO: 102876 - DNA, 632 bp, Heterodera glycines
  misc_feature (20)..(20): n is a, c, g, or t
  Promoter: Source sequence=SeqID_9341; Location=1..632; Strand=+; Gene= SeqID_71057
gagtatttttatgagttacnaataatcgaaaaaaacatttgaaattatagtgcatcatttgtctattttttcggtctgaaccagatcaaaatcggctataaatgatttgccaaaacttttttttgaatttttctattattttaagcgcctaaaaaatcctgcctctgaaattttgtttttttggctatgtgcatttggctatgtgccatatggccaatagtttcaaacaaaataactttttgaaattactctgattatttttttattaatttattttaatacattttttgcatttttcagattttaagtttgtatttttaacgggttttttttgtttgaaattattttagctactttatgcgaatttagttttttgagttttctaatttttaggaaataggtattttccacacaaatattttatgttaattttttttaattaaataggaacgcggaaagccaatcaatgagaaaaatgcttccaaaaaaaagttggtggttcaataagattaaataaatttatgattaaataatattttctaataaaataaatttattccttatcattcatcaattcaccttaccacactcggttaaggcttaaggattttaaaaaatcaatcactgatatg

SEQ ID NO: 102877 - DNA, 155 bp, Heterodera glycines
  Promoter: Source sequence=SeqID_27400; Location=561..715; Strand=+; Gene=SeqID_58091
ttgtcaagaataatttgtttttttcttttaatgaaggaaaattttaaaattaaaaatcaaaagataattaataaataaattataaaattatatatagcctattaacttcctagacacgatttaattaacttttcagtattacaactttcataatg

SEQ ID NO: 102878 - DNA, 146 bp, Heterodera glycines
  Promoter: Source sequence=SeqID_31813; Location=1515..1660; Strand=-; Gene=SeqID_62098
attaatggcaattattaaaatgccaattgctctggcttgacaagaagcatttttaattgattcctcaatgcatttattaattatatccccgggttcagtacacaaatgcaagtgcacagaatgtactcggtctgctgcctcaaatg

SEQ ID NO: 102879 - DNA, 97 bp, Heterodera glycines
  Promoter: Source sequence=SeqID_22102; Location=501..597; Strand=+; Gene=SeqID_52750
tttatttttatataaaattagttttgtaccaacaactaaaacaattaaaaaataaattattattgaaaataaaaatgaaaacattgttctcaacatg

SEQ ID NO: 102880 - DNA, 482 bp, Heterodera glycines
  Promoter: Source sequence=SeqID_33098; Location=511..992; Strand=-; Gene=SeqID_63261
ttttctattttttttctttatctttctcaatctctcctctctctctctcttttcctttctctttctctctgtgtatcttcgtctctccttttacactgatcactttcgacccattctttttttaccttttctgatcactttccattcttccgatcaatctcggctcaacacagcatactgaataagcatgtgatttttgttcattctctccaggcaacagctgttacggaagggcacaaaatgtatgggatttatctcgaaaattcgtgggaaggaggctatttattcaagtttagagcttctcgtcggaagcgaatgctttgtcaaatggatcagataaaaatgtttcaaaatttgcaatttaacaatcggaggaacttaaaaatttcaaacctaatttttttgttttcttttaaaattaattaataaattaaaataaattttaggtaaaatttgtgcgtaaacacagagccaacaacatg

SEQ ID NO: 102881 - DNA, 217 bp, Heterodera glycines
  Promoter: Source sequence=SeqID_16021; Location=1..217; Strand=+; Gene=SeqID_80377
tcaaatttagcataatgttttttttgctgttctttgcaacttttggttgcgccgttgcttttaatcagtattcgatttcaatcagcatatggccgagccttgacacttcaaagcatcagtattacgtaattttggaattctaatcgaataaatataatattaaaaagaaataacgaacaataatttaaattgttttaataaaattaaggccggaatg

SEQ ID NO: 102882 - DNA, 162 bp, Heterodera glycines
  Promoter: Source sequence=SeqID_44422; Location=1..162; Strand=+; Gene=SeqID_71912
aagcatgcagaaatggctgaatgcttgcagaaaattgctgcggcaatgcgcgaaaataaggaaagagtgtatttagaattttgccaacgtttggatattgagacaaaaatcaatcaagcagagattaagaaaaaagaatgaagagttaaaaaagaacacatg

SEQ ID NO: 102883 - DNA, 1003 bp, Heterodera glycines
  Promoter: Source sequence=SeqID_17930; Location=477..1479; Strand=+; Gene=SeqID_82487
ctattttaaaaaagctttattaacacagcggcccaattttgggctccaagtacaattatgctggatttttcgtcttagtggtctgtgagttagtcaccaaaagggggtctcaggttcgagtcctccttatgttgtgtgttaatttcaatttcttcttttacagaagaaggcagaattatttttttattaataaaagttttcgtgtcaataaaaatcatattcaaaaagcgttggttacgtacaacatcgacaattttatgaaatttttttagcttataacttggtgaatagtagagcaaataaaaccattttatgctcattttgaagggaaaattctggagaatattgtaaattttatttggtttggccttaaattgtggacttggctaaaaaagaattaaattattgaaatgttcatcccttgtaaaaaaatttttcctattgcttaattttcttaaaattttgcataggccaatattttgacctcctctagcgattccaagtttattttatggaacttaagtttttaactcgagatcggctcttctaattttacaagggaaaatcccaaaaaaattttaagttttgcaaagttttggcgttctgattactaaataaataataaacctatttgcactgagagcccaaaattggggccgctgtgttaataatgttaataaaaaaaaatcccataaatttctttaaatgaaacatttttaattgcatattttcttttcctattttagaaattaaaatggcttagtgacgagggcagcggggcacagcgggggacaaaatatgccattctaattgttgtgcacatatttagcacatcaatcgcttgacagaacgggggaccaaagcaagaaccaacaacaaatgaccaccaatctttaaacggcacatttgttctgccaaaaaaaattaaaaattcttttacgcatgggagaaaaaagaaataattcccgcggggaattggcggggcatacccaaactcaatatg

SEQ ID NO: 102884 - DNA, 1003 bp, Heterodera glycines
  misc_feature (173)..(173): n is a, c, g, or t
  misc_feature (211)..(211): n is a, c, g, or t
  misc_feature (223)..(223): n is a, c, g, or t
  Promoter: Source sequence=SeqID_25187; Location=1081..2083; Strand=-; Gene=SeqID_55925
ttaaattttttcctttactcgaaattttcatctctaatttttcactcagacctccattcttaccagtgctgtttttcccggttcacggttgccctaccgggaccgggacctgagcttttcaggaccgggaaccgggacctcgaataacgagaattcctggcccggtccggtcncgcttcactctaatatatacaaaaaaatttttatcgtntattaactattntaaataaaatgatagcgaagataaaattgtaaattcattcaattatatggtgcattgattctttatatagcttgtttttattgaaattttatggttctgtaaatatataaacaaaataatgtgctgattattatttgaattaatttcgattcgaacgtctattaattgtaacataatttttggttgaatttatttataatattttttataacaattataattaattttaataggtccattcaattagtgtttgaatttaacttctcctgtttgccagagtatcatcttcttgtgtcctcattgctggcgaattttataattccttcatttaatatttaaagtttttttatattgatatttaattctttatataatttttgttgtaaagatcatatttaatcagaaatattttttattttaatgatatttagtatattcaaaagaggttcaattattttatgcatttttttcaaattttcacgtatatttatttttaaatttaaattaattaccaaaaaatctaaaaaaaagtttcaaaaaattaatacaattatagtttatcaacaccaagttttgataatttagctctttttgtgtgagatttattttttatgtttcttccttttttcactttaattatctgatttcgttagcgccaacaagagtgcgttatttataagaatgttctgattttggggtagcgacgaaaattgttcttaaaaattttctcaaaatcgcgcaaaaattggtcatttttggtgaaaatctgtgagcaaaatg

SEQ ID NO: 102885 - DNA, 228 bp, Heterodera glycines
  Promoter: Source sequence=SeqID_8270; Location=597..824; Strand=-; Gene=SeqID_67509
acttcaagttttcatcactaaaggaggaacaattcaaggttttgatgctcttgacagatctaaagtcgccgaaagatgcaactttgagacaacgaattttgtcaaagctcggcgcagacggagatgacgtcaagtatgatgacattgttcaagattgtatcaatttcatgacgacaatcagcgaatcaaagctgattgaatcatctgcggccaaccgaagcataaatg

SEQ ID NO: 102886 - DNA, 497 bp, Heterodera glycines
  Promoter: Source sequence=SeqID_13594; Location=328..824; Strand=-; Gene=SeqID_77495
attttttggatgccgctgagttcctgatcgtgtccgatttggatgatgtgctgatcccgaagcttggccaaacatttttggaggaattccgttttctaagtgccaaagtgccttacgcggccggcttttcctacaaccgatacaacaccgaattggtgacaagtgagctagctttactgtgcacgaattaagctgtataagctgtattagaaccatctctctctctctctctctctctctccgcattctgccctatctgtctctttcctatccgtctttcctctcactcttatctttctctctctctctctcgttctctctctcactttcgtcttctcgactcctcctccttcttgttagatctttttctcttgcatttctcttcttcaggcagtgaaccgggcgaattttcccttgcggcattgatcaatgaagcgcggtaaaaagaattcaattttcaaaaaaaattgatcacttattagagtggctaccgaatg

SEQ ID NO: 102887 - DNA, 838 bp, Heterodera glycines
  Promoter: Source sequence=SeqID_16290; Location=428..1265; Strand=+; Gene=SeqID_80679
agaggggttggtctctatctatattgacaaaatattcgatttattaatgttatccacggcctagggcccagaggattcggcttggaaagggttcgaagaatttttaaatccgatttgcttttaaaataggcattttcaaacagaggggcgccggtggtgccgcccataggtgccgtcggtgaatattttccgaaaattttgatgtatttgtttatacatttgtgccaaatgactaatttttctggatttttgggtcaaattttctgaaaaatctatggaaagccattgccaataaacagttttcaaaatttcgaattactcaaaattttcaagaaaaaactgcacttgacggcgttttgccttttgtaaaatcataaaaacgtctcttttttaacacatctcatcatttctcaattcattttttggttcttcgcttaaaaacctttttccctgtgctattttttcaaaaattttctcagtcggagaaaattttcactttagccaactttaacaccatttttgggcgcccgcttttggtcccaaatttccaactaattttttttttcataaaaagcaggatgcctgggtgtcgcaagtgcgtgccgcaatccgtcatgtggacgacccacggctgaacaaagtgttgcgctccgtctacgcatatgacaacattccgcgcagtaaggcaaagtttgtcaacttcatgcaaaattcggtgcgcgtccgggaccgcgcggtgtgtgtggacgcgtggaatgccataaggcggggggcggacgcggtagcggaagagaagatggtggcacaagcgaagcggacggaacacgcggaaacaatg

SEQ ID NO: 102888 - DNA, 83 bp, Heterodera glycines
  Promoter: Source sequence=SeqID_893; Location=4823..4905; Strand=-; Gene=SeqID_63416
tcgcgcaaccacaacctccggcgccgcctgacccggcaccggcagagcccggcaacagcaacaaccacaaaacggcggcaatg

SEQ ID NO: 102889 - DNA, 159 bp, Heterodera glycines
  Promoter: Source sequence=SeqID_2196; Location=2302..2460; Strand=+; Gene=SeqID_78426
tctccaacctccttttcatttagccccgatgacccacttttttatatatgctctcaaatttagtatcacattttaacaatttttgagccacacaaatttaatataaataagtttatgttgaaactgtttattgttcattctctaattattttgtcaatg

SEQ ID NO: 102890 - DNA, 597 bp, Heterodera glycines
  Promoter: Source sequence=SeqID_13219; Location=305..901; Strand=+; Gene=SeqID_77047
tgggtggtgtgcctggacaggtgagcctgttcaaatttttgaaacattttggatgcttgcgaatggcattgtccggcggggctatcttaaaatccaccattttcctctacaaattgacattttaaggtttaaattagcttttcaagccaacgagtaattaattcttgaacaggttgccaaaatgttttttgaagttcgattttcgaaacacacggcgtatttttataaaagattattctgcatcgaaggttaaaagtggaaaaacgctttttgccattttgacccaaatgtttagaaatttttttaatcgccattttgaaaaaactaattaaaatcttttaatgccaatttgtagaggacagattggagtattaaaatagaataaagaaatttctgcaaccagacttttttgagattttttcatttaatcgcttttcaaaaaaaaaaatttcttttttttattttaatcgaaaattttgaataaagatttcaaattttcggggggtggggcggagcgatatgctctggtaattgtcatttcggcaatctttgcctcattctcctctctttttggcacagttccatccggcaggaatg

SEQ ID NO: 102891 - DNA, 75 bp, Heterodera glycines
  Promoter: Source sequence=SeqID_26251; Location=1467..1541; Strand=-; Gene=SeqID_56998
tatagccctgggagctgtcttggtcccggtactgggtgtttgagctcaacatttattagaaaaaataacatcatg

SEQ ID NO: 102892 - DNA, 77 bp, Heterodera glycines
  Promoter: Source sequence=SeqID_11344; Location=1057..1133; Strand=-; Gene=SeqID_74728
aaattatttgtttttttaatccttgaaaataattttttttttttgaatcttttttgtttcagcaattaagtacaatg

SEQ ID NO: 102893 - DNA, 140 bp, Heterodera glycines
  Promoter: Source sequence=SeqID_6425; Location=2232..2371; Strand=+; Gene=SeqID_46244
ggtcgtttcccttagattagcttcccgtttccttaattttaatttttgtccttttcatttgaccatttgtcatgcgtttagggtttatgagtttgggagatgagttgaccggcaattatgggatcaaagaccagcgaatg

SEQ ID NO: 102894 - DNA, 113 bp, Heterodera glycines
  Promoter: Source sequence=SeqID_7012; Location=2204..2316; Strand=-; Gene=SeqID_63567
ttttactttttttttttttttgaatttttcgtttttttgactcattccaaaactttcgacttttttggacgaaaataatccaatttttagttttcatattttttcagattatg

SEQ ID NO: 102895 - DNA, 202 bp, Heterodera glycines
  misc_feature (5)..(5): n is a, c, g, or t
  Promoter: Source sequence=SeqID_18179; Location=986..1187; Strand=-; Gene=SeqID_82763
tcatntaatgtgattttttaatttttattattttttctacccaagatattgcagaaaaataatattagcattttttgaggtttttttaacctaaaaagacaattttatgcattttggtcaaatttttttaaatgttgcagctttttaataaatttgataaaaaaacgattctatatttaggtggtcgccgttattgatgatg

SEQ ID NO: 102896 - DNA, 457 bp, Heterodera glycines
  Promoter: Source sequence=SeqID_24523; Location=694..1150; Strand=-; Gene=SeqID_55250
ttcacgtacacaaatgtgtaaattcattcataaaacaaacaaaaatggagttgaaaagggaaagaatgaagaaagaaagcatttgtctccataaaagtgtttagccatgagatttaggcacacatttggcgaaaagtctttcactattaaatgccaaaatcagtcgacaaaatgcaacaattattttattatttaaataatttttattaaaattatttatttttactgtttcttggtgtggtaatgttgtgcaaatttttagtcatttcatactttggcatttttctattgtaaaaacagaaacattttgcgcaatgctttttcctcaattctttctttcatttttgttcattttgttattagcggacggaatggcgcaacaatcgaacaaagtgacagggccaaggcaacaatttatcattcaattaattaattatttttaatttgatttcaaatg

SEQ ID NO: 102897 - DNA, 583 bp, Heterodera glycines
  Promoter: Source sequence=SeqID_14894; Location=1..583; Strand=+; Gene=SeqID_79057
atgattagggctgctaattttatgtaaatacatattttttcctggattctccatagcctaattaataggaaaaacactttcttttttgtgtttgcgaacaaaagttgggacttttatttacatattttgggatttttctacatatcacatatgtacatatttttatacatattttggactttttcgtacatatttcgcaatttttcgtacatatttttcattttttttacatattttgaggatttttgagaatttatagaaattttttgtaaaaaattaaaatttttttttgaaaatgtacgattttttttcaaaaaatgatatatcaaaaattaatttgtaaaaaatattcaaatgtgattctaagcctattttggtcatttttatggcattttgtgcctatttcactttttacgaagaatttttttccaaaaaataaccattaaaaaaattttatttacatattttcctacatatttgaggatttttgtacatatttcatacatattttagcattttttatacatattttatttacataattcgcaaattttcttacataaaattagcagccctacttatg

SEQ ID NO: 102898 - DNA, 82 bp, Heterodera glycines
  Promoter: Source sequence=SeqID_3938; Location=1..82; Strand=+; Gene =SeqID_52531
aacagcctatggtacgacgcttttttgatgaatttttcatttccaccccaaatgaatgcaatttaggggaaaattcagcatg

SEQ ID NO: 102899 - DNA, 628 bp, Heterodera glycines
  Promoter: Source sequence=SeqID_22144; Location=1898..2525; Strand=+; Gene=SeqID_52799
gcggaattgggtcgattttgttaagttggcgatgtgattttgcaaatggcattcacattcggagatgatagtagcccgggcaaagcaaatcaattcatctgccgaaatttcatacacgaggtaacaaatttatgttggcaaatggtggccaaaaaattgttaattaaaatttgattaattattatttatatatttatttcggtcgaatgattgagtaccgatgatgaaaggctgtttaataaaaattcacgaaattattttcatacaaattttaatcagaacataaggcataaagaccatatttttgggtcgaaaatctgaacattttgcgaaacgccgcagggaaaatttgagtgtgatttgttaacagattttgtcaaaaaatgaccaaattttgcgttaaactttaaaatttatagataaaacattataatattattattcggtccataattttttttttcaaattgagcccaattttattaaagcttaattttcatgaaatttcctcttctgctgacggaatcgaactcatcattcaattttcattgcctttttaataaataattttaacactttttaatttttatgaatgttttatacggcatttttaatagagaaaggaatg

SEQ ID NO: 102900 - DNA, 158 bp, Heterodera glycines
  Promoter: Source sequence=SeqID_21273; Location=1..158; Strand=+; Gene=SeqID_51866
aagcgcattaaacaaattgaaatttatgtggaaaacctactacatcatcgagaaattacccgtctcaagccaaaagctatatgctctcatttatattcaccgcgcaaaaagaagtggcactttttatggcacagaatgaaaatggaggggaaaaaatg

SEQ ID NO: 102901 - DNA, 54 bp, Heterodera glycines
  Promoter: Source sequence=SeqID_26354; Location=313..366; Strand=+; Gene=SeqID_57096
atggagcattctcaaagctactcattctttttcatcattcattttacaaaaatg

SEQ ID NO: 102902 - DNA, 1003 bp, Heterodera glycines
  Promoter: Source sequence=SeqID_12315; Location=1371..2373; Strand=+; Gene=SeqID_75911
tgtcccaattaatatttgtttaaatgctcgaatgttaaataacaaatcgtgtatcctaatttaacataaaatgaaaattatttcaatattttacttatcgcataaatattatatagtgataattttgaatatctgttttcgttcaaaataaaaattctattaaaatattttaagaagtttatcgtttgtgtggttaaaattaatctgccaaaattaatactcgctacaaaattctattttttggtatttcccttaaaatgagaaatttaaatttttttatgaaagtcttgaaaaatccgtaatacataaataaatacaaaaaatagcatttttacatttctcttaaataagcacacgctcactctgatcaaaacttattttttttttaatatttatctattaaaattttaaacaatttttttgtatgtataaaacccaaacaatccaaaaaaaatactttcatttattcactaaaattgtatgatcagcacatttcaccatgataaagattgaacaaaaagagcgaaatgagaactcacatcagcagtttatcaaacgggtgaagaaattgggacaaatccaactggataaatgagcgtatattcaaatcaaaatattatcaaaaatgatcaaaataccaaagaacaaataaatgatcaacaaaaaagaaaaacagttcaaaaatttgaagcaattaaagaaaaattgaatcaaaatagaaaatataatcggagaaacagtgtcaaaattgagagaaaaatttaaacgcggcatatgaaaaagatgcatttatttttattaaaataataaaaagaaaatccattaattgcaggaaattggtcggatatatttgccaaccaaaaaattattgactttttaaagaataatttttttcaaaagcctcattatttaaaaattttaatttcctttttattatagaaaagaaatgtattttttattaaaataaatatagttttatatttttatttttatatttgaaatg

SEQ ID NO: 102903 - DNA, 734 bp, Heterodera glycines
  Promoter: Source sequence=SeqID_42631; Location=1..734; Strand=+; Gene=SeqID_70481
atatgatgtaattaaagctaatatttctaatccaactcaaaaacatatctaaaccagggatgggccaaattgataaataaaaagcgaaatgcgaaaagcgaaatttgcgaaactgaaaaatgcgaaatgaaaaaaaaagcgaaatgcgaaaagccaaaatatgcgaaaatgcgaaaagcgaaatgcgaaaagccaaaatatgcgaaaatgcgaaaagcgaaattttttctacaactttttaatagttaaaatcataaagcaaaaatcattttttaaaattttattccaaatttaaaaatcaataaaacgcttttttgaggcgcgctttttccaaaaaaactttttgggaagagggggcaggcggcgccgggaaaatttttgaaaatttgattaaaatttgttgacagattttcactaaaaaatgattaaattttgtgatttttatcatttttctaatgagaaataagagttttggcgcgccgctgagaacagtttttcatcaaattaccaaattttgcgattttgggccattttctaagaaaaaataggagttttgggggcgcggcggtgccgataggcgccgccggggaaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatg

SEQ ID NO: 102904 - DNA, 61 bp, Heterodera glycines
  Promoter: Source sequence=SeqID_15162; Location=1153..1213; Strand=-; Gene=SeqID_79360
ggtgcgtcaattttctaaattacctaattacagttaataaattttttagctctctccaatg

SEQ ID NO: 102905 - DNA, 65 bp, Heterodera glycines
  Promoter: Source sequence=SeqID_43874; Location=394..458; Strand=+; Gene=SeqID_71453
tgtttgttattttttgtcgaatagttttgaaaattatgtaagttcagaatttcgccgaacggatg

SEQ ID NO: 102906 - DNA, 155 bp, Heterodera glycines
  Promoter: Source sequence=SeqID_27400; Location=559..713; Strand=-; Gene=SeqID_58092
ttatgaaagttgtaatactgaaaagttaattaaatcgtgtctaggaagttaataggctatatataattttataatttatttattaattatcttttgatttttaattttaaaattttccttcattaaaagaaaaaaacaaattattcttgacaatg

SEQ ID NO: 102907 - DNA, 118 bp, Heterodera glycines
  Promoter: Source sequence=SeqID_31236; Location=1..118; Strand=+; Gene=SeqID_61610
cactagagaccggaaatttcaaatttgcggatcccgctgcgggattggaactcaaaattctttgcgggacgggatcccgcgggattaatcccgcaaatcccgcattttccaaaaaatg

SEQ ID NO: 102908 - DNA, 324 bp, Heterodera glycines
  Promoter: Source sequence=SeqID_3508; Location=1223..1546; Strand=-; Gene=SeqID_84959
aattcaataatttgcataaaaatagtgaatttttaaaaccaatcaactacgatggattttttaatactcggccattttccataccaaataaaactttccgactgctggcgtacagaaaggaggtttttatgtgaaatttgctatatttgatttttccatttttgccgctgtcccatttagacacttatccgtccgctcggatgagcggcgttcgtccatcccctctaaacgctgcttcatcgtcgtccaattgcaccagtcaaatgctgcctttgccccctccccaccatccctcctcccattcggccacttcaatggcaaatg

SEQ ID NO: 102909 - DNA, 545 bp, Heterodera glycines
  Promoter: Source sequence=SeqID_893; Location=492..1036; Strand=+; Gene=SeqID_63417
aaatggcactttaatgaactgtttagcattttgttggcatacatttatggcattttccattggatttagcacaatccatttggcattcggacattttctctcattggcgccctctcccgtgacaaaattttgaaaaaacaaaatttttttctaaattccttaaaggtttttttcaaaaaaaaaaaatttaagtaggtagaaaagatttaatataattaaaaaattttctttcaaaaatgaaagcaaattaagcggggatttgcccatcattggatggcattcgatttccggaaaatctttggggtcgggtttctgaaaaatctttgaccttggaattcgatttccgaaaaatctttgacatcggggtcccgatttccggaaaatttttggacctcggaatgccaaccttggatgattaaacagtgatttaccaattatttttggggccattaaattgaccatggattatgccaatgtgccaatttcagttggtatttgtgccaacattttgaatggatttaggtgggctggggctgcacccaatg

SEQ ID NO: 102910 - DNA, 599 bp, Heterodera glycines
  Promoter: Source sequence=SeqID_14853; Location=1..599; Strand=+; Gene=SeqID_79003
aatcccatgatcggcattggcatccgcggcactcgtcggcacaaggcgtctttagtcagccgatttgtcgaaggaaattggatcatcagacactcatcagccattagcaaattttcatgtgatttggcccagaagtgtgcgcaactctctaacggaagcaaatgaaaatttttagaaagaaaccaaataaataaataaaaaagaacagcgaaatagcagtaaaatgaggagagcgagagagatagaagcgagagacagcgagttaaaaagagagagagagagagaaaagagagtaagcatcaaaattactcatacatttcaaaaaatcaatccatttaatattattaaaattgctttttttaataaaagtgcaacaaattaaaagtgcgaaaattgatcagcaacgaaagcccagcggaaatcggtggaaatttaataaattgtgggagggaagttgcgaaaatggaaatgttcacatgaattccccaagcttagctgatttttgcagagccaagacaatataaaagtcgggaaatctgaaggaaaaatcacttattaaatttaatttaataaaacaaaattttaaaaaatcgaaaatg

SEQ ID NO: 102911 - DNA, 92 bp, Heterodera glycines
  Promoter: Source sequence=SeqID_7780; Location=1..92; Strand=+; Gene =SeqID_65937
aatcgatcagtgcgcttttgctggcgctcgaccactcattgaccatccctttttcttggtccaaatcaccgcttccgatcttttggccaatg

SEQ ID NO: 102912 - DNA, 390 bp, Heterodera glycines
  misc_feature (26)..(26): n is a, c, g, or t
  Promoter: Source sequence=SeqID_1748; Location=1..390; Strand=+; Gene= SeqID_75676
aaattggtgacagatattaaaaatanttgatttaaatttccttaatttaaaagaaaattaaaagaaaataatttaaatatatattaaaattaaatttggtccaaaattttcattaaattcttctccactttgccttttcttcttcttcttatgcttctaccgttcattgaatacgaaccatcatcattgcccggagaaggaatttggtcaaaaaacctttaaataaaaatataaaaattaattaataatttaacacaaaatttgtcgattaattattattgagcaataaataacaatttggcaaaattcaatgttatttttccataattaattaatcattctcattatcattatgtaccaaatgcaattgttgagcaggtaatgaaaatg

SEQ ID NO: 102913 - DNA, 707 bp, Heterodera glycines
  Promoter: Source sequence=SeqID_28367; Location=210..916; Strand=-; Gene=SeqID_58999
tatttaattattattaaaatttagccgaataaaatattgaaaaattttttatatttaaaatttttgaaaaattccgactgccgacatttttggggtcggaattccacttccgacttacgaaaaattattgggccttggaattccgacttcctacttacgaaaatttttggtgcctcggaattccatccttgatatgtacgccagcaaagtctatgaaaatattcgtgaccaagataaagcggatttttctcctaaattattaattaatctaaaattcagggcctttaaagataaatttgtaaaatttattttatgaaagtgtatataatgacgacaacaaatgccaacaatgagcagtggatggtaatattgccagcattcaatatgagaaaattatatgtgtataaccaaaagcaattggacgaattcatcagcaagcataaaaacccaatttacaataaaaatggcaatttgtaaaaatagtaataaaatcctattcctcattattttatccaaaaaaaactcactttcttctgcgaatgaataaataatccttattaatattattttttgattatttgtgatattttattggcaaataaaagctgtgcctttaaaggcaaaatttgatttccaattttattttaatagttactttaggtttaatttagcaattttcgaagccaatttaagaatagtgactaatg

SEQ ID NO: 102914 - DNA, 142 bp, Heterodera glycines
  Promoter: Source sequence=SeqID_15378; Location=783..924; Strand=-; Gene=SeqID_79635
catcaattcgtccaaaaatgaaaaaaattggagagaagataaaaaagggcggtgaccatacaattaagtatagcgaagaacagaaattacaattggaaattgaggaagatgacgacaatttgtaaaagatgacgattctatg

SEQ ID NO: 102915 - DNA, 746 bp, Heterodera glycines
  Promoter: Source sequence=SeqID_23448; Location=1..746; Strand=+; Gene=SeqID_54156
atatcgattctcgccctccacgagccgctccaccaacctttccaacttttcgagccgttcgatgattgggttcagtgtgggattccctgaaccttctaacaacttttcaagccggtcaagacgggcgagaatgtcctctccctcatttaatacttttcaaaaaattaaatttttgtaaaaataagtttcaaaaaaatttttttttactgatcaaaaggagtttgccgcaataaattcaacaatttattttaaaatttttttgaaaagaatatcgattttttcatttctttttcttaccattatattgcagaacgaacggcattcaatttatttaaggattgaatttatacaggaaccaatggcgccgccggccccatgttcccaaaaagtttttcggaaaaagcacaacgcgaaaaaaatacatttttattgattttttctcatttggaataaaaattttaaatgctgaattttttgtcggtcaaatgctgcttttgaacattttcaattggtaaccctggccttaaaatcagcttctttttctacctactttacgattttgattatttttttgctcaattgtgaattaaggcttatataaaattgggcagcaatgaacgaatttgcacgtcactgaattattgaattccaataaaatggatgccattgcgttttccattgctatttcatattacattaatgctaaaataaaacaacaatttctccattttttttaaataccaatg

SEQ ID NO: 102916 - DNA, 70 bp, Heterodera glycines
  Promoter: Source sequence=SeqID_35347; Location=594..663; Strand=-; Gene=SeqID_64920
tcataacagaacgccaatttctgtgtgttttttgtttctttgggaattccaatttcagtgtttgaatatg

SEQ ID NO: 102917 - DNA, 197 bp, Heterodera glycines
  Promoter: Source sequence=SeqID_28545; Location=268..464; Strand=+; Gene=SeqID_59150
attcctttccacctgctaaattaaaatcttcgtttcggaataatgttattcaaaaatatctacttgtaacaatgtagtttttaatatcaaagattgtatatatccttcattttatttttgaaccgtaaacacacacattaatagctttatttttgaaaaataggaattcaaccgcgaaactgaaaacgtcttccatg

SEQ ID NO: 102918 - DNA, 158 bp, Heterodera glycines
  Promoter: Source sequence=SeqID_1040; Location=2052..2209; Strand=-; Gene=SeqID_66723
tagagaaatagcatttcagcttgacaatgaggtactgatgattgaccaaatatcagcacgtttatcaaagttaaatgtactgagggacgacaatttggaatggaatataaaccctattccacaaatcccaaatcatcgcatttcatcatttagttatg

SEQ ID NO: 102919 - DNA, 123 bp, Heterodera glycines
  misc_feature (20)..(20): n is a, c, g, or t
  Promoter: Source sequence=SeqID_45013; Location=1..123; Strand=+; Gene=SeqID_72405
tttttcgggtttttagggcnatatttgggggatttttacctcctatgttatgcacatatttgacatttttagtgcatacaccttataaccctaatgattacagtagatttaagaggggaaatg

SEQ ID NO: 102920 - DNA, 919 bp, Heterodera glycines
  Promoter: Source sequence=SeqID_19906; Location=1..919; Strand=+; Gene=SeqID_84665
agatacgcccttgtcacgaataacaaagatagttgattaaattaaattgaactttaaaagcctttgtttaatttattattaaataaacaattaataataaattaattaatgtgcttaatggagaaagcttataagacacatgtttgaatttattttcattttgaatatgagggatagctcgattgattcgtttgcatttttcttcttaggctcatgtgcttagtgtatattaaatcgacagatgtccaaaaaaaatagcatacacaccgaaagttttaacgaatgtacaagccaatttaaatggtaaaagatgaagaaggcagataatggcatagagaaatgtgtacaagccaatgagggctagaaagtgaaaaaaagaaagtttacaaaataaggagtgaaggaacagattatagtgtacaagcaaaagagtttggaaaggagataaagagaagaagaaataaaatgatggatagtgcattattatgtagatagacggcttaagagaaaatggaggtcaaacaaattgatcatgttaagtcatttttgaaaatttattaaatcacaatcaaaagttttaatgaatgtgcaagccaatttaaatggtaaaaggatgaataagatggagaatggcataaagaaatagtgtacaagccaatgagggcagaaagaggaaaaagaaagttgacaaatcaaggagtaaaggcaaagattaagtgtacaagttgaagactttggtaagcagctataaagagaggaagaaataaagtaatggatgatagccctatattgtgtatatagacggattaagagaaattgaggtcaaacaattgaccatctgaagtcatttttgcaaattgtaaattccatttttgtttaatttaaattggtaattttaattaatttttagtaaaacatg

SEQ ID NO: 102921 - DNA, 79 bp, Heterodera glycines
  misc_feature (17)..(17): n is a, c, g, or t
  Promoter: Source sequence=SeqID_26675; Location=1..79; Strand=+; Gene= SeqID_57434
agtaaataatacacaanaaaaagaataaaattaatataaattatgaaatattaatgaatacaaatttcagttggttatg

SEQ ID NO: 102922 - DNA, 637 bp, Heterodera glycines
  Promoter: Source sequence=SeqID_21565; Location=196..832; Strand=+; Gene=SeqID_52177
ttcccgcactgcgtttgccaaagctaaatttgatacatttgtattggtgcttatggcattaataatggacaatgaaaaacaggaaagtataagaaaaagttgcgttataacaaggaaggggtgttggactttcctgttttgtcatattttccggcccacttcagtgatatcctttctatatgctttttctgtcttgcagtaacatttgcaaattgtcaacccactgacgatagtcggctcttccgtggctccccccccccgcctcttttggcgccccttttcccattgtacacggttttcatttttatgttttttcttcttttttccataaataattttgcctttttctttagtccacacataaggaagagcgtcttttattatttatatttttgcagccttttctatgaataatcggtcagatggcgatcagattggacggggtttaatttatgtgcaatgactgacagatagaaatgaaaaagggaggcgatcaatagacagaaacagacaaacgatcattcactctcatcaaagggtgggaggatattaaaagagggacaaatttgtaatcgggcggaacagcagcaaaaaaaaaaaaatgggaaattgaaatggagaagcgttttttgggatg

SEQ ID NO: 102923 - DNA, 486 bp, Heterodera glycines
  Promoter: Source sequence=SeqID_25544; Location=1672..2157; Strand=-; Gene=SeqID_56288
gtcaattgtaaactaaaattattatttcctgtcaatccgtcgatgattcattttttatcacaaaaatccactggctaaaaatgaaatcttttcactttacacattttgttaacatattaaacaataaaatttatccattaataaaatctaatgaatattttcttggtcaattattttatttttctgatttttgttcatcattttattgtttcaaatggcacaaagtattttcattaaaataagaaaataatttacttaaattttaagaaatgtttcgttggatttagcaaaatttggtcctttaaaagtgaaatttgaacttcatggagaatgttcaaggtctttaattgttgttaattaaaaggcacattaattatttattgctaatgaattgactaattaagccttttgttgtgctactatagcgcattttatggtaaaaattttccatggaaattgtcgaaaagattcaaattcaacaaaatg

SEQ ID NO: 102924 - DNA, 201 bp, Heterodera glycines
  Promoter: Source sequence=SeqID_10796; Location=540..740; Strand=+; Gene=SeqID_74059
tctgcaaattttaatgatcatcagtaagaattactgcaattttaacgaatttattcgaaattgatgctgaaattttagaaaaatgatatttgcttaactgtcgcaattttaacgcattggaaattctcatataaaaggcgagtaaaagaaatggatgcatcattcaataattcactaggaatttaatttttttcagaaatg

SEQ ID NO: 102925 - DNA, 111 bp, Heterodera glycines
  Promoter: Source sequence=SeqID_2441; Location=512..622; Strand=+; Gene=SeqID_79733
tttttaaaagtatctcctgcaaaatatgtaaatcaagcaaacaaaaacgggagggaaaagaatgggtaggcaaatgaaagtgttgtgttaatttttgtccattgcaaaatg

SEQ ID NO: 102926 - DNA, 580 bp, Heterodera glycines
  misc_feature (28)..(28): n is a, c, g, or t
  Promoter: Source sequence=SeqID_23627; Location=1109..1688; Strand=-; Gene=SeqID_54326
aaaaatgattattgcaaaaatgattttntgttacaaattttatgaccaaagggtattataatatgtggccgaccaagcaaatgaatgggcagggaaattaattgttatgtggccaaaaccataatccaaaacacaacaatgaagtagggtttcaagggcccgatccgggtattgccgggtccagaaaagccgagtccggggtccaagtttttaaaccgagtccgggtccggaaatcgtcttcaatcagaccctaacaaattactcatttttttcaaaaaaataatgaaatatttcactaaatatttaatttatattttagattaattcaatgagcaaccaaaaatattttaagatttagtaaaatatcaataaaattttcaattttacaaagtggggcacatgaattgaagagcattttcgtaaaaattgaaaaaaaatagaatttatgcacaatgaaatgaccatctgtgattatggagcaatataccgttattaggtgcgcttttttgcaagccaaccgaagaaagaatttgtgccagatggttttggtaaaagtataaaaaaaaaacataaaaaatg

SEQ ID NO: 102927 - DNA, 818 bp, Heterodera glycines
  Promoter: Source sequence=SeqID_2150; Location=3630..4447; Strand=-; Gene=SeqID_78096
aatataaattaatattcggatgaggaaaaacgtgaaatattaaaacaatttgattaaataaatgacaaattaagaaataatcacccactctataattcatgcttgcctttttcataaaaaattggaaattctttaatgcgattttttagttttatttttattccgtatccgcttattataatctttatttttacgcacccgagggcaactgggtggatggagattaaattatattgtgttatacaaaataagactgctctcattttaataaatacatagaaaaatattaggtcttattgagttattagcataaaatgatgagaattaggcacataaaaatgccgaaaaaggcatttaaaaaaaggcggctaggcatcaaacacaaaaaatgtaaaaataggcaaaaatatgcattataaaacttatccaagaagctttaagccaagctaaaagccctcttttttgtgcttattgttatgttcaatggtgaacacaacgaagaataaaaatagtttatttgtcggaggcaaaagaataaataataaaattggtgtgtcggtggatgaagaataaatgaataataaaatgatgtgttgaatgaatggaagaagaagcaattgagtgacaaagtgatgggtatttatggacgatgctgcgagatgagtattgacacgaaattgagtacagtaaatggcgtacatttgaatattgagtgatatacacaacacctccccctttaagttggaatgtaatgagagaaaaaaaatgggttggtgagtgaatcaatcaatttgtgtaatcatatcgtgcttttgatg

SEQ ID NO: 102928 - DNA, 160 bp, Heterodera glycines
  Promoter: Source sequence=SeqID_13189; Location=2380..2539; Strand=-; Gene=SeqID_77012
ttccaatcactgggactcaatccaccggcattccaatcagtgggactcaacccaccaacattccaatcaacaggactcaaccctccagcattcaatcactgggactcaacccaccaacattccaatcaacaggactcaatccaccatcatttaatcaatg

SEQ ID NO: 102929 - DNA, 966 bp, Heterodera glycines
  Promoter: Source sequence=SeqID_15647; Location=1..966; Strand=+; Gene=SeqID_79942
ttctaattttacaaaaaaatctagaaaaattgtcataaatttagttagactagcttaatacgaaaaaaattcaaataaaaaatttctatcaagaaaattcaaggaaatttaaaaaaatttttcaagttttttgagttttttccggaaattccggaaatttagtttttattaacacttagattttcaaaaagctaaaatacttttaagttttcttgaaatttagaaaagttttaatttttttttttttgcggcgacgttatgtcccggcgacgttttggggtgtactctcttttccggtcttacatattaccctagtgaagttttaagttttgttttaaattgatttttaaagaatttgtttttattagttctttgtcgcgttgattccataattttgttaccctccctcccagcaaaggaaattgttgtgtctgaccaacacttataccaaaactagagcaaattaggattgggttttttggacaaagtttatttagacaaaaataagttaaattggttaatgatcgatttagcaaaatgtggtatgtcaaaatgtgaatgaaaaactgagaagagaagaaaaaatcccaaatggtgtccaatgagctgcttatatacgggtcgggagcagatcgggaaaagggttttaggagagaaaacacaagaaacaaaaaggttaagacgaagaatagtcggcacatcaaaaaaagacaaagagaatgtttttgggaaatgccagaggggatgggcgaagggattagtttgggataacaaattcaacatcaaagggaagaaagagagaagagcattgtaaagggaataaattggggaaaaagtccaaaagcaaaatgccgatcaaaacaaggcaaaacggattcaacagaaatgaattttttgcctagtttatattttgtgttaacaataagtctgtaaatactttttttccaaattttccagttgatgatg

SEQ ID NO: 102930 - DNA, 145 bp, Heterodera glycines
  Promoter: Source sequence=SeqID_31551; Location=346..490; Strand=-; Gene=SeqID_61880
tcgttggagtaattccgcctgaattatattttcaaataatatttgaaacttatgctgatttaaaaaaaattaccaattccaaacgtaggaatcaaaaggatttttgctgccagacgaagctcaatgaaattctgtccagaaaatg

SEQ ID NO: 102931 - DNA, 398 bp, Heterodera glycines
  Promoter: Source sequence=SeqID_3451; Location=1881..2278; Strand=-; Gene=SeqID_84730
aatggacaatccgtcatggataatccgtcagtggacaattcgtcagaaaaattttttggcaatgattaaaaatcttgcaaaaatgattcttaaatttaataaatataatttttataaatttttaacattttagttgctttgtacttcaatcaatggaccttctcgagaaattatatttaattcttttaaaaatgcttatttatttataattttttaaaataactcaaattattaatttaggtttttagtgacttattaattttcacatgattttaaatagatctgcgtatttaaaaaataaatttgcttatggattagttactgacggattattatccactgacggattgtccacttactgacggattgtccgctgacggattgaccactgacggatg

SEQ ID NO: 102932 - DNA, 390 bp, Heterodera glycines
  Promoter: Source sequence=SeqID_12009; Location=1586..1975; Strand=-; Gene=SeqID_75535
aaaaacaatagtatttcatcattagaattttgaacatttctagtaataattttttaaattttttttcttaaaattcttatataaaattttctaaaattctttttgttttcgaaattacaaaaaaatttctgggtaatccggttctataagcctattgatgcaaatggattgaatatttaaattctcaaaggatataaatcgaaaatagtgattaatttcaaattaatttatatattttcgtatatttatatatatatttttttaatatttgaagtttaaaaaaaatatatattatcgtttaattaagtgtttcgcttgcacattctggccagtactcggtggaagcacaaaacaaagtgggccaagcacactcatcggcaacattgaatg

SEQ ID NO: 102933 - DNA, 140 bp, Heterodera glycines
  Promoter: Source sequence=SeqID_9563; Location=1852..1991; Strand=-; Gene=SeqID_71895
actcaaaaagcaattaaacattaattaattaataaataattgctgtttttcaattattttattacccttttgcggtcgttgttttgttttccttttgctccgactttttttggcgttgtccgatgtttttccacacaatg

SEQ ID NO: 102934 - DNA, 279 bp, Heterodera glycines
  Promoter: Source sequence=SeqID_21760; Location=2099..2377; Strand=-; Gene=SeqID_52356
gtcatggggaaatcattgggcacaaaagagaaagacgatctgctgaagccctcctcgggacttcctaatgaatagcgcatttttaaccaccaaccacctcgccactaaccgtgaaataatcttcgatggattatcacgtagtggcgcagaaagaacgaacatttatctggattcaccgtcctcagacattatgaggaacagggaataactatcaatcttcttgtaccattggtacaagaatgtggggggtttagtccccgccgtggcgaaattcacatg

SEQ ID NO: 102935 - DNA, 144 bp, Heterodera glycines
  Promoter: Source sequence=SeqID_3999; Location=5191..5334; Strand=-; Gene=SeqID_52760
cagacccgaagtaaaacaaaatctaaacaaaattcatttccatcttcacatctatatggaataacctttttatcaagctttcttatgctttgttcattgagaatgtccttagcgaaaattttaagaacttcttttagaaaaatg

SEQ ID NO: 102936 - DNA, 584 bp, Heterodera glycines
  Promoter: Source sequence=SeqID_504; Location=658..1241; Strand=+; Gene=SeqID_54655
gttctaccagacctccaacaatttcttcaaataaaatatccctcaaactttctctaaaaattttactcaaaaaaatttttttttccctcttctacaacccctaaaaacaacaattttccctttgttggaggtctgacttttctaatttctgcttctccattcaaaatttcaattcttttatcactactttccatttcacctcatttccgccaaaagtgtaagtggcacatgcccttcttttggttatttttattttgaataaataaataaatattagaaaggaaatttacttcattttcaactattttttaaaagaggccataagggggattactcggaattctgatttatgacattttagggtcaaattccgatttttgggtgttgttttgaaaaaaaagaaaaaactaattatcttgctaaacaaatttttttaaataaaattttatatgcaaatcattttttaaacactttgacgaatatattgttggaaatgtatatgttaaaaaaaggtgagcgttttcgtaagttatggatgatgtgagagatggacgtaatgcacaaagaaaacggtagaaaaaatg

SEQ ID NO: 102937 - DNA, 184 bp, Heterodera glycines
  Promoter: Source sequence=SeqID_33342; Location=1423..1606; Strand=-; Gene=SeqID_63434
aaaaataagaaataaatttaagaaaaattgatcaatctattcctaaaatcctgactaattttaaattttttcaaaattatcataaaatataaatgaaaaatttagggctgttgtttggataaattactcagcagatgaatgcgcttcacattttatgcggcacggcatttgtgtgtttggcatg

SEQ ID NO: 102938 - DNA, 591 bp, Heterodera glycines
  Promoter: Source sequence=SeqID_1277; Location=2977..3567; Strand=+; Gene=SeqID_71322
atctttactttgtacgggagatatgagcgacaaaaacatggatttttggacccaaagactttaatcatacaccccaatgcgcgggaggcgaattgcaaggaatttcgctatttgtatactcaaacacggggaatagtcacacaatatgaccaagtgacaggggaaatgcacgaattaccacctgattctgtgcattatctctccagacacgggaagattgacttcccagaaataccaatacatttttttagaaataaagtacttgccaatttatccgagctatattccccggaaaattttgaagaaacgatcgaagtggcgaaggttgtgcaggaaattgcaagactctcgcggccaaacgcctgggaaattgtctcagagaaaaatgatcaaatggccacaaatatagtctcgaatggcttattttcatttttaagagggggaataatttcagctaatcaattatgggtttttctttgttgctgctatataacggtgacagtattaattcagtgcttcctaccagcaccaattgcacaggccatacagtatttgggcttaggtggtcttattttaaatggcttaagaatg

SEQ ID NO: 102939 - DNA, 127 bp, Heterodera glycines
  Promoter: Source sequence=SeqID_25935; Location=1..127; Strand=+; Gene=SeqID_56698
gctttttttttcaataaatggaggggaataaaatttttaattcctttttaactttgggaaaaagtttcaaacgaacttttgaaaaaatcgattttttgtttcataaatattttttcagaaagtcatg

SEQ ID NO: 102940 - DNA, 1003 bp, Heterodera glycines
  Promoter: Source sequence=SeqID_2556; Location=2931..3933; Strand=+; Gene=SeqID_80406
ttggacgcgtgcgtgtgtgtgggagaaggagggagtgggaaaaaaagagagtaaattgcaatggaaaagaaaagagagcaaaagaaaggaaagggagagataatgggaaatttgtctcgcatcccttccttatttataacccatcttttattatataaaataattaataaaataatgagcacatttttgtgtttgtttgagtggaaaatccggtatatgaagtttctgtttttgtgtgtaagaaaaaatttgtggttttgctgttattattattttttgtctaaattttcgtttttgttaattgatttccattttgatgtgaaagctttttgttttgcttatgtaaacgataatggagaattgtttgattaaaaaaatacattagaattcgtttgaatgaaaaaggtttgttacttaaaaaagttttttgtacttttccttgcttataatatgaaaagaatctgatttggtttttgatatttgttttgaataaaaagcatgttatgatagtaataaaaaatgaaagaaaaatcctttgatggatagaaaaagcaatataaatgtacaccatagtgttttgatttatgggttatatttcaatttctggattccttttaaatagttctgtattccgttgctgaggttgttttccggtgattgaaatgtcggagaactgagtcccggtaattgtgttgctgaaggattgtcccggcgattggaatgttggtgggttgagtccccccccccccccctccattccatccttttgcttcatcattttccaatcggggggataataattgggaagcaatgagttggccaaaatcaaaaatccattcagtctctgtcattttatgggccagctaattaaatttggatttatctgtttaagcattgtactttactttactttttatttttgcattttcttttgacaaaaccattttaaaaaagtttttcattggtttcacataaaatttgcaattttttaaaatttcagatg

SEQ ID NO: 102941 - DNA, 261 bp, Heterodera glycines
  Promoter: Source sequence=SeqID_11547; Location=1..261; Strand=+; Gene=SeqID_74983
gttaaatgattaaagtgtaaaatgttcaaatatatccgcaaaaaaaaaaaatcattgatatgataaagcgtttaatgatttaaattttggcaattttgaattgcatgaaacatagagttcaccaaaatattagcggttggcgtgggatttggttaaaaattcatttctttttaaatatttacagaaaaaaccagttttcatacagaatttttagcgtaagtttttgcatttgtatatttgcaaaaatcgggggggccaatg

SEQ ID NO: 102942 - DNA, 500 bp, Heterodera glycines
  misc_feature (36)..(36): n is a, c, g, or t
  Promoter: Source sequence=SeqID_12235; Location=1..500; Strand=+; Gene=SeqID_75807
caaaagctaataatgatgatgaagggtcggtcatcncatcaaaagatatgagacggacattgtttttgagtagttggaatgagttgtatataatgcatggtggatggagtatgacgagaggaatatgttacgggtaggaagaataatattttggtatggtgggtataaatgtaaatagaaagcataggaatatgctacagttcaaaagtgctacttagctaaaaaaaattacggtagtaaggttaaacacattgtacaaatcttatcagttgagaaagcatggcatatttaataagtgattttgcggtaagaccattccatggccataaatttgaggacacacgacaaaattaaacaaacggaaagaattaatcacggtcattattaacatttcatatatgattatcatcaaaatttgtgtgctaccgcaaaaattctttcttttggatgataagactgacagacagcgaaagattattttgtgagggcaactcaaaatg

SEQ ID NO: 102943 - DNA, 293 bp, Heterodera glycines
  Promoter: Source sequence=SeqID_6367; Location=1215..1507; Strand=-; Gene=SeqID_61280
aaaaaagccattaagatagaaaaggccgaacggaaccgatcccttttctcgcaacagattctatgcaatggtacttgagaggcgaacattttgcaacgcgagaattaagctcgagactcaagagccaaaaaatcagagaatttctcgtcggactttatttagacaaagaaattcttgcccacattttggatgaaagcaattccaatcatattcatgtcattgataattttccaaattaaattttaaattattgaaaaaatatataaataaaaaatgcaaattcctcacatatg

SEQ ID NO: 102944 - DNA, 71 bp, Heterodera glycines
  Promoter: Source sequence=SeqID_217; Location=6827..6897; Strand=-; Gene=SeqID_77994
gtaccatcgaacggcgtggggatgtgttaactgtttgccacttaggtgcaaagcagtacgcctttcgtatg

SEQ ID NO: 102945 - DNA, 205 bp, Heterodera glycines
  Promoter: Source sequence=SeqID_20365; Location=1..205; Strand=+; Gene=SeqID_50884
tgtttcttacattctctactacatattcctgccgcttatttggctcttcaattgtatgcacaattggagcaagccaatcaaaacaactccatactcaaaacgctgtggcctcaacagttcgctgattgggcctcgggttcgtttttattttggtattttatttgactttgttttgtctaaggaccgaactcccgagtttaatatg

SEQ ID NO: 102946 - DNA, 136 bp, Heterodera glycines
  Promoter: Source sequence=SeqID_22832; Location=567..702; Strand=-; Gene=SeqID_53539
attaaatttgccttaaataaaatattaaccggacgactttgatttttttaaaatgttttaaagttcaattacaaatggactaaattaaaaaatgaacttaaattgaataaaaaatgataatatttatacagaaatg

SEQ ID NO: 102947 - DNA, 192 bp, Heterodera glycines
  misc_feature (85)..(85): n is a, c, g, or t
  Promoter: Source sequence=SeqID_40425; Location=1009..1200; Strand=-; Gene=SeqID_68767
tttttttacaaattgagccaaaaccgcatatttgtcattgtttggtgaaaatatgttaacaaattcactcaaattttcaaaaatntagctgagagttatttttgaaaaatgcgtaaattgcttagcagaaatttaaaaaaaaattggaaaaaattcattccggtgaaaactacaaagcgagtttttcccatg

SEQ ID NO: 102948 - DNA, 1003 bp, Heterodera glycines
  Promoter: Source sequence=SeqID_983; Location=825..1827; Strand=-; Gene=SeqID_65464
atacaatttttttcttttataaaaatggaaattttgctcaaaaaatcgaatattttttgctagtaatttgaaaaatctttgttagtttaatttttgtaaattttattgaaaagaatttttacacaattttctagcaaataatattttatttgaaaattaaaaaagggtattttttctagagaccgagccggaccggatccggtaccggattttcctggatcaggaatcaggtccggcaattttttgtaaaaatagggattgaccggattacatagattgaccggattatgagagaccggatcccgaatccggttgtttttgaaaatgccaatccggtccggtccggcgaattcatgaccggatccggtcctgctctgtctcaactcaaaatccttcacttttgttcatttttctttgaaaaatatcttttagccataatgtctttaactttaaatggtcaaattttcaaatttttcccccggcggagcctatcggcaccgccggcgggcctccaaaatttttttctttttaaaaaattggcccaaaaaagcaaaaaatggtcatttttggtgaaaatcagataacaaattgcatcaaattttcaaaaattttcccggcggcgcctgtcggcaccgccggccccattaccgaagtttttttttgtgataagggcgccgcaaaaaaacattcttattatttttccattaaacataggttttcaaaaataaaaaactttaaatttttttaaattttttcttgaaattttatttttattttttcggcgcattgttttttccatggcgacattttctggtgcacgaattttacatataattgatgaaattttgcgggttttttccctaaattaacattgaaatctaaatttttaccaatacggaatccggttacggatccggctatttgaaaaatagggattgaccggattaccggattgaccggattatgagagaccggatcccgaatccggttgtttttgaaaatg

SEQ ID NO: 102949 - DNA, 516 bp, Heterodera glycines
  Promoter: Source sequence=SeqID_27756; Location=1175..1690; Strand=+; Gene=SeqID_58425
attgtttttaaaaaccaaaattgttttaatttaaatttaaactcccttttatcaatgaaatatgaacgagctggggaagcttttcaggaaaaaaaaaaattttggtaagaattttaagaaattggaagtccattttcccatttttgtcgatttttaactggtttttccgttttttccttcccattttattttggcacttttcgccataaaatattttagcccttttgatcaattgccaatttgttttttttaaattttctttttcttcagaatttggagttaacttttctccaaaaattccccaaaaataatttttcgtccgtcccatcgatgcgaattgggctccaaaatgtgcaaattgacgtcaaattcgtccaaattgcccaatttgcgcacattccgcgcaaaaatttcagcgcaaaacaattggaaatatttttgataaaattgggacaaatcattcacaaattggaggaaaattaccattttgacgagcgggcgcatcgatacgaaatg

SEQ ID NO: 102950 - DNA, 509 bp, Heterodera glycines
  Promoter: Source sequence=SeqID_2652; Location=1..509; Strand=+; Gene= SeqID_80894
ttatctgacaacaccggtacgaagttccttttggtcatcgatgcggaggagggcactctcaaagatcacgaaattcggctctttttcaaaaacattcacacaaaatattgcagcgccatttcaaatccgttttattcgtttggaagtactttgcaatccaggtgatcatctccttttgcaatgtcactgctattttggagggcggaaattgaattggaattgtttcgccttcccccccccccatctcctaatcgtttttcaaattagaattccctcttttagtaaaatagatgccgtggttaacgaactgcttgcatccttttgactgttcagaaaagcagtaattgatcacagaaaagagaactattgcaaataaatataaattattttcttttgagcattttacacactttcgcttgaccgtattgaggttgtaaattaccttaatattatcagaaaacaaagttttacataatttaataagactgatatttttagcctctaaaatg

SEQ ID NO: 102951 - DNA, 366 bp, Heterodera glycines
  Promoter: Source sequence=SeqID_3010; Location=2438..2803; Strand=-; Gene=SeqID_82750
gagtttagcagatgtttctgctggtccgttgtccaattgcgcgagacgcgagcaaatggtcaaatgggaaaagaagcgattaattgcgaattggtgatcagtggaacagaattgacattcaaattaatgatcaggatggaatcgaagatggatcagcgaatgctttttcaaaaatccaaaataaattgctttctgtttttaggcttctcgacgcaacttttggctaaagtgatcagcagcagaagtgattgaattgctgaaaagtgattgatttatttcaattatggaatttgaaattgacgtgatcattaaatatacttttttgttggtacgatcaatttggatttttttttgcagtaaaaaatg

SEQ ID NO: 102952 - DNA, 61 bp, Heterodera glycines
  Promoter: Source sequence=SeqID_7058; Location=4373..4433; Strand=-; Gene=SeqID_63700
attaatttaaactatttaataatattttaatgggaaggaagatcagatttttttaaaaatg

SEQ ID NO: 102953 - DNA, 472 bp, Heterodera glycines
  Promoter: Source sequence=SeqID_38491; Location=477..948; Strand=-; Gene=SeqID_67281
aatgtgttctacatcggatggcttaaagttggacaatatttgatgaatccattcggaggtccacaaaaaaatttttgaaattttttttatttcattttttcagaggacgacgacgattttggttgtttctttgacagttttaatttgattttgttgacttttgttttctcaagagctcaattatgtgcttgatcggaacacatacatcggtaggtgtgattggttttaaaacggaatgacttaatccaagtccataccaggctgttcaaaatgtcgagctttactatgtacaaatataagattaatttgacttaggaggcatagtaatttctaacctataaaaacaaccaagattttcgaagatttacgcaaatttccttgataaaaaacctctaaatttgagccttattcggtccctaataaaatctctctcctgactgttttattttaatctctctgatcagcgcatatg

SEQ ID NO: 102954 - DNA, 1003 bp, Heterodera glycines
  Promoter: Source sequence=SeqID_12500; Location=313..1315; Strand=+; Gene=SeqID_76137
tgaatccgaaattctctctttaagtgacttcaaaatgtgcaaatgtgccaataaattaactcagtgaaagaaaaagtcagatgaacgaaagagtgccggtgccaatctttcgttaattaatattaattattcattcattggcatctgatatttccttttcatttcatctgttgtccgctttaacaatttctaaacatcaatttatcactccataaaaccttttacaactaattatttatggggattaattcccattagtagataatattcccaatcaaattatcgattgattttcgatcgataatttgagtgtgtctactttttttctctgacatccccttccacaaacccaaacctattggatggtctcctcgagagagagagagagagagagagtacattctatgatttctctgactaatgaaatcgactttaatttaatttgtttttttaaatttattaatcgataattttatttgacccccccatacctattggatgatctttgatcccttcaaccgaaacctattggatggacttgtgcgcgagaatttaattaatttaaattttaattaattaatttaaacgagcgagagctgcgcgactatttccgataaattgtggaaaatcaaaaacatggtcgcggtctcgaaccgttgagagtggaagcgaggagcttaaccacttggccacaggggcagttgaaaggtacgggataattgttgactttatgatgaaaattccgttaaaatttattaatcgataattttatttgagccccccccccccaaaaaaaaaggcaaaacctattgtaaggactgtacacaaataatcaataaacccaagcctattgcctatatcatatccgaagctttaagtaaattagcaaaaaacccttttcttccggctgggctcgaacccataccaacttactgtgctaaccaattggccattttatgccactgggaaagcaaaatccaattcattaaattgtaaaaaaatg

SEQ ID NO: 102955 - DNA, 697 bp, Heterodera glycines
  Promoter: Source sequence=SeqID_42327; Location=194..890; Strand=+; Gene=SeqID_70252
atgaaagggcgagagaagggaaaattgagagaaaagggggagagaaaggaagagaaaaatacaaaaacgaaataaaagaattattgtatattttaaaaacaaatctgaaaaaaaaagaatttcttattcgaaggattattttttagaaattttattttattttttttaaatatgaaaaataataaatcattaataataaatcaattccaatgccaacactctgatgagaagcaattgctaaaacattctaagcaaattgataaccaaaatatgtatagctcaaataagaatatttattatttttatttttatgccgttcttttcttctcaatcccttttaattcattggcgctcaaaattttcgtaaaatcggcgaataaaattcgaattgactctgtccaattgctctttgtttcttcgccttcgtttttttgtattcccaaatgcaaaaagcaaattggaactgttcaaaaaattgatgctgaacagaattttgtggaaataaatttgttgggagaggaaaattggaacaaaaatggcaattttattgccaaagtttcatattcgggcccacctgttaatgagcaggtttttaaacaattaatttttacccatttttaaattttatttcccaattttgatgctcatctcaaaatttgttgacgtcgatgctcactttttacttcgtgctgaaatg

SEQ ID NO: 102956 - DNA, 85 bp, Heterodera glycines
  Promoter: Source sequence=SeqID_21766; Location=1590..1674; Strand=+; Gene=SeqID_52372
ttatattttaatttttggtatcattcaaaagcctaatattttctatttgtctacaaaattaaaaaaaattttcagaaaacttatg

SEQ ID NO: 102957 - DNA, 494 bp, Heterodera glycines
  Promoter: Source sequence=SeqID_9093; Location=1742..2235; Strand=+; Gene=SeqID_70221
tggatttcatgctaattattagtgagaaaagtatgatgtataaagccaaaaaaattgcaaatattcccaccgaaagtgcgcaatttgctggcaaacatttgtgaatttaggggcgcacaaaagcatttttttttaattatattagaaatatttcgcacaaatttatttttaattctttcaaaaatttaattttgtaaaaaaaaaatttaaattaaatcatataaaaaaattattaattaattttaataaattttacataatatatttagtataggaatttattgttatttggtattttgtagtcactgaaatcattttaataattcctttagcaaaccatttaatggcgaactaattaatcaattattgaacagcaggtgttttacgcgaaattttatctatttgttaagccaaccgacggaaggattacgtcaaaagccgaaaaaggaggtcgtcgcttttgcgtttctgcgaaaattcgcgtgccaaaaatg

SEQ ID NO: 102958 - DNA, 83 bp, Heterodera glycines
  Promoter: Source sequence=SeqID_2769; Location=1..83; Strand=+; Gene =SeqID_81495
aagtttttggacgagccgagagggcctttaggtcggcatgttcgacagtacctttccgctatgagttaatcaaacgtgaaatg

SEQ ID NO: 102959 - DNA, 382 bp, Heterodera glycines
  Promoter: Source sequence=SeqID_6452; Location=2850..3231; Strand=-; Gene=SeqID_61633
tgttatctaaattaggtacaatatattaacctgaaaaatgcagaaaggagaaaaattttctatttatttttagataattttattaatattggcaaaatgttctaatttcaaaattttttgtcatttcaaagacaacattcaaatttcttataacttttttgccttttcccccacgaaaatgccattcttaggggtgtatatttaaccccgaccccgagtcggggttaagggtcggggtcggggttcgtcggggttggaagcgtcggggtcggggtcggggttaaccccgaaaaatggcctaaaatgtcggggttcggggtcggggcggggtcggggttggcacccttaatcagattaatgaaacgagataaagccaaatatg

SEQ ID NO: 102960 - DNA, 307 bp, Heterodera glycines
  misc_feature (22)..(22): n is a, c, g, or t
  Promoter: Source sequence=SeqID_1425; Location=1..307; Strand=+; Gene= SeqID_73485
ccgtgcccgactcattacactngtgtaaatctcaacgtcaatatgacccaacccatcctgtgattatattgtctatgcggggcatgtgcttgcccgcgacgacattcccgcctttaaatctgacctcaattttaaatgtatttgtcataacaaatcttaatgtgttttgggtgaccactcacgaggcaataaccttaatttagctcttttacaaactaaatataggaaaattgaacaccccatagaaaattcgaaaactttactaaataaaaaacaaaattttttatactcaacatttatcaatatg

SEQ ID NO: 102961 - DNA, 75 bp, Heterodera glycines
  Promoter: Source sequence=SeqID_28063; Location=1253..1327; Strand=-; Gene=SeqID_58721
gtttaaaaatgaaaattgccttaggcattgaaatcggcggaagagcaatgcaaaacagtggacggggcggcaatg

SEQ ID NO: 102962 - DNA, 770 bp, Heterodera glycines
  Promoter: Source sequence=SeqID_8348; Location=1109..1878; Strand=-; Gene=SeqID_67764
acttaaaaaagaaaccaataatttagctaatattttaggtgtttatccaatcgaaattattttttggaataatttaatttattattaaaaaaaaaaaattatataaaatctgacctgcccattgagacaaattttggttcgtttatcaaaatgctgatggtaatgagcagaattatttgcaaaacactcggataattttggtggattaggcacataagtacagacaaaaaatgctgggcgtttggcgggggagggaggggggaagaagccgtgctgctaaattaaatcaacggatgaacgaagacaaattcaatgggaaaataaaattgaaaaaattaaagtttttctcaaaaaaattttctcaatattaatagacgtaaaaaaatattaataatttgaattatatttaaaaagttagaaacgattcagagaaatataatgcgaaattaaatgaaatcaaaccaaatttaaatgaaaaatatttaattttataaaaaaaagtattttattattatttatagttagtaaaaaaaaaatttctcctcgtaattacaatacaagattctcaatttaacctctaattacgtgtaatagctggactgtaaaactgaatggtaaataccagggatgggctaaattgaaaaataaaaagcgaaatgcgaaaagcgaaaagcgaatttttttttttaattttaccaatagcttttgaggttgtgatgcaaaaaaaaatctgcattttccggttcgatctttttctcagataaaaaatg

SEQ ID NO: 102963 - DNA, 1003 bp, Heterodera glycines
  Promoter: Source sequence=SeqID_11078; Location=3282..4284; Strand=-; Gene=SeqID_74413
atgtttttggtttacccccgttaaacccaagtcttaccgtgcaggattccggcacggcatatttggcacatgaaatgcatcgttagaaacaaacgttccatgattcgtggcggctgtatgaaatttcgcctactaaggcaaaatcggacgtttcgcctactaagccaaaatctgacatttcgcctactggacatctcgcctagcttatttgagacgaaattatgtggtctgcccaaccgatcattgagttggttttcctattttttgtgtctctctccgttggctgtggaagagacgtcatttacttacttccttatatcattcgatagctctaaatttttctattttattgtaaaatttcaaaaaaatttttaaagtgttccattttgagcgaagttatcaaaattttcgcaagctgccaaatggcatatgaccccggtttaaagaatctcatgagaattaattaataattcgagaaaagaaattggcacaaaaattggatgccaacttttagattaattatactgacaaaaagtgcatgggaaaattgaaagtttattggcccccgtttatattggaatgggaaaatatttgaaaataagacttttaacagtgaaaattatcgtttatttaagttttctcagcgaatacaatatttaaattttcccattaaaccaaaaaaaaaaagaaagaaacaatttccgcttctacttaaaattcacaattaatactaaagcacagaaaataataaaattgaaaatcagtacaatagaatgcctgttttggaatggtattgatgttagaagtacatcaaatatttttaaaaatttattgagacaatttaagaaatgaaagttttgaatttgatgaaaaattaattcgctcattaaacgtgggatttttaaacatttcgaatcggaaaaatgctataaaagaaatgtttaagttcagtttaaacacattgaaatttaaccaattatcacaaaatttgaccaaaaaaatg

SEQ ID NO: 102964 - DNA, 257 bp, Heterodera glycines
  misc_feature (49)..(49): n is a, c, g, or t
  misc_feature (98)..(100): n is a, c, g, or t
  misc_feature (108)..(110): n is a, c, g, or t
  misc_feature (116)..(116): n is a, c, g, or t
  misc_feature (124)..(124): n is a, c, g, or t
  misc_feature (141)..(141): n is a, c, g, or t
  misc_feature (143)..(143): n is a, c, g, or t
  Promoter: Source sequence=SeqID_18915; Location=1..257; Strand=+; Gene=SeqID_83632
tctgagccactccgtctcgccaactccgtctggcccctttagggtgagngcctaaggggccaactccggctcagatactttaaaaagagaagaaaggnnncaacgaannngaaaanacatcccnaagaaagaaaaaagagncncaaaaactcatccgttaaatctacttatttattttcatgataagaattattcattaaaatagtgtctgacctaacattttaaagtaccataaatattttagcactacgaaaatg

SEQ ID NO: 102965 - DNA, 478 bp, Heterodera glycines
  Promoter: Source sequence=SeqID_11138; Location=630..1107; Strand=-; Gene=SeqID_74485
ggaaaaaattaaaaaataaataaaaacttgctgattaaaaattcttatggctaagtttgtctcattgttttatttatggctacaatttctgcttttgcattttccgcagaaaataatgaaatgactgatcaaacactttcagttaacatttataaataaatccaaaaaatccaattttattgtttttgcattttttattattcatttatttgtttcgttatttgcagcggtataaaaacggaatgaaattaaattgttcaaatgttctcaattcattgactctttcacgggcatttaagcattttatgtcaataagtcaatgtctggtgccaaatttggtcccatttttggcattttttcatttgctttttgtgtcctttttcgtgtgccaaattgacgccgtttcaggtgaatgaatggaaatcggcatgaaaaaataccgttcatccgcttaatttgccattctttttaagacatg

SEQ ID NO: 102966 - DNA, 639 bp, Heterodera glycines
  misc_feature (62)..(63): n is a, c, g, or t
  Promoter: Source sequence=SeqID_20661; Location=687..1325; Strand=-; Gene=SeqID_51219
atatttttttataatgaaattatttcgaggtgccggcgtttttcctaaaagcgcaatttaannttaaaaataataaatgcgctagaatttatttatttatataaaaaatttttttttatataatgcaatcaattagttcgaattaagcacatttaggaaacacgcccaggacgattagtaaagtaaaatatataaataatatgtagatttatagaaattgttaattttttctcttgactgggtactgagtattgaagcgttgccgtgtgttatatttgcattatttataatatgtaggtattttttgtaataatttcattattttacatattttttacttatctatttaaattttcattctttctagcaatttttaatttttacatacttccttttattttgttctataatattttattattttctctttaattatttactgcacataaataaataatgctggcatggagcggactcgaacctgcacttactagccaattaatgtgctttttattttaattgcttttaatgaaagacttaattattaattagcctttcatttaatttttaattaataattaaaataataaataatttcaattttattaaaataataagaattttcagttacttaaaatg

SEQ ID NO: 102967 - DNA, 255 bp, Heterodera glycines
  Promoter: Source sequence=SeqID_27239; Location=107..361; Strand=+; Gene=SeqID_57930
ggttttggcaatgggaattaattagttaatttattagactaattagcaagacggttaattaattagcgatggaaagtattactaaacttatgtagaaaaaaatctttccaatcacgtaataagccctttctccgatcagtttccggcaccaccccttcggtccctatcggcgctgcgattagcggcggcaccggcgccgcagtcgcttcgtccgcctccggtgccggcggcgcccttttgtcgtcgtcaaaaatg

SEQ ID NO: 102968 - DNA, 92 bp, Heterodera glycines
  Promoter: Source sequence=SeqID_43466; Location=194..285; Strand=+; Gene=SeqID_71121
agtaaaatttattttttatttttttttggaattatttatttatttattttattgcgcaaaattaataaaattttatttctcgactttagatg

SEQ ID NO: 102969 - DNA, 833 bp, Heterodera glycines
  Promoter: Source sequence=SeqID_14498; Location=1..833; Strand=+; Gene=SeqID_78542
aataagaacgaagaagaacatttatgcatgataattacctcacttgttgtttgagcattattgaaacgagaaatgttttatgaaacacggctcaatttaaattattgtcccgataaattaaaaaaatatttaaattctatggaataaaataagaaaggatgaaaaagtttttagctgcgattcattacaaggtgaaattgcatttttttagctgaatatacataagtagagtgctcattttgcagcatatgctgttttgccactgctgcacagttcgccagcactataattttttggggtaataaaacgcaacttttaaattttaatcgcagttgaaaaatagccttttaacaggtttcttcgctcaaattcaaccaaatgcatttttaatttaacattgattgtgagtattataatattttagaagatgaatgctgaataggtcgtaataaaataatttttttttaaatctgtagttaatcaaataaatcgctgagtttttcaaaaaattttggtaacgtctggcggtgccgttaacgaaatctgttaagaaaattggtgcaaatcttcaaatacattcattccatttttggactgggcattatttttggcttttcgcaatttttttttgcttcagattttattttttggcgaaaaaatgctaaaaattccagtaaaatacacctcccccccctaattcgggatttcaaaaaatgtaaaaatacaccccctaaaaatcgagttcaaattattgaaaacgagtgattaagctttgttgacagattctatgtttccattaaaaaatttttattttttgcagtaaaatccccatg

SEQ ID NO: 102970 - DNA, 602 bp, Heterodera glycines
  Promoter: Source sequence=SeqID_3227; Location=2041..2642; Strand=-; Gene=SeqID_83780
ttcctcttcctacgcatatacaatttggccgcgtgcgcctcctcataaaatctcccataaaatttaactttattgatttttattttttaaacaaaattttccacatataagcactaaaattatacttaatcaaaatttacaagagcattttttgggattaatgaatagttcaatagcaatttctgaaatcattttgaattattaaaatttacaattttcgatagatattgctgaagaaaacattaaaaataaatttgaatttgtcatatatatttgccctggtaaagggaagaatcgttttttggccaattcatttttaccccgattcgtttttgacccaattcgtttttattaccccaattcgtttttattaccccgatcgtttttttaccccgattcgttttttgaggtagaaattcaaaaattcgaggttgaatcgatgaaattttaaatatttaagaaaaattgcagcttacgaatgtttttaagttgggttacagtttacccacccctttactgtgttttagtccattttgaaatttggaaaaatatttttctaactttaaatttttataaaattttgttttcagtaaaaacggatg

SEQ ID NO: 102971 - DNA, 151 bp, Heterodera glycines
  Promoter: Source sequence=SeqID_24209; Location=2103..2253; Strand=-; Gene=SeqID_54923
aaaatctcaaaatccaaattgtgacagtagttttcaacatgatgctgatccgttcacagttaaaggatttgatcagaacaatgctgaattgtgttcggctacaacacagtcagacgcatttaacaatgaaacatggcaatttgtgaagatg

SEQ ID NO: 102972 - DNA, 76 bp, Heterodera glycines
  Promoter: Source sequence=SeqID_5093; Location=930..1005; Strand=+; Gene=SeqID_56878
cgtaaatttttttttttgaatttattactgttaaaaaattgttccattgttaagttacatgttggccgctaacatg

SEQ ID NO: 102973 - DNA, 588 bp, Heterodera glycines
  Promoter: Source sequence=SeqID_20423; Location=406..993; Strand=+; Gene=SeqID_45578
tttttttggcaacaaattggtagcgaaaatataccctaaaattttcaaaaaaataaaattttttttttaatcattgagacttgaaaacaaaggcctacaaatttggagggagaattaagtattgaaaataaaatttttgagtgagttgccttttacgacaaatagaaaggaagaagttgattgtgggccccgaaaatgtacaacaaacaaaaacaacaacgaaaaaaacgacagaacgccaaaaaatttttttttaaattttgctgattgtgagaaaagacaacttcaatttgccgccggggctgctaaaaatgacatctgcaattttcattatgggaaatgaaagtaaattttatccaagtcgaacatttagggacaaaaaaaaagagcttttccccgttagggctttctagggtcggaaaaaccgattctcgcatccatttgtgcccattttgaatcccgaacccggattcgaacaaaagtcaaaattaatttaaaatttgaaaaaacagaccaaaaaaagtgcaaaaaactttcaaaaacccatttttttaacttgtgcgtttcttgattattattattattatg

SEQ ID NO: 102974 - DNA, 1003 bp, Heterodera glycines
  Promoter: Source sequence=SeqID_6291; Location=887..1889; Strand=+; Gene=SeqID_61039
ttataagccggctaatgaactaattaaaatcttccgaattattagacaatagattcacaattgtttcctattttttttattaaaggatttttattcaaataaaattttgtgtcggaattcttaaattaaatttccattttaataattgttttttatttcctattaattaaatgggcttcttaattaattttcaaacaaaatatcatttgcaaatttttttattaaaattttttttgaacaaaattttcaaataaaatttccatttttagtattaaatatattattttttttacaattttaatgaaattccaaaaaaaaaataattcacaatttgtttctattaaaagatttttatccgttcaaatgaaatttccattttttagcattaaacattttaattttttgtttattaaaatgggcgtttgtcagtcgcaggaggaaattaaggcacgagaaatttccaagaaaattgatcgtgatctgcaggtggaaaagcagttcagacaaaaattgctatttttgggtaattttttcaaaatttaaatttaataattaaaattaataaaaaaaattaccaaatgataaatttaggaccagctgaaagtggaaaaagcacatgtgtgaagcaaatgcagtaagaaaagttgaagataactgtgttaattgcttaagtaattttaaaaaatgaaaaattttttgactctattgcactttaggcgtacaacaagcgccttttttcgttaagtgtctcatggatttttagaaatttctcatgtccaattttagtatatgtccattaggggtgtaaaatatcaaaatttattcaaaaagtaaaaaaaaaataggccaagagttataatcaaaccgaaagaaacccattttactgaagattgccattgattgaacgcctaaggtacaacaaagcccaatatttttaggtataaaattttttaaaataattaattatttaattaattaattttcagaattttacacaataatg

SEQ ID NO: 102975 - DNA, 78 bp, Heterodera glycines
  Promoter: Source sequence=SeqID_28783; Location=1..78; Strand=+; Gene= SeqID_59361
ccttgcgcgttggttaattgagttacagaattacaatattaaaataattcatgtagcggggaagcagaaccaagaatg

SEQ ID NO: 102976 - DNA, 113 bp, Heterodera glycines
  Promoter: Source sequence=SeqID_20877; Location=1..113; Strand=+; Gene=SeqID_51460
cataaatatatttttaaaatatattttttggcacacattaaaagttatacgcttttatttgcagttttttttataacaattttcaattttttgtgacggttggatgcaaaatg

SEQ ID NO: 102977 - DNA, 79 bp, Heterodera glycines
  Promoter: Source sequence=SeqID_9370; Location=694..772; Strand=-; Gene=SeqID_71130
ggcccaaccaacggccgtctttcgactcggacgatacgacccgcagcgaacaacaccacgcccgctcaaggtggtcatg

SEQ ID NO: 102978 - DNA, 233 bp, Heterodera glycines
  Promoter: Source sequence=SeqID_1625; Location=4786..5018; Strand=-; Gene=SeqID_74920
tatatttacaacttatgaatgatgaatgggttttcttaatgtgtttttatggtaaaaacccggtttaccaaaaacccaatacgtattggccgattttactgtcccgattcgtatttttttatgtgggaggcagataacattagacagttcatatacctataataactagagttcgacctggacccaggctgggatttttcttggataaggccggcgcttatcggcatcgcatg

SEQ ID NO: 102979 - DNA, 382 bp, Heterodera glycines
  Promoter: Source sequence=SeqID_19060; Location=1..382; Strand=+; Gene=SeqID_83805
tacgtacccccgcgtacccccccccctgggaccgtccctgccccccccgcgccctctaaaatggcaactatgttttaccacagtcaatttggatgagtgttggcgtcctgtttattcgcccaaaaatgtagaggaatctgtcgaacaattgcgcttgtattgcggaaaaatttggcgaaaacgaccgacggcggaacgtacgaatcttaaaagttgagaccaaaaattaaattaaccagaaaaggaattttgttttttagaaaactttcttaatagtagggccaatcattgcccccgtgaagatttatccatttttagcgaagaacttttcttaaaaatttcaaaaatatttttttttcagttacgtcagtgtctttacatg

SEQ ID NO: 102980 - DNA, 290 bp, Heterodera glycines
  misc_feature (74)..(75): n is a, c, g, or t
  Promoter: Source sequence=SeqID_38735; Location=1262..1551; Strand=-; Gene=SeqID_67463
ttttttacaacaaaaaaatatattgggtataatatttctatattgatttgaaaattttttagtgatttcatcannaatcttttccagtgcaatttattaccagaaattttttctaagctattgcttcgctattagacaatttccaaaaaagttatacatgaaaattgtgaaaagtcgaaatttttgaagttttttgtaataaaataaaattttttccaggcttgaaaatcttttcgcttttggtaaggctaatagagcatgttaagagctttcgagtgataccaacaatg

SEQ ID NO: 102981 - DNA, 273 bp, Heterodera glycines
  Promoter: Source sequence=SeqID_40597; Location=1..273; Strand=+; Gene=SeqID_68874
tatttatttgatctatttatattttcatagggaacatatttcgcgcatttggggcatatccagaaattatcaaaaaatgatgtaccgaaatgcaaaagactgtgctttttacacctgctacaaatctcgtaatgacagggacagtaatgacaacacttaattttatgtgggcagttcatttttcaatttaattttattttgggttgctatttatagaaggggtatataaagggagtgaaaggaccatttgattgataccttgtatcaaaaatg

SEQ ID NO: 102982 - DNA, 222 bp, Heterodera glycines
  Promoter: Source sequence=SeqID_16038; Location=1..222; Strand=+; Gene=SeqID_80399
ccggggtgaaggaccaaaggggcccctggtggttgatcaggattggggggcccccagctcccaatggtccctgaaaacaggggccaaaatcgccaaaatggcgatcagcgaggctattggggagcccatgctcctccccgacgggaaccatcacgccgtgaactcacggggcgcctcagctcgtggttggagaaaaaccacgggccaaactggtacgaaatg

SEQ ID NO: 102983 - DNA, 716 bp, Heterodera glycines
  Promoter: Source sequence=SeqID_17948; Location=1291..2006; Strand=-; Gene=SeqID_82503
tttctgtgatcaatttgtgataattcgttcaccatttcaaaattttggtttaattacccaagtttgaggtcatttcccggaataaattttttattaattctgtgtctcgtccctgcctaccccgaccccagtgcccgacctttggccccgaacgcaatcgggacaaattggcgctcctgggtggatctgtgaaccacggattgactcaacgaatcccggtgacacaggggaagggaaaagcaaattagagagcctagacaaggaccctctgaggcttgtctagtgttcatagtttcgtgtagttattgtcctccgaggcataacttcacgagggacgtagcggactaagtgtttaccctctgaggaagcacttcgtccgaacagagggttggaaggtgttgtgtagtggacgaagtacttgcccttcgaggaagtacttcgtgcaaaaagggtgttttcgcgcactaggccattgacaaataaggaaaaaaggcaaactaacagtcctccgaggctttagtttagccataaggcaaaaggcaaactaacagtcctccgaggctttagtttagccataaggcaaaaggcaaacaccttgtcctccgaggcaggtgtttagtcacagaaggtccaggaccaaggccagactgatctcggaaaaagacacaaaacaacaagcacacacacacacacacgcacaatcaaacagcacaatg

SEQ ID NO: 102984 - DNA, 114 bp, Heterodera glycines
  Promoter: Source sequence=SeqID_7232; Location=3083..3196; Strand=-; Gene=SeqID_64209
tctaaaaacataacatcaattaaactggcaattaatagcgacctaaccaactaatagtcaattaaactgattactagggagtgtaattatatggatataaaatcgcgaaatatg

SEQ ID NO: 102985 - DNA, 152 bp, Heterodera glycines
  Promoter: Source sequence=SeqID_4546; Location=730..881; Strand=+; Gene=SeqID_54842
ataataaaatttagtaaaacatcaatattcataataagggatattttaatatactgaattgctgtggaaaatgttttataatgctttttaattacattttattaaaaatatgagattgcttatttacagaaatattttaaggttatcgaatg

SEQ ID NO: 102986 - DNA, 405 bp, Heterodera glycines
  Promoter: Source sequence=SeqID_16308; Location=1933..2337; Strand=-; Gene=SeqID_80699
attttccggcacaggtcgaactgggcccgaatatttgggcgcttcggtgatcaaccctgagacgggcgactggaagagccgtacgatcaaagtgaaggactttaacagtctttatccgtcgcggtaagaaatgtcggaaaaaaaatgaatagttgaaaaatctttggcactttaaggaatatgttcaccaattatccggttggccacccgaccgtggtgcagtttgacaaggacgtggaatggaggcgtccagaggacattgtcggcgacgacggcatccgccttgagggcatcatcaagtgcttcgtagtgccgccccgccactgccactacgatatcccggtccttccgtaccggatcaacaaccgcacgctgtttcccctctgccggacgtgttccgaaatg

SEQ ID NO: 102987 - DNA, 930 bp, Heterodera glycines
  Promoter: Source sequence=SeqID_4305; Location=2440..3369; Strand=+; Gene=SeqID_53974
attagatgaaatactgacaaaattttgtacaacatagcgaaaatattccaattaaccgtgaaagctaaattaaatatttagtcaaaatgtaatttaaaaatttaacattttacttaaatgcgtaagattcatcaaattctaaaataaagacggcacaagcaaaaaatatgattttagcctaagaaataaggacattttgaatttttacgatttcaaattttgaacaaaaaatggcagttttatgaaatagtagatctcgtattttgaaaaaaaaaaacttggacctgggttccattttattttttggcgtgacttttacaaaaataaaaaagtatggatgtgggaataatgggataatggctagggatgtcaaaaatatgtacaaaaagtggtcaagatatgtacataaatatgtaaaaaaaaatcccgaaatatgtaagaaaaacccaaaatatgtaccaaatatgtaaataaaaaattttggattttttttttgagaatttccaaaatttctgtaaaaaatccacaaaatatgtaaaaaatgtatgaaaaagtccgaaaaagtccaaaatatgtaccaaatatgtataaaaccccgaaatatgtaaaaatatgtaaataaaagtgcaaacttttgtttgcaaacacaaaaaagaaagtgtttttcctactatttagagcatggagaatccaggaaaaaatatgtatttacataaaattgccatccctaataatggcatagaatgggttatttcagtcccaaaaagcgatttaaataaataaaattatcattttaaaaacaaaaatatttaaaaactatctttagaatgattttataatttatgtgattttaactaacagcaaattttttactatttcaacaaacctcctttaactaaatgccgaaaactgattcggtcttaactcatg

SEQ ID NO: 102988 - DNA, 304 bp, Heterodera glycines
  Promoter: Source sequence=SeqID_13237; Location=2185..2488; Strand=-; Gene=SeqID_77068
ttagcgcccaatttaaggaatgatgagtcgggctttgaagtggccgacgcattaatttcctgcacaattcgctcaaaatcgcacgctgttgtgctccaatttgtggccaaaaatttaagcaaaaagcatttgtcaaatgcttcgtcggctcaagtgaatttgaaacaaaataccaaaaaacttaaaaattggccaggtgttttttgaaattcatcgactgtcgacgggcgataatattgccgacgaattggacggaatgacaatttgcaacggtggcattgctaacaatgcaagggccaacatg

SEQ ID NO: 102989 - DNA, 467 bp, Heterodera glycines
  Promoter: Source sequence=SeqID_22030; Location=1498..1964; Strand=-; Gene=SeqID_52665
aaaaaggccattacgcaaatcgttgtacgaagggaattttggcctttttgtccaacaccgccacagcgagcgaccagcagagagaacagccgcgagacaatcaacagaagaaatacgccggcggagaggggggacgaaaacgcaaaatgacggacaggaaaatttcgattgatattttgttttgcaaatttatttgttgctatttccccctaagtgagaagaactgaataaacgcttttttgcatttagtttcactagtatacagtttttgcttttatgaatattttgtatttgtgtttcgttcacatttccccctcaacttttttttctaagaataatgtttcacattcgccgctatgacaaattgcaatggtgtggactggcgatccatcgtcgcactttgagtgtacgtttttccctttgatcttttgatgggttacactttcttcagttgaccgtcgactatg

SEQ ID NO: 102990 - DNA, 243 bp, Heterodera glycines
  misc_feature (30)..(30): n is a, c, g, or t
  Promoter: Source sequence=SeqID_7564; Location=1..243; Strand=+; Gene= SeqID_65236
cagcagtttcccgtcgatggatcagctcgnccatgccatggtgcaagtgctgcgccatttcaaaatctctcattgttttgcaatgggcgaaggcgccggcgcggacatttgttgtcgattcgctgtaacaaagctttttagtcaaattggtggtccatcatctcgagtagtgcaaattttatgaaattgtttcgctacattcattgacttttgcatatcccgagaaaggaaattcgaacaatg

SEQ ID NO: 102991 - DNA, 1003 bp, Heterodera glycines
  Promoter: Source sequence=SeqID_15727; Location=248..1250; Strand=+; Gene=SeqID_80052
tcatttgggtcattaagtctcattaaaaaatttcaaaaaaaattactgaaagtttttactgcaattattgtaagtattacccatgctgtcataatcttcattttgctgctaaaaaaccctcatttgggtcattaagtctcattaaaaaatttcaaaaaaaattactgaaagtttttactgcaattattgtaagtattacccatgctgtcataatcttcattttgctgctaaaaaaccctcatttggggtcattaagtctcattaaaaaatttcaaaaaaaattactgaaagtttttactgcaattattgtaagtattacccatgctgtcataatcttcattttgctgctaaaaaaccctcatttgggtcattaagtctcattaaaaaatttcaaaaaaaattactgaaagtttttactgcaattattgtaagtattacccatgctgtcataatcttcattttgctgctaaaaaaccctcatttgggtcattaagtctcattaaaaaatttcaaaaaagaagcaacagtgggcatattattatgtcaaaatgataaattatgagaattttttttagacttaatttgaaatttcaagaaagcgtcacatcttttctgactatgaatgttacaatacattttattcaaaaagatgatcttgaaatttgcgagcaactttttgtgtttaatcataaaaaaaaataaaaaattaataattaattaaattccgtccattcatttttatttaaaagatatttatttactcgcaaccttttgttaattgattttcttatcatccatcattattcattcacagtgttttctcatccattctcattcctttcgcatattttgtcaaagcaaatccaaaccaaaacaaaaaattgcattccgacgaccaataaatgttgaattattattcaaataattaaaacgttttaaatattttaattatatatagaatttaaataaaacatttatatttgtatttttatttgttaaaatg

SEQ ID NO: 102992 - DNA, 395 bp, Heterodera glycines
  Promoter: Source sequence=SeqID_21062; Location=1199..1593; Strand=-; Gene=SeqID_51651
ggttcaacttttatcacactttttgtcaatgatttttttcttctttcagggacatttatgtgatcaaagaacggaagaaattttttttgttattacgcgcattttttatacaataaaagcatttgttgtattactgatgtggaattccggtttcaatatttatgtttcaaactgttccaaactccgaaccctgattcgaacccaaaatcgaaaattcaattttaaaaaagcacattttgatgaaaatcgattcaaacgcacgaaatagacaactgcttggagtcggggtcggtttaccgcggccagctcgccgcacatggttcgcagcaggttcttcgccgcggggtttgaacaaatcctttgaaaaatttttttacacttcagaataaaatatg

SEQ ID NO: 102993 - DNA, 335 bp, Heterodera glycines
  Promoter: Source sequence=SeqID_25373; Location=1..335; Strand=+; Gene=SeqID_56118
tatcaaaaattaataaaatttggaatgataataaaatttgtaaagaaaacaaacaaaacttactgtaattggattattgtacattttaaactgattcatttaccggccatacaataaaatatatttacaaccaaaaaaaggcccgaggctgatcatatcttcgatttttaaatactgatattctacatttctttacttaactatctagcgctttataaaaccgaaatcacagctccgctaatttgggaattttttccaaattaattgaatagcctttttcaaaaatttgggtttttaattttacttttgttgaaatttgcagagagctggcaatg

SEQ ID NO: 102994 - DNA, 122 bp, Heterodera glycines
  Promoter: Source sequence=SeqID_5479; Location=716..837; Strand=-; Gene=SeqID_58202
aactagcaagttcaaactaaaatgaaagaatatttaaatttgttcgaattcggttctgatccgtccctggaatttcggcataatccctaaacttcccccccccctccccttattgtaagatg

SEQ ID NO: 102995 - DNA, 103 bp, Heterodera glycines
  misc_feature (64)..(64): n is a, c, g, or t
  misc_feature (68)..(69): n is a, c, g, or t
  Promoter: Source sequence=SeqID_31104; Location=1..103; Strand=+; Gene=SeqID_61486
accagaaccgaaactatctgtatggatggatgacaaattctttacatttccattgcccgaccgnccgnngcccagcaaaattttctttaagaaccttcggatg

SEQ ID NO: 102996 - DNA, 210 bp, Heterodera glycines
  Promoter: Source sequence=SeqID_4891; Location=1..210; Strand=+; Gene= SeqID_45927
aaatttcaaacaaggaaatctggcaaaaatcgtattgctagaaaaacaatttttaccatttcaaaaattcgctagaaaaaatttcaaaatgtttttccaaagtattcgtggtgggaaacgttgtgggggaggacgagctgctccaaacagaaacggagttgcgcttcattctttttggttcatttaagcaaagcggattttgctcggatg

SEQ ID NO: 102997 - DNA, 279 bp, Heterodera glycines
  Promoter: Source sequence=SeqID_4122; Location=949..1227; Strand=+; Gene=SeqID_45723
gctgaaaaaagcaaaaatattatttaatttattagaaaaaataaatcatccaacaaaggggtgacgacttaagttagattttagtaataaacaatgtcgagtccaaagagctcttttacagactaaatttcagtgtgactcaatccatttacttttatgttttttgactaacaataagattgtaggggattcgaccagaagaaaaaagcaaaaagattgttattaatagtagcactattataaaatgatcaaaaatttccaaccattcaatgcatcatg

SEQ ID NO: 102998 - DNA, 1003 bp, Heterodera glycines
  Promoter: Source sequence=SeqID_6560; Location=1828..2830; Strand=-; Gene=SeqID_62006
aatttcgacactgaactatttcaaaaactttcactgttttccagcattttcgacactggaccatttcgacagtgagtaaattcgacactattgagaattttttaaaattaataagaaattttggtgttagtattaggtatgataaattttcctatttcattttctaattcgtactttttaaaaggttaggttggtataactgagtaaaacgtcaaacccagtgtcagtgttagacaatgactcataatgccaaatagcgatattttggggcgataattcaaaaaaacctgatcagtcagtgatcactgatcattgcaattttttgcattggttgtcaaagcgctttgtagggcttctagggcccgaaaaccgaaaatcaccctaaaacatgttttcatgacttttgaagacggaactgccagacggaactgacccgcttcgacccattccacggtcggggtcgttttcgcgtgagggccattttcgcaaaattttttaattaatttataaaaatccagaattttgggactcagaaaatccaagattccccccccccccccgaaatgaaaatttttaaaaattttcttcgaattcgtcccccaaaacgaaactacaatatttatgggaacatttttgaatattggcaattttcgtaacaaagtgcactcaaattttcaaaatttttcaaaaaaaattttctcttgaaaaaattcccggttggtcccggcttttctcgcggtcccgatcccggtcccggtcaaaaaagttggtcccggtcccgacttttctggtcccggtaagtcccggtcccggtttttgtcaaatttcccggtcccgaccaactctagttataccaacctaaccttttaaaaagtacgaattagaaaatgaaataggaaaatttatcatacctaatactaacaccaaaatttcttattaatttttaaaaattctcaatagtgtcgaatttactcactgtcgaaatggtccagtgtcgaaaatg

SEQ ID NO: 102999 - DNA, 1003 bp, Heterodera glycines
  Promoter: Source sequence=SeqID_21289; Location=222..1224; Strand=-; Gene=SeqID_51882
tccccacgatttgattgccttgttgtcatgcacttgaaaacacgaaaatgggcatatgggaggctttctgtttgttccagccaaaacgccggcggagtgcaagtgccgaaatgttttggggatatgacaatcgatcagttgtgcccaccaagaaatgtgattggcttcaaatatatttacatcaggtagaggagcaccagcagaagcagaagttctggaaaataatcaattttctaagcagtaaggcccaaatccaaggtcattgaatacaaacttaagtgatgcttgagaccaaaattttcccgagactcgagaccaagacttgactctgagaccgaaactcgaaccgagaccgaaaaacccgagactcgagacttttttcaaaaaaatttttattggcttaaaaatcgtttattaagtttttgaaaaatactcgagtttcgacccgagaattcttgaatctttcatcgagaaaaagtctcgagtctccaatccctacggaatcttattagatgacttttttaaaccccttcaactaggcacctctttaaggcccgtaaccagggggggcagactcattggagagctcggtgagatcgatttttccaaattttaaactttcaaaaagtttctaaattttgacggtgaggtctagcaaacggatttcgacattttgaattttgtgattttttaacgatttttcctgagacaacggagagcaattccaaaatataggtgtcccaccgctatcgactggaaccgataaataaacaatatcatatattctcccagagagattacctactcactcactgattcagggattttaaagttgtgaatatatctcatttagagggtcgaaccaataaattatgagacaaaaatacacgaaaaattttggttttatggcatattaacgtaacactcactgaatgtgagatgacagttgtggtcgagttgcaaatcatagtattctccatgtccctcttcttcaggaaggatg

SEQ ID NO: 103000 - DNA, 284 bp, Heterodera glycines
  Promoter: Source sequence=SeqID_38187; Location=398..681; Strand=+; Gene=SeqID_67081
atcagtttataaaaaaaaagttaagcctaaaatttttcgcaaatttaaaaagcaattaaaaatttttagattttttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatg

SEQ ID NO: 103001 - DNA, 129 bp, Heterodera glycines
  Promoter: Source sequence=SeqID_20197; Location=1..129; Strand=+; Gene=SeqID_84993
tgcgaaggtcgtcatttctcaagatgggagaaagctcgtggcattctacacagcagcatatccattttccaatcacttctcctgccgattgtcattgatggactcgaattttcgtccagtgagcaaatg

SEQ ID NO: 103002 - DNA, 81 bp, Heterodera glycines
  misc_feature (38)..(38): n is a, c, g, or t
  Promoter: Source sequence=SeqID_11475; Location=1..81; Strand=+; Gene= SeqID_74876
aaaaataactcacataattatgtattgtcaagtgcttntagccatacaatcggcacaatccgttcaaagcatacgcaaatg

SEQ ID NO: 103003 - DNA, 79 bp, Heterodera glycines; identical to SEQ ID NO: 102977
  Promoter: Source sequence=SeqID_9370; Location=694..772; Strand=-; Gene=SeqID_71131

SEQ ID NO: 103004 - DNA, 674 bp, Heterodera glycines
  Promoter: Source sequence=SeqID_6755; Location=519..1192; Strand=+; Gene=SeqID_62751
ttgcggcagtggtccgttcagtgtccttaaataacaaaaattttagtcagaatttcgatttccgaaaaatttttgggcctcggaatgccaatccaggagaaaaattaacggattggtcgtttgggctacaattccggtttactaacctaaagttgaaaaaataagttgaaaaaaatcataaaacggaagcaaaggtcatcacagttaacagaatgattttgtacaaaaaaaaaaaactgcaaaactctctaaatttacgattttttatacacattttagaaacaaatgaatgaaacaagtttgaccacactacatattattattttcacacaagcattggtcagagaaacttcaagaaataacgatggagggggggggatgagatgaatatgagaaatagtatgggggacatacacatttcaaagaaaaagagttgtcgtcaaacacaaacattatttatttttctctgatgatgaaactgatgtgactgatggcaatgtcaaaacaataattccatgaaaattcctcaaatccggtccgggtgtggttttcgggatcttttgcattttaagcgtccaattgacttttgcaaatcaccgaattgctccccctctttgtttttaccattttttgcacatttttttaatgtacaacaaatcttgttttctacaatg

SEQ ID NO: 103005 - DNA, 446 bp, Heterodera glycines
  misc_feature (129)..(129): n is a, c, g, or t
  misc_feature (212)..(212): n is a, c, g, or t
  Promoter: Source sequence=SeqID_22379; Location=1724..2169; Strand=-; Gene=SeqID_53049
ttttcgttttggggcaaagctgattattttttttaaatcaacagcaagctaatagaatgcagatccattcgaagagatataactcaaattatggcatttatgcctcagaaataatttggtgagtagctntagcaattctccgcgccctctgtgattaaaaaaataaataaataaataaaataattttggccccaaaaacgggaaaagtaacnttaaaatgaatattaacattaaatatattcatttgaaggaataaattcataaatttttttatatatatattaataaatatcctaagattatgtggcatttaatgatattttttacaattttctttgattttggaattgaatccggcaaaatccgaacaaattttaatgaaatattcggcgaagaatgggacaaaaatgaatgtgaagaaattttgataaaaactgaacgaaatg

SEQ ID NO: 103006 - DNA, 143 bp, Heterodera glycines
  Promoter: Source sequence=SeqID_17903; Location=2825..2967; Strand=-; Gene=SeqID_82455
cgccagtaccaccggtcccactgcctccactttcccccgaagtgcctccacttcggccgagtccgtctcccgaagtgcctccacttcggccgagtccgtctcccgaagtgcctccacttcggaggagtccgtccccaaaaatg

SEQ ID NO: 103007 - DNA, 355 bp, Heterodera glycines
  Promoter: Source sequence=SeqID_17714; Location=234..588; Strand=+; Gene=SeqID_82246
tttcgttttgttccatatgctaacacatatttccttgctttaaaaaaatatttagcaatctgttttaaatatgaaatattccagaaataattctgtaactattattaattattatttaaacgaattcgaactccatctttactcaccggctcatcactcaagttagtgttcgataaagtgcttgaatgaaattataattaaaattagcacaaattaattgtttattgaatcaaaaaacaaacatttaatttctgagccaaagctcgtttattccctaagaactacaaacaaattttataaaacaaaatgttgaaagtaattaatttaaattttttcagaattctctgttgaaatg

SEQ ID NO: 103008 - DNA, 637 bp, Heterodera glycines
  Promoter: Source sequence=SeqID_7804; Location=1257..1893; Strand=-; Gene=SeqID_66019
tttcggccaattctgaaccccggacgcgaattcgaacaaaaaagttgcaagtctaaattttcgaattaagcattttttgttcaaaaacggcataaatgatctcctattgcaggattgatgtatttcagtttgtttctgtgtatttaaaccgatttgaagaaaaacactaatttcgaaaattttgactttcgattttttgttcgagtttgggtccggggttcgcaattgagaatgattttcttatagaagtttacttctatattacaatactaatgccatagaattttattttaaaaatttgcatcactgacgcattttctactgacgcattttccactgacgcattttccactgaccgattttccggtcacggtcaaaaatcatccattttcgggtgactttgggaataatctcgatggatcattccgtaaaaattagctcagtatataacaaacatttttataaaatttaattttccaaataaacaattgcactttttttggctctcctccggcacagctgtgcatgatgtccacgtgcacattctcgaatttgtatctaaatagtaaaaacaatatattattttaaaatgtatttaacttcatttaaaaatatatttaattggcagaaatcaatg

SEQ ID NO: 103009 - DNA, 191 bp, Heterodera glycines
  Promoter: Source sequence=SeqID_25694; Location=1022..1212; Strand=-; Gene=SeqID_56435
ttattgtcgaagaaatctcgaaaataggacgtaatttgggactgattttgccactcgttatggcacataaaaagcaaatatttggatggccacaaagtgaaagtatttaaagggctccaaaacgttttcgcacattcataaaatattcattctgcaaaaagtcaatcattcgctgcttatcattggaaatg

SEQ ID NO: 103010 - DNA, 125 bp, Heterodera glycines
  Promoter: Source sequence=SeqID_44852; Location=764..888; Strand=-; Gene=SeqID_72266
gatcggactttgtatccgatcatcgaccggcgcatgaaagtgtttgaaggatgggacgacacagaggacaacgagcagcaaaatgtggacgcagacgcagagacggaccgggatgattagagatg

SEQ ID NO: 103011 - DNA, 766 bp, Heterodera glycines
  Promoter: Source sequence=SeqID_8157; Location=3189..3954; Strand=+; Gene=SeqID_67161
tgatctgaataggctagtaaatttaatcaatgcttttgtggttttgaaaccgttttgactttttaaaaagcatacaatttaaataacgaggcttaaaaaattaataaaaaattttggcgtaatgttttcttactttgctaaaaagatcgaaatctaattctatggtaacatgtgatttcgtcagaactaatgggatggacgaactggccgctttgataaatatatttgttgagtgattctacgtgtgtggttttttatgaatttaacctcactcatttgcttctttgactttttgccctgaaaaaatgagtcaaatttaaaagttgttttcggtcaatcatgatgagatacctatatatgaaattatgctcaaaagcaacattctttgtgttgaagtttttaaagttaaattttgttgccgaatggacattggcaactgttgcatttgcctgggtgggttcggcgttgcacagatgggcgtgctgccgtgcctgcacactttccaccactcatgcattcagcgcgcactgggccaaaatgcgcagtgtccgctttgccgtcggcacgccaccgacacgcaaattgtgagaccgaaatacgaaggaagctgccgcgaggcgggcgatttgccaagaaaggttgtcgtgtttaatgggcgggcgccaatgaatttgaatttctgttcgctttatggattttagtcactattcgtttattcagactagatggaatttaaattagcaaaatttcctttcctcaggccatg

SEQ ID NO: 103012 - DNA, 1003 bp, Heterodera glycines
  Promoter: Source sequence=SeqID_1783; Location=39..1041; Strand=+; Gene=SeqID_75932
ttataaactattaattcatttttactttaataatgctaaaaaatgattttataaaataataaataaaaacaattaaaaaatacagcaaaaaatatttaattatggcaattaagaaaaaaaataaatttaaattttattaatttatttattaagaaaattaaaaaagaatatatggggggagcaacataaagtttttacgtattacaattgaaaccgggtaatgtgaataatgtaattaaaaaattgtttttaagtaaatataaatttggcgactactgagagagtcttggcgccttgagtctcgacatgagaaaattcacaaaatttttgggcggatggtgggatatcgatttcgttgagtcccaatcgttctcactagagtgccacgggaccgggacctggtagcggacaactgagtacaactgagtaccaaggtcccggttttgaccgggaccgggactagtcccggttttttcccggtattcccagccaaaaattcccggtttttcaacccgaaaaggtcccggtcccgggtttgcccaaaattcccggtcccgtggcactctagttctcactactccaaagtgtcagtctcgtgtctcgtaaattttcagtcttgaatatcaccaattcttttttaaaggaaggcttccggaaattaaggaaaatttgactcaactacagtgtctaattagggtaattagtccaaaccaataaaacaaagcaaatttgatgcaattgaaaattaaaaaaaaaataaacattcgtacaaataatacagaaattatatttgcacaaaatgtgccatcagcagaatcaacacaaaaagctgacgacgacgacgacaaatatttgccgcgccgccactaaaataataggggggatttggggattttctgggggggggcggtaaaaattggggggatttgcaattttcgaattttcttttcgcgcgcggtttattaccaccataccaccatctgttctgacagtcagaagaatg

SEQ ID NO: 103013 - DNA, 90 bp, Heterodera glycines
  Promoter: Source sequence=SeqID_15393; Location=1958..2047; Strand=-; Gene=SeqID_79654
tagagagatagatataagaaggacacatttatgcaaaaaagtaggcattaatgccaaattgaactgtttttcgttgttacagaaagtatg

SEQ ID NO: 103014 - DNA, 1003 bp, Heterodera glycines
  Promoter: Source sequence=SeqID_13553; Location=1981..2983; Strand=+; Gene=SeqID_77457
tgctggactcggtttttgcccaactacatgggcccctccccttcaaccctagatgaaaccaagatgaaaaattttcgctattagttttatttattggtcgatttatgaaatcattggcttcataatataaataaattaaataattaattgctataaaagtataaattccacttattggagaatgttatttagtttttgaattttactcaatttcaattaaatttcactttctgtccgaaaacccctggtgatcaaagggaggggtgatcaccgggttctatgccctcgttctcggcttggtcgacccctttcgaattgaggcccaaggggggccgagaaaggagaagagggagggcgggacaaagagggaaggaaagaaacggcaccaccactcaaaggaggagtgagtggactccaaactgcgaccgtcgggattgacccgactcgttcaccggtgggaagggaagaagtgaacctcggatcatccgatcccgttcgacagttgcagttttcgagaacggaccacggggcagaggaaggccccaattgtacgatttgctgttggcaattccgaagggagggaagggaatttgccgcgaccaaaggagcggtcaacaaacacaatttatttgccgtaggataaacaacaatcggagagagcaaagtggggagcgaaaaagataaggaaaaaggggagcgaaaaaaatggatcagtcaagaaaaacagaagcaaggaaaagaaaaaaggagccggggggttaaataggccccgggcagggagacaaaaaatgcaaaacatgtgaatgggtcggcacctgcgataggcgatgagaaggcgaagggaaagcacaaatttgaaaagattggtgatggcgaagaaatacgatgaataggacaaagagggggcaaaaaatgggaatctgagaaaagagccccaatcgggtggacaaagaacatttgaattttagtgaaatagcgataaacaaatgcaaattaagcgatg

SEQ ID NO: 103015 - DNA, 600 bp, Heterodera glycines
  Promoter: Source sequence=SeqID_3696; Location=2378..2977; Strand=-; Gene=SeqID_51495
ttttcttcactgatcaatttttgattaagtcagccggacagttttctgtccaagcatttgcattaaattgtaattgtgaatatttgaataaagattaagaaagagtcttagtcttttctctatctgtaaaagggacgctcaggagccctttcatacagatcactaagccattgacccacgttgggtcaaagaaaaggctttcaaaaggaaaggagaagcattttcctcctttcaaattgtcccttcagtaaaggagaggaatttcctcctttaatttgtccctttggactctgtgagtttctgtcttttggacagaaattcgctttgcttaaaaaactccgcccttctgccgggagagtctgcttccccttctgccgggaagtgcaaatttttgtggctttttgcccacaaattggagccccgtaggggtcggcttccagtcgtaagcctaccctccaaccaaaccaatccaaagcgcggcctgagcgcttggatcaaacacacaacccaaaggggtttattgtgttttcatcaagcgtaagagcaatgagtgagctcttgcgcatctccattgcaccaatggtggtgcgtctcaagatg

SEQ ID NO: 103016 - DNA, 89 bp, Heterodera glycines
  Promoter: Source sequence=SeqID_16573; Location=1160..1248; Strand=+; Gene=SeqID_47380
ggtaggggaaccaagcatttgttagttttcacatttgaatctttcatttacaaaaaaatgattggcattaggtgggctccgaggccatg

SEQ ID NO: 103017 - DNA, 239 bp, Heterodera glycines
  Promoter: Source sequence=SeqID_16373; Location=1..239; Strand=+; Gene=SeqID_80762
cccccccccccccaaacggggcgggtgcccattttgcccagcgcccagttcataatatgaaaggagagttggtcaaccaaaattttgtgaacgggggggggatcagcggcccaaaacaatttttggaaaattttaggtataattttgggcgccggcccgagaaattgtttggaaaaattttatgaacttttgttaagaaatatattcaaaatttcaatataacgaaacatttttgtatg

SEQ ID NO: 103018 - DNA, 157 bp, Heterodera glycines
  Promoter: Source sequence=SeqID_4435; Location=622..778; Strand=+; Gene=SeqID_54437
tatttgtcaaagctgatctcaacgctcaacgaatttcgtgagcaaaaaacaattaattatttatatataattaatcactataattagtgggtcattaattaatattagccttcaaaatgtaatttacaattatttattttttaagaatttctctatg

SEQ ID NO: 103019 - DNA, 184 bp, Heterodera glycines
  Promoter: Source sequence=SeqID_34254; Location=674..857; Strand=+; Gene=SeqID_64089
tctgaaaagggcatggggaagaactaattgacgataattaatgctaatgaagccacaattgacagtgcgaatggtaatgacatgaattaactgtacaaaatgctaaaccgacaaaatgccatgatttaatcctcgctaattaattaatcatattaatttttccaaatccagtctgtgaccaatg

SEQ ID NO: 103020 - DNA, 70 bp, Heterodera glycines
  Promoter: Source sequence=SeqID_26686; Location=417..486; Strand=-; Gene=SeqID_57444
atattggaataaaaataatatgttaattaattaaacaattcgtgaatccgtcgctcatcagactggaatg

SEQ ID NO: 103021 - DNA, 139 bp, Heterodera glycines
  Promoter: Source sequence=SeqID_7487; Location=765..903; Strand=+; Gene=SeqID_64977
agagacaagggatgggaaggggacgaaggggagatggctggtgtggttgagacatcgctgcgcatttcatttgtctttgttgtgctctcggttacccccaaaattatttaattaaatttaaggaaaattatttcaaatg

SEQ ID NO: 103022 - DNA, 173 bp, Heterodera glycines
  Promoter: Source sequence=SeqID_21577; Location=1137..1309; Strand=-; Gene=SeqID_52185
ggtaagtgaaaagcatggccaaccccattttgctttggcattgctcacatcctcccaacttttaagcgcggctattggtttggccaccaaacaaatgccattggacgaatgggtgggacaatgccggggcacttactcctattcatcacacggcattttgtacgggcacaatg

SEQ ID NO: 103023 - DNA, 231 bp, Heterodera glycines
  Promoter: Source sequence=SeqID_2480; Location=2053..2283; Strand=+; Gene=SeqID_79934
aattttcaagtaagcgaaaaggaccgtaaatttaataatttaaatataaaatggccccctactctatccaaaaggacaggttcggcaggcccgtatttgtgatccaaaagttttatgcgactgggacgggacaaaatctcgccgaaatttgaaaaaaaaattcgacggcgagattttgtcacgtcgtaggtattttgaatttattttcttggtttacatgctttaattatg

SEQ ID NO: 103024 - DNA, 409 bp, Heterodera glycines
  Promoter: Source sequence=SeqID_9876; Location=182..590; Strand=+; Gene=SeqID_72902
ttgaggagagtgttgccgaggttcaatttttattccaaaatttttccccaaattttattttattttttaaggctttgaagacatgttatgcctccgcaacgctcagttactcgcaaaaccaacaggcattctttacaatttgttttttgtatttattttattatggcacccccatatctccccctgaaaattttcctaaaaaattattagaaaaaattttcagaaaaaaatattagaaactttttataagaaatttcttgaaaattttttcgaataattcattctttttttaattttgaaaaacttaaaaaggcacacgctgtttggaagtgaaattcgccatttccccccgtttcagtacactttggtgccccgtgccagccaaagtgtcaaagtactggccgaaatg

SEQ ID NO: 103025 - DNA, 1003 bp, Heterodera glycines
  Promoter: Source sequence=SeqID_22416; Location=192..1194; Strand=+; Gene=SeqID_53081
ttgttgaaaaaacacaaaatggtaaaaattgggacaataaaaaaaaaattttaacaaaatttggagtgatagatgcaaaataattcttaataaatggacaaataataaataaattttggcgaaattattatcagactggtgtcaaattacataaatgaatggcacagcggtgtggcgcaagacaaattccagacaatctttttaatttttaacgaaaagataaaagaaacggtgtcaaattacacaaatgagcaggtgtgagggggggcaaagtaaagatgtgaaattaaaaattattggtcaaataaacaaacgcccaacacctgaaagggtgctgtaattatttttaaggagataaaaaattaacagacaaatcaataattaaacttaaatgtatttgttaattcactgaaaaatatttatattattttagaagtaataaaaaatttattttaggaaaataattaattaattaaccttttaattattttaatttctaaattatattttattatacggtcccccatttctttttgcttttaaaagagaaaattgtgaattcaataattgatttttttacttgacccctcccgccttctcgccgcccgctctcgccccccccctgcccccgctgatgacgtcaaattttccctttatgagagcaaattaatgtttattatccattgccaatgtggccgagtggttagtgcgtcagtctggccgcccccctggggttcggatccgcttggtgcggggaatttttggagaattttaaatgaatttaaattcaacgtctttgacctttaagacatttaaaataatttaaaattaaataaatttaattaaaataatttgcataaagtcgcgcagtcaaaaaagtcgcgcaccccccctgcaataggtttgggtttgcaagaaaaaagtcgcgcaataggtttgggtttcaagaaaaagtcgcgcaataggttttggcttcagtactgaaaagtctggcgctcagatg

SEQ ID NO: 103026 - DNA, 516 bp, Heterodera glycines
  Promoter: Source sequence=SeqID_3490; Location=651..1166; Strand=-; Gene=SeqID_84883
attgtttttaaaaaccaaaattgttttaatttaaatttaaactcccttttatcaatgaaatatgaacgagctggggaagcttttcaggaaaaaaaatattttggtaagaattttaagaaattggaagtccattttcccatttttgtcgatttttaactggtttttccgttttttccttcccattttattttggcactttttcgccataaaatattttatcccttttgatcaattgccaatttgtttttttaaattttcttttttcttcagaatttggagttaacttttctccaaaaattccccaaaaataatttttcgtccgtcccatcgatgcgaattgggctccaaaatgtgcaaattgacgtcaaattcgtccaaattgcccaatttgcgcacattccgcgcaaaaatttcagcgcaaaacaattggaaatatttttgataaaattgggacaaatcattcacaaattggaggaaaattaccattttgacgagcgggcgcatcgatacgaaatg

SEQ ID NO: 103027 - DNA, 353 bp, Heterodera glycines
  Promoter: Source sequence=SeqID_15180; Location=1..353; Strand=+; Gene=SeqID_79379
ggactaacaaccatcatggttttttgtcaaaatccgatgtgccgacaaccatcaatctaacgtgataggaaattggcaaaaaattagctgatcattatttatcaacaatttctgcatttaattgcatttccaccaaagcattgcccgataaatgcccaaaatagcaactgcccttttttaaatgcaaggacattatgccaaacaatttcagaatatacaattttgtttgctttctctccatgttttcaactttttcatttttgttcctgtcgttaacctttttactttaattcgttcttttagttttatttttttgtgcaaattttgaaagcaattttattaaatacgtcatg

SEQ ID NO: 103028 - DNA, 70 bp, Heterodera glycines
  Promoter: Source sequence=SeqID_4278; Location=1794..1863; Strand=-; Gene=SeqID_53860
gacataaatctacgagtcgtcgaatttctgacccaataaaaatccgatttcaggtcatcattacataatg

SEQ ID NO: 103029 - DNA, 457 bp, Heterodera glycines
  Promoter: Source sequence=SeqID_900; Location=419..875; Strand=-; Gene=SeqID_63492
tgttgaattatataccgtagattggtttattattctataatatctatgatttattttttttaaatgtgagcgttgaattttgagcatcgatttttatgtgtgtgagtaatggacggttttcttttctgatcatttttcaagctccatccgaagctctcttctttctatccactcgttcgtttttaaattttatttttatttgttgtgtcattcgttacttttcatcgtctactctgattgaaactatgtaaagtggggcaagagagagttgagagcggtcgcgacaagtgggagaaggggggggggggggggtgttggtctggacttgaaaggaaagttataaactcacgatcacatacattgtgggtggggtatgatttgcatattttctccattcgagttcaatatattgtgaggagaaacgcggacttatactacgttagctcatgcgaaaatg

SEQ ID NO: 103030 - DNA, 146 bp, Heterodera glycines
  Promoter: Source sequence=SeqID_27655; Location=1..146; Strand=+; Gene=SeqID_58334
aagcgctcatgaatatgacatccatttcgaccagtttataaactcggaccagaattcgaacaaatatatcggaacttcgcatttcaacgaatttcgaatttttcgtctaaaaaaggcttatatgatcttttattacaggaaagatg

SEQ ID NO: 103031 - DNA, 362 bp, Heterodera glycines
  Promoter: Source sequence=SeqID_1168; Location=1..362; Strand=+; Gene= SeqID_69229
cccaagttcagatccagacttttttaaaatgtcgaactctattaaaatattcccagcggaatctaaacacacaaggcaattaaaacagaaaccaaaagtgcatttatttagcgttcataagaaagattcggaggtggacagaattttaaaattcctcgtaattttttacaagtaatgtgcaaagaacagaagcgttgttgatatgccgattaaagcatacctaattctttcattttttatttatattatcaatatgaaaaaacctttatcgatatgtatatgtcattcccttgttcattttagcattgaatttctggtaattattgtagttgaaacacagcgccagtgacgcattgaccatg

SEQ ID NO: 103032 - DNA, 245 bp, Heterodera glycines
  misc_feature (39)..(39): n is a, c, g, or t
  misc_feature (49)..(49): n is a, c, g, or t
  Promoter: Source sequence=SeqID_5756; Location=1..245; Strand=+; Gene= SeqID_46111
gaaaatgtttgtagaatttttgtgtccatttgatacaantttggattantataaatttgggcataatgttttttatttatttaaaactttttaaaaagctttaccaaagctaaagcttaagcttcattaaaagcaattaactccacattttttccctttaaaagctctgttttaacattcaaaattttttacccattttagcccagtatttcaacaatttattcatttcactttcaatgacaatg

SEQ ID NO: 103033 - DNA, 319 bp, Heterodera glycines
  Promoter: Source sequence=SeqID_16600; Location=625..943; Strand=-; Gene=SeqID_81010
tttgtgacataaacatttatttgatttattttaccatattcacaatttgatcaaaatataggtggtcaaaagtgttgtcccatttcattttttggcacaattttgcagtccaaaaattctgaaaaaattcctgctaaggtaactttgagtgctgatcaaaaaagtcttttacagcaacttggtccgatcactccttcctggtgatctgaacaccccaatatacagtgaaaaacggaaaatttttcgaaaaaaattcctagggggttgggaaaatttttctggaaattttaagtgggcccattagaaagagtacaaaatg

SEQ ID NO: 103034 - DNA, 114 bp, Heterodera glycines
  Promoter: Source sequence=SeqID_10321; Location=107..220; Strand=+; Gene=SeqID_73501
ggtgggtgaaacgggcaagaattaaacaaaatgctaaatttttaatcattaaatacccccaataattcattaaagacgcttgcgttgaacgcgtttgcttccgctttgaaaatg

SEQ ID NO: 103035 - DNA, 204 bp, Heterodera glycines
  Promoter: Source sequence=SeqID_13805; Location=1481..1684; Strand=-; Gene=SeqID_77735
tttacaccccttcgcccctcaacagatccacgtgtaccgtcaccatttgcgggagccgcgtctgtacgagtgccccgtctgcgacttctctcactacgcctgctcttccgacgtgcgtaatcacatcctccgagcccacaaaagccaaccgacgctgttgccgcgggcgaatttgctgcgtttctcccgcgaaatcgcggaatg

SEQ ID NO: 103036 - DNA, 88 bp, Heterodera glycines
  Promoter: Source sequence=SeqID_24637; Location=131..218; Strand=+; Gene=SeqID_55375
ttttcttttttattgcgagtcaaaattatggggtttattttaaaacagaatcgtaattaaacgtggtgacgccattgcccgtgagatg

SEQ ID NO: 103037 - DNA, 162 bp, Heterodera glycines
  Promoter: Source sequence=SeqID_17157; Location=1..162; Strand=+; Gene=SeqID_81595
atcatttttttattattatttatttattcattcatccccccttttagtcactcctcctttttggtataaaaaatttttctaaaatttcaaagttctaaattttacaaaggtcacccattcgagtttggcaatttggttttgtctttgccattctgttaaatg

SEQ ID NO: 103038 - DNA, 414 bp, Heterodera glycines
  Promoter: Source sequence=SeqID_5693; Location=4566..4979; Strand=+; Gene=SeqID_58927
aattataaataaataaaaatattattatgtaatgttaaaatgaataacaccaacacaacaaaacacgacatacaaattttgaattccccagaagagcctaatgaaactcttttgcatgtactgcttttttctcattatcttcttgcatttcctgtgtttttgcttttttggttcgttttaattcggtggcttaaaagtcacggtcacctctcgcccagcgaggccgagacagtaatggaagagatgaaaaatatcccccgacacccaccaatattttttgcagcaaaatgatgcaagattagagaaaactgacactgaactctctcttcagtatgacaaaatcgataatgactcatgctgatggagcattctcaaagctactcattctttttcatcattcattttacaaaaatg

SEQ ID NO: 103039 - DNA, 179 bp, Heterodera glycines
  Promoter: Source sequence=SeqID_21620; Location=937..1115; Strand=+; Gene=SeqID_52217
attttctcgaaagtaatcaaaaaatcactatatttttctattaacctaataaatttatgaaaataaattattttttattaaaattattttaatttgcttaaatttttaattttactttttactttattaatgaattaattaattaaattacaaattttatatagtgtgaacaaatcatg

SEQ ID NO: 103040 - DNA, 433 bp, Heterodera glycines
  misc_feature (30)..(30): n is a, c, g, or t
  Promoter: Source sequence=SeqID_327; Location=1..433; Strand=+; Gene =SeqID_82460
ttaattcgcgcataagccatacgtcatgcnaattcattcaaattacatacatacattcggacatatatgggttgtattcagtatacatttatcatgcggtttcattgattagctcaaatatgctccgcttatccatgccatttatcttacatgattctattatatatggctcctttatgtgcattagtcctgcatgcattcattcaattacgcactcattcattcaattattcactcattcattcattcatttattcattctttcattcattcacgcataacataggcattcatagagctatcaggcattcatagagccatccattcatacattttaattatcataaaatgtcagaaataagcttatctcattcagatgagatccaaaaatataccttctaagctttccaatcccgaagttcctgaccaaatg

SEQ ID NO: 103041 - DNA, 626 bp, Heterodera glycines
  Promoter: Source sequence=SeqID_8221; Location=1136..1761; Strand=+; Gene=SeqID_67347
ttttgtcgtcaaactaattaaaattcttttttttctagttacgggcctgcccctaaattatcctgcatttttttaattaactcctagaaattggaaatttttgctgcccaattttcgtgcttttttgtcgtttttgtaattttttatgtcttttttcatatttttcgtgcctattttaggtgcttatttgaaacattttcgtgcctaaaagttcgggccctagttcatacttaacaaatctaaagagtgtttgctaggtaaattattcgttttcgcgtccgccaattcaagtccaaattttccgatttgactaataaacgactgattccaaagatcactcaatattacaaaatccctgaattttcgaaaaatatcacttcggcttcctcaaaacacataattatgccaaatgatagcgaacatttaaaatcgaaaaacaaagcaaaaaataaataaaagtcttgtgaaatgttaacgatttctttctcgtccctctaaatcttcacaataacttcttgaatgatttgtgttgcgtcattttgttgaccatcttttgcacatcgtcactttcaaaattgtatctcatgtaattggagtcgttcgttgccgcaacaattttgaaaatg

SEQ ID NO: 103042 - DNA, 549 bp, Heterodera glycines
  Promoter: Source sequence=SeqID_5487; Location=1329..1877; Strand=+; Gene=SeqID_58229
attggcatcgaaatttcgttgataccattcaaaaatttgtggcaaaatgggaaaagtttgctgctcgagtcaaacgaatatttgaggttttgttttgccgtggttttttttatctcttccgaaaattttgacatattatcaaaagattaactcacaagcaaaaaaaaagggggaaagaatcatcggaatttaataaaatttaacatcaagaattatgaaaaatgcattttctttttttgttactttttgtttttttttattaagagaaaaaaaatgggaaaaagaggtggactaagattttatccgaaaaaaaatttgaaaccaaataattaaggaaacggagggccagaggtagaaaattattcccaattttcaaactcccttccctactagccctcccctcttttacagccccccctcttcctttcctcgctacgaaaggtccttccttaatttgaggtgcattgacgttcctttttcatttataagccaaatttacgcgaaaaacttccgaaaaatgaaaaacttagtcagaaattgagagaaatg

SEQ ID NO: 103043 - DNA, 674 bp, Heterodera glycines
  Promoter: Source sequence=SeqID_20591; Location=1712..2385; Strand=+; Gene=SeqID_51144
attatgcaaaaaaacaagtaaaaagggtaaaaatcggattaaaaaaatattataatattgaaattataaacattaaaacaaactaaactcatagtatacataaaaaaaacatcaaacacgccacaaaaacaacaattatattacaaatatacatgtatatataaaatccaaaaattgctatatatatacataatcttatacatataaaatggaaaaatattatattatttaattaattaaagaatatgtttgttttttatattttttcctatataaaattgcttgaaaaaattgcaaaaattcaatggttttatgcacccaccgtttgtcatcaagctagccttttgtaaattttcgcgcatcttcatatggtcatggttgagctcgttgaactagaaaaataaaaaaataaaatttgattatcgaaatatatattctttaatattaattaaattaaaaaagaatgagataaaaaaaattgataatcctctcattcctttaaacattaattagaaaacaaacctgaccatgaaatggttatgctccaaatcctgggagagtttgacctgaaaatgaagttgaattatatatatatatattattattattaagtgaatttaaaagcattttactttttgcttaatttagcaaaaccctttccttgtacaggtatg

SEQ ID NO: 103044 - DNA, 357 bp, Heterodera glycines
  misc_feature (37)..(37): n is a, c, g, or t
  misc_feature (73)..(73): n is a, c, g, or t
  misc_feature (82)..(82): n is a, c, g, or t
  Promoter: Source sequence=SeqID_5571; Location=1..357; Strand=+; Gene= SeqID_58516
taatttcacatctttacgttgccctcccctcacactngctcatttgtgtatttgacaccgtttcttttatctnttcgttaanaattaaaaagattgtctggaatttgtcttgcgccaaaccgctgtgccattcatttatgtaatttgacaccagtctgataataatttcgccaaaatttatttattatttgtccatttattacgaattattttgcatctatcactccaaattttgttaaaaaaaaaaatttttttattgtcccaattttgaccattttgtgttttttcaacaaaataaatatttgttcaaatttaaagaattaatttttaaaattttagacacaaaaacaaatcatg

SEQ ID NO: 103045 - DNA, 931 bp, Heterodera glycines
  Promoter: Source sequence=SeqID_10534; Location=2309..3239; Strand=-; Gene=SeqID_73768
gcttattgcgctaaaaaccagcacacactcgaaccacggcggccagtaggtggggcaagactccgggctacggaatgcaaatttttgcaaaaaaaaaagttccacaaaggagagtaatccactttcactgtggacatgtcatagattaagtcgtcctcgggtaatatggattaaacaaaaataagaaatcacaacaaattaaatataagaatcaggtcattcgatcaataaaaccaaatttttaaatgctaaaaaccaaacatttacatagcttttacaaagatttattctattctctgagattattaaagaactaaattggtgccattctttttaggtcaacattttgctcgataatttttatagaaattactaatgcagaaatgcaaaaattaatggataaatgagtcatgtaaatgtgaacataagcaacagcagagtcagcagatgttcatttattacttcttcaatttatttaaaatatcatattttttattattttttatatataaattcactttatttgtttcaaaaatggctctattgcactttatgagtccaaaggtttttatgaatccaatcaattaacaatacctggtttttatgtatacaataattttgttcatgcgtgtacaaaccctaaatttttgatatcattcgaaagcacaaaagcgtttaggccattgtcaaaaaagttttgattaattaaatattgtgattattttcgtttgtaactttctttagctgttcgaattctctttttttctcgtattattaccttattcagactttgtgctttcgaatgataccaaaaagataggagttgttcgaacatgaacaaagctattctaaaaaacaggtattgttaattgatttccagttttaaaagctgattccaaaatgtcaatttcagccgattcaacaaataatg

SEQ ID NO: 103046 - DNA, 847 bp, Heterodera glycines
  Promoter: Source sequence=SeqID_13978; Location=1..847; Strand=+; Gene=SeqID_77938
ccgaaataaagaacgcatacgtaaatatgattctttattatttgtgcgacatgattggaaaattgcaatttattatcaatatttatgcctaaatccctaattgtatccacaacatttattatatttccatcaattttatatatttctttggggtttttattccccaagtaaagtacaaaagtttttttaattgagattctgatttgccatttatttgcccattctgataaattatgcaatgctttatgcataatttctgtgtcaactctcgctttataacaaatatacaatttaacatcatcagcatataatttaattcttactcctgatggcaaagcatcaggaagatcgttaatataaatcaaaaataataaaggtccaaggacagatccctgggggactccagaggtaacttttttactggaggataaatcatccccaattttaacacaaagtcctattactcaaaaagtcctttatccacatcaaaagtttgccccttatacctattttttccaatttgtataaaagtaattcatggggcactgagtcaaatgctttttgaaaatcaatataaatacaatcaacattttttccatttattattgcctcgtaccaatcttccacaactgttattaattgactcgttgtagacctatttctaacaaaaccaaattgaaattccgaaatttttttgttttttaatagaaaattgtaaatatctttgcttaaaattctttccattaccctgcagagtgagcaggttaatgaaattggcctatagttttcgggattatttttgtcacccttcttaaaaagcggaaaaacaattgattctttccagatg

SEQ ID NO: 103047 - DNA, 238 bp, Heterodera glycines
  Promoter: Source sequence=SeqID_2227; Location=1955..2192; Strand=-; Gene=SeqID_78609
aagcttaaaaattcaaaggcaacgcctcagcttgatgtgaggcttaatgaagtcgcgggtaaataaataataaataaccactcactttattttaacaaatttatttatttttcttttttaaatatttcaaactttattaggcaaatgcataaaatttttgcgtgcatttaacgttgagataagcacagaaaacgaatttttagcttgatttgaagcttcttggatcaattatacaatg

SEQ ID NO: 103048 - DNA, 599 bp, Heterodera glycines
  Promoter: Source sequence=SeqID_15674; Location=489..1087; Strand=+; Gene=SeqID_79981
gacgaagaaaacgacgccaggtgtcttcccatttacaaattaaaagggcatttttggaaaaaatatttattttttggcagaaaaaattgcaataaaatattaagtttagtttttttttctttttgaaaaatttttttaattttttctcttttgtgtcgaagcatttctccttcaaaatattgttaaatttgaatatatttttccattttgttttgtaaagcttgctgcccaaacgaattacaagtcgagcgactcgccatgtcctcaaaatgactggaaggaactcatggaacaagtgattaatttctttttaattcttgagttaatcaaaatgaataatgcaaaaggcatagaaattttcctttccttgcatttttcaattttcgagaaattcgtaccaaggcccaataatctgtgggcatgttttgcctccatgtttttaagccatgcaaaattttccgcagagcatctcatcagaggactcggtccgctcggtaaaagccatccaaaacgggctgttcagacggtactccgggcgcaagttcctggtgacctgcgcaaccgcggcaaacgaagactctgccgccggtgccgaaatg

SEQ ID NO: 103049 - DNA, 181 bp, Heterodera glycines
  Promoter: Source sequence=SeqID_23898; Location=1589..1769; Strand=-; Gene=SeqID_54590
aagttcaaatttggagacaccacgaaaaaacagaccattttatgtgtcaaaaagtggatcatgaatttattggggattgaaatgatggatgctttcggacttttggacgacattcgacaaaaagtcaattcttcattgaatttgaatgcaatcaaaaagaaaatggtgatctcaaaagatg
